United States Patent 11,078,247 (RNA ENCODING A THERAPEUTIC PROTEIN) - sequence listing, part 7

SEQ ID NO: 14688 - RNA, 2721 nt, Artificial Sequence
  CBL__Homo_sapiens__NP_005179
auggccggcaacgugaagaagagcagcggcgccggcggcggcagcggcagcggcggcagcggcagcggcggccugaucggccugaugaaggacgccuuccagccccaccaccaccaccaccaccaccugagcccccacccccccggcaccguggacaagaagaugguggagaagugcuggaagcugauggacaagguggugagacugugccagaaccccaagcuggcccugaagaacagcccccccuacauccuggaccugcugcccgacaccuaccagcaccugagaaccauccugagcagauacgagggcaagauggagacccugggcgagaacgaguacuucagaguguucauggagaaccugaugaagaagaccaagcagaccaucagccuguucaaggagggcaaggagagaauguacgaggagaacagccagcccagaagaaaccugaccaagcugagccugaucuucagccacaugcuggccgagcugaagggcaucuuccccagcggccuguuccagggcgacaccuucagaaucaccaaggccgacgccgccgaguucuggagaaaggccuucggcgagaagaccaucgugcccuggaagagcuucagacaggcccugcacgaggugcaccccaucagcagcggccuggaggccauggcccugaagagcaccaucgaccugaccugcaacgacuacaucagcguguucgaguucgacaucuucaccagacuguuccagcccuggagcagccugcugagaaacuggaacagccuggccgugacccaccccggcuacauggccuuccugaccuacgacgaggugaaggccagacugcagaaguucauccacaagcccggcagcuacaucuucagacugagcugcaccagacugggccagugggccaucggcuacgugaccgccgacggcaacauccugcagaccaucccccacaacaagccccuguuccaggcccugaucgacggcuucagagagggcuucuaccuguuccccgacggcagaaaccagaaccccgaccugaccggccugugcgagcccaccccccaggaccacaucaaggugacccaggagcaguacgagcuguacugcgagaugggcagcaccuuccagcugugcaagaucugcgccgagaacgacaaggacgugaagaucgagcccugcggccaccugaugugcaccagcugccugaccagcuggcaggagagcgagggccagggcugccccuucugcagaugcgagaucaagggcaccgagcccaucgugguggaccccuucgaccccagaggcagcggcagccugcugagacagggcgccgagggcgcccccagccccaacuacgacgacgacgacgacgagagagccgacgacacccuguucaugaugaaggagcuggccggcgccaagguggagagaccccccagccccuucagcauggccccccaggccagccugccccccgugccccccagacuggaccugcugccccagagagugugcgugcccagcagcgccagcgcccugggcaccgccagcaaggccgccagcggcagccugcacaaggacaagccccugcccgugccccccacccugagagaccugccccccccccccccccccgacagacccuacagcgugggcgccgagagcagaccccagagaagaccccugcccugcacccccggcgacugccccagcagagacaagcugccccccgugcccagcagcagacugggcgacagcuggcugcccagacccauccccaaggugcccgugagcgcccccagcagcagcgaccccuggaccggcagagagcugaccaacagacacagccugcccuucagccugcccagccagauggagcccagacccgacgugcccagacugggcagcaccuucagccuggacaccagcaugagcaugaacagcagcccccuggugggccccgagugcgaccaccccaagaucaagcccagcagcagcgccaacgccaucuacagccuggccgccagaccccugcccgugcccaagcugccccccggcgagcagugcgagggcgaggaggacaccgaguacaugacccccagcagcagaccccugagaccccuggacaccagccagagcagcagagccugcgacugcgaccagcagaucgacagcugcaccuacgaggccauguacaacauccagagccaggcccccagcaucaccgagagcagcaccuucggcgagggcaaccuggccgccgcccacgccaacaccggccccgaggagagcgagaacgaggacgacggcuacgacgugcccaagccccccgugcccgccgugcuggccagaagaacccugagcgacaucagcaacgccagcagcagcuucggcuggcugagccuggacggcgaccccaccaccaacgugaccgagggcagccaggugcccgagagaccccccaagcccuuccccagaagaaucaacagcgagagaaaggccggcagcugccagcagggcagcggccccgccgccagcgccgccaccgccagcccccagcugagcagcgagaucgagaaccugaugagccagggcuacagcuaccaggacauccagaaggcccuggugaucgcccagaacaacaucgagauggccaagaacauccugagagaguucgugagcaucagcagccccgcccacguggccaccuaa

SEQ ID NO: 14689 - RNA, 1473 nt, Artificial Sequence
  CBLL1__Homo_sapiens__NP_001271220
auggaccacaccgacaacgagcugcagggcaccaacagcagcggcagccugggcggccuggacgugagaagaagaauccccaucaagcugaucagcaagcaggccaacaaggccaagcccgcccccagaacccagagaaccaucaacagaaugcccgccaaggccccccccggcgacgagggcuucgacuacaacgaggaggagagauacgacugcaagggcggcgagcuguucgccaaccagagaagauuccccggccaccuguucugggacuuccagaucaacauccugggcgagaaggacgacacccccgugcacuucugcgacaagugcggccugcccaucaagaucuacggcagaaugauccccugcaagcacguguucugcuacgacugcgccauccugcacgagaagaagggcgacaagaugugccccggcugcagcgaccccgugcagagaaucgagcagugcaccagaggcagccuguucaugugcagcaucgugcagggcugcaagagaaccuaccugagccagagagaccugcaggcccacaucaaccacagacacaugagagccggcaagcccgugaccagagccagccuggagaacgugcacccccccaucgcccccccccccaccgagauccccgagagauucaucaugccccccgacaagcaccacaugagccacaucccccccaagcagcacaucaugaugcccccccccccccugcagcacgugccccacgagcacuacaaccagccccacgaggacaucagagccccccccgccgagcugagcauggccccccccccccccagaagcgugagccaggagaccuucagaaucagcaccagaaagcacagcaaccugaucaccgugcccauccaggacgacagcaacagcggcgccagagagccccccccccccgcccccgcccccgcccaccaccaccccgaguaccagggccagcccguggugagccacccccaccacaucaugcccccccagcagcacuacgccccccccccccccccccccccccccaucagccaccccaugccccaccccccccaggccgccggcaccccccaccugguguacagccaggccccccccccccccaugaccagcgcccccccccccaucacccccccccccggccacaucaucgcccagaugccccccuacaugaaccaccccccccccggccccccccccccccagcacggcggcccccccgugaccgccccccccccccaccacuacaaccccaacagccugccccaguucaccgaggaccagggcacccugagcccccccuucacccagcccggcggcaugagccccggcaucuggcccgcccccagaggccccccccccccccccagacugcagggcccccccagccagaccccccugcccggcccccaccaccccgaccagaccagauacagacccuacuaccaguaa

SEQ ID NO: 14690 - RNA, 582 nt, Artificial Sequence
  CBLN1__Homo_sapiens__NP_004343
augcugggcgugcuggagcugcugcugcugggcgccgccuggcuggccggccccgccagaggccagaacgagaccgagcccaucgugcuggagggcaagugccugguggugugcgacagcaaccccaccagcgaccccaccggcaccgcccugggcaucagcgugagaagcggcagcgccaagguggccuucagcgccaucagaagcaccaaccacgagcccagcgagaugagcaacagaaccaugaucaucuacuucgaccaggugcuggugaacaucggcaacaacuucgacagcgagagaagcaccuucaucgcccccagaaagggcaucuacagcuucaacuuccacguggugaagguguacaacagacagaccauccaggugagccugaugcugaacggcuggcccgugaucagcgccuucgccggcgaccaggacgugaccagagaggccgccagcaacggcgugcugauccagauggagaagggcgacagagccuaccugaagcuggagagaggcaaccugaugggcggcuggaaguacagcaccuucagcggcuuccugguguucccccuguaa

SEQ ID NO: 14691 - RNA, 675 nt, Artificial Sequence
  CBLN2__Homo_sapiens__XP_011524128
augcaggcccccggcagaggcccccugggccugagacugaugaugcccggcagaagaggcgcccugagagagcccggcggcugcggcagcugccugggcguggcccuggcccugcugcugcugcugcugcccgccugcugccccgugagagcccagaacgacaccgagcccaucgugcuggagggcaagugccugguggugugcgacagcagccccagcgccgacggcgccgugaccagcagccugggcaucagcgugagaagcggcagcgccaagguggccuucagcgccaccagaagcaccaaccacgagcccagcgagaugagcaacagaaccaugaccaucuacuucgaccaggugcuggugaacaucggcaaccacuucgaccuggccagcagcaucuucguggcccccagaaagggcaucuacagcuucagcuuccacguggugaagguguacaacagacagaccauccaggugagccugaugcagaacggcuaccccgugaucagcgccuucgccggcgaccaggacgugaccagagaggccgccagcaacggcgugcugcugcugauggagagagaggacaaggugcaccugaagcuggagagaggcaaccugaugggcggcuggaaguacagcaccuucagcggcuuccugguguucccccuguaa

SEQ ID NO: 14692 - RNA, 606 nt, Artificial Sequence
  CBLN4__Homo_sapiens__NP_542184
augggcagcggcagaagagcccugagcgccgugcccgccgugcugcuggugcugacccugcccggccugcccgugugggcccagaacgacaccgagcccaucgugcuggagggcaagugccugguggugugcgacagcaaccccgccaccgacagcaagggcagcagcagcagcccccugggcaucagcgugagagccgccaacagcaagguggccuucagcgccgugagaagcaccaaccacgagcccagcgagaugagcaacaagaccagaaucaucuacuucgaccagauccuggugaacgugggcaacuucuucacccuggagagcguguucguggcccccagaaagggcaucuacagcuucagcuuccacgugaucaagguguaccagagccagaccauccaggugaaccugaugcugaacggcaagcccgugaucagcgccuucgccggcgacaaggacgugaccagagaggccgccaccaacggcgugcugcuguaccuggacaaggaggacaagguguaccugaagcuggagaagggcaaccuggugggcggcuggcaguacagcaccuucagcggcuuccugguguucccccuguaa

SEQ ID NO: 14693 - RNA, 834 nt, Artificial Sequence
  CBR1__Homo_sapiens__NP_001748
augagcagcggcauccacguggcccuggugaccggcggcaacaagggcaucggccuggccaucgugagagaccugugcagacuguucagcggcgacguggugcugaccgccagagacgugaccagaggccaggccgccgugcagcagcugcaggccgagggccugagccccagauuccaccagcuggacaucgacgaccugcagagcaucagagcccugagagacuuccugagaaaggaguacggcggccuggacgugcuggugaacaacgccggcaucgccuucaagguggccgaccccacccccuuccacauccaggccgaggugaccaugaagaccaacuucuucggcaccagagacgugugcaccgagcugcugccccugaucaagccccagggcagaguggugaacgugagcagcaucaugagcgugagagcccugaagagcugcagccccgagcugcagcagaaguucagaagcgagaccaucaccgaggaggagcuggugggccugaugaacaaguucguggaggacaccaagaagggcgugcaccagaaggagggcuggcccagcagcgccuacggcgugaccaagaucggcgugaccgugcugagcagaauccacgccagaaagcugagcgagcagagaaagggcgacaagauccugcugaacgccugcugccccggcugggugagaaccgacauggccggccccaaggccaccaagagccccgaggagggcgccgagacccccguguaccuggcccugcugccccccgacgccgagggcccccacggccaguucgugagcgagaagagaguggagcagugguaa

SEQ ID NO: 14694 - RNA, 834 nt, Artificial Sequence
  CBR3__Homo_sapiens__NP_001227
augagcagcugcagcagaguggcccuggugaccggcgccaacagaggcaucggccuggccaucgccagagagcugugcagacaguucagcggcgacguggugcugaccgccagagacguggccagaggccaggccgccgugcagcagcugcaggccgagggccugagccccagauuccaccagcuggacaucgacgaccugcagagcaucagagcccugagagacuuccugagaaaggaguacggcggccugaacgugcuggugaacaacgccgccguggccuucaagagcgacgaccccaugcccuucgacaucaaggccgagaugacccugaagaccaacuucuucgccaccagaaacaugugcaacgagcugcugcccaucaugaagccccacggcagaguggugaacaucagcagccugcagugccugagagccuucgagaacugcagcgaggaccugcaggagagauuccacagcgagacccugaccgagggcgaccugguggaccugaugaagaaguucguggaggacaccaagaacgaggugcacgagagagagggcuggcccaacagccccuacggcgugagcaagcugggcgugaccgugcugagcagaauccuggccagaagacuggacgagaagagaaaggccgacagaauccuggugaacgccugcugccccggccccgugaagaccgacauggacggcaaggacagcaucagaaccguggaggagggcgccgagacccccguguaccuggcccugcugccccccgacgccaccgagccccagggccagcuggugcacgacaagguggugcagaacugguaa

SEQ ID NO: 14695 - RNA, 714 nt, Artificial Sequence
  CBR4__Homo_sapiens__NP_116172
auggacaaggugugcgccguguucggcggcagcagaggcaucggcagagccguggcccagcugauggccagaaagggcuacagacuggccgugaucgccagaaaccuggagggcgccaaggccgccgccggcgaccugggcggcgaccaccuggccuucagcugcgacguggccaaggagcacgacgugcagaacaccuucgaggagcuggagaagcaccugggcagagugaacuuccuggugaacgccgccggcaucaacagagacggccugcuggugagaaccaagaccgaggacauggugagccagcugcacaccaaccugcugggcagcaugcugaccugcaaggccgccaugagaaccaugauccagcagcagggcggcagcaucgugaacgugggcagcaucgugggccugaagggcaacagcggccagagcguguacagcgccagcaagggcggccuggugggcuucagcagagcccuggccaaggagguggccagaaagaagaucagagugaacgugguggcccccggcuucgugcacaccgacaugaccaaggaccugaaggaggagcaccugaagaagaacaucccccugggcagauucggcgagaccaucgagguggcccacgccgugguguuccugcuggagagccccuacaucaccggccacgugcuggugguggacggcggccugcagcugauccuguaa

SEQ ID NO: 14696 - RNA, 1698 nt, Artificial Sequence
  CBS__Homo_sapiens__XP_011528084
augcccagcgagaccccccaggccgaggugggccccaccggcugcccccacagaagcggcccccacagcgccaagggcagccuggagaagggcagccccgaggacaaggaggccaaggagccccuguggaucagacccgacgcccccagcagaugcaccuggcagcugggcagacccgccagcgagagcccccaccaccacaccgcccccgccaagagccccaagauccugcccgacauccugaagaagaucggcgacacccccauggugagaaucaacaagaucggcaagaaguucggccugaagugcgagcugcuggccaagugcgaguucuucaacgccggcggcagcgugaaggacagaaucagccugagaaugaucgaggacgccgagagagacggcacccugaagcccggcgacaccaucaucgagcccaccagcggcaacaccggcaucggccuggcccuggccgccgccgugagaggcuacagaugcaucaucgugaugcccgagaagaugagcagcgagaagguggacgugcugagagcccugggcgccgagaucgugagaacccccaccaacgccagauucgacagccccgagagccacgugggcguggccuggagacugaagaacgagauccccaacagccacauccuggaccaguacagaaacgccagcaacccccuggcccacuacgacaccaccgccgacgagauccugcagcagugcgacggcaagcuggacaugcugguggccagcgugggcaccggcggcaccaucaccggcaucgccagaaagcugaaggagaagugccccggcugcagaaucaucggcguggaccccgagggcagcauccuggccgagcccgaggagcugaaccagaccgagcagaccaccuacgagguggagggcaucggcuacgacuucauccccaccgugcuggacagaaccgugguggacaagugguucaagagcaacgacgaggaggccuucaccuucgccagaaugcugaucgcccaggagggccugcugugcggcggcagcgccggcagcaccguggccguggccgugaaggccgcccaggagcugcaggagggccagagaugcguggugauccugcccgacagcgugagaaacuacaugaccaaguuccugagcgacagauggaugcugcagaagggcuuccugaaggaggaggaccugaccgagaagaagcccuggugguggcaccugagagugcaggagcugggccugagcgccccccugaccgugcugcccaccaucaccugcggccacaccaucgagauccugagagagaagggcuucgaccaggcccccgugguggacgaggccggcgugauccugggcauggugacccugggcaacaugcugagcagccugcuggccggcaaggugcagcccagcgaccaggugggcaaggugaucuacaagcaguucaagcagaucagacugaccgacacccugggcagacugagccacauccuggagauggaccacuucgcccugguggugcacgagcagauccagagccaggaccaggccugggccggcguggugggcggccccgccgaccacagcaccggcaagagcagccagagacagaugguguucggcguggugaccgccaucgaccugcugaacuucguggccgcccaggagagagaccagaaguaa

SEQ ID NO: 14697 - RNA, 558 nt, Artificial Sequence
  CBX1__Homo_sapiens__NP_006798
augggcaagaagcagaacaagaagaagguggaggaggugcuggaggaggaggaggaggaguacgugguggagaaggugcuggacagaagaguggugaagggcaagguggaguaccugcugaaguggaagggcuucagcgacgaggacaacaccugggagcccgaggagaaccuggacugccccgaccugaucgccgaguuccugcagagccagaagaccgcccacgagaccgacaagagcgagggcggcaagagaaaggccgacagcgacagcgaggacaagggcgaggagagcaagcccaagaagaagaaggaggagagcgagaagcccagaggcuucgccagaggccuggagcccgagagaaucaucggcgccaccgacagcagcggcgagcugauguuccugaugaaguggaagaacagcgacgaggccgaccuggugcccgccaaggaggccaacgugaagugcccccagguggugaucagcuucuacgaggagagacugaccuggcacagcuaccccagcgaggacgacgacaagaaggacgacaagaacuaa

SEQ ID NO: 14698 - RNA, 1599 nt, Artificial Sequence
  CBX2__Homo_sapiens__NP_005180
auggaggagcugagcagcgugggcgagcagguguucgccgccgagugcauccugagcaagagacugagaaagggcaagcuggaguaccuggugaaguggagaggcuggagcagcaagcacaacagcugggagcccgaggagaacauccuggaccccagacugcugcuggccuuccagaagaaggagcacgagaaggaggugcagaacagaaagagaggcaagagacccagaggcagacccagaaagcugaccgccaugagcagcugcagcagaagaagcaagcugaaggagcccgacgcccccagcaagagcaagagcagcagcagcagcagcagcagcaccagcagcagcagcagcagcgacgaggaggacgacagcgaccuggacgccaagagaggccccagaggcagagagacccaccccgugccccagaagaaggcccagauccugguggccaagcccgagcugaaggaccccaucagaaagaagagaggcagaaagccccugccccccgagcagaaggccaccagaagacccgugagccuggccaaggugcugaagaccgccagaaaggaccugggcgcccccgccagcaagcugccccccccccugagcgcccccguggccggccuggccgcccugaaggcccacgccaaggaggccugcggcggccccagcgccauggccacccccgagaaccuggccagccugaugaagggcauggccagcagccccggcagaggcggcaucagcuggcagagcagcaucgugcacuacaugaacagaaugacccagagccaggcccaggccgccagcagacuggcccugaaggcccaggccaccaacaagugcggccugggccuggaccugaaggugagaacccagaagggcgagcugggcaugagcccccccggcagcaagauccccaaggcccccagcggcggcgccguggagcagaaggugggcaacaccggcggccccccccacacccacggcgccagcagagugcccgccggcugccccggcccccagcccgcccccacccaggagcugagccugcaggugcuggaccugcagagcgugaagaacggcaugcccggcgugggccugcuggccagacacgccaccgccaccaagggcgugcccgccaccaaccccgcccccggcaagggcaccggcagcggccugaucggcgccagcggcgccaccaugcccaccgacaccagcaagagcgagaagcuggccagcagagccguggccccccccacccccgccagcaagagagacugcgugaagggcagcgccacccccagcggccaggagagcagaaccgcccccggcgaggccagaaaggccgccacccugcccgagaugagcgccggcgaggagagcagcagcagcgacagcgaccccgacagcgccagcccccccagcaccggccagaaccccagcgugagcgugcagaccagccaggacuggaagcccaccagaagccugaucgagcacguguucgugaccgacgugaccgccaaccugaucaccgugaccgugaaggagagccccaccagcgugggcuucuucaaccugagacacuacuaa

SEQ ID NO: 14699 - RNA, 552 nt, Artificial Sequence
  CBX3__Homo_sapiens__NP_009207
auggccagcaacaagaccacccugcagaagaugggcaagaagcagaacggcaagagcaagaagguggaggaggccgagcccgaggaguucgugguggagaaggugcuggacagaagaguggugaacggcaagguggaguacuuccugaaguggaagggcuucaccgacgccgacaacaccugggagcccgaggagaaccuggacugccccgagcugaucgaggccuuccugaacagccagaaggccggcaaggagaaggacggcaccaagagaaagagccugagcgacagcgagagcgacgacagcaagagcaagaagaagagagacgccgccgacaagcccagaggcuucgccagaggccuggaccccgagagaaucaucggcgccaccgacagcagcggcgagcugauguuccugaugaaguggaaggacagcgacgaggccgaccuggugcuggccaaggaggccaacaugaagugcccccagaucgugaucgccuucuacgaggagagacugaccuggcacagcugccccgaggacgaggcccaguaa

SEQ ID NO: 14700 - RNA, 1683 nt, Artificial Sequence
  CBX4__Homo_sapiens__NP_003646
auggagcugcccgccgugggcgagcacguguucgccguggagagcaucgagaagaagagaaucagaaagggcagaguggaguaccuggugaaguggagaggcuggagccccaaguacaacaccugggagcccgaggagaacauccuggaccccagacugcugaucgccuuccagaacagagagagacaggagcagcugaugggcuacagaaagagaggccccaagcccaagccccugguggugcaggugcccaccuucgccagaagaagcaacgugcugaccggccugcaggacagcagcaccgacaacagagccaagcuggaccugggcgcccagggcaagggccagggccaccaguacgagcugaacagcaagaagcaccaccaguaccagccccacagcaaggagagagccggcaagccccccccccccggcaagagcggcaaguacuacuaccagcugaacagcaagaagcaccaccccuaccagcccgaccccaagauguacgaccugcaguaccagggcggccacaaggaggcccccagccccaccugccccgaccugggcgccaagagccacccccccgacaagugggcccagggcgccggcgccaagggcuaccugggcgccgugaagccccuggccggcgccgccggcgcccccggcaagggcagcgagaagggcccccccaacggcaugaugcccgcccccaaggaggccgugaccggcaacggcaucggcggcaagaugaagaucgugaagaacaagaacaagaacggcagaaucgugaucgugaugagcaaguacauggagaacggcaugcaggccgugaagaucaagagcggcgagguggccgagggcgaggccagaagccccagccacaagaagagagccgccgacgagagacacccccccgccgacagaaccuucaagaaggccgccggcgccgaggagaagaagguggaggccccccccaagagaagagaggaggaggugagcggcgugagcgacccccagccccaggacgccggcagcagaaagcugagccccaccaaggaggccuucggcgagcagccccugcagcugaccaccaagcccgaccugcuggccugggaccccgccagaaacacccacccccccagccaccacccccacccccacccccaccaccaccaccaccaccaccaccaccaccaccacgccgugggccugaaccugagccacgugagaaagagaugccugagcgagacccacggcgagagagagcccugcaagaagagacugaccgccagaagcaucagcacccccaccugccugggcggcagccccgccgccgagagacccgccgaccugccccccgccgccgcccugccccagcccgaggugauccugcuggacagcgaccuggacgagcccaucgaccugagaugcgugaagaccagaagcgaggccggcgagccccccagcagccugcaggugaagcccgagacccccgccagcgccgccguggccguggccgccgccgccgcccccaccaccaccgccgagaagccccccgccgaggcccaggacgagcccgccgagagccugagcgaguucaagcccuucuucggcaacaucaucaucaccgacgugaccgccaacugccugaccgugaccuucaaggaguacgugaccguguaa

SEQ ID NO: 14701 - RNA, 576 nt, Artificial Sequence
  CBX5__Homo_sapiens__NP_001120793
augggcaagaagaccaagagaaccgccgacagcagcagcagcgaggacgaggaggaguacgugguggagaaggugcuggacagaagaguggugaagggccagguggaguaccugcugaaguggaagggcuucagcgaggagcacaacaccugggagcccgagaagaaccuggacugccccgagcugaucagcgaguucaugaagaaguacaagaagaugaaggagggcgagaacaacaagcccagagagaagagcgagagcaacaagagaaagagcaacuucagcaacagcgccgacgacaucaagagcaagaagaagagagagcagagcaacgacaucgccagaggcuucgagagaggccuggagcccgagaagaucaucggcgccaccgacagcugcggcgaccugauguuccugaugaaguggaaggacaccgacgaggccgaccuggugcuggccaaggaggccaacgugaagugcccccagaucgugaucgccuucuacgaggagagacugaccuggcacgccuaccccgaggacgccgagaacaaggagaaggagaccgccaagagcuaa

SEQ ID NO: 14702 - RNA, 1185 nt, Artificial Sequence
  CBX6__Homo_sapiens__NP_001290423
auggagcugagcgccgugggcgagagaguguucgccgccgagagcaucaucaagagaagaaucagaaagggcagaaucgaguaccuggugaaguggaagggcugggccaucaaguacagcaccugggagcccgaggagaacauccuggacagcagacugaucgccgccuucgagcagaaggagagagagagagagcuguacggccccaagaagagaggccccaagcccaagaccuuccugcugaagcccagcgccagcgccagcagccccaagcugcacagcagcgccgccgugcacagacugaagaaggacaucagaagaugccacagaaugagcagaagaccccugcccagacccgacccccagggcggcagccccggccugagaccccccaucagccccuucagcgagaccgugagaaucaucaacagaaaggugaagcccagagagcccaagagaaacagaaucauccugaaccugaaggugaucgacaagggcgccggcggcggcggcgccggccagggcgccggcgcccuggccagacccaaggugcccagcagaaacagagugaucggcaagagcaagaaguucagcgagagcgugcugagaacccagaucagacacaugaaguucggcgccuucgcccuguacaagcccccccccgccccccugguggcccccagccccggcaaggccgaggccagcgcccccggccccggccugcugcuggccgcccccgccgcccccuacgacgccagaagcagcggcagcagcggcugccccagccccaccccccagagcagcgaccccgacgacaccccccccaagcugcugcccgagaccgugagccccagcgcccccagcuggagagagcccgaggugcuggaccugagccugccccccgagagcgccgccaccagcaagagagccccccccgaggugaccgccgccgccggccccgccccccccaccgcccccgagcccgccggcgccagcagcgagcccgaggccggcgacuggagacccgagaugagccccugcagcaacgugguggugaccgacgugaccagcaaccugcugaccgugaccaucaaggaguucugcaaccccgaggacuucgagaagguggccgccggcguggccggcgccgccggcggcggcggcagcaucggcgccagcaaguaa

SEQ ID NO: 14703 - RNA, 756 nt, Artificial Sequence
  CBX7__Homo_sapiens__NP_783640
auggagcugagcgccaucggcgagcagguguucgccguggagagcaucagaaagaagagagugagaaagggcaagguggaguaccuggugaaguggaagggcuggccccccaaguacagcaccugggagcccgaggagcacauccuggaccccagacuggugauggccuacgaggagaaggaggagagagacagagccagcggcuacagaaagagaggccccaagcccaagagacugcugcugcagagacuguacagcauggaccugagaagcagccacaaggccaagggcaaggagaagcugugcuucagccugaccugcccccugggcagcggcagccccgagggcguggugaaggccggcgcccccgagcugguggacaagggcccccuggugcccacccugcccuucccccugagaaagcccagaaaggcccacaaguaccugagacugagcagaaagaaguucccccccagaggccccaaccuggagagccacagccacagaagagagcuguuccugcaggagccccccgcccccgacgugcugcaggccgccggcgagugggagcccgccgcccagccccccgaggaggaggccgacgccgaccuggccgagggccccccccccuggacccccgcccugcccagcagcgaggugaccgugaccgacaucaccgccaacagcaucaccgugaccuucagagaggcccaggccgccgagggcuucuucagagacagaagcggcaaguucuaa

SEQ ID NO: 14704 - RNA, 1170 nt, Artificial Sequence
  CBX8__Homo_sapiens__NP_065700
auggagcugagcgccgugggcgagagaguguucgccgccgaggcccugcugaagagaagaaucagaaagggcagaauggaguaccuggugaaguggaagggcuggagccagaaguacagcaccugggagcccgaggagaacauccuggacgccagacugcuggccgccuucgaggagagagagagagagauggagcuguacggccccaagaagagaggccccaagcccaagaccuuccugcugaaggcccaggccaaggccaaggccaagaccuacgaguucagaagcgacagcgccagaggcaucagaauccccuaccccggcagaagcccccaggaccuggccagcaccagcagagccagagagggccugagaaacaugggccugagcccccccgccagcagcaccagcaccagcagcaccugcagagccgaggcccccagagacagagacagagacagagacagagacagagagagagacagagagagagagagagagagagagagagagagagagagagagagagagagagagagaggcaccagcagaguggacgacaagcccagcagccccggcgacagcagcaagaagagaggccccaagcccagaaaggagcugcccgaccccagccagagaccccugggcgagcccagcgccggccugggcgaguaccugaagggcagaaagcuggacgacacccccagcggcgccggcaaguuccccgccggccacagcgugauccagcuggccagaagacaggacagcgaccuggugcagugcggcgugaccagccccagcagcgccgaggccaccggcaagcuggccguggacaccuuccccgccagagugaucaagcacagagccgccuuccuggaggccaagggccagggcgcccuggaccccaacggcaccagagugagacacggcagcggcccccccagcagcggcggcggccuguacagagacaugggcgcccagggcggcagacccagccugaucgccagaauccccguggccagaauccugggcgaccccgaggaggagagcuggagccccagccugaccaaccuggagaaggugguggugaccgacgugaccagcaacuuccugaccgugaccaucaaggagagcaacaccgaccagggcuucuucaaggagaagagauaa

SEQ ID NO: 14705 - RNA, 510 nt, Artificial Sequence
  CBY1__Homo_sapiens__NP_001002880
auggacaagugccagaagcacgacguggagugcgagaagcccgacgccaacgaggacagccugugcaacagcgugcacgugcaguggcccggcgagggcagcaccggcuucgccuucaucagacccaagaugcccuucuucggcaacaccuucagccccaagaagaccccccccagaaagagcgccagccugagcaaccugcacagccuggacagaagcaccagagagguggagcugggccuggaguacggcagccccaccaugaaccuggccggccagagccugaaguucgagaacggccaguggaucgccgagaccggcgugagcggcggcguggacagaagagaggugcagagacugagaagaagaaaccagcagcuggaggaggagaacaaccugcugagacugaagguggacauccugcuggacaugcugagcgagagcaccgccgagagccaccugauggagaaggagcuggacgagcugagaaucagcagaaagagaaaguaa

SEQ ID NO: 14706 - RNA, 2856 nt, Artificial Sequence
  CC2D1A__Homo_sapiens__NP_060191
augcacaagagaaagggcccccccggcccccccggcagaggcgccgccgccgccagacagcugggccugcugguggaccugagccccgacggccugaugauccccgaggacggcgccaacgacgaggagcuggaggccgaguuccuggcccuggugggcggccagccccccgcccuggagaagcugaagggcaagggcccccugcccauggaggccaucgagaagauggccagccugugcaugagagaccccgacgaggacgaggaggagggcaccgacgaggacgaccuggaggccgacgacgaccugcuggccgagcugaacgaggugcugggcgaggagcagaaggccagcgagacccccccccccguggcccagcccaagcccgaggccccccaccccggccuggagaccacccugcaggagagacuggcccuguaccagaccgccaucgagagcgccagacaggccggcgacagcgccaagaugagaagauacgacagaggccugaagacccuggagaaccugcuggccagcaucagaaagggcaacgccaucgacgaggccgacauccccccccccguggccaucggcaagggccccgccagcacccccaccuacagccccgcccccacccagcccgcccccagaaucgccagcgcccccgagcccagagugacccuggagggccccagcgccaccgcccccgccagcagccccggccuggccaagccccagaugccccccggccccugcagccccggcccccuggcccagcugcagagcagacagagagacuacaagcuggccgcccugcacgccaagcagcagggcgacaccaccgccgccgccagacacuucagaguggccaagagcuucgacgccgugcuggaggcccugagcagaggcgagcccguggaccugagcugccugccccccccccccgaccagcugccccccgacccccccagcccccccagccagccccccacccccgccaccgcccccagcaccaccgaggugccccccccccccagaacccugcuggaggcccuggagcagagaauggagagauaccagguggccgccgcccaggccaagagcaagggcgaccagagaaaggccagaaugcacgagagaaucgugaagcaguaccaggacgccaucagagcccacaaggccggcagagccguggacguggccgagcugcccgugccccccggcuucccccccauccagggccuggaggccaccaagcccacccagcagagccuggugggcgugcuggagaccgccaugaagcuggccaaccaggacgagggccccgaggacgaggaggacgaggugcccaagaagcagaacagccccguggcccccaccgcccagcccaaggccccccccagcagaaccccccagagcggcagcgcccccaccgccaaggccccccccaaggccaccagcaccagagcccagcagcagcuggccuuccuggagggcagaaagaagcagcugcugcaggccgcccugagagccaagcagaagaacgacguggagggcgccaagaugcaccugagacaggccaagggccuggagcccaugcuggaggccagcagaaacggccugcccguggacaucaccaaggugccccccgcccccgugaacaaggacgacuucgcccuggugcagagacccggccccggccugagccaggaggccgccagaagauacggcgagcugaccaagcugaucagacagcagcacgagaugugccugaaccacagcaaccaguucacccagcugggcaacaucaccgagaccaccaaguucgagaagcuggccgaggacugcaagagaagcauggacauccugaagcaggccuucgugagaggccugcccacccccaccgccagauucgagcagagaaccuucagcgugaucaagaucuuccccgaccugagcagcaacgacaugcugcuguucaucgugaagggcaucaaccugcccaccccccccggccugagccccggcgaccuggacguguucgugagauucgacuuccccuaccccaacguggaggaggcccagaaggacaagaccagcgugaucaagaacaccgacagccccgaguucaaggagcaguucaagcugugcaucaacagaagccacagaggcuucagaagagccauccagaccaagggcaucaaguucgagguggugcacaagggcggccuguucaagaccgacagagugcugggcaccgcccagcugaagcuggacgcccuggagaucgccugcgaggugagagagauccuggaggugcuggacggcagaagacccaccggcggcagacuggaggugauggugagaaucagagagccccugaccgcccagcagcuggagaccaccaccgagagauggcuggugaucgaccccgugcccgccgccgugcccacccagguggccggccccaagggcaaggccccccccgugcccgcccccgccagagagagcggcaacagaagcgccagaccccugcacagccugagcgugcuggccuucgaccaggagagacuggagagaaagauccuggcccugagacaggccagaagacccgugccccccgagguggcccagcaguaccaggacaucaugcagagaagccaguggcagagagcccagcuggagcagggcggcgugggcaucagaagagaguacgccgcccagcuggagagacagcugcaguucuacaccgaggccgccagaagacugggcaacgacggcagcagagacgccgccaaggaggcccuguacagaagaaaccugguggagagcgagcugcagagacugagaagauaa

SEQ ID NO: 14707 - RNA, 1806 nt, Artificial Sequence
  CC2D1B__Homo_sapiens__XP_011539232
augaugcccggccccagacccagaaagggcccccaggccagaggccagggcguggccgccgccaagcagaugggccuguucauggaguucggccccgaggacaugcugcugggcauggacgaggccgaggacgacgaggaccuggaggccgagcugcuggcccugaccggcgaggcccagaccaccggcaagaagcccgcccccaagggccaggccccccugcccauggcccacaucgagaagcuggccgccgacugcaugagagacguggaggaggaggaggaggaggagggccuggaggaggacgccgagcugcugaccgagcugcaggaggugcugggcguggacgaggagaccgagccccuggacggcgacgagguggccgaccccggcggcagcgaggaggagaacggccuggaggacaccgagccccccgugcagaccgccgugcugaccgccagcgcccccgccgcccaggccggcgccagccagggccugcacgcccugcuggaggagagaauccacaacuacagagaggccgccgccagcgccaaggaggccggcgaggccgccaaggccagaagaugcgagagaggccugaagacccuggagagccagcuggccagcgugagaagaggcagaaagaucaacgaggacgagauccccccccccguggcccugggcaagagaccccuggccccccaggagcccgccaacagaagccccgagaccgacccccccgccccccccgcccuggagagcgacaaccccagccagcccgagaccagccugcccggcaucagcgcccagcccgugagcgaccuggaccccgaccccagagcccugcugagcagcagacagagagaguacaagguggccgcccugagcgccaagagagccggcgagcuggacagagccagagagcugaugagaaucggcaagagauucggcgccgugcuggaggcccuggagaagggccagcccguggaccugagcgccaugccccccgcccccgaggaccugaagccccagcaggccagccaggcccccaccgcccccagcgugaucccccccgccguggagagagugcagcccgugauggcccccgacgugcccgccacccccguggcccccaccgagagccagaccgugcuggacgcccugcagcagagacugaacaaguacagagaggccggcauccaggccagaagcggcggcgacgagagaaaggccagaaugcacgagagaaucgccaagcaguaccaggacgccaucagagcccacagagccggcagaaaggugaacuucgccgagcugcccgugccccccggcuucccccccauccccggccuggagagcaccaugggcguggaggaggacgccguggccgccacccuggccgccgccgagaagcuggccagcgccgaggacagcgcccccgccgacaaggacgaggacgagccccccggccaccugcagggcgagccccccgcccaggcccccguggccaagaagcccgccagacccaccgugcccagcagccagagacugcccgagcccagagccagcagcagcaaggagagccccagccccagcgugagagagcagcuggcccugcuggaggccagaaagcugcaguaccagagagccgcccugcaggccaagagaagccaggaccuggagcaggccaaggccuaccugagaguggccaaguggcuggaggcccagaucauccaggccagaagcggcagacccguggaccugagcaagggccccugcgaccugggcagaugccugagacccuaa

SEQ ID NO: 14708 - RNA, 4863 nt, Artificial Sequence
  CC2D2A__Homo_sapiens__NP_001073991
augaaccccagagaggagaaggugaagaucaucaccgaggaguucaucgagaacgacgaggacgccgacaugggcagacagaacaagaacagcaaggugagaagacagcccagaaagaagcagccccccaccgccgugcccaaggagauggugagcgagaagagccaccugggcaacccccaggagcccgugcaggaggagcccaagaccagacugcugagcaugaccgugagaagaggccccagaagccugccccccauccccagcaccagcagaaccggcuucgccgaguucagcaugagaggcagaaugagagagaagcugcaggccgccagaagcaaggccgagagcgcccugcugcaggagauccccacccccagacccagaagacugagaagccccagcaagaaggagcuggagaccgaguucggcaccgagcccggcaaggagguggagagaacccagcaggagguggacagccagagcuacagcagagugaaguuccacgacagcgccagaaagaucaagcccaagccccaggugccccccggcuuccccagcgccgaggaggccuacaacuucuucaccuucaacuucgaccccgagcccgagggcagcgaggagaagcccaaggccagacacagagccggcaccaaccaggaggaggaggagggcgaggaggaggagccccccgcccagggcggcggcaaggagauggacgaggaggagcugcugaacggcgacgacgccgaggacuuccugcugggccuggaccacguggccgacgacuucguggccgugagacccgccgacuacgagagcauccacgacagacugcagauggagagagagaugcuguucauccccagcagacagaccgugcccaccuacaagaagcugcccgagaacgugcagcccagauuccuggaggacgagggccuguacaccggcgugagacccgagguggccagaaccaaccagaacaucauggagaacagacugcugaugcaggaccccgagagaagaugguucggcgacgacggcagaauccuggcccugcccaaccccaucaagcccuuccccagcagaccccccgugcugacccaggagcagagcaucaaggccgagcuggagacccuguacaagaaggccgugaaguacgugcacagcagccagcacgugaucagaagcggcgacccccccggcaacuuccagcuggacaucgacaucagcggccugaucuucacccaccaccccugcuucagcagagagcacgugcuggccgccaagcuggcccagcuguacgaccaguaccuggccagacaccagagaaacaaggccaaguuccugaccgacaagcugcaggcccugagaaacgccgugcagaccggccuggaccccgagaagccccaccagagccuggacaccauccagaagaccaucaacgaguacaagagcgagaucagacagaccagaaaguucagagacgccgagcaggagaaggacagaacccugcugaagaccaucaucaagguguggaaggagaugaagagccugagagaguuccagagauucaccaacaccccccugaagcuggugcugagaaaggagaaggccgaccagaaggccgacgaggaggccuacgaggccgagauccaggccgagaucagcgagcugcuggaggagcacaccgaggaguacgcccagaagauggaggaguacagaaccagccugcagcaguggaaggccuggagaaaggugcagagagccaagaagaagaagagaaagcaggccgccgaggagcaccccggcgacgagaucgccgagcccuaccccgaggaggaccuggugaagcccagcccccccgagcccaccgacagagccgugaucgagcaggaggugagagagagagccgcccagagcagaagaagacccugggagcccacccuggugcccgagcugagccuggccggcagcgugacccccaacgaccagugccccagagccgaggugagcagaagagaggacgugaagaagagaagcguguaccugaaggugcuguucaacaacaaggaggugagcagaaccgugagcagaccccugggcgccgacuucagagugcacuucggccagaucuucaaccugcagaucgugaacuggcccgagagccugacccugcagguguacgagaccgugggccacagcagccccacccugcuggccgagguguuccugcccauccccgagaccaccguggugaccggcagagcccccaccgaggagguggaguucagcagcaaccagcacgugacccuggaccacgagggcgugggcagcggcgugcccuucagcuucgaggccgacggcagcaaccagcugacccugaugaccagcggcaaggugagccacagcguggccugggccaucggcgagaacggcaucccccugauccccccccugagccagcagaacaucggcuucagaagcgcccugaagaaggccgacgccaucagcagcaucggcaccagcggccugaccgacaugaagaagcuggccaagugggccgccgagagcaagcuggaccccaacgaccccaacaacgccccccugaugcagcugaucagcguggccaccagcggcgagagcuacgugcccgacuucuucagacuggagcagcugcagcaggaguucaacuucgugagcgaccaggagcugaacagaagcaagagauucagacugcugcaccugagaagccaggaggugcccgaguucagaaacuacaagcaggugcccguguacgacagagagaucauggagaagguguuccaggacuacgagaagagacugagagacagaaacgugaucgagaccaaggagcacaucgacacccacagagccaucguggccaaguaccugcagcaggugagagagagcgugaucaacagauuccugaucgccaagcaguacuuccugcuggccgacaugaucguggaggaggaggugcccaacaucagcauccugggccugagccuguucaagcuggccgagcagaagagaccccugagacccagaagaaagggcagaaagaaggugaccgcccagaaccugagcgacggcgacaucaagcugcuggugaacaucgugagagccuacgacauccccgugagaaagcccgccgugagcaaguuccagcagcccagcagaagcagcagaauguucagcgagaagcacgccgccagccccagcaccuacagccccacccacaacgccgacuacccccugggccaggugcuggugagacccuucguggaggugagcuuccagagaaccgugugccacaccaccaccgccgagggccccaaccccagcuggaacgaggagcuggagcugcccuucagagcccccaacggcgacuacagcaccgccagccugcagagcgugaaggacgugguguucaucaacaucuucgacgaggugcugcacgacgugcuggaggacgacagagagagaggcagcggcauccacaccagaaucgagagacacuggcugggcugcgugaagaugcccuucagcaccaucuacuuccaggccagaaucgacggcaccuucaagaucgacaucccccccgugcugcugggcuacagcaaggagagaaacaugauccuggagagaggcuucgacagcgugagaagccugagcgagggcagcuacaucacccuguucaucaccaucgagccccagcuggugcccggcgagagcaucagagagaaguucgagagccaggaggacgagaagcugcugcaggccaccgagaaguuccaggccgagugcgcccugaaguuccccaacagacagugccugaccaccgugaucgacaucagcggcaagaccguguucaucaccagauaccugaagccccugaaccccccccaggagcugcugaacguguaccccaacaaccugcaggccaccgccgagcugguggccagauacgugagccugauccccuuccugcccgacaccgugagcuucggcggcaucugcgaccuguggagcaccagcgaccaguuccuggaccugcuggccggcgacgaggaggagcacgccgugcugcugugcaacuacuuccugagccugggcaagaaggccuggcugcugaugggcaacgccauccccgagggccccaccgccuacgugcugaccugggagcagggcagauaccugaucuggaaccccugcagcggccacuucuacggccaguucgacaccuucugcccccugaagaacgugggcugccugaucggccccgacaacaucugguucaacauccagagauacgagagcccccugagaaucaacuucgacgugaccagacccaagcuguggaagagcuucuucagcagaagccugcccuaccccggccugagcagcgugcagcccgaggagcugaucuaccagagaagcgacaaggccgccgccgccgagcugcaggacagaaucgagaagauccugaaggagaagaucauggacuggagacccagacaccugaccagauggaacagauacugcaccagcacccugagacacuuccugccccugcuggagaagagccagggcgaggacguggaggacgaccacagagccgagcugcugaagcagcugggcgacuacagauucagcggcuucccccugcacaugcccuacagcgaggugaagccccugaucgacgccguguacagcaccggcgugcacaacaucgacgugcccaacguggaguucgcccuggccguguacauccaccccuaccccaagaacgugcugagcguguggaucuacguggccagccugaucagaaacagauaa

SEQ ID NO: 14709 - RNA, 3408 nt, Artificial Sequence
  CCAR1__Homo_sapiens__NP_001269889
auggcccaguucggcggccagaagaacccccccugggccacccaguucaccgccaccgccgugagccagcccgccgcccugggcgugcagcagcccagccugcugggcgccagccccaccaucuacacccagcagaccgcccuggccgccgccggccugaccacccagacccccgccaacuaccagcugacccagaccgccgcccugcagcagcaggccgccgccgccgccgccgcccugcagcagcugcagcagccccagcagacccugcugacccagcccgccguggcccugcccaccagccugagccugagcaccccccagcccaccgcccagaucaccgugagcuaccccacccccagaagcagccagcagcagacccagccccagaagcagagaguguucaccggcguggugaccaagcugcacgacaccuucggcuucguggacgaggacguguucuuccagcugagcgccgugaagggcaagaccccccaggugggcgacagagugcugguggaggccaccuacaaccccaacaugcccuucaaguggaacgcccagagaauccagacccugcccaaccagaaccagagccagacccagccccugcugaagaccccccccgccgugcugcagcccaucgccccccagaccaccuucggcgugcagacccagccccagccccagagccugcugcaggcccagaucagcgccgccagcaucaccccccugcugcagacccagccccagccccugcugcagcagccccagcagaaggccggccugcugcagccccccgugagaaucgugagccagccccagcccgccagaagacuggacccccccagcagauucagcggcagaaacgacagaggcgaccaggugcccaacagaaaggacgacagaagcagagagagagagagagagagaagaagaagcagagagagaagcccccagagaaagagaagcagagagagaagccccagaagagagagagagagaagccccagaagagugagaagaguggugcccagauacaccgugcaguucagcaaguucagccuggacugccccagcugcgacaugauggagcugagaagaagauaccagaaccuguacauccccagcgacuucuucgacgcccaguucaccuggguggacgccuucccccugagcagacccuuccagcugggcaacuacugcaacuucuacgugaugcacagagagguggagagccuggagaagaacauggccauccuggacccccccgacgccgaccaccuguacagcgccaaggugaugcugauggccagccccagcauggaggaccuguaccacaagagcugcgcccuggccgaggacccccaggagcugagagacggcuuccagcaccccgccagacuggugaaguuccuggugggcaugaagggcaaggacgaggccauggccaucggcggccacuggagccccagccuggacggccccgaccccgagaaggaccccagcgugcugaucaagaccgccaucagaugcugcaaggcccugaccggcaucgaccugagcgugugcacccagugguacagauucgccgagaucagauaccacagacccgaggagacccacaagggcagaaccgugcccgcccacguggagaccguggugcuguucuuccccgacguguggcacugccugcccaccagaagcgagugggagacccugagcagaggcuacaagcagcagcugguggagaagcugcagggcgagagaaaggaggccgacggcgagcaggacgaggaggagaaggacgacggcgaggccaaggagaucagcacccccacccacuggagcaagcuggaccccaagaccaugaaggugaacgaccugagaaaggagcuggagagcagagcccugagcagcaagggccugaagagccagcugaucgccagacugaccaagcagcugaagguggaggagcagaaggaggagcagaaggagcuggagaagagcgagaaggaggaggacgaggacgacgacagaaagagcgaggacgacaaggaggaggaggagagaaagagacaggaggagaucgagagacagagaagagagagaagauacauccugcccgacgagcccgccaucaucgugcaccccaacugggccgccaagagcggcaaguucgacugcagcaucaugagccugagcgugcugcuggacuacagacuggaggacaacaaggagcacagcuucgaggugagccuguucgccgagcuguucaacgagaugcugcagagagacuucggcgugagaaucuacaagagccugcugagccugcccgagaaggaggacaagaaggagaaggacaagaagagcaagaaggacgagagaaaggacaagaaggaggagagagacgacgagaccgacgagcccaagcccaagagaagaaagagcggcgacgacaaggacaagaaggaggacagagacgagagaaagaaggaggacaagagaaaggacgacagcaaggacgacgacgagaccgaggaggacaacaaccaggacgaguacgaccccauggaggccgaggaggccgaggacgaggaggacgacagagacgaggaggagaugaccaagagagacgacaagagagacaucaacagauacugcaaggagagacccagcaaggacaaggagaaggagaagacccagaugaucaccaucaacagagaccugcugauggccuucguguacuucgaccagagccacugcggcuaccugcuggagaaggaccuggaggagauccuguacacccugggccugcaccugagcagagcccaggugaagaagcugcugaacaagguggugcugagagagagcugcuucuacagaaagcugaccgacaccagcaaggacgaggagaaccacgaggagagcgagagccugcaggaggacaugcugggcaacagacugcugcugcccacccccaccgugaagcaggagagcaaggacguggaggagaacgugggccugaucguguacaacggcgccaugguggacgugggcagccugcugcagaagcuggagaagagcgagaaggugagagccgagguggagcagaagcugcagcugcuggaggagaagaccgacgaggacgagaagaccauccugaaccuggagaacagcaacaagagccugagcggcgagcugagagaggugaagaaggaccugagccagcugcaggagaaccugaagaucagcgagaacaugaaccugcaguucgagaaccagaugaacaagaccaucagaaaccugagcaccgugauggacgagauccacaccgugcugaagaaggacaacgugaagaacgaggacaaggaccagaagagcaaggagaacggcgccagcguguaa

SEQ ID NO: 14710 - RNA, 2772 nt, Artificial Sequence
  CCAR2__Homo_sapiens__NP_066997
augagccaguucaagagacagagaaucaacccccugcccggcggcagaaacuucagcggcaccgccagcaccagccugcugggccccccccccggccugcugaccccccccguggccaccgagcugagccagaacgccagacaccugcagggcggcgagaagcagagaguguucaccggcaucgugaccagccugcacgacuacuucggcgugguggacgaggagguguucuuccagcugagcguggugaagggcagacugccccagcugggcgagaaggugcuggugaaggccgccuacaaccccggccaggccgugcccuggaacgccgugaaggugcagacccugagcaaccagccccugcugaagagccccgcccccccccugcugcacguggccgcccugggccagaagcagggcauccugggcgcccagccccagcugaucuuccagccccacagaauccccccccuguucccccagaagccccugagccuguuccagaccagccacacccugcaccugagccaccugaacagauuccccgccagaggcccccacggcagacuggaccagggcagaagcgacgacuacgacagcaagaagagaaagcagagagccggcggcgagcccuggggcgccaagaagcccagacacgaccugccccccuacagagugcaccugacccccuacaccguggacagccccaucugcgacuuccuggagcugcagagaagauacagaagccugcuggugcccagcgacuuccugagcgugcaccugagcuggcugagcgccuucccccugagccagcccuucagccugcaccaccccagcagaauccaggugagcagcgagaaggaggccgcccccgacgccggcgccgagcccaucaccgccgacagcgaccccgccuacagcagcaaggugcugcugcugagcagccccggccuggaggagcuguacagaugcugcaugcuguucguggacgacauggccgagcccagagagacccccgagcacccccugaagcagaucaaguuccugcugggcagaaaggaggaggaggccgugcuggugggcggcgaguggagccccagccuggacggccuggacccccaggccgacccccaggugcuggugagaaccgccaucagaugcgcccaggcccagaccggcaucgaccugagcggcugcaccaagugguggagauucgccgaguuccaguaccugcagcccggcccccccagaagacugcagaccguggugguguaccugcccgacguguggaccaucaugcccacccuggaggagugggaggcccugugccagcagaaggccgccgaggccgccccccccacccaggaggcccagggcgagaccgagcccaccgagcaggcccccgacgcccuggagcaggccgccgacaccagcagaagaaacgccgagacccccgaggccaccacccagcaggagaccgacaccgaccugcccgaggcccccccccccccccuggagcccgccgugaucgccagacccggcugcgugaaccugagccugcacggcaucguggaggacagaagacccaaggagagaaucagcuucgaggugauggugcuggccgagcuguuccuggagaugcugcagagagacuucggcuacagaguguacaagaugcugcugagccugcccgagaagguggugagcccccccgagcccgagaaggaggaggccgccaaggaggaggccaccaaggaggaggaggccaucaaggaggagguggugaaggagcccaaggacgaggcccagaacgagggccccgccaccgagagcgaggccccccugaaggaggacggccugcugcccaagccccugagcagcggcggcgaggaggaggagaagcccagaggcgaggccagcgaggaccugugcgagauggcccuggaccccgagcugcugcugcugagagacgacggcgaggaggaguucgccggcgccaagcuggaggacagcgaggugagaagcguggccagcaaccagagcgagauggaguucagcagccugcaggacaugcccaaggagcuggaccccagcgccgugcugccccuggacugccugcuggccuucguguucuucgacgccaacuggugcggcuaccugcacagaagagaccuggagagaauccugcugacccugggcaucagacugagcgccgagcaggccaagcagcuggugagcagaguggugacccagaacaucugccaguacagaagccugcaguacagcagacaggagggccuggacggcggccugcccgaggaggugcuguucggcaaccuggaccugcugcccccccccggcaagagcaccaagcccggcgccgcccccaccgagcacaaggcccuggugagccacaacggcagccugaucaacgugggcagccugcugcagagagccgagcagcaggacagcggcagacuguaccuggagaacaagauccacacccuggagcugaagcuggaggagagccacaacagauucagcgccaccgaggugaccaacaagacccuggccgccgagaugcaggagcugagagugagacuggccgaggccgaggagaccgccagaaccgccgagagacagaagagccagcugcagagacugcugcaggagcugagaagaagacugaccccccugcagcuggagauccagagagugguggagaaggccgacagcuggguggagaaggaggagcccgcccccagcaacuaa

SEQ ID NO: 14711 - RNA, 1221 nt, Artificial Sequence
  CCBE1__Homo_sapiens__NP_597716
auggugccccccccccccagcagaggcggcgccgccagaggccagcugggcagaagccugggcccccugcugcugcugcuggcccugggccacaccuggaccuacagagaggagcccgaggacggcgacagagagaucugcagcgagagcaagaucgccaccaccaaguaccccugccugaagagcagcggcgagcugaccaccugcuacagaaagaagugcugcaagggcuacaaguucgugcugggccagugcauccccgaggacuacgacgugugcgccgaggcccccugcgagcagcagugcaccgacaacuucggcagagugcugugcaccugcuaccccggcuacagauacgacagagagagacacagaaagagagagaagcccuacugccuggacaucgacgagugcgccagcagcaacggcacccugugcgcccacaucugcaucaacacccugggcagcuacagaugcgagugcagagagggcuacaucagagaggacgacggcaagaccugcaccagaggcgacaaguaccccaacgacaccggccacgagaagagcgagaacauggugaaggccggcaccugcugcgccaccugcaaggaguucuaccagaugaagcagaccgugcugcagcugaagcagaagaucgcccugcugcccaacaacgccgccgaccugggcaaguacaucaccggcgacaaggugcuggccagcaacaccuaccugcccggcccccccggccugcccggcggccagggcccccccggcagccccggccccaagggcagccccggcuuccccggcaugcccggcccccccggccagcccggccccagaggcagcaugggccccaugggccccagccccgaccugagccacaucaagcagggcagaagaggccccgugggcccccccggcgcccccggcagagacggcagcaagggcgagagaggcgcccccggccccagaggcagccccggcccccccggcagcuucgacuuccugcugcugaugcuggccgacaucagaaacgacaucaccgagcugcaggagaagguguucggccacagaacccacagcagcgccgaggaguucccccugccccaggaguuccccagcuaccccgaggccauggaccugggcagcggcgacgaccaccccagaagaaccgagaccagagaccugagagcccccagagacuucuaccccuaa

SEQ ID NO: 14712 - RNA, 1119 nt, Artificial Sequence
  CCBL1__Homo_sapiens__NP_001116144
auggccaagcagcugcaggccagaagacuggacggcaucgacuacaaccccuggguggaguucgugaagcuggccagcgagcacgacguggugaaccugggccagggcuuccccgacuuccccccccccgacuucgccguggaggccuuccagcacgccgugagcggcgacuucaugcugaaccaguacaccaagaccuucgugaucaucaucgagcccuucuucgacugcuacgagcccaugaccaugauggccggcggcagacccguguucgugagccugaagcccggccccauccagaacggcgagcugggcagcagcagcaacuggcagcuggaccccauggagcuggccggcaaguucaccagcagaaccaaggcccuggugcugaacacccccaacaacccccugggcaagguguucagcagagaggagcuggagcugguggccagccugugccagcagcacgacguggugugcaucaccgacgagguguaccaguggaugguguacgacggccaccagcacaucagcaucgccagccugcccggcaugugggagagaacccugaccaucggcagcgccggcaagaccuucagcgccaccggcuggaaggugggcugggugcugggccccgaccacaucaugaagcaccugagaaccgugcaccagaacagcguguuccacugccccacccagagccaggccgccguggccgagagcuucgagagagagcagcugcuguucagacagcccagcagcuacuucgugcaguucccccaggccaugcagagaugcagagaccacaugaucagaagccugcagagcgugggccugaagcccaucaucccccagggcagcuacuuccugaucaccgacaucagcgacuucaagagaaagaugcccgaccugcccggcgccguggacgagcccuacgacagaagauucgugaaguggaugaucaagaacaagggccugguggccauccccgugagcaucuucuacagcgugccccaccagaagcacuucgaccacuacaucagauucugcuucgugaaggacgaggccacccugcaggccauggacgagaagcugagaaaguggaagguggagcuguaa

SEQ ID NO: 14713 - RNA, 882 nt, Artificial Sequence
  CCDC101__Homo_sapiens__NP_612423
auggcccuggugagcgccgacagcagaaucgccgagcugcugaccgagcugcaccagcugaucaagcagacccaggaggagagaagcagaagcgagcacaaccuggugaacauccagaagacccacgagagaaugcagaccgagaacaagaucagccccuacuacagaaccaagcugagaggccuguacaccaccgccaaggccgacgccgaggccgagugcaacauccugagaaaggcccuggacaagaucgccgagaucaagagccugcuggaggagagaagaaucgccgccaagaucgccggccuguacaacgacagcgagccccccagaaagaccaugagaagaggcgugcugaugacccugcugcagcagagcgccaugacccugccccuguggaucggcaagcccggcgacaagccccccccccugugcggcgccauccccgccagcggcgacuacguggccagacccggcgacaagguggccgccagagugaaggccguggacggcgacgagcaguggauccuggccgagguggugagcuacagccacgccaccaacaaguacgagguggacgacaucgacgaggagggcaaggagagacacacccugagcagaagaagagugaucccccugccccaguggaaggccaaccccgagaccgaccccgaggcccuguuccagaaggagcagcuggugcuggcccuguacccccagaccaccugcuucuacagagcccugauccacgcccccccccagagaccccaggacgacuacagcgugcuguucgaggacaccagcuacgccgacggcuacagccccccccugaacguggcccagagauacgugguggccugcaaggagcccaagaagaaguaa

SEQ ID NO: 14714 - RNA, 1542 nt, Artificial Sequence
  CCDC102B__Homo_sapiens__NP_001087198
augaaccuggacagcauccacagacugaucgaggagacccagaucuuccagaugcagcagagcagcaucaagagcagaggcgacaugguggcccccgccagcccccccagagacaccugcaacaccugcuucccccugcacggccugcagagccacgccgcccacaacuucugcgcccacagcuacaacaccaacaagugggacaucugcgaggagcugagacugagagagcuggaggaggugaaggccagagccgcccagauggagaagaccaugagaugguggagcgacugcaccgccaacuggagagagaaguggagcaaggugagagccgagagaaacagcgccagagaggagggcagacagcugagaaucaagcuggagauggccaugaaggagcugagcacccugaagaagaagcagagccugcccccccagaaggaggcccuggaggccaacgugacccaggaccugaagcugcccggcuucguggaggagagcugcgagcacaccgaccaguuccagcugagcagccagaugcacgagagcaucagagaguaccuggugaagagacaguucagcaccaaggaggacaccaacaacaaggagcagggcguggugaucgacagccugaagcugagcgaggagaugaagcccaaccuggacggcguggaccuguucaacaacggcggcagcggcaacggcgagaccaagaccggccugagacugaaggccaucaaccugccccuggagaacgaggugaccgagaucagcgcccugcaggugcaccuggacgaguuccagaagauccuguggaaggagagagagaugagaaccgcccuggagaaggagaucgagagacuggagagcgcccugagccuguggaaguggaaguacgaggagcugaaggagagcaagcccaagaacgugaaggaguucgacauccugcugggccagcacaacgacgagaugcaggagcugagcggcaacaucaaggaggagagcaagagccagaacagcaaggacagagugaucugcgagcugagagccgagcuggagagacugcaggccgagaacaccagcgagugggacaagagagagauccuggagagagagaagcagggccuggagagagagaacagaagacugaagauccaggugaaggagauggaggagcugcuggacaagaagaacagacugagcgccaacagccagagccccgacuucaagaugagccagaucgaccugcaggagaagaaccaggagcugcugaaccugcagcacgccuacuacaagcugaacagacaguaccaggccaacaucgccgagcugacccacgccaacaacagaguggaccagaacgaggccgaggugaagaagcugagacugagaguggaggagcugaagcagggccugaaccagaaggaggacgagcuggacgacagccugaaccagaucagaaagcugcagagaagccuggacgaggagaaggagagaaacgagaaccuggagaccgagcugagacaccugcagaacugguaa

SEQ ID NO: 14715 - RNA, 297 nt, Artificial Sequence
  CCDC103__Homo_sapiens__NP_001245326
auggagagaaacgacaucaucaacuucaaggcccuggagaaggagcugcaggccgcccugaccgccgacgagaaguacaagagagagaacgccgccaagcugagagccguggagcagagaguggccagcuacgaggaguucagaggcaucgugcuggccagccaccugaagccccuggagagaaaggacaagaugggcggcaagagaaccgugcccuggaacugccacaccauccagggcagaaccuuccaggacguggccaccgagaucagccccaacagcuggaagagcagcuaa

SEQ ID NO: 14716 - RNA, 1500 nt, Artificial Sequence
  CCDC105__Homo_sapiens__NP_775753
augagagugcuggugccccccgccgagagaagccaggacaccagagugggcgcccccgccuggagagaggccgcccaggccauggccagaaccgcccacauccugaccgacagaugcggccaggaggccgugaccauguggcagcccaaggacagcgugcuggaccccaacguggcccaccaccugggcagagccgccuacauccagcccuggagauucagaguggagaugaucaagggcggcggcacccuggagaagcccccccccggcgagggcgugacccuguggaagggcaagaugaagccccccgccugguacgccagacugccccugccccugcacagaaaggccagagcccugcagaccaccgagguggugcacgcccacgccagaggcgccagacugaccgccgccagacugggcagagcccagcaccagaucaacggcagagugagacagcugcugagacagagagaggugaccgaccacagacugagcgaggugagaaagggccugcugaucaaccagcagagcgugaagcugagaggcuacagacccaagagcgagaaggugcccgacaaggccgacagcaugcugaccugggagaaggaggagcugaagagcaugaagagaaagauggagagagacauggagaagagcgaggugcugcugaagacccuggccagcugcagagacacccugaacuucugcuucaaggagagacugcaggccguggaccugaugaaccagccccuggacaaggugcuggagcaggccagaagacacagcugggugaaccugagcagagcccccacccccagaacccagggccagaagacccccccccccgaccccgugggcaccuacaaccccgccugcgcccuggcccugaacgaggccaagagacugcugguggagagcaaggacacccugguggagauggccaagaacgagguggacgugagagagcagcagcugcagaucagcgacagagugugcgccagccuggcccagaaggccagcgagacccuggagcugaaggagagacugaacaugacccugggccugaugagaggcaccauccugagaugcaccaaguacaaccaggagcuguacaccacccacggccugaucaagggcccccugagcaaggugcaccuggagaccgccgagaagcuggacagaccccuggugagaauguaccagagacacgugggcacccagcugcccgaggccgccagacuggcccagggcaccgacaagcugcagugccacaucaccuaccuggagaagaaccuggacgagcugcuggccacccacaagaaccugagcuggggccugaacugcaagaacaucggccacgagguggacggcaacguggugagacugagacugagacagagacagccccacgugugcuacgagcaggcccagagacuggugaaggacugggaccccagaacccccccccccagaagcaagagcagcgccgaccccuaa

SEQ ID NO: 14717 - RNA, 2355 nt, Artificial Sequence
  CCDC108__Homo_sapiens__NP_001265224
auggagaccgccaucuggagaagaagcuacaucagccugaucagcagcgagagacccgugcacaacuggagaggcaagagcgugcagaagaagcaggccgagagcaagagccagaucaagcugcacacccagagcgcccccuucggccugugccccaaggacaugaugcugacccaggcccccagcagcguggugagaagcagaaacagcagaaaccacaccgugaacagcggcggcagcugccugagcgccagcaccguggccauccccgccaucaacgacagcagcgccgccaugagcgccugcagcaccaucagcgcccagcccgccagcagcauggacacccagaugcacagccccaagaagcaggagagagugaacaagagagugaucuggggcaucgagguggccgaggagcugcacuggaagggcugggagcugggcaaggagaccaccagaaaccuggugcugaagaacagaagccugaagcugcagaagaugaaguacagaccccccaagaccaaguucuucuucaccgugaucccccagcccaucuuccugagccccggcaucacccugacccugcccaucguguucagaccccuggaggccaaggaguacauggaccagcugugguucgagaaggccgagggcauguucugcgugggccugagagccacccugcccugccacagacugaucugcagaccccccagccugcagcugcccaugugcgccgugggcgacaccaccgaggccuucuucugccuggacaacgugggcgaccugcccaccuucuucaccugggaguucagcagccccuuccagaugcugcccgccaccggccugcuggagcccggccaggccagccagaucaaggugaccuuccagccccugaccgccgugaucuacgaggugcaggccaccugcugguacggcgccggcagcagacagagaagcagcauccagcugcaggccguggccaagugcgcccagcugcuggugagcaucaagcacaagugccccgaggaccaggacgccgagggcuuccagaagcugcuguacuucggcagcguggccgugggcugcaccagcgagagacagaucagacugcacaaccccagcgccgugaacgcccccuucagaaucgagaucagccccgacgagcuggccgaggaccaggccuucagcugccccaccgcccacggcaucgugcugcccggcgagaagaagugcgugagcguguucuuccaccccaagacccuggacaccagaaccguggacuacugcagcaucaugcccagcggcugcgccagcaagacccugcugaagguggugggcuucugcagaggccccgccgugagccugcagcacuacugcgugaacuucagcugggugaaccugggcgagagaagcgagcagccccuguggaucgagaaccagagcgacugcaccgcccacuuccaguucgccaucgacugccuggagagcguguucaccaucagacccgccuucggcacccuggugggcaaggccagaaugacccugcacugcgccuuccagcccacccaccccaucaucugcuucagaagaguggccugccugauccaccaccaggacccccuguuccuggaccugaugggcaccugccacagcgacagcaccaagcccgccauccugaagccccagcaccugaccugguacagaacccaccuggccagaggccugacccuguacccccccgacauccuggacgccaugcugaaggagaagaagcuggcccaggaccagaacggcgcccugaugauccccauccaggaccuggaggacaugcccgccccccaguaccccuacaucccccccaugaccgaguucuucuucgacggcaccagcgacaucaccaucuuccccccccccaucagcguggagcccguggagguggacuucggcgccugccccggccccgaggcccccaaccccgugccccugugccugaugaaccacaccaagggcaagaucauggugguguggaccagaagaagcgacugccccuucugggugacccccgagagcugcgacgugcccccccugaagagcauggccaugagacugcacuuccagcccccccaccccaacugccuguacaccguggagcuggaggccuucgccaucuacaaggugugcgccagaaacgagagagaggagugcggcgugagcgccagaagccugagcggccuggugggcuggcaggaggugaccgagggcagcuucagacugcacccccugagagccagacugagccugggcuggaccgugacccccaugagccugagcccccccaagcugcuggccuaa

SEQ ID NO: 14718 - RNA, 2013 nt, Artificial Sequence
  CCDC114__Homo_sapiens__NP_653178
auggagggcgagagaagagccuacagcaaggaggugcaccagagaaucaacaagcagcuggaggagaucagaagacuggaggaggugagaggcgaccugcaggugcagaucagcgccgcccagaaccaggugaagagacugagagacagccagagacuggagaacauggacagacugcugaagggcagagcccaggugcaggccgagaucgaggagcugcaggagcagaccagagcccuggacaagcagauccaggagugggagaccagaaucuucacccacagcaagaacgugagaagccccggcuucauccuggaccagaaggugaagaucagaagaagaaucagaauccuggagaaccagcuggacagagugaccugccacuucgacaaccagcuggugagaaacgccgcccugagagaggagcuggaccugcugagaaucgacagaaacagauaccugaacguggacagaaagcugaagaaggagauccaccaccugcaccaccuggugagcacccugauccugagcagcaccagcgccuacgccgugagagaggaggccaaggccaagaugggccugcugagagagagagccgagaaggaggaggcccagagcgagauggaggcccaggugcugcagagacagauccugcaccuggagcagcugcaccacuuccugaagcugaagaacaacgacagacagcccgaccccgacgugcuggagaagagagagaagcaggccggcgagguggccgagggcguguggaagaccagccaggagagacuggugcugugcuacgaggacgcccugaacaagcugagccagcugaugggcgagagcgaccccgaccugcuggugcagaaguaccuggagaucgaggagagaaacuucgccgaguucaacuucaucaacgagcagaaccuggagcuggagcacgugcaggaggagaucaaggagaugcaggaggcccuggugagcgccagagccagcaaggacgaccagcaccugcugcaggagcagcagcagaaggugcugcagcagagaauggacaaggugcacagcgaggccgagagacuggaggccagauuccaggacgugagaggccagcuggagaagcugaaggccgacauccagcugcuguucaccaaggcccacugcgacagcagcaugaucgacgaccugcugggcgugaagaccagcaugggcgacagagacaugggccuguuccugagccugaucgagaagagacugguggagcugcugaccgugcaggccuuccugcacgcccagagcuucaccagccuggccgacgccgcccugcuggugcugggccagagccuggaggaccugcccaagaagauggccccccugcagccccccgacacccuggaggacccccccggcuucgaggccagcgacgacuaccccaugagcagagaggagcugcugagccagguggagaagcugguggagcugcaggagcaggccgaggcccagagacagaaggaccuggccgccgccgccgccaagcuggacggcacccugagcguggaccuggccagcacccagagagccggcagcagcaccgugcuggugcccaccagacacccccacgccauccccggcagcauccugagccacaagaccagcagagacagaggcagccugggccacgugaccuucggcggccugagcagcagcaccggccaccugcccagccacaucacccacggcgaccccaacaccggccacgugaccuucggcagcaccagcgccagcagcggcggccacgugaccuucagacccgugagcgccagcagcuaccugggcagcaccggcuacgugggcagcagcagaggcggcgagaacaccgagggcggcguggagagcggcggcaccgccagcgacagcagcggcggccugggcagcagcagagaccacgugagcagcaccggccccgccagcagcaccggccccggcagcagcaccagcaaggacagcagaggcuaa

SEQ ID NO: 14719 - RNA, 543 nt, Artificial Sequence
  CCDC115__Homo_sapiens__NP_115733
auggccgcccuggaccugagagccgagcuggacagccuggugcugcagcugcugggcgaccuggaggagcuggagggcaagagaaccgugcugaacgccagaguggaggagggcuggcugagccuggccaaggccagauacgccaugggcgccaagagcgugggcccccugcaguacgccagccacauggagccccaggugugccugcacgccagcgaggcccaggagggccugcagaaguucaagguggugagagccggcgugcacgcccccgaggaggugggccccagagaggccggccugagaagaagaaagggccccaccaagacccccgagcccgagagcagcgaggccccccaggacccccugaacugguucggcauccuggugccccacagccugagacaggcccaggccagcuucagagacggccugcagcuggccgccgacaucgccagccugcagaacagaaucgacuggggcagaagccagcugagaggccugcaggagaagcugaagcagcuggagcccggcgccgccuaa

SEQ ID NO: 14720 - RNA, 1323 nt, Artificial Sequence
  CCDC121__Homo_sapiens__NP_001136155
augggcagcagaggccagggcagccacagcaagaagaccagaagcaugcccgugauccugagcccccagagaaccggcagcggcgccaccggcggccccgccgccagagccuacagcguggccgaggccgugaagcaguucagagccggccccgccggcaccggcgccggcugcagccugcagggcugcugggccgcccccagacccuucgagcacagaaccaacaagcugagagagcugagcacccuggcccacugcagcagagagcugcagacccaggugcccgacgccagcgcccacagccuggccgugacccugagcgagcugcacagcugcagagaccugcaggacgagugccuggacagcagauucgccgagggccccagaagacugcugccccccuaccacagccugaucaacaacuucgugaagcccgagaagcugaccaagguggagaccagacugaaggagaagaucguggccgagaugaccgaccugaacaagcacaucaagcaggcccagacccagagaaagcagcugcuggaggagagcagagagcugcacagagagaagcugcuggugcaggccgagaacagauucuuccuggaguaccugaccaacaagaccgaggaguacaccgagcagcccgagaagguguggaacagcuaccugcagaagagcggcgagaucgagagaagaagacaggagagcgccagcagauacgccgagcagaucagcgugcugaagaccgcccugcugcagaaggagaacauccagagcagccugaagagaaagcugcaggccaugagagacaucgccauccugaaggagaagcaggagaaggagauccagacccugcaggaggagaccaagaaggugcaggccgagaccgccagcaagaccagagaggugcaggcccagcugcugcaggagaagagacugcuggagaagcagcugagcgagcccgacagaagacugcugggcaagagaaagagaagagagcugaacaugaaggcccaggcccugaagcuggccgccaagagauucaucuucgaguacagcugcggcaucaacagagagaaccagcaguucaagaaggagcugcugcagcugaucgagcaggcccagaagcugaccgccacccagagccaccuggagaacagaaagcagcagcugcagcaggagcagugguaccuggagagccugauccaggccagacagagacugcagggcagccacaaccagugccugaacagacaggacgugcccaagaccacccccagccugccccagggcaccaagagcagaaucaaccccaaguaa

SEQ ID NO: 14721 - RNA, 822 nt, Artificial Sequence
  CCDC122__Homo_sapiens__NP_659411
augagcgacaacaaggagagaaagagccagggcuuccccaaggaggacaaccaggacaccagcagccuggccgacgccguggagaagguggccaagcagcagcagagccaggccagcgagaucgagaagaacaagaaggugcuguucaaccugaagaacgagcugcacgagcuggagaaggagaucgccgccaucagcgccgagaccaaggagaccgagagacagaucuaccagcaggacagcgccaucgagaacaccaagcugcacugcgacagccuggagacccagaucaagagccugcacagcgagaacgugaagcugaaguucgacaucgagaccgcccaggaggacuucgaggagcacaugaucaaguacaacgccuacuacgccaagaucaaggcccacaagaacagccugggcgagguggagagcaaguggagcuucaugaccgagcugcacgagaagagagacuucgugaagaagcugaagaccaugaaggaggagcugaugcaggaccugcagaaccccggcggcaacagaaucacccaggugcaggaggacaucaccaaccugaaggacaagaucaucaccgugaaggagagcaucaucgagaagaccugcuuccuggaggaggagaagaagacccacgagaagcugagaaaggagaucgaggugcagcacaagagauacgacgccauccugaagagacugcacugccaggugaacaagcugcagagcaacagaagacaguggcaguggaacauccagcagcuggagaagaccgccgccgagcugagaaagugcaucggcaugcaggaguaa

SEQ ID NO: 14722 - RNA, 3165 nt, Artificial Sequence
  CCDC129__Homo_sapiens__NP_001244896
augagcgugagccugcagaacuacagccccaugauggcccagaagagccagggcagcgacaaccugcaggagggccaggagaagagcaagagagagauccugaagugcaccaagagcgccugggccccccuggacgaguggcugccccccgaccccgaggaggagagccagagccugaccauccccaugcuggaggacagcaagcaggagagcauccagcaguggcuggacagcggcuucuucgugagcgccaacgagaacuuccagcaggugaucgacagaaccgugagccuguacgagcagggcauggugcagaugaccgugaaggacuacaugagaagccugcaccaguucagcgagacccccauccugagcagaggcaccagcuucaacagcugcuacagcaccgccagcgugccccagagcauccccgaguggcuggaguucugggagaucgaccccguggagauccugcuggaccugggcuucggcgccgacgagcccgacaucugcaugcagauccccgccagauuccugggcugcggcagcgccgccagaggcaucaacaucagaguguuccuggaggcccagaagcagagaauggacaucgagaaccccaaccuguacggcagauucagacagcuggagauccuggaccacgugaccaacgccuucagcagccugcugagcgacgugagcauccugcccaacagagccgaggagaaggccggcggcgagagcgugcagagaaccagcgugagcgccgccaaggagcacagaagaagaaugggcaagcugcugagaagagccagcaagcagaacaucagaagagacugcaaccccgaggugagcgagagcuucaaggugaaggacgagguguucgugcccuucaccaagcccugggacugcggcgccgagcuggccgccaccagcaucaaccacaagcagaaccaccugagccugagcguggagcaccagagccugcaggccugcgacgaccugcugcccuaccccccccacggccugcugagcaagcaguggcccugcagcagcaugcccgccaagcaggccccccccagcugcgugagcgagggcagcgugaagggcagaacccagaaggagaaccuguuccagaccaacaagcugaagagccugagccaccuggccggcaagggccccgacagcuucgagauggaggaggugcagagcuucgaggaggagaccggcaacccccuggacaugaccagcggcaccgugggcgccagaguggacagagccaacagcugccagagcgacagcagcggcuuccuggaggagccccuggagccccugccccugcagaugcccagccugcccaacagccagagccccgccgagaacggcggcagaaagcccagagaccagagccacagccuggugagcagccaggacugccagcuggagagcgacggccccgacagcaagagcagagccagcaugagcuucagcagccaggaggccaacgcccuggagcagagagccagcgugagcgugauggaggaggaguuccugcuggaggccauggagggcccccccgagcuguacauccccgacauggccugcgccaagaccaccaccagaggcgagugccccagaaaggacagccaccuguggcagcugcugcccaugccccacgccgaguacgaggugaccagacccaccgccaccagcaaguacgaccacccccugggcuucauggugacccacgugaccgagaugcaggacagcuucgugagacccgagggcgccggcaaggugcagagccaccacaacgagagccagagaagccccggcaacgaccacacccaggacaaguuccugcacguggacagcgaggcccccagagaggaggagagcagcggcuucugcccccacaccaaccacagccugcuggugcccgagagcagcagccagugcauccccaagcacagcgagaucacccccuacgccaccgaccuggcccagaccagcgagaagcugaucccccaccugcacaagcugcccggcgaccccgcccaggugaagagcagaagcggcacccugggccagauccugcccggcaccgaggccgagauggagaaccugccccugaacaccggcagcagcagaagcgugaugacccagaugagcagcagccuggugagcgccgcccagagagccguggcccugggcaccggccccagaggcaccagccuggagugcaccgugugcgaccccgugaccgccaccgagaccagacugggcaccaaggccagacagcugaacgacgccagcauccagaccagcgcccugagcaacaagacccugacccacggcccccagccccugaccaagagcgugagccuggacagcggcuucagcagcaucugccccaugggcaccugccacgccauccccgcccacugcugcaucugcugccaccaccacccccacugccacggcgagagacagagccccggccccgagcccagcgugugcagacacugccugugcagccugaccggccaccaggaggcccaguucaugaccacccugaaggcccugcaggacaccaccgugagagagcugugcagcugcaccgugcacgagauggaggccaugaagaccaucugccagagcuucagagaguaccuggaggagaucgagcagcaccugaugggccagcaggcccuguucagcagagacaugagcgaggaggagagagaggaggccgagcagcugcagacccugagagaggcccugagacagcagguggccgagcuggaguuccagcugggcgacagagcccagcagaucagagagggcauccugcugcagcuggaggugcugaccgccgagccccccgagcacuacagcaaccugcaccaguacaacuggaucgaggagagcaacggccagaccagcugcagcaagauccaccccggcauggcccccagaaccguguucccccccgacgacggccaggaggcccccugcagcggcggcacccagcuggccgccuucaccccccccacccuggagaacagcaccagaaugagccccagcagcagcgccugggccaagcugggccccaccccccugagcaacugccccgugggcgagaaggacgccgacguguuccuguaa

SEQ ID NO: 14723 - RNA, 1191 nt, Artificial Sequence
  CCDC130__Homo_sapiens__NP_110445
augggcgagagaaagggcgugaacaaguacuacccccccgacuucaaccccgagaagcacggcagccugaacagauaccacaacagccacccccugagagagagagccagaaagcugagccagggcauccugaucaucagauucgagaugcccuacaacaucuggugcgacggcugcaagaaccacaucggcaugggcgugagauacaacgccgagaagaagaaggugggcaacuacuacaccacccccaucuacagauucagaaugaagugccaccugugcgugaacuacaucgagaugcagaccgaccccgccaacugcgacuacgugaucgugagcggcgcccagagaaaggaggagagaugggacauggccgacaacgagcaggugcugaccaccgagcacgagaagaagcagaagcuggagaccgacgccauguucagacuggagcacggcgaggccgacagaagcacccugaagaaggcccugcccacccugagccacauccaggaggcccagagcgccuggaaggacgacuucgcccugaacagcaugcugagaagaagauucagagagaagaagaaggccauccaggaggaggaggagagagaccaggcccugcaggccaaggccagccugaccaucccccuggugcccgagaccgaggacgacagaaagcuggccgcccugcugaaguuccacacccuggacagcuacgaggacaagcagaagcugaagagaaccgagaucaucagcagaagcugguuccccagcgcccccggcagcgccagcagcagcaaggugagcggcgugcugaagaagcuggcccagagcagaagaaccgcccuggccaccagccccaucaccgugggcgaccugggcaucgugagaagaagaagcagagacgugcccgagagcccccagcacgccgccgacacccccaagagcggcgagcccagagugcccgaggaggccgcccaggacagacccaugagccccggcgacugcccccccgagaccaccgagacccccaagugcagcagccccagaggccaggagggcagcagacaggacaagccccugagccccgccggcagcagccaggaggccgccgacacccccgacaccagacaccccugcagccugggcagcagccugguggccgacuacagcgacagcgagagcgaguaa

SEQ ID NO: 14724 - RNA, 351 nt, Artificial Sequence
  CCDC134__Homo_sapiens__NP_001291726
auggaccugcugcaguuccuggccuuccuguucgugcugcugcugagcggcaugggcgccaccggcacccugagaaccagccuggaccccagccuggagaucuacaagaagauguucgaggugaagagaagagagcagcugcuggcccugaagaaccuggcccagcugaacgacauccaccagcaguacaagauccuggacgugaugcugaagggccuguucaaguucauccccagcaccgaccccuuccagaaggcccugagagaggaggagaagagaagaaagaaggaggagaagagaaaggagaucagaaagggccccagaaucagcagaagccagagcgagcuguaa

SEQ ID NO: 14725 - RNA, 1305 nt, Artificial Sequence
  CCDC136__Homo_sapiens__NP_001188301
auggaggccggcgccggcgccggcgccggcgccgccggcuggagcugccccggccccggccccaccgugaccacccugggcagcuacgaggccagcgagggcugcgagagaaagaagggccagagauggggcagccuggagagaagaggcaugcaggccauggagggcgaggugcugcugcccgcccuguacgaggaggaggaggaggaggaggaggaggaggaggagguggaggaggaggaggagcaggugcagaagggcggcagcgugggcagccugagcgugaacaagcacagaggccugagccugaccgagaccgagcuggaggagcugagagcccaggugcugcagcugguggccgagcuggaggagaccagagagcuggccggccagcacgaggacgacagccuggagcugcagggccugcuggaggacgagagacuggccagcgcccagcaggccgagguguucaccaagcagauccagcagcugcagggcgagcugagaagccugagagaggagaucagccugcuggagcacgagaaggagagcgagcugaaggagaucgagcaggagcugcaccuggcccaggccgagauccagagccugagacaggccgccgaggacagcgccaccgagcacgagagcgacaucgccagccugcaggaggaccugugcagaaugcagaacgagcuggaggacauggagagaaucagaggcgacuacgagauggagaucgccagccugagagccgagauggagaugaagagcagcgagcccagcgaggagcugcaggagcugagagagagauaccacuuccugaacgaggaguacagagcccugcaggagagcaacagcagccugaccggccagcuggccgaccuggagagcgagagaacccagagagccaccgagagauggcugcagagccagacccugagcaugaccagcgccgagagccagaccagcgagauggacuuccuggagcccgaccccgagaugcagcugcugagacagcagcugagagacgccgaggagcagaugcacggcaugaagaacaagugccaggagcugugcugcgagcuggaggagcugcagcaccacagacaggugagcgaggaggagcagagaagacugcagagagagcugaagugcgcccagaacgaggugcugagauuccagaccagccacagcgugacccagagcagccccacccccaacccccccaucuucagccugccccuggugggccugguggugaucagcgcccugcuguggugcuggugggccgagaccagcagcuaa

SEQ ID NO: 14726 - RNA, 492 nt, Artificial Sequence
  CCDC140__Homo_sapiens__NP_694583
augggcgacgagugcagcaaccccgaccugcuggccgagcccggcagcagcccccccugggaccacggcaaccagagacaggaggccgccaacgagagcaacaccagagugcccagagugcugaaggcccaccugggccccgagaccgcccagcccaccaagagaagcaagagaaacagauggagaagacagagcugccagggccccagccccgccagaagcggccaguuccugggcagcgccgaccugggccugcagagaggcgugcugaagagcgccgccagaaccugccugagcgagaucagcaacagcaccagagccagccccgagagcgcccagagcaccgaccccggcagagccgccagacccagaaccagaacccugcccaccccccacagcuucaagaucggcgaggaggccgaggagaugaagaagaagaaggagagaaagagaagaaaggagagaaagaaggagagaaacuucaagaaguaa

SEQ ID NO: 14727 - RNA, 4593 nt, Artificial Sequence
  CCDC141__Homo_sapiens__NP_775919
augagcagccagggcagccccagcguggcccugagcaccaccaccgugagcagcguggccgugcaggccggcgacagcaagaucgugaucgccgugaucaagugcggcaagugggugcagcugcagcuggccgagagccagcccaaccugcuggagaucggcagcagccaggacgagaccaagaagcugcugcacgaccacgagcugcugcuggccaagcugaaggcccuggaggacagagugugggagcugcugcaggaggccgacaagaccgccgaggagaacaaggaccagagccagguguacgacgccauggccgagacccugggcgaggccugggccgcccuggugagcaugcuggagagaagaaccgagcugcugagacugaccagcgaguucuucgagaacgcccuggaguucgccaucaagaucgaccaggccgaggacuuccugcagaacacccacgaguucgagagcgccgagagccugaagagccugcugcagcugcacgagcaccacaccaaggagcugcuggagagaagccuggcccugcugaacaagagccagcagcugaccgacuucaucgagaaguucaagugcgagggccccaacgugaaccccgagcugacccagggcgcccacagcagcugccugaagguggacagacugcuggagcugcugcaggacagaagaagacagcuggacaaguaccugaagcagcaguggcaggagcugagccaggugcugcagaucugccagugggaccagcaggagaaccaggugaccugcugguuccagaagaccaucagaaaccugcaggagcagagccugggcagcagccugagcgacaacgaggacagaauccacaagcaggaggagcugaucaucaaggccaaggaguggaacagcgccguggagaagcugaagagcgaggcccugagaauccugcugagcaaggacuacguggagaaggagcaccugcagcugagccaccagaagcugagccagcugcaggaggaguucggccagcugaugguggagagaaacaccuggcugaagaaggccaacgaguucuucaacagcgccaacaaggccuucgacgugcugggcagaguggaggccuaccugaagcugcugaagagcgagggccugagccuggccgugcuggccgugagacacgaggagcugcacagaaagaucaaggacugcaccaccgacgcccugcagaagggccagacccugaucagccagguggacagcugcagcagccaggugagcggcauccacgagaugaugggcugcaucaagagaagaguggaccaccugaccgagcagugcagcgcccacaaggaguacgcccugaagaagcagcagcugaccgccagcguggagggcuaccugagaaagguggagaugagcauccagaagaucagccccgugcugagcaacgccauggacgugggcagcaccagaagcgagagcgagaagauccugaacaaguaccuggagcuggacauccaggccaaggagaccagccacgagcuggaggccgccgccaagaccaugauggagaagaacgaguucgugagcgacgagauggugagccugagcagcaaggccagauggcuggccgaggagcugaaccuguucggccagagcaucgacuacagaagccaggugcugcagaccuacguggccuuccugaagagcagcgaggagguggagaugcaguuccagagccugaaggaguucuacgagaccgagaucccccagaaggagcaggacgacgccaaggccaagcacugcagcgacagcgccgagaagcaguggcagcuguuccugaagaagagcuucaucacccaggaccugggccuggaguuccugaaccugaucaacauggccaaggagaacgagauccuggacgugaagaacgagguguaccugaugaagaacaccauggagaaccagaaggccgagagagaggagcugagccugcugagacuggccuggcagcugaaggccaccgagagcaagcccggcaagcagcagugggccgccuucaaggagcagcugaagaagaccagccacaaccugaagcugcugcaggaggcccugaugcccgugagcgcccuggaccugggcggcagccugcaguucauccuggaccugagacagaaguggaacgacaugaagccccaguuccagcagcugaacgacgaggugcaguacaucaugaaggagagcgaggagcugaccggcagaggcgcccccgugaaggagaagagccagcagcugaaggaccugauccacuuccaccagaagcagaaggagagaauccaggacuacgaggacauccuguacaagguggugcaguuccaccaggugaaggaggagcugggcagacugaucaagagcagagagcuggaguucguggagcagcccaaggagcugggcgacgcccacgacgugcagauccaccugagaugcagccaggagaagcaggccagaguggaccaccugcacagacuggcccugagccugggcguggacaucaucagcagcgugcagagaccccacugcagcaacgugagcgccaagaaccugcagcagcagcuggagcugcuggaggaggacagcaugaaguggagagccaaggccgaggaguacggcagaacccugagcagaagcguggaguacugcgccaugagagacgagaucaacgagcugaaggacagcuucaaggacaucaagaagaaguucaacaaccugaaguucaacuacaccaagaagaacgagaagagcagaaaccugaaggcccugaaguaccagauccagcagguggacauguacgccgagaagaugcaggcccugaagagaaagauggagaaggugagcaacaagaccagcgacagcuuccugaacuaccccagcgacaaggugaacgugcugcuggaggugaugaaggaccugcagaagcacguggacgacuucgacaagguggugaccgacuacaagaagaaccuggaccugaccgagcacuuccaggaggugaucgaggagugccacuucugguacgaggacgccagcgccaccguggugagagugggcaaguacagcaccgagugcaagaccaaggaggccgugaagauccugcaccagcaguucaacaaguucaucgcccccagcgugccccagcaggaggagagaauccaggaggccaccgaccuggcccagcaccuguacggccuggaggagggccagaaguacaucgagaagaucgugaccaagcacaaggaggugcuggagagcgugaccgagcugugcgagagccugaccgagcuggaggagaagcugaagcagggcgacgugcugaagaugaaccccaaccuggaggacuuccacuacgacuacaucgaccugcugaaggagcccgccaagaacaagcagaccaucuucaacgaggagagaaacaagggccaggugcagguggccgaccugcugggcaucaacggcaccggcgaggagagacugccccaggaccugaaggugagcaccgacaaggagggcggcgugcaggaccugcugcugcccgaggacaugcugagcggcgaggaguacgagugcgugagccccgacgacaucagccugcccccccugcccggcagccccgagagcccccuggcccccagcgacauggagguggaggagcccgugagcagcagccugagccugcacaucagcagcuacggcgugcaggccggcaccagcagccccggcgacgcccaggagagcgugcugcccccccccguggccuucgccgacgccugcaacgacaagagagagaccuucagcagccacuucgagagacccuaccugcaguucaaggccgagcccccccugaccagcagaggcuucguggagaagagcaccgcccugcacagaaucagcgccgagcaccccgagagcaugaugagcgaggugcacgagagagcccugcagcagcacccccaggcccagggcggccugcuggagaccagagagaagaugcacgccgacaacaacuucaccaagacccaggacagacugcacgccagcagcgacgccuucagcggccugagauuccagagcggcaccagcagaggcuaccagagacagauggugcccagagaggagaucaagagcaccagcgccaagagcagcguggugagccuggccgaccaggcccccaacuucagcagacugcugagcaacgugaccgugauggagggcagccccgugacccuggagguggaggugaccggcuuccccgagcccacccugaccugguacaagaagggccagaagcugagcgccgacggccaccugcaggugcugcacaaggagaccagacacagcguguucauccccaaggugugcaaggccgacgccggccuguacguggccagagcccagaacagcagcggcgcccugagcagcaacgugauccugcacgugaccggcaacugcagacugcccaucaccagagugaacuggaucacccugugcgugguguacgugagcgugagccugauguacuggcugcugacccaguaa

SEQ ID NO: 14728 - RNA, 1338 nt, Artificial Sequence
  CCDC148__Homo_sapiens__NP_001288613
augaagagaacccuggagaugaacguguucgugacccugcagauccugguggacuucgugaagaagcagcugaagaccguguucgagagacugagacuggagcagcagagaaucgagaacgaccugagcgacuggagcaucaagauccuggaccacagccuggaggagaagaccaacccccugagcgagcugcccaucgagcuggagagccuggagugccccuaccccgaccugaagagcagcauccugagcgaguucuacaaguucacccagaaguaccagaagaagcugcaggacuucaaccugcagcuggaggacaucuacagaaacugccagcugagcgaggaggaccacuggaucuaccaggccauccuggaccaguaccccggcgaccuguucggcagaagaacccuguaccuggacaugcugcagagauacuucccccacaagagcagacacgaccugguggagcacgagaaguacugcgaccaguacagauucgccaucgagcagcagaacauccugaucagcaacuggaacaagaacaagaaggacuucauccagaaggccgugcugacccugaccgaggccugcgccacccacgagauggagagcaugcuggccaaggacaagaagaagcagcaggagcugugcgccgaccugaaggccaaggugagacaguggagagcccaccaggaggagguggccagacuggagauggagaucagcgccagaagaagagagaaggaggaggagaaggagaagcuguggaagaagaaggagcugcugcagagagccgagaagaagaagaagaucaagaaguacugggccaagaagaagcagaaguggcaggagauggagaugagagaccugcagagacuggaggagcugaagaagcugaucgccgagcagagccugaaggacagagagagagugaaguacagacaggagcugcuggagagaagacugauggagaagaaggagguggcccugcaggaggcccacgaggacaaggagagagccagaagacuggaggcccugagaaagcagguggccgugguggcccaguucgaccccgugagaaugaugagcgacaccauggccagcaaggccagaaugggcaucgagaucgaggaggaguucauccugcagaagccccuguucacccugaacaccuacaacgagcagcagaucaucagcgaccccagacugagauucgagcuggcccugagagaggccggccugcacagaacccuguacgccaaggagauccugcccaagaucagcccccagaagccccccagaaaggacauggagagcaccguguucaagaucuaa

SEQ ID NO: 14729 - RNA, 1626 nt, Artificial Sequence
  CCDC151__Homo_sapiens__NP_001289382
augcacccccccguggcccccugcaagaagcugagaugcccccccaccagaagcuucacccccaccagaggcagaagcaaggagggcgacagaaaggccuucuucgagagcagccaguggaacaucaagaagaaccaggagaccaucagccagcugagaaaggagaccaaggcccuggagcugaagcugcuggaccugcugaagggcgacgagaagguggugcaggccgugaucagagaguggaagugggagaagcccuaccugaagaacagaaccggccaggcccuggagcaccuggaccacagacugagagagaaggugaagcagcagaacgcccugagacaccagguggugcugagacagagaagacuggaggagcugcagcugcagcacagccugagacugcuggagauggccgaggcccagaacagacacaccgagguggccaagaccaugagaaaccuggagaacagacuggagaaggcccagaugaaggcccaggaggccgagcacaucaccagcguguaccugcagcugaaggccuaccugauggacgagagccugaaccuggagaacagacuggacagcauggaggccgagguggugagaaccaagcacgagcuggaggcccugcacguggugaaccaggaggcccugaacgccagagacaucgccaagaaccagcugcaguaccuggaggagacccuggugagagagagaaagaagagagagagauacaucagcgagugcaagaagagagccgaggagaagaagcuggagaacgagagaauggagagaaagacccacagagagcaccugcugcugcagagcgacgacaccauccaggacagccugcacgccaaggaggaggagcugagacagagauggagcauguaccagauggaggugaucuucggcaaggugaaggacgccaccggcaccgacgagacccacagccuggugagaagauuccuggcccagggcgacaccuucgcccagcuggagacccugaagagcgagaacgagcagacccuggugagacugaagcaggagaagcagcagcugcagagagagcuggaggaccugaaguacagcggcgaggccacccuggugagccagcagaagcugcaggccgaggcccaggagagacugaagaaggaggagagaagacacgccgaggccaaggaccagcuggagagagcccugagagccaugcagguggccaaggacagccuggagcaccuggccagcaagcugauccacaucaccguggaggacggcagauucgccggcaaggagcuggacccccaggccgacaacuacgugcccaaccugcugggccugguggaggagaagcugcugaagcugcaggcccagcugcagggccacgacgugcaggagaugcugugccacaucgccaacagagaguuccuggccagccuggagggcagacugcccgaguacaacaccagaaucgcccugccccuggccaccagcaaggacaaguucuucgacgaggagagcgaggaggaggacaacgagguggugaccagagccagccugaagaucagaagccagaagcugaucgagagccacaagaagcacagaagaagcagaagaagcuaa

SEQ ID NO: 14730 - RNA, 294 nt, Artificial Sequence
  CCDC167__Homo_sapiens__NP_612502
augaccaagaagaagagagagaaccugggcguggcccuggagaucgacggccuggaggagaagcugagccagugcagaagagaccuggaggccgugaacagcagacugcacagcagagagcugagccccgaggccagaagaagccuggagaaggagaagaacagccugaugaacaaggccagcaacuacgagaaggagcugaaguuccugagacaggagaacagaaagaacaugcugcugagcguggccaucuucauccugcugacccugguguacgccuacuggaccauguaa

SEQ ID NO: 14731 - RNA, 1509 nt, Artificial Sequence
  CCDC169-SOHLH2__Homo_sapiens__NP_001185839
auggagacccugcaggagagccugaacacccugcugaagcagcuggaggaggagaagaagacccuggagagccaggugaaguacuacgcccugaagcuggagcaggagagcaaggccuaccagaagaucaacaacgagagaagaaccuaccuggccgagaugagccagggcagcggccugcaccaggugagcaagagacagcagguggaccagcugcccagaaugcaggagaaccuggugaagacccugcugcugaaggaggagcuggacccccugaaggccaagaucgacauccugcuggugggcgacgugaccgugggcuaccuggccgacaccgugcagaagcuguucgccaacaucgccgaggugaccaucaccaucagcgacaccaaggaggccgccgcccugcuggacgacugcaucuucaacauggugcugcugaaggugcccagcagccugagcgccgaggagcuggaggccaucaagcugaucagauucggcaagaagaagaacacccacagccuguucguguucaucauccccgagaacuucaagggcugcaucagcggccacggcauggacaucgcccugaccgagccccugaccauggagaagaugagcaacguggugaaguacuggaccaccugccccagcaacaccgugaagaccgagaacgccaccggccccgaggagcugggccugccccugcagagaagcuacagcgagcaccugggcuacuuccccaccgaccuguucgccugcagcgagagccugagaaacggcaacggccuggagcugaacgccagccugagcgaguucgagaagaacaagaagaucagccugcugcacagcagcaaggagaagcugagaagagagagaaucaaguacugcugcgagcagcugagaacccugcugcccuacgugaagggcagaaagaacgacgccgccagcgugcuggaggccaccguggacuacgugaaguacaucagagagaagaucagccccgccgugauggcccagaucaccgaggcccugcagagcaacaugagauucugcaagaagcagcagacccccaucgagcugagccugcccggcaccgugauggcccagagagagaacagcgugaugagcaccuacagccccgagagaggccugcaguuccugaccaacaccugcuggaacggcugcagcacccccgacgccgagagcagccuggacgaggccgugagagugcccagcagcagcgccagcgagaacgccaucggcgaccccuacaagacccacaucagcagcgccgcccugagccugaacagccugcacaccgugagauacuacagcaaggugacccccagcuacgacgccaccgccgugaccaaccagaacaucagcauccaccugcccagcgccaugccccccgugagcaagcugcugcccagacacugcaccagcggccugggccagaccugcaccacccaccccaacugccugcagcaguucugggccuacuaa

SEQ ID NO: 14732 - RNA, 2148 nt, Artificial Sequence
  CCDC170__Homo_sapiens__NP_079335
augagccuggacugcaccagccacaucgcccugggcgccgccagccccgcccccgaggagaccuacgaccaccugagcgaggugcccgugaccagagagcagcugaaccacuacagaaacguggcccagaacgccagaagcgagcuggccgccacccuggugaaguucgagugcgcccagagcgagcugcaggaccugagaagcaagaugcugagcaaggaggugagcugccaggagcugaaggccgagauggagagcuacaaggagaacaacgccagaaagagcagccugcugaccagccugagagacagagugcaggagcuggaggaggagagcgccgcccugagcaccagcaagaucagaaccgagaucaccgcccacgccgccaucaaggagaaccaggagcugaagaagaaggugguggagcugaacgagaagcugcagaagugcagcaaggagaacgaggagaacaagaagcaggugagcaagaacugcagaaagcacgaggaguuccugacccagcugagagacugccuggaccccgacgagagaaacgacaaggccagcgacgaggaccugauccugaagcugagagaccugagaaaggagaacgaguucgugaagggccagaucgugauccuggaggagaccaucaacgugcacgagauggaggccaaggccagcagagagaccaucaugagacuggccagcgaggugaacagagagcagaagaaggccgccagcugcaccgaggagaaggagaagcugaaccaggaccugcugagcgccguggaggccaaggaggcccuggagagagaggugaagaucuuccaggagagacugcuggccggccagcaggugugggacgccagcaagcaggaggugagccugcugaagaagagcagcagcgagcuggagaagagccugaaggccagccaggacgccgugaccaccagccagagccaguacuucagcuucagagagaagaucgccgcccugcugagaggcagacugagcaugaccggcagcaccgaggacaccauccuggagaagaucagagagauggacagcagagaggagagcagagacagaauggugagccagcuggaggcccagaucagcgagcugguggagcagcugggcaaggagagcggcuuccaccagaaggcccugcagagagcccagaaggccgagaacaugcuggagacccugcagggccagcugacccaccuggaggccgagcuggugagcggcggcgugcugagagacaaccugaacuucgagaagcagaaguaccugaaguuccuggaccagcugagccagaagaugaagcuggaccagauggccgccgagcugggcuucgacaugagacuggacguggugcuggccagaaccgagcagcuggugagacuggagagcaacgccgugaucgagaacaagaccaucgcccacaaccugcagagaaagcugaagacccagaaggagagacuggagagcaaggagcugcacaugagccugcugagacagaagaucgcccagcuggaggaggagaagcaggccagaaccgcccuggugguggagagagacaacgcccaccugaccaucagaaaccugcagaagaagguggagagacugcagaaggagcugaacaccugcagagaccugcacaccgagcugaaggccaagcuggccgacaccaacgagcugaagaucaagacccuggagcagaccaaggccaucgaggaccugaacaagagcagagaccagcuggagaagaugaaggagaaggccgagaagaagcugaugagcgugaagagcgagcuggacaccaccgagcacgaggccaaggagaacaaggagagagccagaaacaugaucgagguggugaccagcgagaugaagacccugaagaagagccuggaggaggccgagaagagagagaagcagcuggccgacuucagagagguggugagccagaugcugggccugaacgugaccagccuggcccugcccgacuacgagaucaucaagugccuggagagacuggugcacagccaccagcaccacuucgugaccugcgccugccugaaggacgugaccaccggccaggagagacacccccagggccaccugcagcugcugcacuaa

SEQ ID NO: 14733 - RNA, 3981 nt, Artificial Sequence
  CCDC171__Homo_sapiens__NP_775821
augaaccugaacaccagcagcaacaccggcgacacccagagacugaagaucgccagccuggacgugaagcagauccugaagaacgagaccgagcuggacaucaccgacaaccugagaaagaagcugcacugggccaagaaggagaagcuggagaucaccaccaagcacaacgccgagcuggccagcuacgagagccagaucgccaagcugagaagcgagguggagaagggcgaggcccugagacagagccuggaguacgaccuggccguggccagaaaggaggccggccugggcagaagagccgccgaggagagacuggccgaggcccacagaauccaggagaagcugugcgcccagaacagcgagcugcaggccaagaccaacgagaccgagaaggccuuccagaccagccagcagaaguggaaggaggagugcagaagauucgagcacgaccuggaggagagagacaacaugauccagaacugcaacagagaguacgaccugcugaugaaggagaagagcagacuggagaagacccugcaggaggcccuggagaagcaccagagagagaagaacgagauggagagccacaucagagagaccgcccuggaggaguucagacugcaggaggagcagugggaggccgagagaagagagcugcaguucaucgugcaggagcaggacaccgccgugcagaacaugcacaagaagguggagaagcuggagaccgagcacauggacugcagcgaccugcugagaagacagaccagcgagcuggaguucagcacccagagagaggagagacugagaaaggaguucgaggccaccacccugagagugagaaagcuggaggagaacaucgaggccgagagagccgcccaccuggagagcaaguucaacagcgagaucauccagcugagaaucagagaccuggagggcgcccugcagguggagaaggccagccaggccgaggccguggccgaccuggagaucaucaagaacgaguucaaggagguggagagcgccuacgagagagagaagcacaacgcccaggagagcuucgccaagcugaaccugcuggagaaggaguacuucagcaagaacaagaagcugaacgaggacaucgaggagcagaagaaggugaucaucgaccugagcaagagacugcaguacaacgagaagagcugcagcgagcugcaggaggagcuggugauggccaagaagcaccaggccuuccugguggagaccugcgagaacaacgugaaggagcuggagagcauccuggacagcuucaccgugagcggccaguggaccagcggcauccacaaggacaaggacaagccccccagcuucagcguggugcuggagagacugagaagaacccugaccgacuaccagaacaagcuggaggacgccagcaacgaggagaaggccugcaacgagcuggacagcaccaagcagaagaucgacagccacaccaagaacaucaaggagcugcaggacaagcuggccgacgugaacaaggagcugagccaccugcacaccaagugcgccgacagagaggcccugaucagcacccugaagguggagcugcagaacgugcugcacugcugggagaaggagaaggcccaggccgcccagagcgagagcgagcugcagaagcugagccaggccuuccacaaggacgccgaggagaagcugaccuuccugcacacccuguaccagcaccugguggccggcugcgugcugaucaagcagcccgagggcaugcuggacaaguucagcuggagcgagcugugcgccgugcugcaggagaacguggacgcccugaucgccgaccugaacagagccaacgagaagaucagacaccuggaguacaucugcaagaacaagagcgacaccaugagagagcugcagcagacccaggaggacaccuucaccaagguggccgagcagaucaaggcccaggagagcugcuggcacagacagaagaaggagcuggagcugcaguacagcgagcuguuccuggaggugcagaagagagcccagaaguuccaggagaucgccgagaagaacauggagaagcugaaccacaucgagaagagccacgagcagcuggugcuggagaacagccacuucaagaagcugcugagccagacccagagagagcagaugagccugcuggccgccugcgcccugauggccggcgcccuguacccccuguacagcagaagcugcgcccugagcacccagagagacuuccugcaggagcaggugaacaccuucgagcuguucaagcuggagaucagaacccuggcccaggcccugagcaccguggaggagaagaagcaggaggaggccaagaugaagaagaagaccuucaagggccugaucagaaucuucagaaagggcgugaucgccgugcuggccgccaacagacugaagauccugggccagagcugcgccagccuguucaccuggauggagagcuucaaggagggcaucggcaugcuggugugcaccggcgagccccaggacaagcacaaguuccccaagcaccagaaggagcagcugagaugccugcaggcccugagcuggcugaccagcagcgaccugcuggccgccaucaucagcagcauggccgagcugcaggacgugaucggcaaggccgaccccaacagcagaaucugcggccaccugcugaucggcgccgccaagaacagcuucgccaagcugauggacaagaucagccuggugauggagugcaucccccugcacagcagcagaagcaucaccuacguggagaaggacagccuggugcagagacuggcccacggccugcacaaggugaacacccuggcccugaaguacggccugagaggccacgugcccaucaccaagagcaccgccagccugcagaagcagauccugggcuucacccagagacugcacgccgccgagguggagagaagaagccugagacuggaggugaccgaguucaagagaagcgugaacgagaugaagaaggagcuggacaaggcccagggccugcagaugcagcugaacgaguucaagcagagcaagcugaucacccacgagaaguucgagagcgccugcgaggagcugaacaacgcccugcugagagaggagcaggcccagaugcugcugaacgagcaggcccagcagcugcaggagcugaacuacaagcuggagcugcacagcagcgaggaggccgacaagaaccagacccugggcgaggccgugaagagccugagcgaggccaagauggagcugagaagaaaggaccagagccugagacagcugaacagacaccugacccagcuggagcaggacaagagaagacuggaggagaacauccacgacgccgagagcgcccugagaauggccgccaaggacaaggagugcguggccaaccacaugagagccguggagaacacccugcacaaggugagagaccagaucagccugagcuggagcgccgccagcagaaacgacuucacccugcagcugcccaagcugcaccuggagaccuucgccauggagggccugaagggcggccccgaggugguggccugccaggccaugaucaagagcuucauggacguguaccagcuggccagcaccagaaucaugacccuggagaaggagaugaccagccacagaagccacaucgccgcccugaagagcgagcugcacaccgccugccugagagagaacgccagccugcagagcaucggcagcagagaccacagcaaccugagcauccccagcagagccccccugcccgccgacaccaccggcaucggcgacuuccugccccugaaggccgagcuggacaccaccuacaccuuccugaaggagaccuucaucaacaccgugccccacgcccugaccagcagccacagcagccccgugaccaugagcgccaacgccaacagacccacccagaucggccuguaa

SEQ ID NO: 14734 - RNA, 2382 nt, Artificial Sequence
  CCDC175__Homo_sapiens__NP_001157871
auggcccugagccccuggacccccggccugggcgccggcgagaagcuggugcaggccgccgccgugagcaccggccccagccuggagcugugcacccugcccagcacccugggcagcagcguggccguggaggcccuggagcagcuguucgugguggagcagagccugcagagcgacuacuucaagugcaacgaggaggccaagaucuuccugaaggacaucgccguggccgugaagaagcuggaggagaugagaaaggccaccaucgaccugcuggagaucgagagcauggagcugaacaagcuguacuaccugcuggagacccugcccaacagcaucaagagagagcuggaggagugcgugagagacgccagaagacugaaccuguucgagaucaacaccaucaagaugagaaucaccagaaccgagaacgagaucgagcugcugaagaagaagaucaccgaccugaccaaguacaacgaggcccugggcgagaagcaggaggagcuggccagaaagcacgccagauucgugcugagccugaaccagaccauggagaagaaggccaccaccaccguguacaucaacgagaccuacaccaagaucaaccugaagagagaggacaucgcccugcagaagaagugcauccaggaggccgaggagcugauggagaaggagagagccgaguaccugaucagaaagcaggagcugaccgcccagaucaacgaguucgagaacaccagagaggugaagagaauggagaccuaccagaagaagaaggagcuggacaagcugcagaccaagaugagcaagaucaaggagaccgugaccgugagcgccgccgugcugagcgaccacaaccuggagaucgccagacugcacgagagcaucagauacugggagcaggaggugagcgagcugaagaaggaccuggccauccuggaggccaagcugugcuucuucaccgacaacaaggagaagcuggacgacaucagcaacgacgagaagaacgaguuccugaacaagaucaagcagcugguggagacccugcacgccgccagaauggaguacaaggaccugagagagaagaugaagacccuggccagacaguacaagaucgugcugagcgaggaggagaaggccuuccugcagaagcagaagauccacgacgagaaccagaagcagcugaccuucaucagccagaaggaguacuuccugagccagaagagaguggacaucaagaacauggaggagggccugaucacccugcaggagcugcagcaggccaccaagaccguguaccagcagcagaucaagauccugagcgccaaccuggagagagagagccagagaugcgugaucacccaguggaagauggccugccugagaaagaagcacgccagauggaccgccaagaucaaggccgagauccaggccaucaccgagaagauccagaacgccgaggugagaagaaucgagcugcugaacgagaccagcuucagacagcaggagaucagcggcuucguggcccagaucgagaagcugaccaccgagcugaaggaggaggagaaggccuucgugaacaaggagaagaugcugaugaaggagcugagcaaguacgaggagaucuucgugaaggagacccagaucaacaaggagaaggaggaggagcugguggaguaccugccccagcugcagguggccgagcaggaguacaaggagaagagaagaaagcuggaggagcugagcaacaucaucaccgcccagagacaggaggaggaccugcugaacaaccacaucuuccuguucaccagagacuucagcagauacaucagcaacauggaggacgugaagcaggagcugcagcagcugagagaccaggagagcaagaagaacaaggaccacuucgagacccugaagaaccuggagaacggcuucuacaucaacgaccagaaggccgaccugcugcugcuggagaacaagaagcugaaggaguacauccuguaccugaagaacaacaucgagaaguacagagagggccaggaggcccugaugcacaccagcagcgaccugagcagacagcugaucgcccaggaggcccaguacaaggaccugugggccgaguuccagaccaccgugaagauccugguggacaacggcgaggagacccugcaggacaucaacaaccugaccgacaagcugagagagagagacgagaagaugcagcacgugagcaccuggcugagaggcagccuggagggccugagacugcugguggagcaggagagccccauggaccugcugaagaagaagaagcacaucagaaccagagugcacuuccccguggugaagugcaccgagaagaacacccugaccaaguaa

SEQ ID NO: 14735 - RNA, 1590 nt, Artificial Sequence
  CCDC176__Homo_sapiens__NP_079333
augcccagcaagggcaaggacaagaagaagggcaagagcaagggcaaggacaccaagaagcugaucaagaccgacgagagcgugguggacagagccaaggccaacgccagccugugggaggccagacuggaggugaccgagcugagcagaaucaaguacagagacaccagcagaauccuggccaagagcaacgaggaccugaagaagaagcagugcaagauggagaaggacaucaugagcgugcugagcuaccugaagaagcaggaccaggagaaggacaacaugaucgagaagcugaagcagcagcugaacgagaccaaggagaaggcccaggaggagaaggacaagcuggagcagaaguacaccagacagaucaacgagcuggagggccaguuccaccagaaggccaaggagaucggcaugauccacaccgagcugaaggccgugagacaguuccagaagagaaagauccagguggagagagagcuggacgaccugaaggagaaccugagaaacaccgagagaauccaccaggagacccugagaagacuggagagcagauucuucgaggagaagcacagacuggagcaggaggccgagaagaagaucaucaugcuggccgagagagcccaccacgaggccaucgugcagcugaacgacgccggcagaaacguguucaaggagaacgacuaccugcagaaggcccuggccuaccaccugaaggagaccgacgcccugcagaagaacagccagaagcugcaggagagccacacccugcugcugcaccagaaggagaucaacgaccugcuggugaaggagaagaucaugcagcuggugcagcagagaagccagauccagacccugcagaagaagguggugaaccuggagaccgcccugagcuacaugaccaaggaguucgagagcgaggugcugaagcugcagcagcacgccaugaucgagaaccaggccggccagguggagaucgacaagcugcagcaccugcugcagaugaaggacagagagaugaacagagugaagaagcuggccaagaacauccuggacgagagaaccgagguggagagauucuuccuggacgcccugcaccaggugaagcagcagauccugaucagcagaaagcacuacaagcagaucgcccaggccgccuucaaccugaagaugagagccgccugcaccggcagaaccgaguaccccaagaucagaaccuucgacggcagagagcacagcaccaacagcgugaaccaggaccugcuggaggccgagaaguggacccacaucgagggcaacguggacaucggcgaccugaccugggagcagaaggagaaggugcugagacugcuguucgccaagaugaacggcugccccagcagaaaguacaaccagagcagcagaccccccgugcccgacuacguggugagcgacagcggcgagaccaaggaguucggcgacgagagcaagcugcaggacaagaucuucaucacccagcagaucgccaucagcgacagcagcggcgagguggugcugcccaccauccccaaggagccccaggagagcgacaccggcaccuucuaa

SEQ ID NO: 14736 - RNA, 2604 nt, Artificial Sequence
  CCDC178__Homo_sapiens__NP_001098998
augaccgagaacaagaccgugagcagcagcagcaccagagacgaccagaccaacaucggccugaccugccaggaggugaaggcccugagagagaaggccuggagcagaaccaacgagggcaacgccaugagccagagccuggugcuguacggcgccagcaaggagaacagcgagggcuuccacgagagcaagaugaccaacaccgagggcgugaacaagggcaucuacuucagcuaccccugcagaagacacagcugcgccguggugaacauccccgcccccugcgugaacaagaugaucagccacauccaggacguggagagcaagauccaggagcaccugaagagauucgagaccagcuucgaggaguggagcagaaccagcagcaccaaggaccugaaggaggacuggagcgugaccacccccgugaaggaggugaagcccggcgagaagagagacgagaagugccccgagcugaagcaggagauggagacccugcugagcgaggccaucagacugaucaagagccuggagaccgacagagccgacgccgaggaggcccugaagcagcagagaagcagaaagaacaugaucaacaugaagaucgacagcuggagcguguggaagcugcaggagcugccccuggccgugcagaaggagcacgaggccuaccugagcgacgugaucgagcugcaguggcaccuggaggacaaggccaaccagcugcagcacuucgagaagcagaagaccgagcuggaggaggccaacgccaagauccaggccgacaucgacuacaugaacgagcacggcccccugcuggacagcaagcagaaccaggagcugcaggaccugaagaaccacuacaagaagaagauggaggugauggaccugcacagaaaggugaacgaggagcuggaggaggcccuggaggccugcgagaacgccagacugaaggcccagcagaucaaggaggagaucgacaaggacaucuaccaggacgagaagaccaucgaggccuacaagagagagaucuaccagcugaacagccuguucgaccacuacagcagcagcgugaucaacgugaacaccaacaucgaggagaaggaggaggaggugaccgaggccaucagagagaccaagagcagcaagaacgagcugcacagccugagcaagaugcuggaggaccugagaagaguguacgaccagcugaccuggaagcagaagagccacgagaaccaguaccuggaggccgugaacgacuucuacgccgccaagaagaccugggacaucgagcugagcgacguggccaaggacuucagcgccaucagccuggccugcaccaagcugaccgaggacaacaagaagcuggagaucgacaucaacaagaucaccgugaagaccaacgagagcaucagaaagaagagcaaguacgagagcgagaucaaguaccugaccaucaugaagcugaagaacgacaagcaccugaagaacaucuacaaggaggccuacagaaucggcacccuguuccaccugaccaagcacaagaccgacgagauggaggacaagaucgccgaggugagaagaaaguucaagggcagagaggaguuccugaagaagcugacccagggcgagguggccgccggcauggugcugcagaagaagcuguacagcaucuacgaggugcaggcccuggagagaaaggagcugaucaagaacagagccaucugcgccaugagccuggccgagcugcaggagccccugcugcagcuggaggacgaggccgagagaaucagaagccuggacaaggagcacagcgugaugcugaacaacaucaucgaccagaaggaccugaucagaagaaaggugggcaaggugaagaagaagcugagaaagaagggcaagaagacccuggacgcccugaucgagaccgagagcaagagaagcgccaucuucaaggaccuggaggccaccaagagcaagaccaugaucuucuacgccaagaucaacgagcugaacgaggagcugaaggccaaggaggaggagaagaagagcuucgaccagacccuggagauccugaagaacaaguucaucaccaugagauucaagagagagcacgcccagaccguguucgaccacuacaugcaggagaagaaggacugcgaggagagaaucuucgaggaggaccagagauucagagugcugcuggccgugagacagaagacccugcaggacacccagaagaucaucgccgacagccuggaggagaaccugagacuggcccaggaguaccagcagcugcagaucaccuuccugaaggagaaggacaacuacuucaacaucuacgacaagcagcugagccuggacaccagcaucagagacaagaagcagcugugccagcugcagagaagaaugcacacccuguggcaggagcacuucaagcugguggugcuguucagccagaugagacuggccaacuuccagaccgacagccaggagagcauccagaagauccuggccgugcaggaggagagcagcaaccugaugcagcacauccugggcuucuuccagacccugaccgacggcaccugcgagaacgacggcuaa

SEQ ID NO: 14737 - RNA, 5106 nt, Artificial Sequence
  CCDC180__Homo_sapiens__NP_065944
augagaggcggcgagaacagaccccccgccagagugcagagcagcagcgaggagcuggagcugagacaccagagccuggacgccuuccccggcagaagacugcccggcagaggcauccagcccgccgccaagaugagcagcgugggcaaggugacccaggugcccaacggcaaggccuaccagcagaucuuccaggccgaggugcagcuggugcacagccuggccgccaccagaaagagagccgccgagagaagcgugacccugaagagcggcagaauccccaugaugaagaagguggagacccccgagggcgaggugaugagccccagacagcagaaguggaugcacagccugcccaacgacuggaucauggagaaccccgugcugcacagagagaaggagagagccaagagagagaaggccagagagagcgagaacaccaucgccgccagagaggugagaggccugauggacaccaucgugcccgagaagaucagcaccagcaccuuccagagacaggccgagcacaagagaaagagcuacgagagcgcccuggccagcuuccaggaggagaucgcccaggugggcaaggagauggagccccugaucguggacaccggcggccuguuccugaagaagcugaccgagagcgacgaggagaugaacagacuguuccugaagguggagaacgacaccaaccuggaggacuacaccauccaggcccugcuggagcugugggacaagguggccggcagacugcugcugagaaagcaggagaucaaggagcuggacgaggcccugcacagccuggaguucagcagaaccgacaagcugaagagcgugcugaagaaguacgccgaggugaucgagaagaccagcuaccugaugagacccgagguguacagacugaucaacgaggaggccauggugaugaacuacgcccugcugggcaacagaaaggcccuggcccagcuguucgugaaccugauggagagcacccugcagcaggagcuggacagcagacacagauggcagggccugguggacaccuggaaggcccugaagaaggaggcccugcugcagagcuucagcgaguucauggccagcgagagcauccacaccccccccgccgugaccaaggagcuggaggugaugcugaagacccagaacgugcugcagcagagaagacugaagcaccugugcaccaucugcgaccugcugccccccagcuacagcaagacccagcugaccgaguggcacagcagccugaacagccugaacaaggagcuggacaccuaccacguggacugcaugaugagaaucagacugcuguacgagaagaccuggcaggagugccugaugcacgugcagaacugcaagaagcagcugcuggacuggaaggccuucaccgaggaggaggccgagacccuggugaaccaguucuucuuccagauggugggcgcccugcagggcaagguggaggaggaccuggagcugcuggacaagagcuucgagacccuggccgaccagaccgaguggcagagcagccaccuguucaaguacuuccaggagguggugcagcugugggaggcccaccagagcgagcugcuggugcaggagcuggagcuggagaagagaauggagcagcacagacagaagcacagccuggagagccaggugcaggaggcccaccuggacagacugcuggaccagcugagacagcagagcgacaaggagacccuggccuuccaccuggagaaggugaaggacuaccugaagaacaugaagagcagauacgagugcuuccacacccugcugaccaaggaggugauggaguaccccgccaucaugcugaaggagcugaacagcuacagcagcgcccugagccaguacuucuucgugagagagaucuucgagcagaaccuggccggcgaggugaucuucaaguucagacagcccgaggcccacgagaagcccagccagaagagagugaagaagcugagaaagaagcagggcagcaaggaggacaugaccagaagcgaggagagcaucagcagcggcaccagcaccgccagaagcguggaggagguggaggaggagaacgaccaggagauggagagcuucaucaccgaggaggugcugggccagcagaagaagagcccccugcacgccaagauggacgagagcaaggagggcagcauccagggccuggaggagaugcagguggagagagagggcagccugaaccccagccugaacgaggagaacgugaagggccagggcgagaagaaggaggagagcgaggaggaggacgagaaggaggaggaggaggaggaggagaagcuggaggaggagaaggaggagaaggaggcccaggaggagcaggagagccugagcgugggcgaggaggaggacaaggaggagggccuggaggagaucuacuacgaggacauggagagcuucaccaucagcagcggcaacaccuacuucguguucgugccccuggaggaggagcacugcagaaagagccacagcaccuucagcgccauguucaucaacgacaccagcagcgccaaguucaucgagcaggugaccauccccagcagacugauccuggagaucaagaagcagcugagagccggcuucuucgagcaccuggagaagugguucgaccagugcagccugaacaccagagugaccguggccaccaagaucaacgagcuggacagcgagcuggagcugcaccugcaccugcaccagcccagagcccagcagaucgagaaggacauccacaacgugagagccgccgagcugcugcugcaccaggagcagcuggacagccacugcgccggcgugaccgagacccugaagaagaagagacugauguucugccaguuccaggaggagcagaacgugagaagcaagaacuucagacugaagaucuacgacauggagcacaucuuccugaacgccaccagaagccagaagcuggugacccugagcaacacccugcaccaggagcugcugagcuacguggacgugacccaggugagccugagaagcuucagacaguaccuggaggagagccugggcaagcugagauacagcaacaucgaguucaucaagcacugcagacuguucagcgagggcggcaacuucagccccaaggagaucaacagccugugcagcagacuggagaaggaggccgccagaaucgagcugguggagagcgugaucaugcugaacauggagaagcuggagaacgaguaccuggaccaggccaacgacgugaucaacaaguucgagagcaaguuccacaaccugagcguggaccugaucuucaucgagaagauccagagacugcugaccaaccugcaggugaagaucaagugccagguggccaagagcaacagccagaccaacggccugaacuucagccugcagcagcugcagaacaagaucaagaccugccaggagagcagaggcgagaagaccaccgugaccaccgaggagcugcugagcuucgugcagaccuggaaggagaagcugagccagagaauccaguaccugaacugcagccuggacagagugagcaugaccgagcugguguucaccaacaccauccugaaggaccaggaggaggacagcgacauccugaccagcagcgaggcccuggaggaggaggccaagcuggacguggugacccccgagagcuucacccagcugagcagagugggcaagccccugaucgaggaccccgccguggacgugaucagaaagcugcugcagcugcccaacaccaaguggcccacccaccacugcgacaaggaccccagccagaccggcagaggcgccugggccugcggcagcagaggcagcagcgaggccggcgccggcggcgccgugugcagcccccccgugcugugcagcugccccggccccagcagccccaagggcuucaagagacacagaugccagcccgagaacagcggcaagaaggccgugcccagcgccagcgccaccagcgccggcagcuucaccccccaccccaagcccaacaagauggagagaaaguacagagugcugggcgacaagcccccccccgccgccgaggacuucaagggcaucauccugacccugcugugggagagcagcgagaaccugcugaccguggccgaggaguucuacagaaaggagaagagacccgugaccagacccgacugcaugugcgacaccuucgaccagugcgccgagaacaucagcaagaagauccuggaguaccagagccaggccaacaaguaccacaacagcugccugaucgagcugagaauccagaucagaagauucgaggagcugcugccccaggugugcuggcuggugauggagaacuucaaggagcaccacuggaagaaguucuucaccagcgugaaggagaucagaggccaguucgaggagcagcagaagagacuggagaagagaaaggacaagaacgcccagaagcugcaccugaaccugggccaccccgugcacuuccaggagauggagagccugcaccugagcgaggaggagagacaggaggagcuggacagcaugaucagaaugaacaaggagaagcuggaggagugcaccagaagaaacggccagguguucaucaccaaccuggccaccuucaccgagaaguuccugcugcagcuggacgagguggugaccaucgacgacgugcagguggccagaauggagccccccaagcagaagcugagcaugcugaucagaagaaagcuggccggccugagccugaaggaggagagcgagaagccccugaucgagagaggcagcagaaaguggcccggcaucaagcccaccgaggugaccauccagaacaagauccugcugcagcccaccagcagcaucagcaccaccaagaccacccugggccaccuggccgccguggaggccagagacgccguguaccugaaguaccuggccagcuucgaggaggagcugaagagaauccaggacgacugcaccagccagaucaaggaggcccagagauggaaggacagcuggaagcagagccugcacaccauccagggccuguacguguaa

SEQ ID NO: 14738 - RNA, 1527 nt, Artificial Sequence
  CCDC181__Homo_sapiens__NP_067002
augaacgagaacaaggacaccgacagcaagaagagcgaggaguacgaggacgacuucgagaaggaccuggaguggcugaucaacgagaacgagaagagcgacgccagcaucaucgagauggccugcgagaaggaggagaacaucaaccaggaccugaaggagaacgagaccgugauggagcacaccaagagacacagcgaccccgacaagagccugcaggacgaggugagccccagaagaaacgacaucaucagcgugcccggcauccagccccuggaccccaucagcgacagcgacagcgagaacagcuuccaggagagcaagcuggagagccagaaggaccuggaggaggaggaggacgaggaggugagaagauacaucauggagaagaucgugcaggccaacaagcugcugcagaaccaggagcccgugaacgacaagagagagagaaagcugaaguucaaggaccagcugguggaccuggaggugcccccccuggaggacaccaccaccuucaagaacuacuucgagaacgagagaaacauguucggcaagcugagccagcugugcaucagcaacgacuucggccaggaggacgugcugcugagccugaccaacggcagcugcgaggagaacaaggacagaaccauccugguggagagagacggcaaguucgagcugcugaaccugcaggacaucgccagccagggcuuccugccccccaucaacaacgccaacagcaccgagaacgacccccagcagcugcugcccagaagcagcaacagcagcgugagcggcaccaagaaggaggacagcaccgccaagauccacgccgugacccacagcagcaccggcgagccccuggccuacaucgcccagcccccccugaacagaaagaccugccccagcagcgccgugaacagcgacagaagcaagggcaacggcaagagcaaccacagaacccagagcgcccacaucagccccgugaccagcaccuacugccugagccccagacagaaggagcugcagaagcagcuggaggagaagagagagaagcugaagagagaggaggagagaagaaagaucgaggaggagaaggagaagaagagagagaacgacaucguguucaaggccuggcugcagaagaagagagagcaggugcuggagaugagaagaauccagagagccaaggagaucgaggacaugaacagcagagagaacagagacccccagcaggccuucagacuguggcugaagaagaagcacgaggagcagaugaaggagagacagaccgaggagcugagaaagcaggaggagugccuguucuuccugaagggcaccgagggcagagagagagccuucaagcaguggcugagaagaaagagaauggagaagauggccgagcagcaggccgugagagagagaaccagacagcugagacuggaggccaagagaagcaagcagcugcagcaccaccuguacaugagcgaggccaagcccuucagauucaccgaccacuacaacuaa

SEQ ID NO: 14739 - RNA, 1872 nt, Artificial Sequence
  CCDC185__Homo_sapiens__NP_689823
auggccggcuucagccacuucagccagccccccuacagagaccugugggagccccccagacccggcggcgagagagagagcacccagagacugggcggccagagaagcggcgccgacagcaccgccugcagcagagccggcacccccggcgccgagagcgaggccggcgccugcuggcugcacccccacugcagcuucacccccagacccagaagaagaggcugcagcgacagccugagaggcagcagaagccugagcgacguggccagaagaccccuggagagaagcagaaagcacagacccagaagcagaagacuggaggacgccuggggcgagaccggcaccaagcccagacccgccuggcagccccagacccagcugcccccccagagaccccagcccugcccccacuacccccuggcccagggcgacagccccccccccugccccggcggcgccggcaccccccugagcggcaccuucagaguggagaaggcccagggcggcgaccagugggccgugccccugggcagacaccugggcagauggagccccagcagcgugcccagcgagagaagcagcgugcccagccagaaguucaagagacacagcgccugcgugugcgcccagaagagagacagcagcgaccagguggagagccuggccagcagagacagccagccccuggccagcagcaaggagaugagaagcccccacacccaggugcugaagagcaagcuggaggaggugguggugagcagccaggaccagcagaucguggcccuggugcugaccagacugaagaaggcccagagaaucagagagcugcagcagcaggccgccaaggccugggaggagcugaagagaagcgaccagaaggugcagaugacccuggagagagagagaagacugcugcugagacagagccaggagcaguggcaggagaaggagcagagaaagacccugcagagccccgagcagagaggccugagaagagacagccagagaaagaacgugccccccggcgagagcagauggaaggagcagcccgaggaccaggagagccccagacaggagaagcuggagaaggccagagcccaggccgagcacagaaagcagugccaggugagaagacugagagagcaggagaagaugcugagaaaccugagagagcagcacagccugcagcugcagagaagacugguggaggccugcagaaagagacaccugcacgccguggagggccagaagaaggugcaggacaccaaccugagcagccugaucaacuaccaggccagaaaggugcugauggacugccaggccaaggccgaggagcugcugagacagcugagccuggagcagagcuuccagagaagccaggagauccaccagggccugagaaaggagagacagagagagcugagagagaaggcccagaaggaggaggagcagcugcagcaggccagauggagagccggcgagagcgaggagcagagaaagaugagaaagagaauccugguggagcuggccgacgagaagaucagacaggccagaagccacgugcacaagaccaccagagacaaggugcagcaccugagagagcugaaccaccugagagagaagaaccaccacauccugaagcugaaggccgagaaggaggagaagugccacaucgagggcaucaaggaggccaucaagaagaaggagcagagagugcagcacaucagccagggcaaggaccccaacuuccaggaguuccagaagcugccccaggccagcagaagagaggagagagccccccccaacagcagccuggaccagauggugcuggaggcccagcugagagccugccagcagaacagaggcuacuaa

SEQ ID NO: 14740 - RNA, 1884 nt, Artificial Sequence
  CCDC22__Homo_sapiens__NP_054727
auggaggaggccgacagaauccugauccacagccugagacaggccggcaccgccgugccccccgacgugcagacccugagagccuucaccaccgagcuggugguggaggccguggugagaugccugagagugaucaaccccgccgugggcagcggccugagcccccugcugccccuggccaugagcgccagauucagacuggccaugagccuggcccaggccugcauggaccugggcuacccccuggagcugggcuaccagaacuuccuguaccccagcgagcccgaccugagagaccugcugcuguuccuggccgagagacugcccaccgacgccagcgaggacgccgaccagcccgccggcgacagcgccauccugcugagagccaucggcagccagaucagagaccagcuggcccugcccugggugcccccccaccugagaacccccaagcugcagcaccugcagggcagcgcccugcagaagcccuuccacgccagcagacugguggugcccgagcugagcagcagaggcgagcccagagaguuccaggccagcccccugcugcugcccgugcccacccaggugccccagcccgugggcagaguggccagccugcuggagcaccacgcccugcagcugugccagcagaccggcagagacagacccggcgacgaggacugggugcacagaaccagcagacugcccccccaggaggacaccagagcccagagacagagacugcagaagcagcugaccgagcaccugagacagagcuggggccugcugggcgcccccauccaggccagagaccugggcgagcugcugcaggccuggggcgccggcgccaagaccggcgcccccaagggcagcagauucacccacagcgagaaguucaccuuccaccuggagccccaggcccaggccacccaggugagcgacgugcccgccaccagcagaagacccgagcaggugaccugggccgcccaggagcaggagcuggagagccugagagagcagcuggagggcgugaacagaagcaucgaggagguggaggccgacaugaagacccugggcgugagcuucgugcaggccgagagcgagugcagacacagcaagcugagcaccgccgagagagagcaggcccugagacugaagagcagagccguggagcugcugcccgacggcaccgccaaccuggccaagcugcagcuggugguggagaacagcgcccagagagugauccaccuggccggccagugggagaagcacagagugccccugcuggccgaguacagacaccugagaaagcugcaggacugcagagagcuggagagcagcagaagacuggccgagauccaggagcugcaccagagcgugagagccgccgccgaggaggccagaagaaaggaggagguguacaagcagcugaugagcgagcuggagacccugcccagagacgugagcagacuggccuacacccagagaauccuggagaucgugggcaacaucagaaagcagaaggaggagaucaccaagauccugagcgacaccaaggagcugcagaaggagaucaacagccugagcggcaagcuggacagaaccuucgccgugaccgacgagcugguguucaaggacgccaagaaggacgacgccgugagaaaggccuacaaguaccuggccgcccugcacgagaacugcagccagcugauccagaccaucgaggacaccggcaccaucaugagagaggugagagaccuggaggagcagaucgagaccgagcugggcaagaagacccugagcaaccuggagaagaucagagaggacuacagagcccugagacaggagaacgccggccugcugggcagagugagagaggccuaa

SEQ ID NO: 14741 - RNA, 825 nt, Artificial Sequence
  CCDC28A__Homo_sapiens__NP_056254
augcccagagccgagcccagagccacccugggcgagcaggagaaggccggccugccccugggcgccuggagacuguaccugcugagacacuucagaaagcagaccgagcugagaagaagcggcagcagagacgugaccggcgcccugcugguggccgccgccguggccagcgaggccgugggcagccugagaguggccgagggcggccccaacacccugcugcugcaggugcugagaagcuggcccuggugcaacaaggagcugaagaccauggaggagagaaaggugaagagaagaagccccaagagcuucagcgcccacugcacccagguggugaacgccaagaagaacgccauccccgugagcaagagcaccggcuucagcaaccccgccagccagagcaccagccagagacccaagcugaagagagugaugaaggagaagaccaagccccagggcggcgagggcaagggcgcccagagcacccccauccagcacagcuuccugaccgacgugagcgacgugcaggagauggagagaggccugcugagccugcugaacgacuuccacagcggcaagcugcaggccuucggcaacgagugcagcaucgagcagauggagcacgugagaggcaugcaggagaagcuggccagacugaaccuggagcuguacggcgagcuggaggagcugcccgaggacaagagaaagaccgccagcgacagcaaccuggacagacugcugagcgaccuggaggagcugaacagcagcauccagaagcugcaccuggccgacgcccaggacgugcccaacaccagcgccagcuaa

SEQ ID NO: 14742 - RNA, 2826 nt, Artificial Sequence
  CCDC39__Homo_sapiens__NP_852091
augagcagcgaguuccuggccgagcugcacugggaggacggcuucgccauccccguggccaacgaggagaacaagcugcuggaggaccagcugagcaagcugaaggacgagagagccagccugcaggacgagcugagagaguacgaggagagaaucaacagcaugaccagccacuucaagaacgugaagcaggagcugagcaucacccagagccugugcaaggccagagagagagagaccgagagcgaggagcacuucaaggccaucgcccagagagagcugggcagagugaaggacgagauccagagacuggagaacgagauggccagcauccuggagaagaagagcgacaaggagaacggcaucuucaaggccacccagaagcuggacggccugaagugccagaugaacugggaccagcaggcccuggaggccuggcuggaggagagcgcccacaaggacagcgacgcccugacccugcagaaguacgcccagcaggacgacaacaagaucagagcccugacccugcagcuggagagacugacccuggagugcaaccagaagagaaagauccuggacaacgagcugaccgagaccaucagcgcccagcuggagcuggacaaggccgcccaggacuucagaaagauccacaacgagagacaggagcugaucaagcagugggagaacaccaucgagcagaugcagaagagagacggcgacaucgacaacugcgcccuggagcuggccagaaucaagcaggagaccagagagaaggagaaccuggugaaggagaagaucaaguuccuggagagcgagaucggcaacaacaccgaguucgagaagagaaucagcguggccgacagaaagcugcugaagugcagaaccgccuaccaggaccacgagaccagcagaauccagcugaagggcgagcuggacagccugaaggccaccgugaacagaaccagcagcgaccuggaggcccugagaaagaacaucagcaagaucaagaaggacauccacgaggagaccgccagacugcagaagaccaagaaccacaacgagaucauccagaccaagcugaaggagaucaccgagaagaccaugagcguggaggagaaggccaccaaccuggaggacaugcugaaggaggaggagaaggacgugaaggagguggacgugcagcugaaccugaucaagggcgugcuguucaagaaggcccaggagcugcagaccgagaccaugaaggagaaggccgugcugagcgagaucgagggcaccagaagcagccugaagcaccugaaccaccagcugcagaagcuggacuucgagacccugaagcagcaggagaucauguacagccaggacuuccacauccagcagguggagagaagaaugagcagacugaagggcgagaucaacagcgaggagaagcaggcccuggaggccaagaucguggagcugagaaagagccuggaggagaagaagagcaccugcggccugcuggagacccagaucaagaagcugcacaacgaccuguacuucaucaagaaggcccacagcaagaacagcgacgagaagcagagccugaugaccaagaucaacgagcugaaccuguucaucgacagaagcgagaaggagcuggacaaggccaagggcuucaagcaggaccugaugaucgaggacaaccugcugaagcuggaggugaagagaaccagagagaugcugcacagcaaggccgaggaggugcugagccuggagaagagaaagcagcagcuguacaccgccauggaggagagaaccgaggagaucaaggugcacaagaccaugcuggccagccagaucagauacguggaccaggagagagagaacaucagcaccgaguucagagagagacugagcaagaucgagaagcugaagaacagauacgagauccugaccguggugaugcugccccccgagggcgaggaggagaagacccaggccuacuacgugaucaaggccgcccaggagaaggaggagcugcagagagagggcgacugccuggacgccaagaucaacaaggccgagaaggagaucuacgcccuggagaacacccugcaggugcugaacagcugcaacaacaacuacaagcagagcuucaagaaggugacccccagcagcgacgaguacgagcugaagauccagcuggaggagcagaagagagccguggacgagaaguacagauacaagcagagacagaucagagagcugcaggaggacauccagagcauggagaacacccuggacgugaucgagcaccuggccaacaacgugaaggagaagcugagcgagaagcaggccuacagcuuccagcugagcaaggagaccgaggagcagaagcccaagcuggagagagugaccaagcagugcgccaagcugaccaaggagaucagacugcugaaggacaccaaggacgagaccauggaggagcaggacaucaagcugagagagaugaagcaguuccacaaggugaucgacgagaugcugguggacaucaucgaggagaacaccgagaucagaaucauccugcagaccuacuuccagcagagcggccuggagcugcccaccgccagcaccaagggcagcagacagagcagcagaagccccagccacaccagccugagcgccagaagcagcagaagcaccagcaccagcaccagccagagcagcaucaaggugcuggagcugaaguuccccgccagcagcagccuggugggcagccccagcagacccagcagcgccagcagcagcagcagcaacgugaagagcaagaagagcagcaaguaa

SEQ ID NO: 14743 - RNA, 438 nt, Artificial Sequence
  CCDC3__Homo_sapiens__NP_001269587
auggacgagaacuacaaccugcugccccacggcgugaacuuccaggacgccaucuuccccgacacccaggagaacagaagaauguucagcagccuguuccaguucagcaacugcagccagggccagcagcuggccaccuucagcagcgacugggagauccaggaggacagcagacugaugugcagcagcgugcagaaggcccuguucgaggaggaggaccacgugaagaagcugcagcagaagguggccacccuggagaagagaaacagacagcugagagagagagugaagaaggugaagagaagccugagacaggccagaaagaagggcagacaccuggagcuggccaaccagaagcugagcgagaagcuggccgccggcgcccugccccacaucaacgccagaggccccgugagaccccccuaccugagaggcuaa

SEQ ID NO: 14744 - RNA, 3093 nt, Artificial Sequence
  CCDC40__Homo_sapiens__NP_001230271
auggccgagcccggcggcgccgccggcagaagccaccccgaggacggcagcgccagcgagggcgagaaggagggcaacaacgagagccacauggugagcccccccgagaaggacgacggccagaagggcgaggaggccgugggcagcaccgagcaccccgaggaggugaccacccaggccgaggccgccaucgaggagggcgagguggagaccgagggcgaggccgccguggagggcgaggaggaggccgugagcuacggcgacgccgagagcgaggaggaguacuacuacaccgagaccagcagccccgagggccagaucagcgccgccgacaccaccuaccccuacuucagccccccccaggagcugcccggcgaggaggccuacgacagcgugagcggcgaggccggccugcagggcuuccagcaggaggccaccggcccccccgagagcagagagagaagagugaccagccccgagcccagccacggcgugcugggccccagcgagcagaugggccaggugaccagcggccccgccgugggcagacugaccggcagcaccgaggagccccagggccaggugcugcccaugggcgugcagcacagauucagacugagccacggcagcgacaucgagagcagcgaccuggaggaguucgugagccaggagcccgugaucccccccggcgugcccgacgcccaccccagagagggcgaccugcccguguuccaggaccagauccagcagcccagcaccgaggagggcgccauggccgagagaguggagagcgagggcagcgacgaggaggccgaggacgagggcagccagcugguggugcuggaccccgaccacccccugauggugagauuccaggccgcccugaagaacuaccugaacagacagaucgagaagcugaagcuggaccugcaggagcuggugguggccaccaagcagagcagagcccagagacaggagcugggcgugaaccuguacgaggugcagcagcaccuggugcaccugcagaagcugcuggagaagagccacgacagacacgccauggccagcagcgagagaagacagaaggaggaggagcugcaggccgccagagcccuguacaccaagaccugcgccgccgccaacgaggagagaaagaagcuggccgcccugcagaccgagauggagaaccuggcccugcaccuguucuacaugcagaacaucgaccaggacaugagagacgacaucagagugaugacccagguggugaagaaggccgagaccgagagaaucagagccgagaucgagaagaagaagcaggaccuguacguggaccagcugaccaccagagcccagcagcuggaggaggacaucgcccuguucgaggcccaguaccuggcccaggccgaggacaccagaauccugagaaaggccgugagcgaggccugcaccgagaucgacgccaucagcguggagaagagaagaaucaugcagcagugggccagcagccuggugggcaugaagcacagagacgaggcccacagagccgugcuggaggcccugagaggcugccagcaccaggccaagagcaccgacggcgagaucgaggccuacaagaagagcaucaugaaggaggaggagaagaacgagaagcuggccagcauccugaacagaaccgagaccgaggccacccugcugcagaagcugaccacccagugccugaccaagcagguggcccugcagagccaguucaacaccuacagacugacccugcaggacaccgaggacgcccugagccaggaccagcuggagcagaugauccugaccgaggagcugcaggccaucagacaggccauccagggcgagcuggagcugagaagaaagaccgacgccgccaucagagagaagcugcaggagcacaugaccagcaacaagaccaccaaguacuucaaccagcugauccugagacugcagaaggagaagaccaacaugaugacccaccugagcaagaucaacggcgacaucgcccagaccacccuggacaucacccacaccagcagcagacuggacgcccaccagaagacccugguggagcuggaccaggacgugaagaaggugaacgagcugaucaccaacagccagagcgagaucagcagaagaaccauccugaucgagagaaagcagggccugaucaacuuccugaacaagcagcuggagagaauggugagcgagcugggcggcgaggaggugggcccccuggagcuggagaucaagagacugagcaagcugaucgacgagcacgacggcaaggccgugcaggcccaggugaccuggcugagacugcagcaggagauggugaaggugacccaggagcaggaggagcagcuggccagccuggacgccagcaagaaggagcugcacaucauggagcagaagaagcugagaguggagagcaagaucgagcaggagaagaaggagcagaaggagaucgagcaccacaugaaggaccuggacaacgaccugaagaagcugaacaugcugaugaacaagaacagaugcagcagcgaggagcuggagcagaacaacagagugaccgagaacgaguucgugagaagccugaaggccagcgagagagagaccaucaagaugcaggacaagcugaaccagcugagcgaggagaaggccacccugcugaaccagcugguggaggccgagcaccagaucaugcugugggagaagaagauccagcuggccaaggagaugagaagcagcguggacagcgagaucggccagaccgagaucagagccaugaagggcgagauccacagaaugaagaaguacugcagaaccacccaggacgcccacagacacgugcacgagcagcacggcacccacgccggcaccugcaccaagaacaccggcagagcccaggccagagccagaaccaccagagacgccagaggccacgugcacgagcagcacggcaccagagccggcaccugcaccaacaacaccggcagagcccaggccagagccagaaccagagacgccagaagacacgugcacgagcacagaacccacaccgccagagccuaa

SEQ ID NO: 14745 - RNA, 927 nt, Artificial Sequence
  CCDC42B__Homo_sapiens__NP_001138344
auggccgugcccugggaggaguacuucagacuggcccugcaggagaagcugagcaccaagcugcccgagcaggccgaggaccacgugccccccgugcugagacugcuggagaagagacaggagcugguggacgccgaccaggcccugcaggcccagaaggagguguucagaaccaagaccgccgcccugaagcagagaugggagcagcuggagcagaaggagagagagcugaagggcagcuucaucagauucgacaaguuccugcaggacagcgaggccagaagaaacagagcccugagaagagccgccgaggagagacaccaggccggcagaagagagguggaggcccugagacuguggacccagcugcaggagcugagaagagagcacgccagacugcagagaagacugaagagacuggagcccugcgccagacugcuggagcaggcccuggagcugcugcccggcuuccaggaggugcccgagcugguggccagauucgacggccuggccgagacccaggccgcccugagacugagagagagagagcagcuggccgagcuggaggccgccagagccagacugcagcagcugagagacgccuggcccgacgaggugcuggcccagggccagagaagagcccagcugcaggagagacuggaggccgccagagagagaacccugcagugggagagcaaguggauccagauccagaacaccgccgccgagaagacccugcugcugggcagaagcagaauggccgugcugaaccuguuccagcuggugugccagcaccagggccagccccccacccuggacaucgaggacaccgagggccagcuggagcacgugaagcuguucaugcaggaccugagcgccaugcuggccggccugggccaggccgagcccgccgcccccgccagcuaa

SEQ ID NO: 14746 - RNA, 729 nt, Artificial Sequence
  CCDC42__Homo_sapiens__NP_001151733
augagccugggcaucauggaggaggaggaccuggccgaguacuucagacugcaguacggcgagagacugcugcagaugcugcagaagcugcccaacguggagggcgccagcgagagccccagcaucuggcugcuggagaagaagaaggagaccgagaucaugcaccagaccauggugcagaagaagaagauguuccagagaagaauggagacccugaaccugagaugggaggagcugggcgugaaggaggcccagcugaaggcccacauccagaagagcgagcaguucauccaggagaacgaccagaagagaaucagagccaugaagaaggccaacaaggagagagagcugaagugccagcacaugcaggagcugaccaagagaaagcaggagaugguggcccugagacuggagcaccagagacugagcgccaagcugaaggacuacuacaucuucaacaaguaccuggagaaggugguggagaacagcgaggagagcagaugggcccacauccagaacaccgccgccaagaagacccugcugcugggcaccaucaagauggccacccugaaccuguuccagaucgugagcaagcaccugaaggaggugaccgagguggcccuggaggacacccacaagcagcuggacaugauccagcaguucauccaggacagaagcgacaucugggccgaggugaagaagaaggagcagcagagagugagaaucuaa

SEQ ID NO: 14747 - RNA, 921 nt, Artificial Sequence
  CCDC50__Homo_sapiens__NP_777568
auggccgaggugagcaucgaccagagcaagcugcccggcgugaaggaggugugcagagacuucgccgugcuggaggaccacacccuggcccacagccugcaggagcaggagaucgagcaccaccuggccagcaacgugcagagaaacagacuggugcagcacgaccugcagguggccaagcagcugcaggaggaggaccugaaggcccaggcccagcugcagaagagauacaaggaccuggagcagcaggacugcgagaucgcccaggagauccaggagaagcuggccaucgaggccgagagaagaagaauccaggagaagaaggacgaggacaucgccagacugcugcaggagaaggagcugcaggaggagaagaagagaaagaagcacuuccccgaguuccccgccaccagagccuacgccgacagcuacuacuacgaggacggcggcaugaagcccagagugaugaaggaggccgugagcacccccagcagaauggcccacagagaccaggagugguacgacgccgagaucgccagaaagcugcaggaggaggagcugcuggccacccagguggacaugagagccgcccagguggcccaggacgaggagaucgccagacugcugauggccgaggagaagaaggccuacaagaaggccaaggagagagagaagagcagccuggacaagagaaagcaggaccccgaguggaagcccaagaccgccaaggccgccaacagcaagagcaaggagagcgacgagccccaccacagcaagaacgagagacccgccagaccccccccccccaucaugaccgacggcgaggacgccgacuacacccacuucaccaaccagcagagcagcaccagacacuucagcaagagcgagagcagccacaagggcuuccacuacaagcacuaa

SEQ ID NO: 14748 - RNA, 987 nt, Artificial Sequence
  CCDC54__Homo_sapiens__NP_115989
auguacacccugcacaccaagagagugaaggccgccgccagacagauguggaccagcaaccugagcaaggugagacagagccugaagaacguguaccacaagugcaagaucagacaccaggacagcaccggcuaccccaccgugaccagcgacgacugcaaccaggacgacgacagcuacgacggcaagaugaaccugcccguggugcugcaggacgugaagaccgcccagguggagcuguucagccagaugaccgacaucgugcacaugauccccaaggugcaggagaagaccgaccuguaccagaagcagauggaggugcuggagaccagaaugaacgugaacgaggacaagcagugcaccaccaccaaggacauccugagcaugaaggaggacaucaaggcccugaagaagaaggugaccgagcuggagauccagaacagcugcagcaccauccacugccuggagauccuggagggcgagagaggcaaggagaucaccgagcugcuguacaagcugauccagcccgccacccugaagaacacccuggccagcaccgacauggagaucagcagcgccgagcccgagaaggugcccagcuaccccaagagcaccgaccaccuggagaagaagaccaucagcccccagaugaagacccugaagaagagaaaccaccagaacgccagcagaagcuucgagaaggccaagcccaacaucuacaucuaccccgacuucagcaccuggaucaagcugaccuucgugcacggcggcaaguggaccuucuuccugagcgccaccaagcuggaggaguucauccaguggcugcugagcagacccaccauccugcccgaggagccccaggugaucacccagagauacugccccuucaccggccccauccugagccugaccaccaucugccugagcaucuucaacaacaucuacggcuucaucugcagccugaaggaggaggugaccagacuguaa

SEQ ID NO: 14749 - RNA, 1653 nt, Artificial Sequence
  CCDC60__Homo_sapiens__NP_848594
augaccaaggugcccgccaccaagaagcugcagagcagccccaacagcggcgccgugagacccuucuacgccagcgagaaccugagacaggugcccgacaagcccaugaagagcaucaaguacauggacaaggagaucaucaaccugaagaaggaccugaucagaagcagauuccugauccagagcgugaagaucggcagaggcuacuucgccauccugagagaggagaccgccaagaagaagaagcagcagcagcugcagaagcugaaggaggaggagagaaacaaguuccagcccgccgagaagaucagcgagauccacuacggcgacacccugcugagcaccuacgacgacgagaagcugaagacccugggcgccagagugaccagaagacccuucacccccauccacagcugcaucaucagccccagccugaccgaggcccacguggagccccuguucagacagcugugcgcccugcacuggcugcuggaggcccugaccaucgaccacacccaccacaccaugaagcccgugaucaccugcuggaaccccaaggaccccggcggcagcaagagcaccaucaagaagaucaacaaggacaagagcaugggccagaagugggagcacuucaucaccgcccccaagaccaagaaguucaagauccccaccaugagagugaccaacagaaagcccagcagaagaggcagcacccugagccugagcagagccagcggcggcagcagcccccagagcagcaugaucagcgugaaccccggcagcgacgagccccccagcgugaacacccaggugaccagcagcaaggacaucgaggacaacgagagcagcagcaccaagcccgacgaggagccccuguacaugaaccugcagaagcugcuggagauggugagagaggacgccagaagaaccgugaccaucgagaacggcaugcagagaaaggcccccagcauccugagcgugcugaagcagaacaagagcaacagcgccuacaaggagaugcagaccacccugaagagcagcgagagaagcagcagcaccagcgccgagagccacauccagcccgugcagaagaagagcaagaacagaaccaacugcgacaucaacauccacuacaagagcggcgugugcaacaccaugagagccaaguucuacagcguggcccaggaggccggcuucugccugcaggacaagauggagauccugaugaagagacaggaggagagaggcauccagaaguucagagccuucgugcuggugagcaacuuccagaaggacaucgccaagaugagacaccacaucagcguggugaagggcgacgccgaggagaucgccgaccacugguacuucgaccugcugagcaagcugcccgaggaccugaagaacuucagacccgccaagaagauccuggugaagcugcagaaguucggcgagaaccuggaccugagaaucagaccccacgugcugcugaaggugcugcaggaccugagaaucugggagcugugcagccccgacaucgccguggccaucgaguucgugagagagcacaucauccacaugccccaggaggacuacaucagcuggcugcagagcagaaucaacauccccaucggccccuacagcgcccugagauaa

SEQ ID NO: 14750 - RNA, 2055 nt, Artificial Sequence
  CCDC62__Homo_sapiens__NP_958843
augaacccccccgccgccuuccuggccggcagacagaacaucggcagcgagguggagaucagcaccaucgagaagcagagaaaggagcugcagcugcugaucggcgagcugaaggacagagacaaggagcugaacgacaugguggccgugcaccagcagcagcugcugagcugggaggaggacagacagaaggugcugacccuggaggagagaugcagcaagcuggagggcgagcugcacaagagaaccgagaucaucagaagccugaccaagaaggugaaggcccuggagagcaaccagauggagugccagaccgcccugcagaagacccagcugcagcugcaggagauggcccagaaggccacccacagcagccugcugagcgaggaccuggaggccagaaacgagacccugagcaacacccugguggagcugagcgcccaggugggccagcugcaggccagagagcaggcccugaccaccaugaucaagcugaaggacaaggacaucaucgaggccgugaaccacaucgccgacugcagcggcaaguucaagaugcuggagcacgcccugagagacgccaagauggccgagaccugcaucgugaaggagaagcaggacuacaagcagaagcugaaggcccugaagaucgaggugaacaagcugaaggaggaccugaacgagaagaccaccgagaacaacgagcagagagaggagaucaucagacugaagcaggagaagagcugccugcacgacgagcugcuguucaccguggagagagagaagagaaaggacgagcugcugaacaucgccaagagcaagcaggagagaaccaacagcgagcugcacaaccugagacagaucuacgugaagcagcagagcgaccugcaguuccugaacuucaacguggagaacagccaggagcugauccagauguacgacagcaagauggaggagagcaaggcccuggacagcagcagagacaugugccugagcgaccuggagaacaaccaccccaagguggacaucaagagagagaagaaccagaagagccuguucaaggaccagaaguucgaggccaugcuggugcagcagaacagaagcgacaagagcagcugcgacgagugcaaggagaagaagcagcagaucgacaccguguucggcgagaagagcgugaucacccugagcagcaucuucaccaaggaccugguggagaagcacaaccugcccuggagccugggcggcaagacccagaucgagcccgagaacaagaucacccugugcaagauccacaccaagagccccaagugccacggcaccggcgugcagaacgagggcaagcagcccagcgagacccccacccugagcgacgagaagcaguggcacgacgugagcguguaccugggccugaccaacugccccagcagcaagcaccccgagaagcuggacguggagugccaggaccagauggagagaagcgagaucagcugcugccagaagaacgaggccugccugggcgagagcggcaugugcgacagcaagugcugccaccccagcaacuucaucaucgaggcccccggccacaugagcgacguggaguggaugagcaucuucaagcccagcaagaugcagagaaucgugagacugaagagcggcugcaccugcagcgagagcaucugcggcacccagcacgacagccccgccagcgagcugaucgccauccaggacagccacagccugggcagcagcaagagcgcccugagagaggacgagaccgagagcagcagcaacaagaagaacagccccaccagccugcugaucuacaaggacgcccccgccuucaacgagaaggccagcaucgugcugcccagccaggacgacuucagccccaccagcaagcugcagagacugcuggccgagagcagacagauggugaccgaccuggagcugagcacccugcugcccaucagccacgagaaccugaccggcagcgccaccaacaagagcgaggugcccgaggagagcgcccagaagaacaccuucgugagcuacuaa

SEQ ID NO: 14751 - RNA, 1692 nt, Artificial Sequence
  CCDC63__Homo_sapiens__XP_011536303
augagcgugcugaagaagaacagaagaaaggacagcgacaccccccaggagcccagcgagaaggccaaggagcagcaggccgaggccgagcugagaaagcugagacagcaguucagaaagaugguggagagcagaaagagcuucaaguucagaaaccagcagaagaucgccagccaguacaaggagaucaagacccugaagaccgagcaggacgagaucacccugcugcugagccugaugaagagcagcagaaacaugaacagaagcgagaagaacuacauggagcugagacugcugcugcagaccaaggaggacuacgaggcccugaucaagagccugaaggugcugcuggccgagcuggacgagaagauccugcagauggagaagaagaucgccaaccagaagcagaucuucgccaagaugcaggaggccaacaaccccagaaagcugcagaagcagauccacauccuggagaccagacugaaccuggugaccgugcacuucgacaagaugcugaccaccaacgccaagcugagaaaggagaucgaggaccugagauucgagaaggccgccuacgacaacguguaccagcagcugcagcacugccugcugauggagaagaagaccaugaaccuggccaucgagcagagcagccaggccuacgagcagagaguggaggccauggccagaauggccgccaugaaggacagacagaagaaggacaccagccaguacaaccuggagaucagagagcuggagagacuguacgcccacgagagcaagcugaagagcuuccugcuggugaagcugaacgacagaaacgaguucgaggagcaggccaagagagaggaggcccugaaggccaagaagcacgugaagaagaacagaggcgagagcuucgagagcuacgagguggcccaccugagacugcugaagcuggccgagagcggcaaccugaaccagcugaucgaggacuuccuggccaaggaggagaagaacuucgccagauucaccuacgugaccgagcugaacaacgacauggagaugaugcacaagagaacccagagaauccaggacgagaucauccugcugagaagccagcagaagcugagccacgacgacaaccacagcgugcugagacagcuggaggacaagcugagaaagaccaccgaggaggccgacauguacgagagcaaguacggcgaggugagcaagacccuggaccugcugaagaacagcguggagaagcuguucaagaagaucaacugcgacgccaccaagauccuggugcagcugggcgagaccggcaaggugaccgacaucaaccugccccaguacuucgccaucaucgagaagaagaccaacgaccugcugcugcuggagaccuacagaagaauccuggagguggagggcgccgaggccgagauccccccccccuucaucaaccccuucuggggcggcagcgcccugcugaagccccccgagcccaucaaggugaucccccccgugcugggcgccgaccccuucagcgacagacuggacgacguggagcagccccuggaccacagcagccugagacagcuggugcuggacaacuacauccugaaggagaacagaagcaaggaggugagaggcgacagccugcccgagaagguggacgacuucagaagcagaaagaaggugaccauguaa

SEQ ID NO: 14752 - RNA, 1455 nt, Artificial Sequence
  CCDC65__Homo_sapiens__NP_149115
augcccaagaaggagaagauggccaagaccccccugagcgacgagaagcagcugcugcuguuccagcagaagcugcuggccgaggaggagauggccaagaagaaggagagacugcugagccaguuccugaaggacaagcuggccaaggaggagcacaacagcgcccugaaccugaacaagaucaacacccaguggagaaccgugcugagagaggugaagaccagagagcugcacaaggacaucgagauccugagccagaccuucgagagagugguggacugcaaggacaacgugaucaagagccuggccaaggaccugagcgaggccgaggagcaguacgcccacgcccugagaagccaccugcacaacguggaccagcugcuggcccugcagagacacagacugagccugcuggaggagagcuacaacauggagcuggaggcccugaccaaggaguucgagaccgagagaaagaccaucaucgaccagcacgagaaggagauccacuaccugcaggacaucuucauggccauggagcagaacuacaucgacagcgaguacgagagcaagcuggaguuccagagcauguggaacgaccugaagaacaugaaccuggaggagaagcacuuccugagacugcaccuggagaacagaguggaggaccuguggagaaaguuccaggacgugcugaagaacuacaccgacgccaccgaggacagaaaggccgccuucgagacccugcaggugaaggacgagaagagcagcaaggagaucgaggugcagaugaagaagauccagaagcugcaggacgccaucaccaucagcaagggcaagaucaugauccacagcagagagagcgaggacgagaacagauacaucagaaacgacaaggagcuggugcuggugcagcugagaaagcugaaggcccagagaacccaggccagagccgccagccagaagaaccuggugagacugacccuggagagcaacgccacccugaaggcccugagaaagaucguggacaagggcgagaagauccugaagcuggccgagaucugcagaaaguucgagaccgaggaggagaaggugcugcccuucuacagcagcgugcugacccccaaggagcaggagggcauccagaagaacaaccuggaggagcugaccgaggagcugaccaaggugaugguggacuacaucggcauggagaacuucuggaagagauacaacaaggugaagcuggagcagcugagccugcagcacagaagagcccagcugcuggacaucaacggcaagcugagagagaugcugaagcaguaccuggacggcaucagcgugagcgacgaggugcugagccagcugaacccccuguucaucgugaacuaccagagcaaccugcugcagccccugagcaucagaaucgcccaccccggcgacaagcagcaccccaccaccuaa

SEQ ID NO: 14753 - RNA, 2745 nt, Artificial Sequence
  CCDC66__Homo_sapiens__NP_001012524
augggcaacaaggccaagaucgccaagugcccccugagaaccaagaccggccacauccugaagagcacccaggacaccugcaucggcagcgagaagcugcugcagaagaagcccgugggcagcgagaccagccaggccaagggcgagaagaacggcaugaccuucagcagcaccaaggaccugugcaagcagugcaucgacaaggacugccugcacauccagaaggagaucagccccgccacccccaacaugcagaagaccagaaacaccgugaacaccagccuggugggcaagcagaagccccacaagaagcacaucaccgccgagaacaugaagagcagccuggugugccugacccaggaccagcugcagcagauccugaugaccgugaaccagggcaacagaagccugagccugaccgagaacggcaaggaggccaagagccaguacagccuguaccugaacagcaucagcaaccagcccaaggacgagaacaucaugggccuguucaagaagaccgagauggugagcagcgugcccgccgagaacaagagcgugcugaacgagcaccaggagaccagcaagcagugcgagcagaagaucgccaucgagaacgaguggaagcccgccgacaucuucagcacccugggcgagagagagugcgacagaagcagccuggaggccaagaaggcccaguggagaaaggagcuggacgagcagguggcccugaagaagaaggagaaggaggugagcgagaaguggaacgaccccuggaagaagagcgagagcgacaagaucaucugggagaagcaccagauccuggaccagagcagagagaccgugcugcuggagcaccccuucagcgccgugaagcaggagcugcagagaaaguggaucgaggagcugaacaagcagaucgaggacgacagacagagaaagaucgaggagaagaucaucuacagcaagggcgaggagcacgacagaugggccaugcacuucgacagccugaagagcuaccccggcagccagagccagcuguucagccagagcacccacaagcagcccgaguacuucugcgugagccccgacacccaggagcuggccgacgugagcagcgugugcacccccaccaccggcagccagguggagcccagcgaggaggagcacaucgccaagcccaucaaggacguggugauggccaacagcaagaagaccaacuuccugagaagcaugaccgcccugcuggaccccgcccagaucgaggagagagacagaagaagacagaagcagcuggagcaccagaaggccaucaccgcccagguggaggagaagagaagaaagaagcagcuggaggaggagcagagaaagaaggaggagcaggaggaggagcugagacuggcccaggagagagaggagaugcagaagcaguacgaggaggacauccugaagcagaagcagaaggaggagaucaugacccugaagaccaacgagcuguuccagaccaugcagagagcccaggagcuggcccagagacugaagcaggagcagagaaucagagagcuggcccagaagggccacgacaccagcagacugaucaagaaccugggcguggacaccauccagauggaguacaacgccagcaacaucagcaacagcagacacgacagcgacgagaucagcggcaagaugaacaccuacaugaacagcaccaccagcaagaaggacaccggcgugcagaccgacgaccugaacaucggcaucuucaccaacgccgagagccacugcggcagccugauggagagagacaucaccaacugcagcagccccgagaucagcgccgagcugaucggccaguucagcaccaagaagaacaagcaggagcugacccaggacaagggcgccagccuggagaaggagaacaacagaugcaacgaccagugcaaccaguucaccagaaucgagaagcagaccaagcacaugaagaaguaccccaagagacccgacuggaacaucaacaagccccccaagagauacauccccgccagcgagaaguaccccaagcagcugcagaagcagagagaggagaagaaggugagaagacagauggagcugcugcaccugguggagaagaacaaccccggccaccugagccagaacagaggcaucagccccgagaucuuccacagcagccaccaggagaccgagagcaagcugagauggcaccuggugaagaaggaggaggagccccugaacauccacagcuucagcaaggagagaagccccagcagccccgugcccguggugaagaacagaacccagcagacccagaacacccugcaccugccccugaagaacagcagcuacgagagagagaaccugaucagcggcagcaaccagaccgagcugagcagcggcaucagcgagagcagccacuucauccccuacgugagaaccaacgagaucuacuaccuggaccccgacgccccccugagcggccccagcacccaggacccccaguaccagaacagccaggacugcggccagaagagacagcuguucgacagcgacugcgugagagacccccugcugaaccccaacauggugaagaacagagacagacagcaggccauccugaagggccugagcgagcugagacagggccugcugcagaagcagaaggagcuggagagcagccugcugccccuggccgagaaccaggaggagagcuucggcagcagcuucuaa

SEQ ID NO: 14754 - RNA, 1815 nt, Artificial Sequence
  CCDC67__Homo_sapiens__NP_857596
auggagaaccaggcccacaacaccaugggcaccagccccugcgaggccgagcugcaggagcugauggagcagaucgacaucauggugagcaacaagaagauggacugggagagaaagaugagagcccuggagaccagacuggaccugagagaccaggagcuggccaacgcccagaccugccuggaccagaagggccaggaggugggccugcugagacagaagcuggacagccuggagaagugcaaccuggccaugacccagaacuacgagggccagcugcagagccugaaggcccaguucagcaagcugaccaacaacuucgagaagcugagacugcaccagaugaagcagaacaaggugcccagaaaggagcugccccaccugaaggaggagauccccuucgagcugagcaaccugaaccagaagcuggaggaguucagagccaagagcagagagugggacaagcaggagauccuguaccagacccaccugaucagccuggacgcccagcagaagcugcugagcgagaagugcaaccaguuccagaagcaggcccagagcuaccagacccagcugaacggcaagaagcagugccuggaggacagcagcagcgagauccccagacugaucugcgaccccgaccccaacugcgagaucaacgagagagacgaguucaucaucgagaagcugaagagcgccgugaacgagaucgcccugagcagaaacaagcugcaggacgagaaccagaagcugcugcaggagcugaagauguaccagagacagugccaggccauggaggccggccugagcgaggugaagagcgagcugcagagcagagacgaccugcugagaaucaucgagauggagagacugcagcugcacagagagcugcugaagaucggcgagugccagaacgcccagggcaacaagaccagacuggagagcagcuaccugcccagcaucaaggagcccgagagaaagaucaaggagcuguucagcgugaugcaggaccagcccaaccacgagaaggagcugaacaagaucagaagccagcugcagcagguggaggaguaccacaacagcgagcaggagagaaugagaaacgagaucagcgaccugaccgaggagcugcaccagaaggagaucaccaucgccaccgugaccaagaaggccgcccugcuggagaagcagcugaagauggagcuggagaucaaggagaagaugcuggccaagcagaaggugagcgacaugaaguacaaggccgugagaaccgagaacacccaccugaagggcaugaugggcgaccuggaccccggcgaguacaugagcauggacuucaccaacagagagcagagcagacacaccagcaucaacaagcugcaguacgagaacgagagacugagaaacgaccuggccaagcugcacgugaacggcaagagcaccuggaccaaccagaacaccuacgaggagaccggcagauacgccuaccagagccagaucaagguggagcagaacgaggagagacugagccacgacugcgagcccaacagaagcaccaugcccccccugccccccagcaccuuccaggccaaggagaugaccagcccccuggugagcgacgacgacguguucccccugagcccccccgacaugagcuuccccgccagccuggccgcccagcacuuccugcuggaggaggagaagagagccaaggagcuggagaagcugcugaacacccacaucgacgagcugcagagacacaccgaguucacccugaacaaguacagcaagcugaagcagaacagacacaucuaa

SEQ ID NO: 14755 - RNA, 1008 nt, Artificial Sequence
  CCDC68__Homo_sapiens__NP_001137301
augaccaccgugaccgugaccaccgagaucccccccagagacaagauggaggacaacagcgcccuguacgagagcaccagcgcccacaucaucgaggagaccgaguacgugaagaagaucagaaccacccugcagaagaucagaacccagauguucaaggacgagaucagacacgacagcaccaaccacaagcuggacgccaagcacugcggcaaccugcagcagggcagcgacagcgagauggaccccagcugcugcagccuggaccugcugaugaagaagaucaagggcaaggaccugcagcugcuggagaugaacaaggagaacgaggugcugaagaucaagcugcaggccagcagagaggccggcgccgccgcccugagaaacguggcccagagacuguucgagaacuaccagacccagagcgaggaggugagaaagaagcaggaggacagcaagcagcugcugcaggugaacaagcuggagaaggagcagaagcugaagcagcacguggagaaccugaaccagguggccgagaagcuggaggagaagcacagccagaucaccgagcuggagaaccuggugcagagaauggagaaggagaagagaacccugcuggagagaaagcugagccuggagaacaagcugcugcagcugaagagcagcgccaccuacggcaagagcugccaggaccugcagagagagaucagcauccugcaggagcagaucagccaccugcaguucgugauccacagccagcaccagaaccugagaagcgugauccaggagauggagggccugaagaacaaccugaaggagcaggacaagagaaucgagaaccugagagagaaggugaacauccuggaggcccagaacaaggagcugaagacccagguggcccugagcagcgagacccccagaaccaaggugagcaaggccgugagcaccagcgagcugaagaccgagggcgugagccccuaccugaugcugaucagacugagaaaguaa

SEQ ID NO: 14756 - RNA, 1425 nt, Artificial Sequence
  CCDC6__Homo_sapiens__NP_005427
auggccgacagcgccagcgagagcgacaccgacggcgccggcggcaacagcagcagcagcgccgccaugcagagcagcugcagcagcaccagcggcggcggcggcggcggcggcggcggcggcggcggcggcaagagcggcggcaucgugaucagccccuucagacuggaggagcugaccaacagacuggccagccugcagcaggagaacaaggugcugaagaucgagcuggagaccuacaagcugaagugcaaggcccugcaggaggagaacagagaccugagaaaggccagcgugaccauccaggccagagccgagcaggaggaggaguucaucagcaacacccuguucaagaagauccaggcccugcagaaggagaaggagacccuggccgugaacuacgagaaggaggaggaguuccugaccaacgagcugagcagaaagcugaugcagcugcagcacgagaaggccgagcuggagcagcaccuggagcaggagcaggaguuccaggugaacaagcugaugaagaagaucaagaagcuggagaacgacaccaucagcaagcagcugacccuggagcagcugagaagagagaagaucgaccuggagaacacccuggagcaggagcaggaggcccuggugaacagacuguggaagagaauggacaagcuggaggccgagaagagaauccugcaggagaagcuggaccagcccgugagcgccccccccagccccagagacaucagcauggagaucgacagccccgagaacaugaugagacacaucagauuccugaagaacgagguggagagacugaagaagcagcugagagccgcccagcugcagcacagcgagaagauggcccaguaccuggaggaggagagacacaugagagaggagaaccugagacugcagagaaagcugcagagagagauggagagaagagaggcccugugcagacagcugagcgagagcgagagcagccuggagauggacgacgagagauacuucaacgagaugagcgcccagggccugagacccagaaccgugagcagccccauccccuacacccccagccccagcagcagcagacccaucagccccggccugagcuacgccagccacaccgugggcuucaccccccccaccagccugaccagagccggcaugagcuacuacaacagccccggccugcacgugcagcacaugggcaccagccacggcaucaccagacccagccccagaagaagcaacagccccgacaaguucaagagacccacccccccccccagccccaacacccagacccccgugcagcccccccccccccccccccccccccccaugcagcccaccgugcccagcgccgccaccagccagcccacccccagccagcacagcgcccaccccagcagccagcccuaa

SEQ ID NO: 14757 - RNA, 1317 nt, Artificial Sequence
  CCDC78__Homo_sapiens__NP_001026907
auggagcacgccgccaccaccggccccagacccggcccccccagcagaagaguggagaacguggugcugagagccaaggacuggcugcccggcgcccccggcggcaccgccgugugggccaccagccuggaggccgaggugccccccgaccuggcccugaacaaggagcagcagcugcagaucagcaaggagcugguggacauccagaucaccacccaccaccugcacgagcagcacgaggccgagaucuuccagcugaagagcgagauccugagacuggagagcagagugcuggagcuggagcugagaggcgacggcaccagccagggcugcgccgugcccguggagagcgaccccagacaccccagagccgccgcccaggagcugagacacaaggcccaggugcccggccacagcgacgaccacagauuccaggugcagcccaagaacaccaugaaccccgagaacgagcagcacagacugggcagcggccugcagggcgaggugaagugggcccuggagcaccaggaggccagacagcaggcccuggugaccagaguggccacccugggcagacagcugcagggcgccagagaggaggccagagccgccggccagagacuggccacccaggccguggugcugugcagcugccagggccagcugagacaggccgaggccgagaacgccagacugcagcugcagcugaagaagcugaaggacgaguacgugcugagacugcagcacugcgccuggcaggccguggagcacgccgacggcgccggccaggcccccgccaccaccgcccugagaaccuuccuggaggccacccuggaggacaucagagccgcccacagaagcagagagcagcagcuggccagagccgccagaagcuaccacaagagacugguggaccugagcagaagacacgaggagcugcugguggccuacagagcccccggcaacccccaggccaucuucgacaucgccagccuggaccuggagccccugcccgugccccuggugaccgacuucagccacagagaggaccagcacggcggccccggcgcccugcugagcagccccaagaagagacccggcggcgccagccagggcggcaccagcgagccccagggccuggacgccgccagcugggcccagauccaccagaagcugagagacuucagcagaagcacccagagcuggaacggcagcggccacagcugcuggagcggccccagauggcugaagagcaacuuccugagcuacagaagcaccuggaccagcaccugggccggcaccagcaccaagagcuaa

SEQ ID NO: 14758 - RNA, 2853 nt, Artificial Sequence
  CCDC80__Homo_sapiens__NP_955805
augaccuggagaaugggccccagauucaccaugcugcuggccauguggcuggugugcggcagcgagccccacccccacgccaccaucagaggcagccacggcggcagaaaggugccccuggugagccccgacagcagcagacccgccagauuccugagacacaccggcagaagcagaggcaucgagagaagcacccuggaggagcccaaccugcagccccugcagagaagaagaagcgugcccgugcugagacuggccagacccaccgagccccccgccagaagcgacaucaacggcgccgccgugagacccgagcagagacccgccgccagaggcagccccagagagaugaucagagacgagggcagcagcgccagaagcagaaugcugagauuccccagcggcagcagcagccccaacauccuggccagcuucgccggcaagaacagagugugggugaucagcgccccccacgccagcgagggcuacuacagacugaugaugagccugcugaaggacgacguguacugcgagcuggccgagagacacauccagcagaucgugcuguuccaccaggccggcgaggagggcggcaaggugagaagaaucaccagcgagggccagauccuggagcagccccuggaccccagccugauccccaagcugaugagcuuccugaagcuggagaagggcaaguucggcauggugcugcugaagaagacccugcagguggaggagagauaccccuaccccgugagacuggaggccauguacgaggugaucgaccagggccccaucagaagaaucgagaagaucagacagaagggcuucgugcagaagugcaaggccagcggcguggagggccaggugguggccgagggcaacgacggcggcggcggcgccggcagacccagccugggcagcgagaagaagaaggaggaccccagaagagcccaggugccccccaccagagagagcagagugaaggugcugagaaagcuggccgccaccgcccccgcccugccccagccccccagcacccccagagccaccacccugccccccgcccccgccaccaccgugaccagaagcaccagcagagccgugaccguggccgccagacccaugaccaccaccgccuuccccaccacccagagacccuggacccccagccccagccacagaccccccaccaccaccgaggugaucaccgccagaagacccagcgugagcgagaaccuguacccccccagcagaaaggaccagcacagagagagaccccagaccaccagaagacccagcaaggccaccagccuggagagcuucaccaacgccccccccaccaccaucagcgagcccagcaccagagccgccggccccggcagauucagagacaacagaauggacagaagagagcacggccacagagaccccaacguggugcccggcccccccaagcccgccaaggagaagccccccaagaagaaggcccaggacaagauccugagcaacgaguacgaggagaaguacgaccugagcagacccaccgccagccagcuggaggacgagcugcaggugggcaacgugccccugaagaaggccaaggagagcaagaagcacgagaagcuggagaagcccgagaaggagaagaagaagaagaugaagaacgagaacgccgacaagcugcugaagagcgagaagcagaugaagaagagcgagaagaagagcaagcaggagaaggagaagagcaagaagaagaagggcggcaagaccgagcaggacggcuaccagaagcccaccaacaagcacuucacccagagccccaagaagagcguggccgaccugcugggcagcuucgagggcaagagaagacugcugcugaucaccgcccccaaggccgagaacaacauguacgugcagcagagagacgaguaccuggagagcuucugcaagauggccaccagaaagaucagcgugaucaccaucuucggccccgugaacaacagcaccaugaagaucgaccacuuccagcuggacaacgagaagcccaugagagugguggacgacgaggaccugguggaccagagacugaucagcgagcugagaaaggaguacggcaugaccuacaacgacuucuucauggugcugaccgacguggaccugagagugaagcaguacuacgaggugcccaucaccaugaagagcguguucgaccugaucgacaccuuccagagcagaaucaaggacauggagaagcagaagaaggagggcaucgugugcaaggaggacaagaagcagagccuggagaacuuccugagcagauucagauggagaagaagacugcuggugaucagcgcccccaacgacgaggacugggccuacagccagcagcugagcgcccugagcggccaggccugcaacuucggccugagacacaucaccauccugaagcugcugggcgugggcgaggaggugggcggcgugcuggagcuguuccccaucaacggcagcagcgugguggagagagaggacgugcccgcccaccuggugaaggacaucagaaacuacuuccaggugagccccgaguacuucagcaugcugcuggugggcaaggacggcaacgugaagagcugguaccccagccccauguggagcauggugaucguguacgaccugaucgacagcaugcagcugagaagacaggagauggccauccagcagagccugggcaugagaugccccgaggacgaguacgccggcuacggcuaccacagcuaccaccagggcuaccaggacggcuaccaggacgacuacagacaccacgagagcuaccaccacggcuaccccuacuaa

SEQ ID NO: 14759 - RNA, 1242 nt, Artificial Sequence
  CCDC83__Homo_sapiens__NP_001273088
auggagaacagcggcaaggccaacaagaaggacacccacgacggcccccccaaggagaucaagcugcccaccagcgaggcccugcuggacuaccagugccagaucaaggaggacgccguggagcaguucauguuccagaucaagacccugagaaagaagaaccagaaguaccacgagagaaacagcagacugaaggaggagcagaucuggcacaucagacaccugcugaaggagcugagcgaggagaaggccgagggccugcccguggugaccagagaggacguggaggaggccaugaaggagaaguggaaguucgagagagaccaggagaagaaccugagagacaugagaaugcagaucagcaacgccgagaagcuguuccuggagaagcugagcgagaaggaguacugggaggaguacaagaacgugggcagcgagagacacgccaagcugaucaccagccugcagaacgacaucaacaccgugaaggagaacgccgagaagaugagcgagcacuacaagaucacccuggaggacaccagaaagaagaucaucaaggagacccugcugcagcuggaccagaagaaggagugggccacccagaacgccgugaagcugaucgacaagggcagcuaccuggagaucugggagaacgacuggcugaagaaggagguggccauccacagaaaggagguggaggagcugaagaacgccauccacgagcuggaggccgagaaccuggugcugaucgaccagcugagcaacugcagacugguggaccugaagauccccagaagacuguaccugacccaggccgccggccuggaggugccccccgaggagaugagccuggagcugcccgagacccacaucgaggagaagagcgagcugcagcccaccgagguggagagcagagaccugaugagcagcagcgacgagagcaccauccugcaccugagccacgagaacagcaucgaggaccugcaguacgugaagaucgacaaggaggagaacagcggcaccgaguucggcgacaccgacaugaaguaccugcuguacgaggacgagaaggacuucaaggacuacgugaaccugggcccccugggcgugaagcugaugagcguggagagcaagaagaugcccauccacuuccaggagaaggagauccccgugaagcuguacaaggacgugagaagccccgagagccacaucaccuacaagaugaugaagagcuuccuguaa

SEQ ID NO: 14760 - RNA, 1662 nt, Artificial Sequence
  CCDC85A__Homo_sapiens__NP_001073902
augagcaaggccgccggcggcgccgccgccgccgccgccgccgccgagagcugcagccccgcccccgccggcagcagcgccgccccccccgcccccguggaggaccugagcaaggugagcgacgaggagcugcugcaguggagcaaggaggagcugaucagaagccugagaagagccgaggccgagaaggugagcgccaugcuggaccacagcaaccugaucagagaggugaacagaagacugcagcugcaccugggcgagaucagaggccugaaggacaucaaccagaagcugcaggaggacaaccaggagcugagagaccugugcugcuuccuggacgacgacagacagaagggcaagagagugagcagagaguggcagagacugggcagauacaccgccggcgugaugcacaaggagguggcccuguaccugcagaagcugaaggaccuggaggugaagcaggaggagguggugaaggagaacauggagcugaaggagcugugcgugcugcuggacgaggagaagggcgccggcugcgccggcagcagaugcagcaucgacagccaggccagccugugccagcugaccgccagcaccgcccccuacgugagagacgugggcgacggcagcagcaccagcagcaccggcagcaccgacagccccgaccaccacaagcaccacgccagcagcggcagccccgagcaccugcagaagcccagaagcgagggcagccccgagcacagcaagcacagaagcgccagccccgagcacccccagaagcccagagccugcggcacccccgacagacccaaggcccugaagggccccagccccgagcaccacaagccccugugcaagggcagccccgagcagcagagacacccccaccccggcagcagccccgagacccugcccaagcacgugcugagcggcagccccgagcacuuccagaagcacagaagcggcagcagccccgagcacgccagacacagcggcggcagccccgagcaccugcagaagcacgcccugggcggcagccuggagcaccugcccagagccagaggcaccagccccgagcaccugaagcagcacuacggcggcagccccgaccacaagcacggcggcggcagcggcggcagcggcggcagcggcggcggcagcagagagggcacccugagaagacaggcccaggaggacggcagcccccaccacagaaacguguacagcggcaugaacgagagcacccugagcuacgugagacagcuggaggccagagugagacagcuggaggaggagaacagaaugcugccccaggccagccagaacagaagacagccccccaccagaaacagcagcaacauggagaagggcuggggcagcagagccagaagagugcugcagugguggcagggcugcagaggcaucggcagaugccugcccacccugcccggcagcuucagacugagcagcggcgccgacggcagcaacagcagccccaacagcgccgccagcuucagcggccacgccacccccagccagcagcccgagcccguggugcacagccugaaggugguguggagaaagcugggcgacgccgccggcagcugccccggcaucagacagcaccugagcggcaaccaguacaagggccccauguaa

SEQ ID NO: 14761 - RNA, 1083 nt, Artificial Sequence
  CCDC86__Homo_sapiens__NP_077003
auggacaccccccugagaagaagcagaagacugggcggccugagacccgagagccccgagagccugaccagcgugagcagaaccagaagagcccugguggaguucgagagcaaccccgaggagaccagagagcccggcagcccccccagcgugcagagagccggccugggcagccccgagagaccccccaagaccagccccggcagccccagacugcagcagggcgccggccuggagagcccccagggccagcccgagcccggcgccgccagcccccagagacagcaggaccugcaccuggagagcccccagagacagcccgaguacagccccgagagccccagaugccagcccaagcccagcgaggaggcccccaagugcagccaggaccagggcgugcuggccagcgagcuggcccagaacaaggaggagcugacccccggcgccccccagcaccagcugccccccgugcccggcagccccgagcccuaccccggccagcaggcccccggccccgagcccagccagccccugcuggagcugacccccagagcccccggcagccccagaggccagcacgagcccagcaagcccccccccgccggcgagaccgugaccggcggcuucggcgccaagaagagaaagggcagcagcagccaggcccccgccagcaagaagcugaacaaggaggagcugcccgugauccccaagggcaagcccaagagcggcagaguguggaaggacagaagcaagaagagauucagccagaugcugcaggacaagccccugagaaccagcuggcagagaaagaugaaggagagacaggagagaaagcuggccaaggacuucgccagacaccuggaggaggagaaggagagaagaagacaggagaagaagcagagaagagccgagaaccugaagagaagacuggagaacgagagaaaggccgagguggugcaggugaucagaaaccccgccaagcugaagagagccaagaagaagcagcugagaagcaucgagaagagagacacccuggcccugcugcagaagcagcccccccagcagcccgccgccaagaucuaa

SEQ ID NO: 14762 - RNA, 5613 nt, Artificial Sequence
  CCDC88A__Homo_sapiens__NP_001129069
auggagaacgagaucuucaccccccugcuggagcaguucaugaccagcccccuggugaccugggugaagaccuucggcccccuggccgccggcaacggcaccaaccuggacgaguacguggcccugguggacggcguguuccugaaccaggugaugcugcagaucaaccccaagcuggagagccagagagugaacaagaaggugaacaacgacgccagccugagaaugcacaaccugagcauccuggugagacagaucaaguucuacuaccaggagacccugcagcagcugaucaugaugagccugcccaacgugcugaucaucggcaagaaccccuucagcgagcagggcaccgaggaggugaagaagcugcugcugcugcugcugggcugcgccgugcagugccagaagaaggaggaguucaucgagagaauccagggccuggacuucgacaccaaggccgccguggccgcccacauccaggaggugacccacaaccaggagaacguguucgaccugcaguggauggaggugaccgacaugagccaggaggacaucgagccccugcugaagaacauggcccugcaccugaagagacugaucgacgagagagacgagcacagcgagaccaucaucgagcugagcgaggagagagacggccugcacuuccugccccacgccagcagcagcgcccagagccccugcggcagccccggcaugaagagaaccgagagcagacagcaccugagcguggagcuggccgacgccaaggccaagaucagaagacugagacaggagcuggaggagaagaccgagcagcugcuggacugcaagcaggagcuggagcagauggagaucgagcugaagagacugcagcaggagaacaugaaccugcugagcgacgccagaagcgccagaauguacagagacgagcuggacgcccugagagagaaggccgugagaguggacaagcuggagagcgaggugagcagauacaaggagagacugcacgacaucgaguucuacaaggccagaguggaggagcugaaggaggacaaccaggugcugcuggagaccaagaccaugcuggaggaccagcuggagggcaccagagccagaagcgacaagcugcacgagcuggagaaggagaaccugcagcugaaggccaagcugcacgacauggagauggagagagacauggacagaaagaagaucgaggagcugauggaggagaacaugacccuggagauggcccagaagcagagcauggacgagagccugcaccugggcugggagcuggagcagaucagcagaaccagcgagcugagcgaggccccccagaagagccugggccacgaggugaacgagcugaccagcagcagacugcugaagcuggagauggagaaccagagccugaccaagaccguggaggagcugagaaccaccguggacagcguggagggcaacgccagcaagauccugaagauggagaaggagaaccagagacugagcaagaagguggagauccuggagaacgagaucgugcaggagaagcagagccugcagaacugccagaaccugagcaaggaccugaugaaggagaaggcccagcuggagaagaccaucgagacccugagagagaacagcgagagacagaucaagauccuggagcaggagaacgagcaccugaaccagaccgugagcagccugagacagagaagccagaucagcgccgaggccagagugaaggacaucgagaaggagaacaagauccugcacgagagcaucaaggagaccagcagcaagcugagcaagaucgaguucgagaagagacagaucaagaaggagcuggagcacuacaaggagaagggcgagagagccgaggagcuggagaacgagcugcaccaccuggagaaggagaacgagcugcugcagaagaagaucaccaaccugaagaucaccugcgagaagaucgaggcccuggagcaggagaacagcgagcuggagagagagaacagaaagcugaagaagacccuggacagcuucaagaaccugaccuuccagcuggagagccuggagaaggagaacagccagcuggacgaggagaaccuggagcugagaagaaacguggagagccugaagugcgccagcaugaagauggcccagcugcagcuggagaacaaggagcuggagagcgagaaggagcagcugaagaagggccuggagcugcugaaggccagcuucaagaagaccgagagacuggaggugagcuaccagggccuggacaucgagaaccagagacugcagaagacccuggagaacagcaacaagaagauccagcagcuggagagcgagcugcaggaccuggagauggagaaccagacccugcagaagaaccuggaggagcugaagaucagcagcaagagacuggagcagcuggagaaggagaacaagagccuggagcaggagaccagccagcuggagaaggacaagaagcagcuggagaaggagaacaagagacugagacagcaggccgagaucaaggacaccacccuggaggagaacaacgugaagaucggcaaccuggagaaggagaacaagacccugagcaaggagaucggcaucuacaaggagagcugcgugagacugaaggagcuggagaaggagaacaaggagcuggugaagagagccaccaucgacaucaagacccuggugacccugagagaggaccuggugagcgagaagcugaagacccagcagaugaacaacgaccuggagaagcugacccacgagcuggagaagaucggccugaacaaggagagacugcugcacgacgagcagagcaccgacgacagauacaagcugcuggagagcaagcuggagagcacccugaagaagagccuggagaucaaggaggagaagaucgccgcccuggaggccagacuggaggagagcaccaacuacaaccagcagcugagacaggagcugaagaccgugaagaagaacuacgaggcccugaagcagagacaggacgaggagagaauggugcagagcagcccccccaucagcggcgaggacaacaagugggagagagagagccaggagaccaccagagagcugcugaaggugaaggacagacugaucgagguggagagaaacaacgccacccugcaggccgagaagcaggcccugaagacccagcugaagcagcuggagacccagaacaacaaccugcaggcccagauccuggcccugcagagacagaccgugagccugcaggagcagaacaccacccugcagacccagaacgccaagcugcagguggagaacagcacccugaacagccagagcaccagccugaugaaccagaacgcccagcugcugauccagcagagcagccuggagaacgagaacgagagcgugaucaaggagagagaggaccugaagagccuguacgacagccugaucaaggaccacgagaagcuggagcugcugcacgagagacaggccagcgaguacgagagccugaucagcaagcacggcacccugaagagcgcccacaagaaccuggagguggagcacagagaccuggaggacagauacaaccagcugcugaagcagaagggccagcuggaggaccuggagaagaugcugaagguggagcaggagaagaugcugcuggagaacaagaaccacgagaccguggccgccgaguacaagaagcugugcggcgagaacgacagacugaaccacaccuacagccagcugcugaaggagaccgaggugcugcagaccgaccacaagaaccugaagagccugcugaacaacagcaagcuggagcagaccagacuggaggccgaguucagcaagcugaaggagcaguaccagcagcuggacaucaccagcaccaagcugaacaaccagugcgagcugcugagccagcugaagggcaaccuggaggaggagaacagacaccugcuggaccagauccagacccugaugcugcagaacagaacccugcuggagcagaacauggagagcaaggaccuguuccacguggagcagagacaguacaucgacaagcugaacgagcugagaagacagaaggagaagcuggaggagaagaucauggaccaguacaaguucuacgaccccagcccccccagaagaagaggcaacuggaucacccugaagaugagaaagcugaucaagagcaagaaggacaucaacagagagagacagaagagccugacccugacccccaccagaagcgacagcagcgagggcuuccugcagcugccccaccaggacagccaggacagcagcagcgugggcagcaacagccuggaggacggccagacccugggcaccaagaagagcagcaugguggcccugaagagacugcccuuccugagaaacagacccaaggacaaggacaagaugaaggccugcuacagaagaagcaugagcaugaacgaccuggugcagagcauggugcuggccggccaguggaccggcagcaccgagaaccuggaggugcccgacgacaucagcaccggcaagagaagaaaggagcugggcgccauggccuucagcaccaccgccaucaacuucagcaccgugaacagcagcgccggcuucagaagcaagcagcuggugaacaacaaggacaccaccagcuucgaggacaucagcccccagggcgugagcgacgacagcagcaccggcagcagagugcacgccagcagacccgccagccuggacagcggcagaaccagcaccagcaacagcaacaacaacgccagccugcacgaggugaaggccggcgccgugaacaaccagagcagaccccagagccacagcagcggcgaguucagccugcugcacgaccacgaggccuggagcagcagcggcagcagccccauccaguaccugaagagacagaccagaagcagccccgugcugcagcacaagaucagcgagacccuggagagcagacaccacaagaucaagaccggcagccccggcagcgagguggugacccugcagcaguuccuggaggagagcaacaagcugaccagcgugcagaucaagagcagcagccaggagaaccugcuggacgaggugaugaagagccugagcgugagcagcgacuuccugggcaaggacaagcccgugagcugcggccuggccagaagcgugagcggcaagacccccggcgacuucuacgacagaagaaccaccaagcccgaguuccugagacccggccccagaaagaccgaggacaccuacuucaucagcagcgccggcaagcccacccccggcacccagggcaagaucaagcuggugaaggagagcagccugagcagacagagcaaggacagcaaccccuacgccacccugcccagagccagcagcgugaucagcaccgccgagggcaccaccagaagaaccagcauccacgacuuccugaccaaggacagcagacugcccaucagcguggacagcccccccgccgccgccgacagcaacaccaccgccgccagcaacguggacaaggugcaggagagcagaaacagcaagagcagaagcagagagcagcagagcagcuaa

SEQ ID NO: 14763 - RNA, 6087 nt, Artificial Sequence
  CCDC88C__Homo_sapiens__NP_001073883
auggacgugaccgugagcgagcugcuggagcuguuccugcagagcccccuggugaccugggugaagaccuucggccccuucggcagcggcagccaggacaaccugaccauguacauggaccugguggacggcaucuuccugaaccagaucaugcugcagaucgaccccagacccaccaaccagagaaucaacaagcacgugaacaacgacgugaaccugagaauccagaaccugaccauccuggugagaaacaucaagaccuacuaccaggaggugcugcagcagcugaucgugaugaaccugcccaacgugcugaugaucggcagagacccccugagcggcaagagcauggaggagaucaagaaggugcugcugcuggugcugggcugcgccgugcagugcgagagaaaggaggaguucaucgagagaaucaagcagcuggacaucgagacccaggccggcaucguggcccacauccaggaggugacccacaaccaggagaacguguucgaccugcaguggcuggagcugcccgacguggcccccgaggagcuggaggcccugagcagaagcauggugcugcaccugagaagacugaucgaccagagagacgagugcaccgagcugaucguggaccugacccaggagagagacuaccugcaggcccagcacccccccagccccaucaagagcagcagcgccgacagcacccccagccccaccagcagccugagcagcgaggacaagcagcaccuggccguggagcuggccgacaccaaggccagacugagaagagugagacaggagcuggaggacaagaccgagcagcugguggacaccagacacgagguggaccagcuggugcuggagcugcagaaggugaagcaggagaacauccagcuggccgccgacgccagaagcgccagagccuacagagacgagcuggacagccugagagagaaggccaacagaguggagagacuggagcuggagcugaccagaugcaaggagaagcugcacgacguggacuucuacaaggccagaauggaggagcugagagaggacaacaucauccugaucgagaccaaggccaugcuggaggagcagcugaccgccgccagagccagaggcgacaaggugcacgagcuggagaaggagaaccugcagcugaagagcaagcugcacgaccuggagcuggacagagacaccgacaagaagagaaucgaggagcugcuggaggagaacauggugcuggagaucgcccagaagcagagcaugaacgagagcgcccaccugggcugggagcuggagcagcugagcaagaacgccgaccugagcgacgccagcagaaagagcuucguguucgagcugaacgagugcgccagcagcagaauccugaagcuggagaaggagaaccagagccugcagagcaccauccagggccugagagacgccagccuggugcuggaggagagcggccugaagugcggcgagcuggagaaggagaaccaccagcugagcaagaagaucgagaagcugcagacccagcuggagagagagaagcagagcaaccaggaccuggagacccugagcgaggagcugaucagagagaaggagcagcugcagagcgacauggagacccugaaggccgacaaggccagacagaucaaggaccuggagcaggagaaggaccaccugaacagagccauguggagccugagagagagaagccaggugagcagcgaggccagaaugaaggacguggagaaggagaacaaggcccugcaccagaccgugaccgaggccaacggcaagcugagccagcuggaguucgagaagagacagcugcacagagaccuggagcaggccaaggagaagggcgagagagccgagaagcuggagagagagcugcagagacugcaggaggagaacggcagacuggccagaaaggugaccagccuggagaccgccaccgagaagguggaggcccuggagcacgagagccagggccugcagcuggagaacagaacccugagaaagagccuggacacccugcagaacgugagccugcagcuggagggccuggagagagacaacaagcagcuggacgccgagaaccuggagcugagaagacugguggagaccaugagauucaccagcaccaagcuggcccagauggagagagagaaccagcagcuggagagagagaaggaggagcugagaaagaacguggaccugcugaaggcccugggcaagaagagcgagagacuggagcugagcuaccagagcgugagcgccgagaaccugagacugcagcagagccuggagagcagcagccacaagacccagacccuggagagcgagcugggcgagcuggaggccgagagacaggcccugagaagagaccuggaggcccugagacuggccaacgcccagcuggagggcgccgagaaggacagaaaggcccuggagcaggagguggcccagcuggagaaggacaagaagcugcuggagaaggaggccaagagacuguggcagcagguggagcugaaggacgccgugcuggacgacagcaccgccaagcugagcgccguggagaaggagagcagagcccuggacaaggagcuggccagaugcagagacgccgccggcaagcugaaggagcuggagaaggacaacagagaccugaccaagcaggugaccgugcacgccagaacccugaccacccugagagaggaccuggugcuggagaagcugaagagccagcagcugagcagcgagcuggacaagcugagccaggagcuggagaaggugggccugaacagagagcugcugcugcaggaggacgacagcggcagcgacaccaaguacaagauccuggagggcagaaacgagagcgcccugaagaccacccuggccaugaaggaggagaagaucgugcugcuggaggcccagauggaggagaaggccagccugaacagacagcuggagagcgagcugcagaugcugaagaaggagugcgagacccugagacagaaccagggcgagggccagcaccugcagaacagcuucaagcaccccgccggcaagaccgccgccagccaccagggcaaggaggccuggggccccggccacaaggaggccaccauggagcugcugagagugaaggacagagccaucgagcuggagagaaacaacgccgcccugcaggccgagaagcagcugcugaaggagcagcugcagcaccuggagacccagaacgugaccuucagcagccagauccugacccugcagaagcagagcgccuuccugcaggagcacaacaccacccugcagacccagaccgccaagcugcagguggagaacagcacccugagcagccagagcgccgcccugaccgcccaguacacccugcugcagaaccaccacaccgccaaggagaccgagaacgagagccugcagagacagcaggagcagcugaccgccgccuacgaggcccugcugcaggaccacgagcaccugggcacccugcacgagagacagagcgccgaguacgaggcccugaucagacagcacagcugccugaagacccugcacagaaaccuggagcuggagcacaaggagcugggcgagagacacggcgacaugcugaagagaaaggccgagcuggaggagagagagaaggugcugaccaccgagagagaggcccugcagcaggagcagagaaccaacgcccuggccaugggcgagaaccagagacugagaggcgagcuggacagagugaacuuccugcaccaccagcugaagggcgaguacgaggagcugcacgcccacaccaaggagcugaagaccagccugaacaacgcccagcuggagcugaacagauggcaggccagauucgacgagcugaaggagcagcaccagaccauggacaucagccugaccaagcuggacaaccacugcgagcugcugagcagacugaagggcaaccuggaggaggagaaccaccaccugcugagccagauccagcugcugagccagcagaaccagaugcugcuggagcagaacauggagaacaaggagcaguaccacgaggagcagaagcaguacaucgacaagcugaacgcccugagaagacacaaggagaagcuggaggagaagaucauggaccaguacaaguucuacgaccccccccccaagaagaagaaccacuggaucggcgccaaggcccuggugaagcugaucaagcccaagaaggagggcagcagagagagacugaagagcaccguggacagcccccccuggcagcuggagagcagcgaccccgccagccccgccgccagccagccccugagaagccaggccgagaaccccgacacccccgcccugggcagcaacugcgccgaggagagagacgcccacaacggcagcgugggcaagggccccggcgaccugaagcccaagagaggcagcccccacagaggcagccuggacagaaccgacgccagcaccgaccuggccaugagaagcuggcccagcgagcugggcagcagaaccugcagcaccagcgccaccaccaccgcccccagcaacagcacccccaucgccagacaccccggcagaaccaagggcuacaacagcgacgacaaccugugcgagcccagccuggaguucgaggugcccaaccacagacaguacgugagcagacccagcagccuggagagcagcagaaacaccagcagcaacagcagcccccugaaccugaagggcagcagcgagcagcugcacggcagaagcgagagcuucagcagcgaggaccugauccccagcagagaccuggccacccugcccagagaggccagcacccccggcagaaacgcccugggcagacacgaguacccccugcccagaaacggcccccugccccaggagggcgcccagaagagaggcaccgccccccccuacgugggcgugagacccugcagcgccagccccagcagcgagauggugacccuggaggaguuccuggaggagagcaacagaagcagccccacccacgacacccccagcugcagagacgaccugcugagcgacuacuucagaaaggccagcgacccccccgccaucggcggccagcccggcccccccgccaagaaggagggcgccaagaugcccaccaacuucguggcccccaccgugaagauggccgcccccaccagcgagggcagaccccugaagcccggccaguacgugaagcccaacuucagacugaccgaggccgaggccccccccagcguggcccccagacaggcccagcccccccagagccugagccugggcagacccagacaggcccccgugccccccgccagccacgcccccgccagcagaagcgccagccugagcagagccuucagccuggccagcgccgaccugcugagagccagcggccccgaggccugcaagcaggagagcccccagaagcugggcgcccccgaggcccugggcggcagagagaccggcagccacacccugcagagccccgccccccccagcagccacagccuggccagagagagaaccccccuggugggcaaggccggcagcagcugccagggccccggccccagaagcagaccccuggacaccagaagauucagccuggccccccccaaggaggagagacuggccccccugcaccagagcgccaccgcccccgccaucgccaccgccggcgccggcgccgccgccgccggcagcggcagcaacagccagcugcugcacuucagccccgccgccgcccccgccgccagaaccaagcccaaggccccccccagaagcggcgagguggccaccaucacccccgugagagccggccugagccugagcgagggcgacggcgugcccggccagggcugcagcgagggccugcccgccaagagccccggcagaagccccgaccuggccccccaccugggcagagcccuggaggacugcagcagaggcagcgugagcaagagcagccccgccagccccgagcccggcggcgacccccagaccgugugguacgaguacggcugcguguaa

SEQ ID NO: 14764 - RNA, 1617 nt, Artificial Sequence
  CCDC8__Homo_sapiens__NP_114429
augcugcagaucggcgaggacguggacuaccugcugauccccagagaggugagacuggccggcggcguguggagagugaucagcaagcccgccaccaaggaggccgaguucagagagagacugacccaguuccuggaggaggagggcagaacccuggaggacguggccagaaucauggagaagagcaccccccaccccccccagccccccaagaagcccaaggagcccagagugagaagaagagugcagcagauggugacccccccccccagacugguggugggcaccuacgacagcagcaacgccagcgacagcgaguucagcgacuucgagaccagcagagacaagagcagacagggccccagaagaggcaagaaggugagaaagaugcccgugagcuaccugggcagcaaguuccugggcagcgaccuggagagcgaggacgacgaggagcugguggaggccuuccugagaagacaggagaagcagcccagcgccccccccgccagaagaagagugaaccugcccgugcccauguucgaggacaaccugggcccccagcugagcaaggccgacagauggagagaguacgugagccaggugagcuggggcaagcugaagagaagagugaagggcugggcccccagagccggccccggcgugggcgaggccagacuggccagcaccgccguggagagcgccggcgugagcagcgcccccgagggcaccagccccggcgacagacugggcaacgccggcgacgugugcgugccccaggccagccccagaagauggagacccaagaucaacugggccagcuucagaagaagaagaaaggagcagaccgcccccaccggccagggcgccgacaucgaggccgaccagggcggcgaggccgccgacagccagagagaggaggccaucgccgaccagagagagggcgccgccggcaaccagagagccggcgcccccgccgaccagggcgccgaggccgccgacaaccagagagaggaggccgccgacaaccagagagccggcgcccccgccgaggagggcgccgaggccgccgacaaccagagagaggaggccgccgacaaccagagagccgaggcccccgccgaccagagaagccagggcaccgacaaccacagagaggaggccgccgacaaccagagagccgaggcccccgccgaccagggcagcgaggugaccgacaaccagagagaggaggccgugcacgaccagagagagagagcccccgccgugcagggcgccgacaaccagagagcccaggccagagccggccagagagccgaggccgcccacaaccagagagccggcgcccccggcauccaggaggccgaggugagcgccgcccagggcaccaccggcaccgcccccggcgccagagccagaaagcaggugaagaccgugagauuccagacccccggcagauucagcugguucugcaagagaagaagagccuucuggcacacccccagacugcccacccugcccaagagagugcccagagccggcgaggccagaaaccugagagugcugagagccgaggccagagccgaggccgagcagggcgagcaggaggaccagcuguaa

SEQ ID NO: 14765 - RNA, 1326 nt, Artificial Sequence
  CCDC91__Homo_sapiens__NP_060788
auggacgacgacgacuucggcggcuucgaggccgccgagaccuucgacggcggcagcggcgagacccagaccaccagccccgccauccccugggccgccuuccccgccgugagcggcgugcaccugagccccagcagccccgagaucgugcuggacagagaccacagcagcagcaucggcugccugagcagcgacgccaucaucagcagccccgagaacacccacgccgccaacagcaucgugagccagaccauccccaaggcccagauccagcagagcacccacacccaccuggacaucagccuguucccccugggccugaccgacgagaagagcaacggcaccaucgcccugguggacgacagcgaggaccccggcgccaacgugagcaacauccagcugcagcagaagaucagcagccuggagaucaagcugaaggugagcgaggaggagaagcagagaaucaagcaggacguggagagccugauggagaagcacaacgugcuggagaagggcuuccugaaggagaaggagcaggaggccaucagcuuccaggacagauacaaggagcugcaggagaagcacaagcaggagcuggaggacaugagaaaggccggccacgaggcccugagcaucaucguggacgaguacaaggcccugcugcagagcagcgugaagcagcagguggaggccaucgagaagcaguacaucagcgccaucgagaagcaggcccacaagugcgaggagcugcugaacgcccagcaccagagacugcuggagaugcuggacaccgagaaggagcugcugaaggagaagaucaaggaggcccugauccagcagagccaggagcagaaggagauccuggagaagugccuggaggaggagagacagagaaacaaggaggcccuggugagcgccgccaagcuggagaaggaggccgugaaggacgccgugcugaaggugguggaggaggagagaaagaaccuggagaaggcccacgccgaggagagagagcuguggaagaccgagcacgccaaggaccaggagaaggugagccaggagauccagaaggccauccaggagcagagaaagaucagccaggagaccgugaaggccgccaucaucgaggagcagaagagaagcgagaaggccguggaggaggccgugaagagaaccagagacgagcugaucgaguacaucaaggagcagaagagacuggaccaggugaucagacagagaagccugagcagccuggagcuguuccugagcugcgcccagaagcagcugagcgcccugaucgccaccgagcccguggacaucgaguaa

SEQ ID NO: 14766 - RNA, 972 nt, Artificial Sequence
  CCDC94__Homo_sapiens__NP_060544
augagcgagagaaaggugcugaacaaguacuacccccccgacuucgaccccagcaagauccccaagcugaagcugcccaaggacagacaguacguggugagacugauggcccccuucaacaugagaugcaagaccugcggcgaguacaucuacaagggcaagaaguucaacgccagaaaggagaccgugcagaacgagguguaccugggccugcccaucuucagauucuacaucaagugcaccagaugccuggccgagaucaccuucaagaccgaccccgagaacaccgacuacaccauggagcacggcgccaccagaaacuuccaggccgagaagcugcuggaggaggaggagaagagagugcagaaggagagagaggacgaggagcugaacaaccccaugaaggugcuggagaacagaaccaaggacagcaagcuggagauggaggugcuggagaaccugcaggagcugaaggaccugaaccagagacaggcccacguggacuucgaggccaugcugagacagcacagacugagcgaggaggagagaagaagacagcagcaggaggaggacgagcaggagaccgccgcccugcuggaggaggccagaaagagaagacugcuggaggacagcgacagcgaggacgaggccgcccccagcccccugcagcccgcccugagacccaaccccaccgccauccuggacgaggcccccaagcccaagagaaagguggaggugugggagcagagcgugggcagccugggcagcagacccccccugagcagacuggugguggugaagaaggccaaggccgaccccgacugcagcaacggccagccccaggccgcccccacccccggcgccccccagaacagaaaggaggccaaccccaccccccugacccccggcgccagcagccugagccagcugggcgccuaccuggacagcgacgacagcaacggcagcaacuaa

SEQ ID NO: 14767 - RNA, 1032 nt, Artificial Sequence
  CCDC97__Homo_sapiens__NP_443080
auggaggccguggccaccgccaccgccgccaaggagcccgacaagggcugcaucgagcccggccccggccacuggggcgagcugagcagaacccccgugcccagcaagccccaggacaagguggaggccgccgaggccacccccguggcccuggacagcgacaccagcggcgccgagaacgccgccgugagcgccaugcugcacgccguggccgccagcagacugcccgugugcagccagcagcagggcgagcccgaccugaccgagcacgagaagguggccauccuggcccagcuguaccacgagaagccccugguguuccuggagagauucagaaccggccugagagaggagcaccuggccugcuucggccacgugagaggcgaccacagagccgacuucuacugcgccgagguggccagacagggcaccgccagacccagaacccugagaaccagacugagaaacagaagauacgccgcccugagagagcugauccagggcggcgaguacuucagcgacgagcagaugagauucagagccccccugcuguacgagcaguacaucggccaguaccugacccaggaggagcugagcgccagaacccccacccaccagccccccaagcccggcagccccggcagacccgccugcccccugagcaaccugcugcugcagagcuacgaggagagagagcugcagcagagacugcugcagcagcaggaggaggaggaggccugccuggaggaggaggaggaggaggaggacagcgacgaggaggaccagagaagcggcaaggacagcgaggccugggugcccgacagcgaggagagacugauccugagagaggaguucaccagcagaaugcaccagagauuccuggacggcaaggacggcgacuucgacuacagcaccguggacgacaaccccgacuucgacaaccuggacaucguggccagagacgaggaggagagauacuucgacgaggaggagcccgaggacgcccccagccccgagcuggacggcgacuaa

SEQ ID NO: 14768 - RNA, 2508 nt, Artificial Sequence
  CCHCR1__Homo_sapiens__NP_001099033
auguggccccacagcgccggcgccagacccugggccagcacccugaccggcaaggaccccagagugauggccugcuggugccuggacggccugcccagcggccuggccgagcccuggagagagcuguggagauggagaagcagaccccugcacugcgugccccccuucagcccccuggccagaagcagcagagaccacagaaaccugagaagaagaggcaacaucgacggcuggagacagaaccuggagcccagcaacaacguggagauguucccccccagcggccaccaggacgugagcgagagaagacuggacacccagagaccccaggugaccaugugggagagagacgugagcagcgacagacaggagcccggcagaagaggcagaagcuggggccuggagggcagccaggcccugagccagcaggccgaggugaucgugagacagcugcaggagcugagaagacuggaggaggaggugagacugcugagagagaccagccugcagcagaagaugagacuggaggcccaggccauggagcuggaggcccuggccagagccgagaaggccggcagagccgaggccgagggccugagagccgcccuggccggcgccgagguggugagaaagaaccuggaggagggcagccagagagagcuggaggaggugcagagacugcaccaggagcagcugagcagccugacccaggcccacgaggaggcccugagcagccugaccagcaaggccgagggccuggagaagagccugagcagccuggagaccagaagagccggcgaggccaaggagcuggccgaggcccagagagaggccgagcugcugagaaagcagcugagcaagacccaggaggaccuggaggcccaggugacccugguggagaaccugagaaaguacgugggcgagcaggugcccagcgaggugcacagccagaccugggagcuggagagacagaagcugcuggagaccaugcagcaccugcaggaggacagagacagccugcacgccaccgccgagcugcugcaggugagagugcagagccugacccacauccuggcccugcaggaggaggagcugaccagaaaggugcagcccagcgacagccuggagcccgaguucaccagaaagugccagagccugcugaacagauggagagagaagguguucgcccugauggugcagcugaaggcccaggagcuggagcacagcgacagcgugaagcagcugaagggccagguggccagccugcaggagaaggugaccagccagagccaggagcaggccauccugcagagaagccugcaggacaaggccgccgagguggagguggagagaaugggcgccaagggccugcagcuggagcugagcagagcccaggaggccagaagaagauggcagcagcagaccgccagcgccgaggagcagcugagacugguggugaacgccgugagcagcagccagaucuggcuggagaccaccauggccaagguggagggcgccgccgcccagcugcccagccugaacaacagacugagcuacgccgugagaaaggugcacaccaucagaggccugaucgccagaaagcuggcccuggcccagcugagacaggagagcugcccccugcccccccccgugaccgacgugagccuggagcugcagcagcugagagaggagagaaacagacuggacgccgagcugcagcugagcgccagacugauccagcaggaggugggcagagccagagagcagggcgaggccgagagacagcagcugagcaagguggcccagcagcuggagcaggagcugcagcagacccaggagagccuggccagccugggccugcagcuggagguggccagacagggccagcaggagagcaccgaggaggccgccagccugagacaggagcugacccagcagcaggagcuguacggccaggcccugcaggagaagguggccgagguggagaccagacugagagagcagcugagcgacaccgagagaagacugaacgaggccagaagagagcacgccaaggccguggugagccugagacagauccagagaagagccgcccaggagaaggagagaagccaggagcugagaagacugcaggaggaggccagaaaggaggagggccagagacuggccagaagacugcaggagcuggagagagacaagaaccugaugcuggccacccugcagcaggagggccugcugagcagauacaagcagcagagacugcugaccgugcugcccagccugcuggacaagaagaagagcguggugagcagccccagaccccccgagugcagcgccagcgcccccguggccgccgccgugcccaccagagagagcaucaagggcagccugagcgugcugcuggacgaccugcaggaccugagcgaggccaucagcaaggaggaggccgugugccagggcgacaaccuggacagaugcagcagcagcaacccccagaugagcagcuaa

SEQ ID NO: 14769 - RNA, 1287 nt, Artificial Sequence
  CCKAR__Homo_sapiens__NP_000721
auggacgugguggacagccugcuggugaacggcagcaacaucaccccccccugcgagcugggccuggagaacgagacccuguucugccuggaccagcccagacccagcaaggaguggcagcccgccgugcagauccugcuguacagccugaucuuccugcugagcgugcugggcaacacccuggugaucaccgugcugaucagaaacaagagaaugagaaccgugaccaacaucuuccugcugagccuggccgugagcgaccugaugcugugccuguucugcaugcccuucaaccugauccccaaccugcugaaggacuucaucuucggcagcgccgugugcaagaccaccaccuacuucaugggcaccagcgugagcgugagcaccuucaaccugguggccaucagccuggagagauacggcgccaucugcaagccccugcagagcagaguguggcagaccaagagccacgcccugaaggugaucgccgccaccuggugccugagcuucaccaucaugacccccuaccccaucuacagcaaccuggugcccuucaccaagaacaacaaccagaccgccaacaugugcagauuccugcugcccaacgacgugaugcagcagagcuggcacaccuuccugcugcugauccuguuccugauccccggcaucgugaugaugguggccuacggccugaucagccuggagcuguaccagggcaucaaguucgaggccagccagaagaagagcgccaaggagagaaagcccagcaccaccagcagcggcaaguacgaggacagcgacggcugcuaccugcagaagaccagaccccccagaaagcuggagcugagacagcugagcaccggcagcagcagcagagccaacagaaucagaagcaacagcagcgccgccaaccugauggccaagaagagagugaucagaaugcugaucgugaucguggugcuguucuuccugugcuggaugcccaucuucagcgccaacgccuggagagccuacgacaccgccagcgccgagagaagacugagcggcacccccaucagcuucauccugcugcugagcuacaccagcagcugcgugaaccccaucaucuacugcuucaugaacaagagauucagacugggcuucauggccaccuuccccugcugccccaaccccggcccccccggcgccagaggcgaggugggcgaggaggaggagggcggcaccaccggcgccagccugagcagauucagcuacagccacaugagcgccagcgugcccccccaguaa

SEQ ID NO: 14770 - RNA, 1344 nt, Artificial Sequence
  CCKBR__Homo_sapiens__NP_795344
auggagcugcugaagcugaacagaagcgugcagggcaccggccccggccccggcgccagccugugcagacccggcgccccccugcugaacagcagcagcgugggcaaccugagcugcgagccccccagaaucagaggcgccggcaccagagagcuggagcuggccaucagaaucacccuguacgccgugaucuuccugaugagcgugggcggcaacaugcugaucaucguggugcugggccugagcagaagacugagaaccgugaccaacgccuuccugcugagccuggccgugagcgaccugcugcuggccguggccugcaugcccuucacccugcugcccaaccugaugggcaccuucaucuucggcaccgugaucugcaaggccgugagcuaccugaugggcgugagcgugagcgugagcacccugagccugguggccaucgcccuggagagauacagcgccaucugcagaccccugcaggccagaguguggcagaccagaagccacgccgccagagugaucguggccaccuggcugcugagcggccugcugauggugcccuaccccguguacaccguggugcagcccgugggccccagagugcugcagugcgugcacagauggcccagcgccagagugagacagaccuggagcgugcugcugcugcugcugcuguucuucauccccggcguggugauggccguggccuacggccugaucagcagagagcuguaccugggccugagauucgacggcgacagcgacagcgacagccagagcagagugagaaaccagggcggccugcccggcgccgugcaccagaacggcagaugcagacccgagaccggcgccgugggcgaggacagcgacggcugcuacgugcagcugcccagaagcagacccgcccuggagcugaccgcccugaccgcccccggccccggcagcggcagcagacccacccaggccaagcugcuggccaagaagagaguggugagaaugcugcuggugaucguggugcuguucuuccugugcuggcugcccguguacagcgccaacaccuggagagccuucgacggccccggcgcccacagagcccugagcggcgcccccaucagcuucauccaccugcugagcuacgccagcgccugcgugaacccccugguguacugcuucaugcacagaagauucagacaggccugccuggagaccugcgccagaugcugccccagaccccccagagccagacccagagcccugcccgacgaggacccccccacccccagcaucgccagccugagcagacugagcuacaccaccaucagcacccugggccccggcuaa

SEQ ID NO: 14771 - RNA, 348 nt, Artificial Sequence
  CCK__Homo_sapiens__NP_000720
augaacagcggcgugugccugugcgugcugauggccgugcuggccgccggcgcccugacccagcccgugccccccgccgaccccgccggcagcggccugcagagagccgaggaggcccccagaagacagcugagagugagccagagaaccgacggcgagagcagagcccaccugggcgcccugcuggccagauacauccagcaggccagaaaggcccccagcggcagaaugagcaucgugaagaaccugcagaaccuggaccccagccacagaaucagcgacagagacuacaugggcuggauggacuucggcagaagaagcgccgaggaguacgaguaccccagcuaa

SEQ ID NO: 14772 - RNA, 294 nt, Artificial Sequence
  CCL11__Homo_sapiens__NP_002977
augaaggugagcgccgcccugcuguggcugcugcugaucgccgccgccuucagcccccagggccuggccggccccgccagcgugcccaccaccugcugcuucaaccuggccaacagaaagaucccccugcagagacuggagagcuacagaagaaucaccagcggcaagugcccccagaaggccgugaucuucaagaccaagcuggccaaggacaucugcgccgaccccaagaagaagugggugcaggacagcaugaaguaccuggaccagaagagccccacccccaagcccuaa

SEQ ID NO: 14773 - RNA, 297 nt, Artificial Sequence
  CCL13__Homo_sapiens__NP_005399
augaaggugagcgccgugcugcugugccugcugcugaugaccgccgccuucaacccccagggccuggcccagcccgacgcccugaacgugcccagcaccugcugcuucaccuucagcagcaagaagaucagccugcagagacugaagagcuacgugaucaccaccagcagaugcccccagaaggccgugaucuucagaaccaagcugggcaaggagaucugcgccgaccccaaggagaagugggugcagaacuacaugaagcaccugggcagaaaggcccacacccugaagaccuaa

SEQ ID NO: 14774 - RNA, 330 nt, Artificial Sequence
  CCL14__Homo_sapiens__NP_116738
augaagaucagcguggccgccauccccuucuuccugcugaucaccaucgcccugggcaccaagaccgagagcagcagccagaccggcggcaagcccaagguggugaagauccagcugaagcuggugggcggccccuaccaccccagcgagugcugcuucaccuacaccaccuacaagauccccagacagagaaucauggacuacuacgagaccaacagccagugcagcaagcccggcaucguguucaucaccaagagaggccacagcgugugcaccaaccccagcgacaagugggugcaggacuacaucaaggacaugaaggagaacuaa

SEQ ID NO: 14775 - RNA, 342 nt, Artificial Sequence
  CCL15__Homo_sapiens__NP_116741
augaaggugagcguggccgcccugagcugccugaugcugguggccgugcugggcagccaggcccaguucaccaacgacgccgagaccgagcugaugaugagcaagcugccccuggagaaccccguggugcugaacagcuuccacuucgccgccgacugcugcaccagcuacaucagccagagcauccccugcagccugaugaagagcuacuucgagaccagcagcgagugcagcaagcccggcgugaucuuccugaccaagaagggcagacaggugugcgccaagcccagcggccccggcgugcaggacugcaugaagaagcugaagcccuacagcaucuaa

SEQ ID NO: 14776 - RNA, 363 nt, Artificial Sequence
  CCL16__Homo_sapiens__XP_005258077
augaaggugagcgaggccgcccugagccugcuggugcugauccugaucaucaccagcgccagcagaagccagcccaaggugcccgagugggugaacacccccagcaccugcugccugaaguacuacgagaaggugcugcccagaagacugguggugggcuacagaaaggcccugaacugccaccugcccgccaucaucuucgugaccaagagaaacagagaggugugcaccaaccccaacgacgacugggugcaggaguacaucaaggaccccaaccugccccugcugcccaccagaaaccugagcaccgugaagaucaucaccgccaagaacggccagccccagcugcugaacagccaguaa

SEQ ID NO: 14777 - RNA, 285 nt, Artificial Sequence
  CCL17__Homo_sapiens__NP_002978
auggccccccugaagaugcuggcccuggugacccugcugcugggcgccagccugcagcacauccacgccgccagaggcaccaacgugggcagagagugcugccuggaguacuucaagggcgccaucccccugagaaagcugaagaccugguaccagaccagcgaggacugcagcagagacgccaucguguucgugaccgugcagggcagagccaucugcagcgaccccaacaacaagagagugaagaacgccgugaaguaccugcagagccuggagagaagcuaa

SEQ ID NO: 14778 - RNA, 270 nt, Artificial Sequence
  CCL18__Homo_sapiens__NP_002979
augaagggccuggccgccgcccugcuggugcuggugugcaccauggcccugugcagcugcgcccaggugggcaccaacaaggagcugugcugccugguguacaccagcuggcagaucccccagaaguucaucguggacuacagcgagaccagcccccagugccccaagcccggcgugauccugcugaccaagagaggcagacagaucugcgccgaccccaacaagaagugggugcagaaguacaucagcgaccugaagcugaacgccuaa

SEQ ID NO: 14779 - RNA, 297 nt, Artificial Sequence
  CCL19__Homo_sapiens__NP_006265
auggcccugcugcuggcccugagccugcuggugcuguggaccagccccgcccccacccugagcggcaccaacgacgccgaggacugcugccugagcgugacccagaagcccauccccggcuacaucgugagaaacuuccacuaccugcugaucaaggacggcugcagagugcccgccgugguguucaccacccugagaggcagacagcugugcgccccccccgaccagcccuggguggagagaaucauccagagacugcagagaaccagcgccaagaugaagagaagaagcagcuaa

SEQ ID NO: 14780 - RNA, 291 nt, Artificial Sequence
  CCL1__Homo_sapiens__NP_002972
augcagaucaucaccaccgcccuggugugccugcugcuggccggcauguggcccgaggacguggacagcaagagcaugcaggugcccuucagcagaugcugcuucagcuucgccgagcaggagaucccccugagagccauccugugcuacagaaacaccagcagcaucugcagcaacgagggccugaucuucaagcugaagagaggcaaggaggccugcgcccuggacaccgugggcugggugcagagacacagaaagaugcugagacacugccccagcaagagaaaguaa

SEQ ID NO: 14781 - RNA, 288 nt, Artificial Sequence
  CCL20__Homo_sapiens__NP_001123518
augugcugcaccaagagccugcugcuggccgcccugaugagcgugcugcugcugcaccugugcggcgagagcgaggccagcaacuucgacugcugccugggcuacaccgacagaauccugcaccccaaguucaucgugggcuucaccagacagcuggccaacgagggcugcgacaucaacgccaucaucuuccacaccaagaagaagcugagcgugugcgccaaccccaagcagaccugggugaaguacaucgugagacugcugagcaagaaggugaagaacauguaa

SEQ ID NO: 14782 - RNA, 405 nt, Artificial Sequence
  CCL21__Homo_sapiens__NP_002980
auggcccagagccuggcccugagccugcugauccuggugcuggccuucggcauccccagaacccagggcagcgacggcggcgcccaggacugcugccugaaguacagccagagaaagauccccgccaagguggugagaagcuacagaaagcaggagcccagccugggcugcagcauccccgccauccuguuccugcccagaaagagaagccaggccgagcugugcgccgaccccaaggagcugugggugcagcagcugaugcagcaccuggacaagacccccagcccccagaagcccgcccagggcugcagaaaggacagaggcgccagcaagaccggcaagaagggcaagggcagcaagggcugcaagagaaccgagagaagccagacccccaagggccccuaa

SEQ ID NO: 14783 - RNA, 282 nt, Artificial Sequence
  CCL22__Homo_sapiens__NP_002981
auggacagacugcagaccgcccugcugguggugcuggugcugcuggccguggcccugcaggccaccgaggccggccccuacggcgccaacauggaggacagcgugugcugcagagacuacgugagauacagacugccccugagaguggugaagcacuucuacuggaccagcgacagcugccccagacccggcguggugcugcugaccuucagagacaaggagaucugcgccgaccccagagugcccugggugaagaugauccugaacaagcugagccaguaa

SEQ ID NO: 14784 - RNA, 414 nt, Artificial Sequence
  CCL23__Homo_sapiens__NP_005055
augaaggugagcguggccgcccugagcugccugaugcuggugaccgcccugggcagccaggccagagugaccaaggacgccgagaccgaguucaugaugagcaagcugccccuggagaaccccgugcugcuggacaugcuguggagaagaaagaucggcccccagaugacccugagccacgccgccggcuuccacgccaccagcgccgacugcugcaucagcuacacccccagaagcauccccugcagccugcuggagagcuacuucgagaccaacagcgagugcagcaagcccggcgugaucuuccugaccaagaagggcagaagauucugcgccaaccccagcgacaagcaggugcaggugugcaugagaaugcugaagcuggacaccagaaucaagaccagaaagaacuaa

SEQ ID NO: 14785 - RNA, 360 nt, Artificial Sequence
  CCL24__Homo_sapiens__XP_011514762
auggccggccugaugaccaucgugaccagccugcuguuccugggcgugugcgcccaccacaucauccccaccggcagcguggugauccccagccccugcugcauguucuucgugagcaagagaauccccgagaacagaguggugagcuaccagcugagcagcagaagcaccugccugaaggccggcgugaucuucaccaccaagaagggccagcaguucugcggcgaccccaagcaggagugggugcagagauacaugaagaaccuggacgccaagcagaagaaggccagccccagagccagagccguggccgugaagggccccgugcagagauaccccggcaaccagaccaccugcuaa

SEQ ID NO: 14786 - RNA, 450 nt, Artificial Sequence
  CCL25__Homo_sapiens__NP_001188288
augaaccuguggcugcuggccugccugguggccggcuuccugggcgccugggcccccgccgugcacacccagggcguguucgaggacugcugccuggccuaccacuaccccaucggcugggccgugcugagaagagccuggaccuacagaauccaggaggugagcggcagcugcaaccugcccgccgccaucuucuaccugcccaagagacacagaaaggugugcggcaaccccaagagcagagaggugcagagagccaugaagcugcuggacgccagaaacaagguguucgccaagcugcaccacaacacccagaccuuccagggcccccacgccgugaagaagcugagcagcggcaacagcaagcugagcagcagcaaguucagcaaccccaucagcagcagcaagagaaacgugagccugcugaucagcgccaacagcggccuguaa

SEQ ID NO: 14787 - RNA, 285 nt, Artificial Sequence
  CCL26__Homo_sapiens__NP_006063
augaugggccugagccuggccagcgccgugcugcuggccagccugcugagccugcaccugggcaccgccaccagaggcagcgacaucagcaagaccugcugcuuccaguacagccacaagccccugcccuggaccugggugagaagcuacgaguucaccagcaacagcugcagccagagagccgugaucuucaccaccaagagaggcaagaaggugugcacccaccccagaaagaagugggugcagaaguacaucagccugcugaagacccccaagcagcuguaa

SEQ ID NO: 14788 - RNA, 339 nt, Artificial Sequence
  CCL27__Homo_sapiens__NP_006655
augaagggcccccccaccuucugcagccugcugcugcugagccugcugcugagccccgaccccaccgccgccuuccugcugccccccagcaccgccugcugcacccagcuguacagaaagccccugagcgacaagcugcugagaaaggugauccagguggagcugcaggaggccgacggcgacugccaccugcaggccuucgugcugcaccuggcccagagaagcaucugcauccacccccagaaccccagccugagccagugguucgagcaccaggagagaaagcugcacggcacccugcccaagcugaacuucggcaugcugagaaagaugggcuaa

SEQ ID NO: 14789 - RNA, 384 nt, Artificial Sequence
  CCL28__Homo_sapiens__NP_001288802
augcagcagagaggccuggccaucguggcccuggccgugugcgccgcccugcacgccagcgaggccauccugcccaucgccagcagcugcugcaccgaggugagccaccacaucagcagaagacugcuggagagagugaacaugugcagaauccagagagccgacggcgacugcgaccuggccgccgugauccugcacgugaagagaagaagaaucugcgugagcccccacaaccacaccgugaagcaguggaugaaggugcaggccgccaagaagaacggcaagggcaacgugugccacagaaagaagcaccacggcaagagaaacagcaacagagcccaccagggcaagcacgagaccuacggccacaagacccccuacuaa

SEQ ID NO: 14790 - RNA, 300 nt, Artificial Sequence
  CCL2__Homo_sapiens__NP_002973
augaaggugagcgccgcccugcugugccugcugcugaucgccgccaccuucaucccccagggccuggcccagcccgacgccaucaacgcccccgugaccugcugcuacaacuucaccaacagaaagaucagcgugcagagacuggccagcuacagaagaaucaccagcagcaagugccccaaggaggccgugaucuucaagaccaucguggccaaggagaucugcgccgaccccaagcagaagugggugcaggacagcauggaccaccuggacaagcagacccagacccccaagaccuaa

SEQ ID NO: 14791 - RNA, 279 nt, Artificial Sequence
  CCL3__Homo_sapiens__NP_002974
augcaggugagcaccgccgcccuggccgugcugcugugcaccauggcccugugcaaccaguucagcgccagccuggccgccgacacccccaccgccugcugcuucagcuacaccagcagacagaucccccagaacuucaucgccgacuacuucgagaccagcagccagugcagcaagcccggcgugaucuuccugaccaagagaagcagacaggugugcgccgaccccagcgaggagugggugcagaaguacgugagcgaccuggagcugagcgccuaa

SEQ ID NO: 14792 - RNA, 282 nt, Artificial Sequence
  CCL3L3__Homo_sapiens__NP_001001437
augcaggugagcaccgccgcccuggccgugcugcugugcaccauggcccugugcaaccaggugcugagcgccccccuggccgccgacacccccaccgccugcugcuucagcuacaccagcagacagaucccccagaacuucaucgccgacuacuucgagaccagcagccagugcagcaagcccagcgugaucuuccugaccaagagaggcagacaggugugcgccgaccccagcgaggagugggugcagaaguacgugagcgaccuggagcugagcgccuaa

SEQ ID NO: 14793 - RNA, 279 nt, Artificial Sequence
  CCL4__Homo_sapiens__NP_002975
augaagcugugcgugaccgugcugagccugcugaugcugguggccgccuucugcagccccgcccugagcgcccccaugggcagcgacccccccaccgccugcugcuucagcuacaccgccagaaagcugcccagaaacuucgugguggacuacuacgagaccagcagccugugcagccagcccgccgugguguuccagaccaagagaagcaagcaggugugcgccgaccccagcgagagcugggugcaggaguacguguacgaccuggagcugaacuaa

SEQ ID NO: 14794 - RNA, 279 nt, Artificial Sequence
  CCL4L1__Homo_sapiens__NP_996890
augaagcugugcgugaccgugcugagccugcuggugcugguggccgccuucugcagccuggcccugagcgcccccaugggcagcgacccccccaccgccugcugcuucagcuacaccgccagaaagcugcccagaaacuucgugguggacuacuacgagaccagcagccugugcagccagcccgccgugguguuccagaccaagagaggcaagcaggugugcgccgaccccagcgagagcugggugcaggaguacguguacgaccuggagcugaacuaa

SEQ ID NO: 14795 - RNA, 264 nt, Artificial Sequence
  CCL4L2__Homo_sapiens__NP_001278397
augaagcugugcgugaccgugcugagccugcuggugcugguggccgccuucugcagccuggcccugagcgcccccaugggcagcgacccccccaccgccugcugcuucagcuacaccgccagaaagcugcccagaaacuucgugguggacuacuacgagaccagcagccugugcagccagcccgccguggugggcaagcaggugugcgccgaccccagcgagagcugggugcaggaguacguguacgaccuggagcugaacuaa

SEQ ID NO: 14796 - RNA, 465 nt, Artificial Sequence
  CCL5__Homo_sapiens__NP_001265665
augaaggugagcgccgccgcccuggccgugauccugaucgccaccgcccugugcgcccccgccagcgccagccccuacagcagcgacaccacccccugcugcuucgccuacaucgccagaccccugcccagagcccacaucaaggaguacuucuacaccagcggcaagugcagcaaccccgccguggugcacagaagcagaaugcccaagagagagggccagcagguguggcaggacuuccuguacgacagcagacugaacaagggcaagcugugccaccccaaggagccccccagcgugugccagcccagagaggagaugggcagcggcgugcaccagcuguucggcgacgagcugggcuggagagugcuggagcccgagcugacccagaucugccuguuccugcuggcccuggugcuggccugggaggccagcccccacuaccccaccccccccgcccccuaa

SEQ ID NO: 14797 - RNA, 300 nt, Artificial Sequence
  CCL7__Homo_sapiens__NP_006264
augaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcuguaa

SEQ ID NO: 14798 - RNA, 300 nt, Artificial Sequence
  CCL8__Homo_sapiens__NP_005614
augaaggugagcgccgcccugcugugccugcugcugauggccgccaccuucagcccccagggccuggcccagcccgacagcgugagcauccccaucaccugcugcuucaacgugaucaacagaaagauccccauccagagacuggagagcuacaccagaaucaccaacauccagugccccaaggaggccgugaucuucaagaccaagagaggcaaggaggugugcgccgaccccaaggagagaugggugagagacagcaugaagcaccuggaccagaucuuccagaaccugaagcccuaa

SEQ ID NO: 14799 - RNA, 1398 nt, Artificial Sequence
  CCM2__Homo_sapiens__NP_001025006
augcacagcagcugcagacagagaagaaaccagaaccugagcaaggagaucccccagaccgaguuccacaccggcuacagcauggagaacgagcccggcaucgugagccccuucaagagaguguuccugaagggcgagaagagcagagacaagaaggcccacgagaaggugaccgagagaagaccccugcacaccguggugcugagccugcccgagagaguggagcccgacagacugcugagcgacuacaucgagaaggaggugaaguaccugggccagcugaccagcauccccggcuaccugaaccccagcagcagaaccgagauccugcacuucaucgacaacgccaagagagcccaccagcugcccggccaccugacccaggagcacgacgccgugcugagccugagcgccuacaacgugaagcuggccuggagagacggcgaggacaucauccugagagugcccauccacgacaucgccgccgugagcuacgugagagacgacgccgcccaccugguggugcugaagaccgcccaggaccccggcaucagccccagccagagccugugcgccgagagcagcagaggccugagcgccggcagccugagcgagagcgccgugggccccguggaggccugcugccuggugauccuggccgccgagagcaagguggccgccgaggagcugugcugccugcugggccagguguuccaggugguguacaccgagagcaccaucgacuuccuggacagagccaucuucgacggcgccagcacccccacccaccaccugagccugcacagcgacgacagcagcaccaagguggacaucaaggagaccuacgagguggaggccagcaccuucugcuuccccgagagcguggacgugggcggcgccagcccccacagcaagaccaucagcgagagcgagcugagcgccagcgccaccgagcugcugcaggacuacaugcugacccugagaaccaagcugagcagccaggagauccagcaguucgccgcccugcugcacgaguacagaaacggcgccagcauccacgaguucugcaucaaccugagacagcuguacggcgacagcagaaaguuccugcugcugggccugagacccuucauccccgagaaggacagccagcacuucgagaacuuccuggagaccaucggcgugaaggacggcagaggcaucaucaccgacagcuucggcagacacagaagagcccugagcaccaccagcagcagcaccaccaacggcaacagagccaccggcagcagcgacgacagaagcgcccccagcgagggcgacgagugggacagaaugaucagcgacaucagcagcgacaucgaggcccugggcugcagcauggaccaggacagcgccuaa

SEQ ID NO: 14800 - RNA, 1395 nt, Artificial Sequence
  CCNA1__Homo_sapiens__NP_001104515
auggagaccggcuuccccgccaucauguaccccggcagcuucaucggcggcuggggcgaggaguaccugagcugggagggccccggccugcccgacuucguguuccagcagcccguggagagcgaggccaugcacugcagcaaccccaagagcggcguggugcuggccaccguggccagaggccccgacgccugccagauccugaccagagccccccugggccaggaccccccccagagaaccgugcugggccugcugaccgccaacggccaguacagaagaaccugcggccagggcaucaccagaaucagaugcuacagcggcagcgagaacgccuucccccccgccggcaagaaggcccugcccgacugcggcgugcaggagccccccaagcagggcuucgacaucuacauggacgagcuggagcagggcgacagagacagcugcagcgugagagagggcauggccuucgaggacguguacgagguggacaccggcacccugaagagcgaccugcacuuccugcuggacuucaacaccgugagccccaugcugguggacagcagccugcugagccagagcgaggacaucagcagccugggcaccgacgugaucaacgugaccgaguacgccgaggagaucuaccaguaccugagagaggccgagaucagacacagacccaaggcccacuacaugaagaagcagcccgacaucaccgagggcaugagaaccauccugguggacuggcugguggaggugggcgaggaguacaagcugagagccgagacccuguaccuggccgugaacuuccuggacagauuccugagcugcaugagcgugcugagaggcaagcugcagcuggugggcaccgccgccaugcugcuggccagcaaguacgaggagaucuacccccccgagguggacgaguucguguacaucaccgacgacaccuacaccaagagacagcugcugaagauggagcaccugcugcugaaggugcuggccuucgaccugaccgugcccaccaccaaccaguuccugcugcaguaccugagaagacagggcgugugcgugagaaccgagaaccuggccaaguacguggccgagcugagccugcuggaggccgaccccuuccugaaguaccugcccagccugaucgccgccgccgccuucugccuggccaacuacaccgugaacaagcacuucuggcccgagacccuggccgccuucaccggcuacagccugagcgagaucgugcccugccugagcgagcugcacaaggccuaccuggacaucccccacagaccccagcaggccaucagagagaaguacaaggccagcaaguaccugugcgugagccugauggagccccccgccgugcugcugcugcaguaa

SEQ ID NO: 14801 - RNA, 1299 nt, Artificial Sequence
  CCNA2__Homo_sapiens__NP_001228
augcugggcaacagcgcccccggccccgccaccagagaggccggcagcgcccugcuggcccugcagcagaccgcccugcaggaggaccaggagaacaucaaccccgagaaggccgcccccgugcagcagcccagaaccagagccgcccuggccgugcugaagagcggcaaccccagaggccuggcccagcagcagagacccaagaccagaagaguggccccccugaaggaccugcccgugaacgacgagcacgugaccgugccccccuggaaggccaacagcaagcagcccgccuucaccauccacguggacgaggccgagaaggaggcccagaagaagcccgccgagagccagaagaucgagagagaggacgcccuggccuucaacagcgccaucagccugcccggccccagaaagccccuggugccccuggacuaccccauggacggcagcuucgagagcccccacaccauggacaugagcaucgugcuggaggacgagaagcccgugagcgugaacgaggugcccgacuaccacgaggacauccacaccuaccugagagagauggaggugaagugcaagcccaaggugggcuacaugaagaagcagcccgacaucaccaacagcaugagagccauccugguggacuggcugguggaggugggcgaggaguacaagcugcagaacgagacccugcaccuggccgugaacuacaucgacagauuccugagcagcaugagcgugcugagaggcaagcugcagcuggugggcaccgccgccaugcugcuggccagcaaguucgaggagaucuacccccccgagguggccgaguucguguacaucaccgacgacaccuacaccaagaagcaggugcugagaauggagcaccuggugcugaaggugcugaccuucgaccuggccgcccccaccgugaaccaguuccugacccaguacuuccugcaccagcagcccgccaacugcaagguggagagccuggccauguuccugggcgagcugagccugaucgacgccgaccccuaccugaaguaccugcccagcgugaucgccggcgccgccuuccaccuggcccuguacaccgugaccggccagagcuggcccgagagccugaucagaaagaccggcuacacccuggagagccugaagcccugccugauggaccugcaccagaccuaccugaaggccccccagcacgcccagcagagcaucagagagaaguacaagaacagcaaguaccacggcgugagccugcugaacccccccgagacccugaaccuguaa

SEQ ID NO: 14802 - RNA, 1302 nt, Artificial Sequence
  CCNB1__Homo_sapiens__NP_114172
auggcccugagagugaccagaaacagcaagaucaacgccgagaacaaggccaagaucaacauggccggcgccaagagagugcccaccgcccccgccgccaccagcaagcccggccugagacccagaaccgcccugggcgacaucggcaacaaggugagcgagcagcugcaggccaagaugcccaugaagaaggaggccaagcccagcgccaccggcaaggugaucgacaagaagcugcccaagccccuggagaaggugcccaugcuggugcccgugcccgugagcgagcccgugcccgagcccgagcccgagcccgagcccgagcccgugaaggaggagaagcugagccccgagcccauccugguggacaccgccagccccagccccauggagaccagcggcugcgcccccgccgaggaggaccugugccaggccuucagcgacgugauccuggccgugaacgacguggacgccgaggacggcgccgaccccaaccugugcagcgaguacgugaaggacaucuacgccuaccugagacagcuggaggaggagcaggccgugagacccaaguaccugcugggcagagaggugaccggcaacaugagagccauccugaucgacuggcuggugcaggugcagaugaaguucagacugcugcaggagaccauguacaugaccgugagcaucaucgacagauucaugcagaacaacugcgugcccaagaagaugcugcagcuggugggcgugaccgccauguucaucgccagcaaguacgaggagauguacccccccgagaucggcgacuucgccuucgugaccgacaacaccuacaccaagcaccagaucagacagauggagaugaagauccugagagcccugaacuucggccugggcagaccccugccccugcacuuccugagaagagccagcaagaucggcgagguggacguggagcagcacacccuggccaaguaccugauggagcugaccaugcuggacuacgacauggugcacuucccccccagccagaucgccgccggcgccuucugccuggcccugaagauccuggacaacggcgaguggacccccacccugcagcacuaccugagcuacaccgaggagagccugcugcccgugaugcagcaccuggccaagaacguggugauggugaaccagggccugaccaagcacaugaccgugaagaacaaguacgccaccagcaagcacgccaagaucagcacccugccccagcugaacagcgcccuggugcaggaccuggccaaggccguggccaagguguaa

SEQ ID NO: 14803 - RNA, 1197 nt, Artificial Sequence
  CCNB2__Homo_sapiens__NP_004692
auggcccugcugagaagacccaccgugagcagcgaccuggagaacaucgacaccggcgugaacagcaaggugaagagccacgugaccaucagaagaaccgugcuggaggagaucggcaacagagugaccaccagagccgcccagguggccaagaaggcccagaacaccaaggugcccgugcagcccaccaagaccaccaacgugaacaagcagcugaagcccaccgccagcgugaagcccgugcagauggagaagcuggcccccaagggccccagccccacccccgaggacgugagcaugaaggaggagaaccugugccaggccuucagcgacgcccugcugugcaagaucgaggacaucgacaacgaggacugggagaacccccagcugugcagcgacuacgugaaggacaucuaccaguaccugagacagcuggaggugcugcagagcaucaacccccacuuccuggacggcagagacaucaacggcagaaugagagccauccugguggacuggcuggugcaggugcacagcaaguucagacugcugcaggagacccuguacaugugcgugggcaucauggacagauuccugcaggugcagcccgugagcagaaagaagcugcagcuggugggcaucaccgcccugcugcuggccagcaaguacgaggagauguucagccccaacaucgaggacuucguguacaucaccgacaacgccuacaccagcagccagaucagagagauggagacccugauccugaaggagcugaaguucgagcugggcagaccccugccccugcacuuccugagaagagccagcaaggccggcgagguggacguggagcagcacacccuggccaaguaccugauggagcugacccugaucgacuacgacauggugcacuaccaccccagcaagguggccgccgccgccagcugccugagccagaaggugcugggccagggcaaguggaaccugaagcagcaguacuacaccggcuacaccgagaacgaggugcuggaggugaugcagcacauggccaagaacguggugaaggugaacgagaaccugaccaaguucaucgccaucaagaacaaguacgccagcagcaagcugcugaagaucagcaugaucccccagcugaacagcaaggccgugaaggaccuggccagcccccugaucggcagaagcuaa

SEQ ID NO: 14804 - RNA, 876 nt, Artificial Sequence
  CCNB3__Homo_sapiens__NP_391990
augcugcugccccugcccccccagagcagcaagcccgugcccaagaagagccagagcagcaagaucgugcccagccaccacgaccccagcgagaagaccggcgagaacugccagaccaagaucagccccagcagccugcaggagagccccagcagccugcagggcgcccugaagaagagaagcgccuucgaggaccugaccaacgugagcuucgagaugacccacgagacccuguaccuggccgugaagcugguggaccuguaccugaugaaggccgugugcaagaaggacaagcugcagcugcugggcgccaccgccuucaugaucgccgccaaguucgaggagcacaacagccccagaguggacgacuucguguacaucugcgacgacaacuaccagagaagcgaggugcugagcauggagaucaacauccugaacgugcugaagugcgacaucaacauccccaucgccuaccacuuccugagaagauacgccagaugcauccacaccaacaugaagacccugacccugagcagauacaucugcgagaugacccugcaggaguaccacuacgugcaggagaaggccagcaagcuggccgccgccagccugcugcuggcccuguacaugaagaagcugggcuacugggugcccuuccuggagcacuacagcggcuacagcaucagcgagcugcacccccuggugagacagcugaacaagcugcugaccuucagcagcuacgacagccugaaggccguguacuacaaguacagccaccccguguucuucgagguggccaagauccccgcccuggacaugcugaagcuggaggagauccugaacugcgacugcgaggcccagggccuggugcuguaa

SEQ ID NO: 14805 - RNA, 597 nt, Artificial Sequence
  CCNC__Homo_sapiens__NP_001013417
auggcccccaccugcguguuccuggccagcaagguggaggaguucggcguggugagcaacaccagacugaucgccgccgccaccagcgugcugaagaccagauucagcuacgccuuccccaaggaguuccccuacagaaugaaccacauccuggagugcgaguucuaccugcuggagcugauggacugcugccugaucguguaccaccccuacagaccccugcugcaguacgugcaggacaugggccaggaggacaugcugcugccccuggccuggagaaucgugaacgacaccuacagaaccgaccugugccugcuguacccccccuucaugaucgcccuggccugccugcacguggccugcguggugcagcagaaggacgccagacagugguucgccgagcugagcguggacauggagaagauccuggagaucaucagagugauccugaagcuguacgagcaguggaagaacuucgacgagagaaaggagauggccaccauccugagcaagaugcccaagcccaagcccccccccaacagcgagggcgagcagggccccaacggcagccagaacagcagcuacagccagagcuaa

SEQ ID NO: 14806 - RNA, 888 nt, Artificial Sequence
  CCND1__Homo_sapiens__NP_444284
auggagcaccagcugcugugcugcgagguggagaccaucagaagagccuaccccgacgccaaccugcugaacgacagagugcugagagccaugcugaaggccgaggagaccugcgcccccagcgugagcuacuucaagugcgugcagaaggaggugcugcccagcaugagaaagaucguggccaccuggaugcuggaggugugcgaggagcagaagugcgaggaggagguguucccccuggccaugaacuaccuggacagauuccugagccuggagcccgugaagaagagcagacugcagcugcugggcgccaccugcauguucguggccagcaagaugaaggagaccaucccccugaccgccgagaagcugugcaucuacaccgacaacagcaucagacccgaggagcugcugcagauggagcugcugcuggugaacaagcugaaguggaaccuggccgccaugaccccccacgacuucaucgagcacuuccugagcaagaugcccgaggccgaggagaacaagcagaucaucagaaagcacgcccagaccuucguggcccugugcgccaccgacgugaaguucaucagcaacccccccagcaugguggccgccggcagcgugguggccgccgugcagggccugaaccugagaagccccaacaacuuccugagcuacuacagacugaccagauuccugagcagagugaucaagugcgaccccgacugccugagagccugccaggagcagaucgaggcccugcuggagagcagccugagacaggcccagcagaacauggaccccaaggccgccgaggaggaggaggaggaggaggaggagguggaccuggccugcacccccaccgacgugagagacguggacaucuaa

SEQ ID NO: 14807 - RNA, 870 nt, Artificial Sequence
  CCND2__Homo_sapiens__NP_001750
auggagcugcugugccacgagguggaccccgugagaagagccgugagagacagaaaccugcugagagacgacagagugcugcagaaccugcugaccaucgaggagagauaccugccccagugcagcuacuucaagugcgugcagaaggacauccagcccuacaugagaagaaugguggccaccuggaugcuggaggugugcgaggagcagaagugcgaggaggagguguucccccuggccaugaacuaccuggacagauuccuggccggcgugcccacccccaagagccaccugcagcugcugggcgccgugugcauguuccuggccagcaagcugaaggagaccagcccccugaccgccgagaagcugugcaucuacaccgacaacagcaucaagccccaggagcugcuggagugggagcugguggugcugggcaagcugaaguggaaccuggccgccgugaccccccacgacuucaucgagcacauccugagaaagcugccccagcagagagagaagcugagccugaucagaaagcacgcccagaccuucaucgcccugugcgccaccgacuucaaguucgccauguacccccccagcaugaucgccaccggcagcgugggcgccgccaucugcggccugcagcaggacgaggaggugagcagccugaccugcgacgcccugaccgagcugcuggccaagaucaccaacaccgacguggacugccugaaggccugccaggagcagaucgaggccgugcugcugaacagccugcagcaguacagacaggaccagagagacggcagcaagagcgaggacgagcuggaccaggccagcacccccaccgacgugagagacaucgaccuguaa

SEQ ID NO: 14808 - RNA, 636 nt, Artificial Sequence
  CCND3__Homo_sapiens__NP_001129489
augaacuaccuggacagauaccugagcugcgugcccaccagaaaggcccagcugcagcugcugggcgccgugugcaugcugcuggccagcaagcugagagagaccaccccccugaccaucgagaagcugugcaucuacaccgaccacgccgugagccccagacagcugagagacugggaggugcuggugcugggcaagcugaagugggaccuggccgccgugaucgcccacgacuuccuggccuucauccugcacagacugagccugcccagagacagacaggcccuggugaagaagcacgcccagaccuuccuggcccugugcgccaccgacuacaccuucgccauguacccccccagcaugaucgccaccggcagcaucggcgccgccgugcagggccugggcgccugcagcaugagcggcgacgagcugaccgagcugcuggccggcaucaccggcaccgagguggacugccugagagccugccaggagcagaucgaggccgcccugagagagagccugagagaggccagccagaccagcagcagccccgcccccaaggcccccagaggcagcagcagccagggccccagccagaccagcacccccaccgacgugaccgccauccaccuguaa

SEQ ID NO: 14809 - RNA, 1083 nt, Artificial Sequence
  CCNDBP1__Homo_sapiens__NP_036274
auggccagcgccaccgcccccgccgccgccgugcccacccuggccagcccccuggagcagcugagacaccuggccgaggagcugagacugcugcugcccagagugagagugggcgaggcccaggagaccaccgaggaguucaacagagagauguucuggagaagacugaacgaggccgccgugaccgugagcagagaggccaccacccugaccaucguguucagccagcugccccugcccagcccccaggagacccagaaguucugcgagcaggugcacgccgccaucaaggccuucaucgccguguacuaccugcugcccaaggaccagggcaucacccugagaaagcuggugagaggcgccacccuggacaucguggacggcauggcccagcugauggaggugcugagcgugacccccacccagagccccgagaacaacgaccugaucagcuacaacagcguguggguggccugccagcagaugccccagauccccagagacaacaaggccgccgcccugcugaugcugaccaagaacguggacuucgugaaggacgcccacgaggagauggagcaggccguggaggagugcgaccccuacagcggccugcugaacgacaccgaggagaacaacagcgacaaccacaaccacgaggacgacgugcugggcuuccccagcaaccaggaccuguacuggagcgaggacgaccaggagcugaucauccccugccuggcccuggugagagccagcaaggccugccugaagaagaucagaaugcugguggccgagaacggcaagaaggaccagguggcccagcuggacgacaucguggacaucagcgacgagaucagccccagcguggacgaccuggcccugagcaucuacccccccaugugccaccugaccgugagaaucaacagcgccaagcuggugagcgugcugaagaaggcccuggagaucaccaaggccagccacgugaccccccagcccgaggacagcuggaucccccugcugaucaacgccaucgaccacugcaugaacagaaucaaggagcugacccagagcgagcuggagcuguaa

SEQ ID NO: 14810 - RNA, 1233 nt, Artificial Sequence
  CCNE1__Homo_sapiens__NP_001229
augcccagagagagaagagagagagacgccaaggagagagacaccaugaaggaggacggcggcgccgaguucagcgccagaagcagaaagagaaaggccaacgugaccguguuccugcaggaccccgacgaggagauggccaagaucgacagaaccgccagagaccagugcggcagccagcccugggacaacaacgccgugugcgccgaccccugcagccugauccccacccccgacaaggaggacgacgacagaguguaccccaacagcaccugcaagcccagaaucaucgcccccagcagaggcagcccccugcccgugcugagcugggccaacagagaggagguguggaagaucaugcugaacaaggagaagaccuaccugagagaccagcacuuccuggagcagcacccccugcugcagcccaagaugagagccauccugcuggacuggcugauggaggugugcgagguguacaagcugcacagagagaccuucuaccuggcccaggacuucuucgacagauacauggccacccaggagaacguggugaagacccugcugcagcugaucggcaucagcagccuguucaucgccgccaagcuggaggagaucuacccccccaagcugcaccaguucgccuacgugaccgacggcgccugcagcggcgacgagauccugaccauggagcugaugaucaugaaggcccugaaguggagacugagcccccugaccaucgugagcuggcugaacguguacaugcagguggccuaccugaacgaccugcacgaggugcugcugccccaguacccccagcagaucuucauccagaucgccgagcugcuggaccugugcgugcuggacguggacugccuggaguuccccuacggcauccuggccgccagcgcccuguaccacuucagcagcagcgagcugaugcagaaggugagcggcuaccaguggugcgacaucgagaacugcgugaaguggauggugcccuucgccauggugaucagagagaccggcagcagcaagcugaagcacuucagaggcguggccgacgaggacgcccacaacauccagacccacagagacagccuggaccugcuggacaaggccagagccaagaaggccaugcugagcgagcagaacagagccagcccccugcccagcggccugcugacccccccccagagcggcaagaagcagagcagcggccccgagauggccuaa

SEQ ID NO: 14811 - RNA, 1215 nt, Artificial Sequence
  CCNE2__Homo_sapiens__NP_477097
augagcagaagaagcagcagacugcaggccaagcagcagccccagcccagccagaccgagagcccccaggaggcccagaucauccaggccaagaagagaaagaccacccaggacgugaagaagagaagagaggaggugaccaagaagcaccaguacgagaucagaaacugcuggccccccgugcugagcggcggcaucagccccugcaucaucaucgagaccccccacaaggagaucggcaccagcgacuucagcagauucaccaacuacagauucaagaaccuguucaucaaccccagcccccugcccgaccugagcuggggcugcagcaaggagguguggcugaacaugcugaagaaggagagcagauacgugcacgacaagcacuucgaggugcugcacagcgaccuggagccccagaugagaagcauccugcuggacuggcugcuggaggugugcgagguguacacccugcacagagagaccuucuaccuggcccaggacuucuucgacagauucaugcugacccagaaggacaucaacaagaacaugcugcagcugaucggcaucaccagccuguucaucgccagcaagcuggaggagaucuacgcccccaagcugcaggaguucgccuacgugaccgacggcgccugcagcgaggaggacauccugagaauggagcugaucauccugaaggcccugaagugggagcugugccccgugaccaucaucagcuggcugaaccuguuccugcagguggacgcccugaaggacgcccccaaggugcugcugccccaguacagccaggagaccuucauccagaucgcccagcugcuggaccugugcauccuggccaucgacagccuggaguuccaguacagaauccugaccgccgccgcccugugccacuucaccagcaucgagguggugaagaaggccagcggccuggagugggacagcaucagcgagugcguggacuggauggugcccuucgugaacguggugaagagcaccagccccgugaagcugaagaccuucaagaagauccccauggaggacagacacaacauccagacccacaccaacuaccuggccaugcuggaggaggugaacuacaucaacaccuucagaaagggcggccagcugagccccgugugcaacggcggcaucaugaccccccccaagagcaccgagaagccccccggcaagcacuaa

SEQ ID NO: 14812 - RNA, 2361 nt, Artificial Sequence
  CCNF__Homo_sapiens__NP_001752
augggcagcggcggcguggugcacugcagaugcgccaagugcuucugcuaccccaccaagagaagaaucagaagaagacccagaaaccugaccauccugagccugcccgaggacgugcuguuccacauccugaaguggcugagcguggaggacauccuggccgugagagccgugcacagccagcugaaggaccugguggacaaccacgccagcgugugggccugcgccagcuuccaggagcuguggcccagccccggcaaccugaagcuguucgagagagccgccgagaagggcaacuucgaggccgccgugaagcugggcaucgccuaccuguacaacgagggccugagcgugagcgacgaggccagagccgaggugaacggccugaaggccagcagauucuucagccuggccgagagacugaacgugggcgccgcccccuucaucuggcuguucaucagaccccccuggagcgugagcggcagcugcugcaaggccguggugcacgagagccugagagccgagugccagcugcagagaacccacaaggccagcauccugcacugccugggcagagugcugagccuguucgaggacgaggagaagcagcagcaggcccacgaccuguucgaggaggccgcccaccagggcugccugaccagcagcuaccugcugugggagagcgacagaagaaccgacgugagcgaccccggcagaugccugcacagcuucagaaagcugagagacuacgccgccaagggcugcugggaggcccagcugagccuggccaaggccugcgccaacgccaaccagcugggccuggaggugagagccagcagcgagaucgugugccagcuguuccaggccagccaggccgugagcaagcagcagguguucagcgugcagaagggccugaacgacaccaugagauacauccugaucgacuggcugguggagguggccaccaugaaggacuucaccagccugugccugcaccugaccguggagugcguggacagauaccugagaagaagacuggugcccagauacagacugcagcugcugggcaucgccugcauggugaucugcaccagauucaucagcaaggagauccugaccaucagagaggccguguggcugaccgacaacaccuacaaguacgaggaccuggugagaaugaugggcgagaucgugagcgcccuggagggcaagaucagagugcccaccgugguggacuacaaggaggugcugcugacccuggugcccguggagcugagaacccagcaccugugcagcuuccugugcgagcugagccugcugcacaccagccugagcgccuacgcccccgccagacuggccgccgccgcccugcugcuggccagacugacccacggccagacccagcccuggaccacccagcugugggaccugaccggcuucagcuacgaggaccugauccccugcgugcugagccugcacaagaagugcuuccacgacgacgcccccaaggacuacagacaggugagccugaccgccgugaagcagagauucgaggacaagagauacggcgagaucagccaggaggaggugcugagcuacagccagcugugcgccgcccugggcgugacccaggacagccccgacccccccaccuuccugagcaccggcgagauccacgccuuccugagcagccccagcggcagaagaaccaagagaaagagagagaacagccugcaggaggacagaggcagcuucgugaccacccccaccgccgagcugagcagccaggaggagacccugcugggcagcuuccuggacuggagccuggacugcugcagcggcuacgagggcgaccaggagagcgagggcgagaaggagggcgacgugaccgcccccagcggcauccuggacgugaccgugguguaccugaaccccgagcagcacugcugccaggagagcagcgacgaggaggccugccccgaggacaagggcccccaggacccccaggcccuggcccuggacacccagauccccgccacccccggccccaagccccuggugagaaccagcagagagcccggcaaggacgugaccaccagcggcuacagcagcgugagcaccgccagccccaccagcagcguggacggcggccugggcgcccugccccagcccaccagcgugcugagccuggacagcgacagccacacccagcccugccaccaccaggccagaaagagcugccugcagugcagaccccccagcccccccgagagcagcgugccccagcagcaggugaagagaaucaaccugugcauccacagcgaggaggaggacaugaaccugggccuggugagacuguaa

SEQ ID NO: 14813 - RNA, 888 nt, Artificial Sequence
  CCNG1__Homo_sapiens__NP_954854
augaucgaggugcugaccaccaccgacagccagaagcugcugcaccagcugaacgcccugcuggagcaggagagcagaugccagcccaaggugugcggccugagacugaucgagagcgcccacgacaacggccugagaaugaccgccagacugagagacuucgaggugaaggaccugcugagccugacccaguucuucggcuucgacaccgagaccuucagccuggccgugaaccugcuggacagauuccugagcaagaugaaggugcagcccaagcaccugggcugcgugggccugagcugcuucuaccuggccgugaagagcaucgaggaggagagaaacgugccccuggccaccgaccugaucagaaucagccaguacagauucaccgugagcgaccugaugagaauggagaagaucgugcuggagaaggugugcuggaaggugaaggccaccaccgccuuccaguuccugcagcuguacuacagccugcugcaggagaaccugccccuggagagaagaaacagcaucaacuucgagagacuggaggcccagcugaaggccugccacugcagaaucaucuucagcaaggccaagcccagcgugcuggcccugagcaucaucgcccuggagauccaggcccagaagugcguggagcugaccgagggcaucgagugccugcagaagcacagcaagaucaacggcagagaccugaccuucuggcaggagcuggugagcaagugccugaccgaguacagcagcaacaagugcagcaagcccaacgugcagaagcugaaguggaucgugagcggcagaaccgccagacagcugaagcacagcuacuacagaaucacccaccugcccaccauccccgagauggugcccuaa

SEQ ID NO: 14814 - RNA, 1035 nt, Artificial Sequence
  CCNG2__Homo_sapiens__XP_011530701
augaaggaccugggcgccgagcaccuggccggccacgagggcgugcagcugcugggccugcugaacguguaccuggagcaggaggagagauuccagcccagagagaagggccugagccugaucgaggccacccccgagaacgacaacacccugugccccggccugagaaacgccaagguggaggaccugagaagccuggccaacuucuucggcagcugcaccgagaccuucgugcuggccgugaacauccuggacagauuccuggcccugaugaaggugaagcccaagcaccugagcugcaucggcgugugcagcuuccugcuggccgccagaaucguggaggaggacugcaacauccccagcacccacgacgugaucagaaucagccagugcaagugcaccgccagcgacaucaagagaauggagaagaucaucagcgagaagcugcacuacgagcuggaggccaccaccgcccugaacuuccugcaccuguaccacaccaucauccugugccacaccagcgagagaaaggagauccugagccuggacaagcuggaggcccagcugaaggccugcaacugcagacugaucuucagcaaggccaagcccagcgugcuggcccugugccugcugaaccuggagguggagacccugaagagcguggagcugcuggagauccugcugcuggugaagaagcacagcaagaucaacgacaccgaguucuucuacuggagagagcuggugagcaagugccuggccgaguacagcagccccgagugcugcaagcccgaccugaagaagcugguguggaucgugagcagaagaaccgcccagaaccugcacaacagcuacuacagcgugcccgagcugcccaccauccccgagggcggcugcuucgacgagagcgagagcgaggacagcugcgaggacaugagcugcggcgaggagagccugagcagcagcccccccagcgaccaggagugcaccuucuucuucaacuucaagguggcccagacccugugcuuccccagcuaa

SEQ ID NO: 14815 - RNA, 813 nt, Artificial Sequence
  CCNH__Homo_sapiens__NP_001186118
augacccugugcaaguacuacgagaagagacugcuggaguucugcagcguguucaagcccgccaugcccagaagcguggugggcaccgccugcauguacuucaagagauucuaccugaacaacagcgugauggaguaccaccccagaaucaucaugcugaccugcgccuuccuggccugcaagguggacgaguucaacgugagcagcccccaguucgugggcaaccugagagagagcccccugggccaggagaaggcccuggagcagauccuggaguacgagcugcugcugauccagcagcugaacuuccaccugaucgugcacaaccccuacagacccuucgagggcuuccugaucgaccugaagaccagauaccccauccuggagaaccccgagauccugagaaagaccgccgacgacuuccugaacagaaucgcccugaccgacgccuaccugcuguacacccccagccagaucgcccugaccgccauccugagcagcgccagcagagccggcaucaccauggagagcuaccugagcgagagccugaugcugaaggagaacagaaccugccugagccagcugcuggacaucaugaagagcaugagaaaccuggugaagaaguacgagccccccagaagcgaggagguggccgugcugaagcagaagcuggagagaugccacagcgccgagcuggcccugaacgugaucaccaagaagagaaagggcuacgaggacgacgacuacgugagcaagaagagcaagcacgaggaggaggaguggaccgacgacgaccugguggagagccuguaa

SEQ ID NO: 14816 - RNA, 1134 nt, Artificial Sequence
  CCNI__Homo_sapiens__NP_006826
augaaguuccccggcccccuggagaaccagagacugagcuuccugcuggagaaggccaucaccagagaggcccagauguggaaggugaacgugagaaagaugcccagcaaccagaacgugagccccagccagagagacgaggugauccaguggcuggccaagcugaaguaccaguucaaccuguaccccgagaccuucgcccuggccagcagccugcuggacagauuccuggccaccgugaaggcccaccccaaguaccugagcugcaucgccaucagcugcuucuuccuggccgccaagaccguggaggaggacgagagaauccccgugcugaaggugcuggccagagacagcuucugcggcugcagcagcagcgagauccugagaauggagagaaucauccuggacaagcugaacugggaccugcacaccgccaccccccuggacuuccugcacaucuuccacgccaucgccgugagcaccagaccccagcugcuguucagccugcccaagcugagccccagccagcaccuggccgugcugaccaagcagcugcugcacugcauggccugcaaccagcugcugcaguucagaggcagcaugcuggcccuggccauggugagccuggagauggagaagcugauccccgacuggcugagccugaccaucgagcugcugcagaaggcccagauggacagcagccagcugauccacugcagagagcugguggcccaccaccugagcacccugcagagcagccugccccugaacagcguguacguguacagaccccugaagcacacccuggugaccugcgacaagggcguguucagacugcaccccagcagcgugcccggccccgacuucagcaaggacaacagcaagcccgaggugcccgugagaggcaccgccgccuucuaccaccaccugcccgccgccagcggcugcaagcagaccagcaccaagagaaagguggaggagauggagguggacgacuucuacgacggcaucaagagacuguacaacgaggacaacgugagcgagaacgugggcagcgugugcggcaccgaccugagcagacaggagggccacgccagccccugccccccccugcagcccgugagcgugauguaa

SEQ ID NO: 14817 - RNA, 1152 nt, Artificial Sequence
  CCNJ__Homo_sapiens__NP_001127847
auggagcuggagggccagugguggagaggccagcuggccgccgacauccaccaggcccugagauacaaggagcugaagcugcccagcuacaagggccagagcccccagcugagccugagaagauacuucgccgaccugaucgccaucgugagcaacagauucacccugugccccagcgccagacaccuggccguguaccugcuggaccuguucauggacagauacgacaucagcauccagcagcugcaccugguggcccugagcugccugcugcuggccagcaaguucgaggagaaggaggacagcgugcccaagcuggagcagcugaacagccugggcugcaugaccaacaugaaccuggugcugaccaagcagaaccugcugcacauggagcugcugcugcuggagaccuuccaguggaaccugugccugcccaccgccgcccacuucaucgaguacuaccugagcgaggccgugcacgagaccgaccugcacgacggcuggcccaugaucugccuggagaagaccaagcuguacauggccaaguacgccgacuacuuccuggaggugagccugcaggacuacgccuuccugaacuacgcccccagccugguggccgccgccugcguggccagcagcagaaucauccugagacugagccccaccuggcccaccagacugcacagacugaccgccuacagcugggacuuccuggugcagugcaucgagagacugcugaucgcccacgacaacgacgugaaggaggccaacaagcagagaggccaggccggcccccagagcgcccagcugagcguguuccagaccgccagccagcccagcagacccgugcacuuccagcagccccaguaccugcaccagacccaccagaccagccugcaguacagacaccccaccagcgagcagcccagcugccagcagaucgugagcaccacccacaccagcagcuacacccugcagaccugccccgccggcuuccagaccagcgugcagggccugggccacaugcagaccggcgugggcaugagccuggccauccccguggaggugaagcccugccugagcgugagcuacaacagaagcuaccagaucaacgagcacuaccccugcaucacccccugcuucgagagauaa

SEQ ID NO: 14818 - RNA, 1308 nt, Artificial Sequence
  CCNJL__Homo_sapiens__NP_078841
augauggacgagcccuggugggagggcagaguggccagcgacgugcacugcacccugagagagaaggagcugaagcugcccaccuucagagcccacagcccccugcugaagagcagaagauucuucguggacauccugacccugcugagcagccacugccagcugugccccgccgccagacaccuggccguguaccugcuggaccacuucauggacagauacaacgugaccaccagcaagcagcuguacaccguggccgugagcugccugcugcuggccaacggcgugagccugcugagccccagacugaagugcagcggcaugaucagcgcccacugcaaccugcaccugcccggcagcagcaacagccccgccagcgccccccaccccccccccacccccccccagguggccgagaccaccggcaaguucgaggacagagaggaccacgugcccaagcuggagcagaucaacagcaccagaauccugagcagccagaacuucacccugaccaagaaggagcugcugagcaccgagcugcugcugcuggaggccuucagcuggaaccugugccugcccacccccgcccacuuccuggacuacuaccugcuggccagcgugagccagaaggaccaccacugccacaccuggcccaccaccugccccagaaagaccaaggagugccugaaggaguacgcccacuacuuccuggaggugacccugcaggaccacaucuucuacaaguuccagcccagcgugguggccgccgccugcgugggcgccagcagaaucugccugcagcugagccccuacuggaccagagaccugcagagaaucagcagcuacagccuggagcaccugagcaccugcaucgagauccugcuggugguguacgacaacgugcugaaggacgccguggccgugaagagccaggcccuggccauggugcccggcaccccccccacccccacccaggugcuguuccagccccccgccuaccccgcccugggccagcccgccaccacccuggcccaguuccagacccccgugcaggaccugugccuggccuacagagacagccugcaggcccacagaagcggcagccugcugagcggcagcaccggcagcagccugcacacccccuaccagccccugcagccccuggacaugugccccgugcccgugcccgccagccugagcaugcacauggccaucgccgccgagcccagacacugccuggccaccaccuacggcagcagcuacuucagcggcagccacauguuccccaccggcugcuucgacagauaa

SEQ ID NO: 14819 - RNA, 1743 nt, Artificial Sequence
  CCNK__Homo_sapiens__XP_011535577
augaaggagaacaaggagaacagcagccccagcgugaccagcgccaaccuggaccacaccaagcccugcugguacugggacaagaaggaccuggcccacacccccagccagcuggagggccuggaccccgccaccgaggccagauacagaagagagggcgccagauucaucuucgacgugggcaccagacugggccugcacuacgacacccuggccaccggcaucaucuacuuccacagauucuacauguuccacagcuucaagcaguuccccagauacgugaccggcgccugcugccuguuccuggccggcaagguggaggagacccccaagaagugcaaggacaucaucaagaccgccagaagccugcugaacgacgugcaguucggccaguucggcgacgaccccaaggaggaggugauggugcuggagagaauccugcugcagaccaucaaguucgaccugcagguggagcaccccuaccaguuccugcugaaguacgccaagcagcugaagggcgacaagaacaagauccagaagcuggugcagauggccuggaccuucgugaacgacagccugugcaccacccugagccugcagugggagcccgagaucaucgccguggccgugauguaccuggccggcagacugugcaaguucgagauccaggaguggaccagcaagcccauguacagaagauggugggagcaguucgugcaggacgugcccguggacgugcuggaggacaucugccaccagauccuggaccuguacagccagggcaagcagcagaugccccaccacaccccccaccagcugcagcagccccccagccugcagcccaccccccaggugccccaggugcagcagagccagcccagccagagcagcgagcccagccagccccagcagaaggacccccagcagcccgcccagcagcagcagcccgcccagcagcccaagaagcccagcccccagcccagcagccccagacaggugaagagagccgugguggugagccccaaggaggagaacaaggccgccgagccccccccccccaagauccccaagaucgagaccacccaccccccccugccccccgcccaccccccccccgacagaaagcccccccuggccgccgcccugggcgaggccgagccccccggccccguggacgccaccgaccugcccaaggugcagauccccccccccgcccaccccgcccccgugcaccagccccccccccugccccacagaccccccccccccccccccagcagcuacaugaccggcaugagcaccaccagcagcuacaugagcggcgagggcuaccagagccugcagagcaugaugaagaccgagggccccagcuacggcgcccugccccccgccuacggcccccccgcccaccugcccuaccacccccacguguacccccccaaccccccccccccccccgugccccccccccccgccagcuuccccccccccgccauccccccccccacccccggcuaccccccccccccccccaccuacaaccccaacuuccccccccccccccccagacugccccccacccacgccgugcccccccaccccccccccggccugggccugccccccgccagcuaccccccccccgccgugccccccggcggccagccccccgugcccccccccauccccccccccggcaugccccccgugggcggccugggcagagccgccuggaugagauaa

SEQ ID NO: 14820 - RNA, 1581 nt, Artificial Sequence
  CCNL1__Homo_sapiens__NP_064703
auggccagcggcccccacagcaccgccaccgccgccgccgccgccagcagcgccgcccccagcgccggcggcagcagcagcggcaccaccaccaccaccaccaccaccaccggcggcauccugaucggcgacagacuguacagcgaggugagccugaccaucgaccacagccugauccccgaggagagacugagccccacccccagcaugcaggacggccuggaccugcccagcgagaccgaccugagaauccugggcugcgagcugauccaggccgccggcauccugcugagacugccccagguggccauggccaccggccaggugcuguuccacagauucuucuacagcaagagcuucgugaagcacagcuucgagaucguggccauggccugcaucaaccuggccagcaagaucgaggaggcccccagaagaaucagagacgugaucaacguguuccaccaccugagacagcugagaggcaagagaacccccagcccccugauccuggaccagaacuacaucaacaccaagaaccaggugaucaaggccgagagaagagugcugaaggagcugggcuucugcgugcacgugaagcacccccacaagaucaucgugauguaccugcaggugcuggagugcgagagaaaccagacccuggugcagaccgccuggaacuacaugaacgacagccugagaaccaacguguucgugagauuccagcccgagaccaucgccugcgccugcaucuaccuggccgccagagcccugcagaucccccugcccaccagaccccacugguuccugcuguucggcaccaccgaggaggagauccaggagaucugcaucgagacccugagacuguacaccagaaagaagcccaacuacgagcugcuggagaaggagguggagaagagaaagguggcccugcaggaggccaagcugaaggccaagggccugaaccccgacggcacccccgcccugagcacccugggcggcuucagccccgccagcaagcccagcagccccagagaggugaaggccgaggagaagagccccaucagcaucaacgugaagaccgugaagaaggagcccgaggacagacagcaggccagcaagagccccuacaacggcgugagaaaggacagcaagagaagcagaaacagcagaagcgccagcagaagcagaagcagaaccagaagcagaagcagaagccacacccccagaagacacuacaacaacagaagaagcagaagcggcaccuacagcagcagaagcagaagcagaagcagaagccacagcgagagccccagaagacaccacaaccacggcagcccccaccugaaggccaagcacaccagagacgaccugaagagcagcaacagacacggccacaagagaaagaagagcagaagcagaagccagagcaagagcagagaccacagcgacgccgccaagaagcacagacacgagagaggccaccacagagacagaagagagagaagcagaagcuucgagagaagccacaagagcaagcaccacggcggcagcagaagcggccacggcagacacagaagauaa

SEQ ID NO: 14821 - RNA, 1170 nt, Artificial Sequence
  CCNL2__Homo_sapiens__XP_011540521
augggccagcuggccgccgcccugaugagccccagaagaggccugccccugggcgccgagagccccagcgccagaugcagccacgccagcaaccugcaccccagaggcuucagccuguuccagguggacagcuucaaggaggccgccgccagaagcgccgagaagggccccgccgccagcgcccuggaggaggaggaggaggagcccaagagaauggccugccugcccgccgccacccccgcccugugcagcgccagcagcuucgagaacuacaugaacgacagccugagaaccgacguguucgugagauuccagcccgagagcaucgccugcgccugcaucuaccuggccgccagaacccuggagaucccccugcccaacagaccccacugguuccugcuguucggcgccaccgaggaggagauccaggagaucugccugaagauccugcagcuguacgccagaaagaagguggaccugacccaccuggagggcgagguggagaagagaaagcacgccaucgaggaggccaaggcccaggccagaggccugcugcccggcggcacccaggugcuggacggcaccagcggcuucagccccgcccccaagcugguggagagccccaaggagggcaagggcagcaagcccagcccccugagcgugaagaacaccaagagaagacuggagggcgccaagaaggccaaggccgacagccccgugaacggccugcccaagggcagagagagcagaagcagaagcagaagcagagagcagagcuacagcagaagccccagcagaagcgccagccccaagagaagaaagagcgacagcggcagcaccagcggcggcagcaagagccagagcagaagcagaagcagaagcgacagcccccccagacaggcccccagaagcgcccccuacaagggcagcgagaucagaggcagcagaaagagcaaggacugcaaguacccccagaagccccacaagagcagaagcagaagcagcagcagaagcagaagcagaagcagagagagagccgacaaccccggcaaguacaagaagaagagccacuacuacagagaccagagaagagagagaagcagaagcuacgagagaaccggcagaagauacgagagagaccaccccggccacagcagacacagaagauaa

SEQ ID NO: 14822 - RNA, 1053 nt, Artificial Sequence
  CCNO__Homo_sapiens__NP_066970
auggugacccccugccccaccagccccagcagccccgccgccagagccggcagaagagacaacgaccagaaccugagagcccccgugaagaagagcagaagacccagacugagaagaaagcagccccugcacccccugaaccccugcccccugcccggcgacagcggcaucugcgaccuguucgagagccccagcagcggcagcgacggcgccgagagccccagcgccgccagaggcggcagcccccugcccggccccgcccagcccguggcccagcuggaccugcagaccuucagagacuacggccagagcugcuacgccuucagaaaggcccaggagagccacuuccaccccagagaggcccuggccagacagccccaggugaccgccgagagcagaugcaagcugcugagcuggcugauccccgugcacagacaguucggccugagcuucgagagccugugccugaccgugaacacccuggacagauuccugaccaccacccccguggccgccgacugcuuccagcugcugggcgugaccagccugcugaucgccugcaagcagguggaggugcacccccccagagugaagcagcugcuggcccugugcugcggcgccuucagcagacagcagcugugcaaccuggagugcaucgugcugcacaagcugcacuucacccugggcgcccccaccaucagcuucuuccuggagcacuucacccacgccagaguggaggccggccaggccgaggccagcgaggcccuggaggcccaggcccuggccagaggcguggccgagcugagccuggccgacuacgccuucaccagcuacagccccagccugcuggccaucugcugccuggcccuggccgacagaaugcugagagugagcagacccguggaccugagacugggcgaccaccccgaggccgcccuggaggacugcaugggcaagcugcagcugcugguggccaucaacagcaccagccugacccacaugcugcccgugcagaucugcgagaagugcagccugccccccagcagcaaguaa

SEQ ID NO: 14823 - RNA, 2181 nt, Artificial Sequence
  CCNT1__Homo_sapiens__NP_001231
auggagggcgagagaaagaacaacaacaagagaugguacuucaccagagagcagcuggagaacagccccagcagaagauucggcguggaccccgacaaggagcugagcuacagacagcaggccgccaaccugcugcaggacaugggccagagacugaacgugagccagcugaccaucaacaccgccaucguguacaugcacagauucuacaugauccagagcuucacccaguuccccggcaacagcguggcccccgccgcccuguuccuggccgccaagguggaggagcagcccaagaagcuggagcacgugaucaagguggcccacaccugccugcacccccaggagagccugcccgacaccagaagcgaggccuaccugcagcaggugcaggaccuggugauccuggagagcaucauccugcagacccugggcuucgagcugaccaucgaccacccccacacccacguggugaagugcacccagcuggugagagccagcaaggaccuggcccagaccagcuacuucauggccaccaacagccugcaccugaccaccuucagccugcaguacaccccccccgugguggccugcgugugcauccaccuggccugcaaguggagcaacugggagauccccgugagcaccgacggcaagcacuggugggaguacguggacgccaccgugacccuggagcugcuggacgagcugacccacgaguuccugcagauccuggagaagacccccaacagacugaagagaaucuggaacuggagagccugcgaggccgccaagaagaccaaggccgacgacagaggcaccgacgagaagaccagcgagcagaccauccugaacaugaucagccagagcagcagcgacaccaccaucgccggccugaugagcaugagcaccagcaccaccagcgccgugcccagccugcccgugagcgaggagagcagcagcaaccugaccagcguggagaugcugcccggcaagagauggcugagcagccagcccagcuucaagcuggagcccacccagggccacagaaccagcgagaaccuggcccugaccggcguggaccacagccugccccaggacggcagcaacgccuucaucagccagaagcagaacagcaagagcgugcccagcgccaaggugagccugaaggaguacagagccaagcacgccgaggagcuggccgcccagaagagacagcuggagaacauggaggccaacgugaagagccaguacgccuacgccgcccagaaccugcugagccaccacgacagccacagcagcgugauccugaagaugcccaucgagggcagcgagaaccccgagagacccuuccuggagaaggccgacaagaccgcccugaagaugagaauccccguggccggcggcgacaaggccgccagcagcaagcccgaggagaucaagaugagaaucaaggugcacgccgccgccgacaagcacaacagcguggaggacagcgugaccaagagcagagagcacaaggagaagcacaagacccaccccagcaaccaccaccaccaccacaaccaccacagccacaagcacagccacagccagcugcccgugggcaccggcaacaagagacccggcgaccccaagcacagcagccagaccagcaaccuggcccacaagaccuacagccugagcagcagcuucagcagcagcagcagcaccagaaagagaggccccagcgaggagaccggcggcgccguguucgaccaccccgccaagaucgccaagagcaccaagagcagcagccugaacuucagcuuccccagccugcccaccaugggccagaugcccggccacagcagcgacaccagcggccugagcuucagccagcccagcugcaagaccagagugccccacagcaagcuggacaagggccccaccggcgccaacggccacaacaccacccagaccaucgacuaccaggacaccgugaacaugcugcacagccugcugagcgcccagggcgugcagcccacccagcccaccgccuucgaguucgugagacccuacagcgacuaccugaaccccagaagcggcggcaucagcagcagaagcggcaacaccgacaagcccagaccccccccccugcccagcgagcccccccccccccugcccccccugcccaaguaa

SEQ ID NO: 14824 - RNA, 951 nt, Artificial Sequence
  CCNY__Homo_sapiens__NP_001269781
augggcaacaccaccagcugcugcgugagcagcagccccaagcugagaagaaacgcccacagcagacuggagagcuacagacccgacaccgaccugagcagagaggacaccggcugcaaccugcagcacaucagcgacagagagaacaucgacgugagagagaagagaaagagccuguucaucaaccaccacccccccggccagaucgccagaaaguacagcagcugcagcaccaucuuccuggacgacagcaccgugagccagcccaaccugaaguacaccaucaagugcguggcccuggccaucuacuaccacaucaagaacagagaccccgacggcagaaugcugcuggacaucuucgacgagaaccugcacccccugagcaagagcgaggugccccccgacuacgacaagcacaaccccgagcagaagcagaucuacagauucgugagaacccuguucagcgccgcccagcugaccgccgagugcgccaucgugacccugguguaccuggagagacugcugaccuacgccgagaucgacaucugccccgccaacuggaagagaaucgugcugggcgccauccugcuggccagcaaggugugggacgaccaggccguguggaacguggacuacugccagauccugaaggacaucaccguggaggacaugaacgagcuggagagacaguuccuggagcugcugcaguucaacaucaacgugcccagcagcguguacgccaaguacuacuucgaccugagaagccuggccgaggccaacaaccugagcuucccccuggagccccugagcagagagagagcccacaagcuggaggccaucagcagacugugcgaggacaaguacaaggaccugagaagaagcgccagaaagagaagcgccagcgccgacaaccugacccugcccagauggagccccgccaucaucagcuaa

SEQ ID NO: 14825 - RNA, 2976 nt, Artificial Sequence
  CCP110__Homo_sapiens__NP_055526
auggaggaguacgagaaguucugcgagaagagccuggccagaauccaggaggccagccugagcaccgagagcuuccugcccgcccagagcgagagcaucagccugaucagauuccacggcguggccauccugagcccccugcugaacaucgagaagagaaaggagaugcagcaggagaagcagaaggcccuggacguggaggccagaaagcaggugaacagaaagaaggcccugcugaccagagugcaggagauccuggacaacgugcaggugagaaaggcccccaacgccagcgacuucgaccagugggagauggagaccguguacagcaacagcgaggugagaaaccugaacgugcccgccaccuuccccaacagcuuccccagccacaccgagcacagcaccgccgccaagcuggacaagaucgccggcauccugccccuggacaacgaggaccagugcaagaccgacggcaucgaccuggccagagacagcgagggcuucaacagccccaagcagugcgacagcagcaacaucagccacguggagaacgaggccuuccccaagaccagcagcgccaccccccaggagacccugaucagcgacggccccuucagcgugaacgagcagcaggaccugccccugcuggccgaggugauccccgaccccuacgugaugagccugcagaaccugaugaagaagagcaaggaguacaucgagagagagcagagcagaagaagccugagaggcagcaugaacagaaucgugaacgagagccaccuggacaaggagcacgacgccguggagguggccgacugcgugaaggagaagggccagcugaccggcaagcacugcgugagcgugauccccgacaagcccagccugaacaagagcaacgugcugcugcagggcgccagcacccaggccagcagcaugagcaugcccgugcuggccagcuucagcaagguggacauccccaucagaaccggccaccccaccgugcuggagagcaacagcgacuucaaggugauccccaccuucgugaccgagaacaacgugaucaagagccugaccggcagcuacgccaagcugcccagccccgagcccagcaugagccccaagaugcacagaagaagaagcagaaccagcagcgccugccacauccugaucaacaaccccaucaacgccugcgagcugagccccaagggcaaggagcaggccauggaccugaucauccaggacaccgacgagaacaccaacgugcccgagaucaugcccaagcugcccaccgaccuggccggcgugugcagcagcaagguguacgugggcaagaacaccagcgaggugaaggaggacguggugcugggcaagagcaaccaggugugccagagcagcggcaaccaccuggagaacaaggugacccacggccuggugaccguggagggccagcugaccagcgacgagagaggcgcccacaucaugaacagcaccugcgccgccaugcccaagcugcacgagcccuacgccagcagccagugcaucgccagccccaacuucggcaccgugagcggccugaagcccgccagcaugcuggagaagaacugcagccugcagaccgagcugaacaagagcuacgacgugaagaaccccagcccccugcugaugcagaaccagaacaccagacagcagauggacacccccauggugagcugcggcaacgagcaguuccuggacaacagcuucgagaaggugaagagaagacuggaccuggacaucgacggccugcagaaggagaacugccccuacgugaucaccagcggcaucaccgagcaggagagacagcaccugcccgagaagagauaccccaagggcagcggcuucgugaacaagaacaagaugcugggcaccagcagcaaggagagcgaggagcugcugaagagcaagaugcuggccuucgaggagaugagaaagagacuggaggagcagcacgcccagcagcugagccugcugaucgccgagcaggagagagagcaggagagacugcagaaggagaucgaggagcaggagaagaugcugaaggagaagaaggccaugaccgccgaggccagcgagcuggacaucaacaacgccguggagcuggaguggagaaagaucagcgacagcagccugcuggagaccaugcugagccaggccgacagccugcacaccagcaacagcaacagcagcggcuucaccaacagcgccaugcaguacagcuucgugagcgccaacgaggcccccuucuaccuguggggcagcagcaccagcggccugaccaagcugagcgugaccagacccuucggcagagccaagaccagauggagccagguguucagccuggagauccaggccaaguucaacaagaucaccgccguggccaagggcuuccugaccagaagacugaugcagaccgacaagcugaagcagcugagacagaccgugaaggacaccauggaguucaucagaagcuuccagagcgaggccccccugaagagaggcaucgugagcgcccaggacgccagccugcaggagagagugcuggcccagcugagagccgcccuguacggcauccacgacaucuucuucgugauggacgccgccgagagaaugagcauccugcaccacgacagagaggugagaaaggagaagaugcugagacagauggacaagaugaagagccccagaguggcccugagcgccgccacccagaagagccuggacagaaagaaguacaugaaggccgccgagaugggcaugcccaacaagaaguuccuggugaagcagaaccccagcgagaccagagugcugcagcccaaccagggccagaacgcccccgugcacagacugcugagcagacagggcagcaucugcagaaagaaccccaagaaggccgccaagugcugcgacaaccugagaagacagcacagccugggcuaa

SEQ ID NO: 14826 - RNA, 1089 nt, Artificial Sequence
  CCR10__Homo_sapiens__NP_057686
augggcaccgaggccaccgagcaggugagcuggggccacuacagcggcgacgaggaggacgccuacagcgccgagccccugcccgagcugugcuacaaggccgacgugcaggccuucagcagagccuuccagcccagcgugagccugaccguggccgcccugggccuggccggcaacggccuggugcuggccacccaccuggccgccagaagagccgccagaagccccaccagcgcccaccugcugcagcuggcccuggccgaccugcugcuggcccugacccugcccuucgccgccgccggcgcccugcagggcuggagccugggcagcgccaccugcagaaccaucagcggccuguacagcgccagcuuccacgccggcuuccuguuccuggccugcaucagcgccgacagauacguggccaucgccagagcccugcccgccggccccagacccagcacccccggcagagcccaccuggugagcgugaucguguggcugcugagccugcugcuggcccugcccgcccugcuguucagccaggacggccagagagagggccagagaagaugcagacugaucuuccccgagggccugacccagaccgugaagggcgccagcgccguggcccagguggcccugggcuucgcccugccccugggcgugaugguggccugcuacgcccugcugggcagaacccugcuggccgccagaggccccgagagaagaagagcccugagaguggugguggcccugguggccgccuucguggugcugcagcugcccuacagccuggcccugcugcuggacaccgccgaccugcuggccgccagagagagaagcugccccgccagcaagagaaaggacguggcccugcuggugaccagcggccuggcccuggccagaugcggccugaaccccgugcuguacgccuuccugggccugagauucagacaggaccugagaagacugcugagaggcggcagcugccccagcggcccccagcccagaagaggcugccccagaagacccagacugagcagcugcagcgcccccaccgagacccacagccugagcugggacaacuaa

SEQ ID NO: 14827 - RNA, 1068 nt, Artificial Sequence
  CCR1__Homo_sapiens__NP_001286
auggagacccccaacaccaccgaggacuacgacaccaccaccgaguucgacuacggcgacgccacccccugccagaaggugaacgagagagccuucggcgcccagcugcugcccccccuguacagccugguguucgugaucggccuggugggcaacauccugguggugcuggugcuggugcaguacaagagacugaagaacaugaccagcaucuaccugcugaaccuggccaucagcgaccugcuguuccuguucacccugcccuucuggaucgacuacaagcugaaggacgacuggguguucggcgacgccaugugcaagauccugagcggcuucuacuacaccggccuguacagcgagaucuucuucaucauccugcugaccaucgacagauaccuggccaucgugcacgccguguucgcccugagagccagaaccgugaccuucggcgugaucaccagcaucaucaucugggcccuggccauccuggccagcaugcccggccuguacuucagcaagacccagugggaguucacccaccacaccugcagccugcacuucccccacgagagccugagagaguggaagcuguuccaggcccugaagcugaaccuguucggccuggugcugccccugcuggugaugaucaucugcuacaccggcaucaucaagauccugcugagaagacccaacgagaagaagagcaaggccgugagacugaucuucgugaucaugaucaucuucuuccuguucuggacccccuacaaccugaccauccugaucagcguguuccaggacuuccuguucacccacgagugcgagcagagcagacaccuggaccuggccgugcaggugaccgaggugaucgccuacacccacugcugcgugaaccccgugaucuacgccuucgugggcgagagauucagaaaguaccugagacagcuguuccacagaagaguggccgugcaccuggugaaguggcugcccuuccugagcguggacagacuggagagagugagcagcaccagccccagcaccggcgagcacgagcugagcgccggcuucuaa

SEQ ID NO: 14828 - RNA, 1125 nt, Artificial Sequence
  CCR2__Homo_sapiens__NP_001116513
augcugagcaccagcagaagcagauucaucagaaacaccaacgagagcggcgaggaggugaccaccuucuucgacuacgacuacggcgcccccugccacaaguucgacgugaagcagaucggcgcccagcugcugcccccccuguacagccugguguucaucuucggcuucgugggcaacaugcugguggugcugauccugaucaacugcaagaagcugaagugccugaccgacaucuaccugcugaaccuggccaucagcgaccugcuguuccugaucacccugccccugugggcccacagcgccgccaacgaguggguguucggcaacgccaugugcaagcuguucaccggccuguaccacaucggcuacuucggcggcaucuucuucaucauccugcugaccaucgacagauaccuggccaucgugcacgccguguucgcccugaaggccagaaccgugaccuucggcguggugaccagcgugaucaccuggcugguggccguguucgccagcgugcccggcaucaucuucaccaagugccagaaggaggacagcguguacgugugcggccccuacuuccccagaggcuggaacaacuuccacaccaucaugagaaacauccugggccuggugcugccccugcugaucauggugaucugcuacagcggcauccugaagacccugcugagaugcagaaacgagaagaagagacacagagccgugagagugaucuucaccaucaugaucguguacuuccuguucuggacccccuacaacaucgugauccugcugaacaccuuccaggaguucuucggccugagcaacugcgagagcaccagccagcuggaccaggccacccaggugaccgagacccugggcaugacccacugcugcaucaaccccaucaucuacgccuucgugggcgagaaguucagaagccuguuccacaucgcccugggcugcagaaucgccccccugcagaagcccgugugcggcggccccggcgugagacccggcaagaacgugaaggugaccacccagggccugcuggacggcagaggcaagggcaagagcaucggcagagcccccgaggccagccugcaggacaaggagggcgccuaa

SEQ ID NO: 14829 - RNA, 1122 nt, Artificial Sequence
  CCR3__Homo_sapiens__NP_001158152
augcccuucggcaucagaaugcugcugagagcccacaagcccggcagaagcgagaugaccaccagccuggacaccguggagaccuucggcaccaccagcuacuacgacgacgugggccugcugugcgagaaggccgacaccagagcccugauggcccaguucgugcccccccuguacagccugguguucaccgugggccugcugggcaacguggugguggugaugauccugaucaaguacagaagacugagaaucaugaccaacaucuaccugcugaaccuggccaucagcgaccugcuguuccuggugacccugcccuucuggauccacuacgugagaggccacaacuggguguucggccacggcaugugcaagcugcugagcggcuucuaccacaccggccuguacagcgagaucuucuucaucauccugcugaccaucgacagauaccuggccaucgugcacgccguguucgcccugagagccagaaccgugaccuucggcgugaucaccagcaucgugaccuggggccuggccgugcuggccgcccugcccgaguucaucuucuacgagaccgaggagcuguucgaggagacccugugcagcgcccuguaccccgaggacaccguguacagcuggagacacuuccacacccugagaaugaccaucuucugccuggugcugccccugcuggugauggccaucugcuacaccggcaucaucaagacccugcugagaugccccagcaagaagaaguacaaggccaucagacugaucuucgugaucauggccguguucuucaucuucuggacccccuacaacguggccauccugcugagcagcuaccagagcauccuguucggcaacgacugcgagagaagcaagcaccuggaccuggugaugcuggugaccgaggugaucgccuacagccacugcugcaugaaccccgugaucuacgccuucgugggcgagagauucagaaaguaccugagacacuucuuccacagacaccugcugaugcaccugggcagauacauccccuuccugcccagcgagaagcuggagagaaccagcagcgugagccccagcaccgccgagcccgagcugagcaucguguucuaa

SEQ ID NO: 14830 - RNA, 1083 nt, Artificial Sequence
  CCR4__Homo_sapiens__NP_005499
augaaccccaccgacaucgccgacaccacccuggacgagagcaucuacagcaacuacuaccuguacgagagcauccccaagcccugcaccaaggagggcaucaaggccuucggcgagcuguuccugcccccccuguacagccugguguucguguucggccugcugggcaacagcgugguggugcuggugcuguucaaguacaagagacugagaagcaugaccgacguguaccugcugaaccuggccaucagcgaccugcuguucguguucagccugcccuucuggggcuacuacgccgccgaccaguggguguucggccugggccugugcaagaugaucagcuggauguaccuggugggcuucuacagcggcaucuucuucgugaugcugaugagcaucgacagauaccuggccaucgugcacgccguguucagccugagagccagaacccugaccuacggcgugaucaccagccuggccaccuggagcguggccguguucgccagccugcccggcuuccuguucagcaccugcuacaccgagagaaaccacaccuacugcaagaccaaguacagccugaacagcaccaccuggaaggugcugagcagccuggagaucaacauccugggccuggugaucccccugggcaucaugcuguucugcuacagcaugaucaucagaacccugcagcacugcaagaacgagaagaagaacaaggccgugaagaugaucuucgccgugguggugcuguuccugggcuucuggacccccuacaacaucgugcuguuccuggagacccugguggagcuggaggugcugcaggacugcaccuucgagagauaccuggacuacgccauccaggccaccgagacccuggccuucgugcacugcugccugaaccccaucaucuacuucuuccugggcgagaaguucagaaaguacauccugcagcuguucaagaccugcagaggccuguucgugcugugccaguacugcggccugcugcagaucuacagcgccgacacccccagcagcagcuacacccagagcaccauggaccacgaccugcacgacgcccuguaa

SEQ ID NO: 14831 - RNA, 1059 nt, Artificial Sequence
  CCR5__Homo_sapiens__NP_000570
auggacuaccaggugagcagccccaucuacgacaucaacuacuacaccagcgagcccugccagaagaucaacgugaagcagaucgccgccagacugcugcccccccuguacagccugguguucaucuucggcuucgugggcaacaugcuggugauccugauccugaucaacugcaagagacugaagagcaugaccgacaucuaccugcugaaccuggccaucagcgaccuguucuuccugcugaccgugcccuucugggcccacuacgccgccgcccagugggacuucggcaacaccaugugccagcugcugaccggccuguacuucaucggcuucuucagcggcaucuucuucaucauccugcugaccaucgacagauaccuggccguggugcacgccguguucgcccugaaggccagaaccgugaccuucggcguggugaccagcgugaucaccugggugguggccguguucgccagccugcccggcaucaucuucaccagaagccagaaggagggccugcacuacaccugcagcagccacuuccccuacagccaguaccaguucuggaagaacuuccagacccugaagaucgugauccugggccuggugcugccccugcuggugauggugaucugcuacagcggcauccugaagacccugcugagaugcagaaacgagaagaagagacacagagccgugagacugaucuucaccaucaugaucguguacuuccuguucugggcccccuacaacaucgugcugcugcugaacaccuuccaggaguucuucggccugaacaacugcagcagcagcaacagacuggaccaggccaugcaggugaccgagacccugggcaugacccacugcugcaucaaccccaucaucuacgccuucgugggcgagaaguucagaaacuaccugcugguguucuuccagaagcacaucgccaagagauucugcaagugcugcagcaucuuccagcaggaggcccccgagagagccagcagcguguacaccagaagcaccggcgagcaggagaucagcgugggccuguaa

SEQ ID NO: 14832 - RNA, 1125 nt, Artificial Sequence
  CCR6__Homo_sapiens__NP_004358
augagcggcgagagcaugaacuucagcgacguguucgacagcagcgaggacuacuucgugagcgugaacaccagcuacuacagcguggacagcgagaugcugcugugcagccugcaggaggugagacaguucagcagacuguucgugcccaucgccuacagccugaucugcguguucggccugcugggcaacauccugguggugaucaccuucgccuucuacaagaaggccagaagcaugaccgacguguaccugcugaacauggccaucgccgacauccuguucgugcugacccugcccuucugggccgugagccacgccaccggcgccuggguguucagcaacgccaccugcaagcugcugaagggcaucuacgccaucaacuucaacugcggcaugcugcugcugaccugcaucagcauggacagauacaucgccaucgugcaggccaccaagagcuucagacugagaagcagaacccugcccagaagcaagaucaucugccuggugguguggggccugagcgugaucaucagcagcagcaccuucguguucaaccagaaguacaacacccagggcagcgacgugugcgagcccaaguaccagaccgugagcgagcccaucagauggaagcugcugaugcugggccuggagcugcuguucggcuucuucaucccccugauguucaugaucuucugcuacaccuucaucgugaagacccuggugcaggcccagaacagcaagagacacaaggccaucagagugaucaucgccguggugcugguguuccuggccugccagaucccccacaacauggugcugcuggugaccgccgccaaccugggcaagaugaacagaagcugccagagcgagaagcugaucggcuacaccaagaccgugaccgaggugcuggccuuccugcacugcugccugaaccccgugcuguacgccuucaucggccagaaguucagaaacuacuuccugaagauccugaaggaccuguggugcgugagaagaaaguacaagagcagcggcuucagcugcgccggcagauacagcgagaacaucagcagacagaccagcgagaccgccgacaacgacaacgccagcagcuucaccauguaa

SEQ ID NO: 14833 - RNA, 1137 nt, Artificial Sequence
  CCR7__Homo_sapiens__NP_001829
auggaccugggcaagcccaugaagagcgugcuggugguggcccugcuggugaucuuccaggugugccugugccaggacgaggugaccgacgacuacaucggcgacaacaccaccguggacuacacccuguucgagagccugugcagcaagaaggacgugagaaacuucaaggccugguuccugcccaucauguacagcaucaucugcuucgugggccugcugggcaacggccugguggugcugaccuacaucuacuucaagagacugaagaccaugaccgacaccuaccugcugaaccuggccguggccgacauccuguuccugcugacccugcccuucugggccuacagcgccgccaagagcuggguguucggcgugcacuucugcaagcugaucuucgccaucuacaagaugagcuucuucagcggcaugcugcugcugcugugcaucagcaucgacagauacguggccaucgugcaggccgugagcgcccacagacacagagccagagugcugcugaucagcaagcugagcugcgugggcaucuggauccuggccaccgugcugagcauccccgagcugcuguacagcgaccugcagagaagcagcagcgagcaggccaugagaugcagccugaucaccgagcacguggaggccuucaucaccauccagguggcccagauggugaucggcuuccuggugccccugcuggccaugagcuucugcuaccuggugaucaucagaacccugcugcaggccagaaacuucgagagaaacaaggccaucaaggugaucaucgccgugguggugguguucaucguguuccagcugcccuacaacggcguggugcuggcccagaccguggccaacuucaacaucaccagcagcaccugcgagcugagcaagcagcugaacaucgccuacgacgugaccuacagccuggccugcgugagaugcugcgugaaccccuuccuguacgccuucaucggcgugaaguucagaaacgaccuguucaagcuguucaaggaccugggcugccugagccaggagcagcugagacaguggagcagcugcagacacaucagaagaagcagcaugagcguggaggccgagaccaccaccaccuucagccccuaa

SEQ ID NO: 14834 - RNA, 1068 nt, Artificial Sequence
  CCR8__Homo_sapiens__NP_005192
auggacuacacccuggaccugagcgugaccaccgugaccgacuacuacuaccccgacaucuucagcagccccugcgacgccgagcugauccagaccaacggcaagcugcugcuggccguguucuacugccugcuguucguguucagccugcugggcaacagccuggugauccuggugcugguggugugcaagaagcugagaagcaucaccgacguguaccugcugaaccuggcccugagcgaccugcuguucguguucagcuuccccuuccagaccuacuaccugcuggaccaguggguguucggcaccgugaugugcaagguggugagcggcuucuacuacaucggcuucuacagcagcauguucuucaucacccugaugagcguggacagauaccuggccguggugcacgccguguacgcccugaaggugagaaccaucagaaugggcaccacccugugccuggccguguggcugaccgccaucauggccaccaucccccugcugguguucuaccagguggccagcgaggacggcgugcugcagugcuacagcuucuacaaccagcagacccugaaguggaagaucuucaccaacuucaagaugaacauccugggccugcugauccccuucaccaucuucauguucugcuacaucaagauccugcaccagcugaagagaugccagaaccacaacaagaccaaggccaucagacuggugcugaucguggugaucgccagccugcuguucugggugcccuucaacguggugcuguuccugaccagccugcacagcaugcacauccuggacggcugcagcaucagccagcagcugaccuacgccacccacgugaccgagaucaucagcuucacccacugcugcgugaaccccgugaucuacgccuucgugggcgagaaguucaagaagcaccugagcgagaucuuccagaagagcugcagccagaucuucaacuaccugggcagacagaugcccagagagagcugcgagaagagcagcagcugccagcagcacagcagcagaagcagcagcguggacuacauccuguaa

SEQ ID NO: 14835 - RNA, 1074 nt, Artificial Sequence
  CCR9__Homo_sapiens__NP_001243298
auggccgacgacuacggcagcgagagcaccagcagcauggaggacuacgugaacuucaacuucaccgacuucuacugcgagaagaacaacgugagacaguucgccagccacuuccugcccccccuguacuggcugguguucaucgugggcgcccugggcaacagccuggugauccugguguacugguacugcaccagagugaagaccaugaccgacauguuccugcugaaccuggccaucgccgaccugcuguuccuggugacccugcccuucugggccaucgccgccgccgaccaguggaaguuccagaccuucaugugcaagguggugaacagcauguacaagaugaacuucuacagcugcgugcugcugaucaugugcaucagcguggacagauacaucgccaucgcccaggccaugagagcccacaccuggagagagaagagacugcuguacagcaagauggugugcuucaccaucugggugcuggccgccgcccugugcauccccgagauccuguacagccagaucaaggaggagagcggcaucgccaucugcaccaugguguaccccagcgacgagagcaccaagcugaagagcgccgugcugacccugaaggugauccugggcuucuuccugcccuucguggugauggccugcugcuacaccaucaucauccacacccugauccaggccaagaagagcagcaagcacaaggcccugaaggugaccaucaccgugcugaccguguucgugcugagccaguuccccuacaacugcauccugcuggugcagaccaucgacgccuacgccauguucaucagcaacugcgccgugagcaccaacaucgacaucugcuuccaggugacccagaccaucgccuucuuccacagcugccugaaccccgugcuguacguguucgugggcgagagauucagaagagaccuggugaagacccugaagaaccugggcugcaucagccaggcccagugggugagcuucaccagaagagagggcagccugaagcugagcagcaugcugcuggagaccaccagcggcgcccugagccuguaa

SEQ ID NO: 14836 - RNA, 1071 nt, Artificial Sequence
  CCRL2__Homo_sapiens__NP_001124382
augaucuacaccagauuccugaagggcagccugaagauggccaacuacacccuggcccccgaggacgaguacgacgugcugaucgagggcgagcuggagagcgacgaggccgagcagugcgacaaguacgacgcccaggcccugagcgcccagcuggugcccagccugugcagcgccguguucgugaucggcgugcuggacaaccugcugguggugcugauccuggugaaguacaagggccugaagagaguggagaacaucuaccugcugaaccuggccgugagcaaccugugcuuccugcugacccugcccuucugggcccacgccggcggcgaccccaugugcaagauccugaucggccuguacuucgugggccuguacagcgagaccuucuucaacugccugcugaccgugcagagauaccugguguuccugcacaagggcaacuucuucagcgccagaagaagagugcccugcggcaucaucaccagcgugcuggccugggugaccgccauccuggccacccugcccgaguucgugguguacaagccccagauggaggaccagaaguacaagugcgccuucagcagaacccccuuccugcccgccgacgagaccuucuggaagcacuuccugacccugaagaugaacaucagcgugcuggugcugccccuguucaucuucaccuuccuguacgugcagaugagaaagacccugagauucagagagcagagauacagccuguucaagcugguguucgccaucauggugguguuccugcugaugugggcccccuacaacaucgccuucuuccugagcaccuucaaggagcacuucagccugagcgacugcaagagcagcuacaaccuggacaagagcgugcacaucaccaagcugaucgccaccacccacugcugcaucaacccccugcuguacgccuuccuggacggcaccuucagcaaguaccugugcagaugcuuccaccugagaagcaacaccccccugcagcccagaggccagagcgcccagggcaccagcagagaggagcccgaccacagcaccgagguguaa

SEQ ID NO: 14837 - RNA, 1296 nt, Artificial Sequence
  CCRN4L__Homo_sapiens__NP_036250
auguuccacagccccagaagacugugcagcgcccugcugcagagagacgcccccggccugagaagacugcccgcccccggccugagaagaccccugagcccccccgccgccgugcccagacccgccagccccagacugcuggccgccgccagcgccgccagcggcgccgccagaagcugcagcagaaccgugugcagcaugggcaccggcaccagcagacuguacagcgcccuggccaagacccugaacagcagcgccgccagccagcaccccgaguaccuggugagccccgaccccgagcaccuggagcccaucgaccccaaggagcugcuggaggagugcagagccgugcugcacaccagaccccccagauuccagagagacuucguggaccugagaaccgacugccccagcacccacccccccaucagagugaugcaguggaacauccuggcccaggcccugggcgagggcaaggacaacuucgugcagugccccguggaggcccugaagugggaggagagaaagugccugauccuggaggagauccuggccuaccagcccgacauccugugccugcaggagguggaccacuacuucgacaccuuccagccccugcugagcagacugggcuaccagggcaccuucuuccccaagcccuggagccccugccuggacguggagcacaacaacggccccgacggcugcgcccuguucuuccugcagaacagauucaagcuggugaacagcgccaacaucagacugaccgccaugacccugaagaccaaccagguggccaucgcccagacccuggagugcaaggagagcggcagacaguucugcaucgccgugacccaccugaaggccagaaccggcugggagagauucagaagcgcccagggcugcgaccugcugcagaaccugcagaacaucacccagggcgccaagaucccccugaucgugugcggcgacuucaacgccgagcccaccgaggagguguacaagcacuucgccagcagcagccugaaccugaacagcgccuacaagcugcugagcgccgacggccagagcgagccccccuacaccaccuggaagaucagaaccagcggcgagugcagacacacccuggacuacaucugguacagcaagcacgcccugaacgugagaagcgcccuggaccugcugaccgaggagcagaucggccccaacagacugcccagcuucaacuaccccagcgaccaccugagccuggugugcgacuucagcuucaccgaggagagcgacggccugagcuaa

SEQ ID NO: 14838 - RNA, 2703 nt, Artificial Sequence
  CCSER1__Homo_sapiens__NP_001138537
augggcgacagcggcagcagaagaagcacccuggugagcagacugcccaucuucagaagaagcaucaacagaagacacgacagccugcccagcagccccagcagcagcaacaccgugggcgugcacagcagcagccccagcagcaccaacagcagcagcggcagcaccggcaagagaagaagcaucuucagaacccccagcaucagcuuccaccacaagaagggcagcgagcccaagcaggagcccaccaaccagaaccugagcaucagcaacggcgcccagcccggccacagcaacaugcagaagcugagccuggaggagcacaucaagaccagaggcagacacagcgugggcuucagcagcagcagaaacaagaagaucaccagaagccugaccgaggacuucgagagagagaaggagcacagcaccaacaagaacguguucaucaacugccugagcagcggcaagagcgagggcgacgacagcggcuucaccgaggaccagaccagaagaagcgugaagcagagcaccagaaagcugcugcccaagagcuucagcagccacuacaaguucagcaagcccgugcugcagagccagagcaucagccuggugcagcagagcgaguucagccuggaggugacccaguaccaggagagagagcccgugcuggugagagccagccccagcugcagcguggacgugaccgagagagccggcagcagccugcagagcccccugcugagcgccgaccugaccaccgcccagacccccagcgaguuccuggcccugaccgaggacagcgugagcgagauggacgccuucagcaagagcggcagcauggccagccacugcgacaacuucggccacaacgacagcaccagccagaugagccugaacagcgccgccgugaccaagaccaccaccgagcugaccggcaccgugcccugcgccaucaugagccccggcaaguacagacuggagggccagugcagcaccgagagcaacagccugcccgagaccagcgccgccaaccagaaggaggugcugcugcagaucgccgagcugcccgccaccagcgugagccacagcgagagcaaccugcccgccgacagcgagagagaggagaacaucggccugcagaacggcgagaccaugcugggcaccaacagccccagaaagcugggcuucuacgagcagcacaaggccaucgccgagcacgugaagggcauccaccccaucagcgacagcaagaucauccccaccagcggcgaccaccacaucuucaacaagaccagccacggcuacgaggccaaccccgccaaggugcuggccagcagccugagccccuucagagagggcagauucaucgagagaagacugagaagcagcagcgagggcaccgccggcagcagcagaaugauccugaagcccaaggacggcaacaucgaggaggugaacagccugagaaagcagagagccggcagcagcagcagcaagaugaacagccuggacgugcugaacaaccugggcagcugcgagcuggacgaggacgaccugaugcuggaccuggaguuccuggaggagcagagccugcaccccagcgugugcagagaggacagcuaccacagcguggugagcugcgccgccguggugcugacccccauggagcccaugaucgagaugaagaagagagaggagcccgaguuccccgagcccagcaagcagaaccugagccugaagcugaccaaggacguggaccaggaggccagaugcagccacaucagcagaaugcccaacagccccagcgccgacuggccccugcagggcguggaggagaacggcggcaucgacagccugcccuucagacugaugcugcaggacugcaccgccgugaagacccugcugcugaagaugaagagagugcugcaggagagcgccgacaugagccccgccagcagcaccaccagccugcccgugagcccccugaccgaggagcccgugcccuucaaggacaucaugaaggacgagugcagcaugcugaagcugcagcugaaggagaaggacgagcugaucagccagcugcaggaggagcugggcaaggugagacaccugcagaaggccuucgccagcagaguggacaagagcacccagaccgagcugcugugcuacgacggccugaaccugaagagacuggagaccgugcagggcggcagagaggccaccuacagaaacagaaucgugagccagaaccugagcaccagagacagaaaggccauccacacccccaccgaggacagauucagauacagcgccgccgaccagaccagccccuacaagaacaagaccugccagcugcccagccugugccugagcaacuuccugaaggacaaggagcuggccgaggugaucaagcacagcagaggcaccuacgagacccugaccagcgacgugacccagaaccugagagccaccgugggccagagcagccugaagcccaccgccaagaccgagggccugagcaccuuccuggagaagcccaaggaccagguggccaccgccagacagcacagcaccuucaccggcagauucggccagccccccagaggccccaucagccugcacauguacagcagaaagaacguguuccugcaccacaaccugcacagcaccgagcugcagacccugggccagcaggacggcuaa

SEQ ID NO: 14839 - RNA, 825 nt, Artificial Sequence
  CCS__Homo_sapiens__NP_005116
auggccagcgacagcggcaaccagggcacccugugcacccuggaguucgccgugcagaugaccugccagagcugcguggacgccgugagaaagagccugcagggcguggccggcgugcaggacguggaggugcaccuggaggaccagauggugcuggugcacaccacccugcccagccaggaggugcaggcccugcuggagggcaccggcagacaggccgugcugaagggcaugggcagcggccagcugcagaaccugggcgccgccguggccauccugggcggccccggcaccgugcagggcguggugagauuccugcagcugacccccgagagaugccugaucgagggcaccaucgacggccuggagcccggccugcacggccugcacgugcaccaguacggcgaccugaccaacaacugcaacagcugcggcaaccacuucaaccccgacggcgccagccacggcggcccccaggacagcgacagacacagaggcgaccugggcaacgugagagccgacgccgacggcagagccaucuucagaauggaggacgagcagcugaaggugugggacgugaucggcagaagccugaucaucgacgagggcgaggacgaccugggcagaggcggccacccccugagcaagaucaccggcaacagcggcgagagacuggccugcggcaucaucgccagaagcgccggccuguuccagaaccccaagcagaucugcagcugcgacggccugaccaucugggaggagagaggcagacccaucgccggcaagggcagaaaggagagcgcccagccccccgcccaccuguaa

SEQ ID NO: 14840 - RNA, 1608 nt, Artificial Sequence
  CCT2__Homo_sapiens__NP_006422
auggccagccugagccuggcccccgugaacaucuucaaggccggcgccgacgaggagagagccgagaccgccagacugaccagcuucaucggcgccaucgccaucggcgaccuggugaagagcacccugggccccaagggcauggacaagauccugcugagcagcggcagagacgccagccugauggugaccaacgacggcgccaccauccugaagaacaucggcguggacaaccccgccgccaaggugcugguggacaugagcagagugcaggacgacgaggugggcgacggcaccaccagcgugaccgugcuggccgccgagcugcugagagaggccgagagccugaucgccaagaagauccacccccagaccaucaucgccggcuggagagaggccaccaaggccgccagagaggcccugcugagcagcgccguggaccacggcagcgacgaggugaaguucagacaggaccugaugaacaucgccggcaccacccugagcagcaagcugcugacccaccacaaggaccacuucaccaagcuggccguggaggccgugcugagacugaagggcagcggcaaccuggaggccauccacaucaucaagaagcugggcggcagccuggccgacagcuaccuggacgagggcuuccugcuggacaagaagaucggcgugaaccagcccaagagaaucgagaacgccaagauccugaucgccaacaccggcauggacaccgacaagaucaagaucuucggcagcagagugagaguggacagcaccgccaagguggccgagaucgagcacgccgagaaggagaagaugaaggagaagguggagagaauccugaagcacggcaucaacugcuucaucaacagacagcugaucuacaacuaccccgagcagcuguucggcgccgccggcgugauggccaucgagcacgccgacuucgccggcguggagagacuggcccuggugaccggcggcgagaucgccagcaccuucgaccaccccgagcuggugaagcugggcagcugcaagcugaucgaggaggugaugaucggcgaggacaagcugauccacuucagcggcguggcccugggcgaggccugcaccaucgugcugagaggcgccacccagcagauccuggacgaggccgagagaagccugcacgacgcccugugcgugcuggcccagaccgugaaggacagcagaaccguguacggcggcggcugcagcgagaugcugauggcccacgccgugacccagcuggccaacagaacccccggcaaggaggccguggccauggagagcuacgccaaggcccugagaaugcugcccaccaucaucgccgacaacgccggcuacgacagcgccgaccugguggcccagcugagagccgcccacagcgagggcaacaccaccgccggccuggacaugagagagggcaccaucggcgacauggccauccugggcaucaccgagagcuuccaggugaagagacaggugcugcugagcgccgccgaggccgccgaggugauccugagaguggacaacaucaucaaggccgcccccagaaagagagugcccgaccaccaccccugcuaa

SEQ ID NO: 14841 - RNA, 1524 nt, Artificial Sequence
  CCT3__Homo_sapiens__NP_001008800
augaugggccacagacccgugcuggugcugagccagaacaccaagagagagagcggcagaaaggugcagagcggcaacaucaacgccgccaagauccaggugcagcaccccgccgccaagagcaugaucgagaucagcagaacccaggacgaggaggugggcgacggcaccaccagcgugaucauccuggccggcgagaugcugagcguggccgagcacuuccuggagcagcagaugcaccccaccguggugaucagcgccuacagaaaggcccuggacgacaugaucagcacccugaagaagaucagcauccccguggacaucagcgacagcgacaugaugcugaacaucaucaacagcagcaucaccaccaaggccaucagcagauggagcagccuggccugcaacaucgcccuggacgccgugaagauggugcaguucgaggagaacggcagaaaggagaucgacaucaagaaguacgccagaguggagaagauccccggcggcaucaucgaggacagcugcgugcugagaggcgugaugaucaacaaggacgugacccaccccagaaugagaagauacaucaagaaccccagaaucgugcugcuggacagcagccuggaguacaagaagggcgagagccagaccgacaucgagaucaccagagaggaggacuucaccagaauccugcagauggaggaggaguacauccagcagcugugcgaggacaucauccagcugaagcccgacguggugaucaccgagaagggcaucagcgaccuggcccagcacuaccugaugagagccaacaucaccgccaucagaagagugagaaagaccgacaacaacagaaucgccagagccugcggcgccagaaucgugagcagacccgaggagcugagagaggacgacgugggcaccggcgccggccugcuggagaucaagaagaucggcgacgaguacuucaccuucaucaccgacugcaaggaccccaaggccugcaccauccugcugagaggcgccagcaaggagauccugagcgagguggagagaaaccugcaggacgccaugcaggugugcagaaacgugcugcuggacccccagcuggugcccggcggcggcgccagcgagauggccguggcccacgcccugaccgagaagagcaaggccaugaccggcguggagcaguggcccuacagagccguggcccaggcccuggaggugauccccagaacccugauccagaacugcggcgccagcaccaucagacugcugaccagccugagagccaagcacacccaggagaacugcgagaccuggggcgugaacggcgagaccggcacccugguggacaugaaggagcugggcaucugggagccccuggccgugaagcugcagaccuacaagaccgccguggagaccgccgugcugcugcugagaaucgacgacaucgugagcggccacaagaagaagggcgacgaccagagcagacagggcggcgcccccgacgccggccaggaguaa

SEQ ID NO: 14842 - RNA, 1530 nt, Artificial Sequence
  CCT4__Homo_sapiens__NP_001243650
augcccgagaacguggcccccagaagcggcgccaccgccggcgccgccggcggcagaggcaagggcgccuaccaggacagagacaagcccgcccagaucagauucagcaacaucagcgccgccaaggccguggccgacgccaucagaaccagccugggccccaagggcauggacaagaugcugguggagcugagcaaggcccaggacaucgaggccggcgacggcaccaccagcguggugaucaucgccggcagccugcuggacagcugcaccaagcugcugcagaagggcauccaccccaccaucaucagcgagagcuuccagaaggcccuggagaagggcaucgagauccugaccgacaugagcagacccguggagcugagcgacagagagacccugcugaacagcgccaccaccagccugaacagcaagguggugagccaguacagcagccugcugagccccaugagcgugaacgccgugaugaaggugaucgaccccgccaccgccaccagcguggaccugagagacaucaagaucgugaagaagcugggcggcaccaucgacgacugcgagcugguggagggccuggugcugacccagaaggugagcaacagcggcaucaccagaguggagaaggccaagaucggccugauccaguucugccugagcgcccccaagaccgacauggacaaccagaucguggugagcgacuacgcccagauggacagagugcugagagaggagagagccuacauccugaaccuggugaagcagaucaagaagaccggcugcaacgugcugcugauccagaagagcauccugagagacgcccugagcgaccuggcccugcacuuccugaacaagaugaagaucauggugaucaaggacaucgagagagaggacaucgaguucaucugcaagaccaucggcaccaagcccguggcccacaucgaccaguucaccgccgacaugcugggcagcgccgagcuggccgaggaggugaaccugaacggcagcggcaagcugcugaagaucaccggcugcgccagccccggcaagaccgugaccaucguggugagaggcagcaacaagcuggugaucgaggaggccgagagaagcauccacgacgcccugugcgugaucagaugccuggugaagaagagagcccugaucgccggcggcggcgcccccgagaucgagcuggcccugagacugaccgaguacagcagaacccugagcggcauggagagcuacugcgugagagccuucgccgacgccauggaggugauccccagcacccuggccgagaacgccggccugaaccccaucagcaccgugaccgagcugagaaacagacacgcccagggcgagaagaccgccggcaucaacgugagaaagggcggcaucagcaacauccuggaggagcugguggugcagccccugcuggugagcgugagcgcccugacccuggccaccgagaccgugagaagcauccugaagaucgacgacguggugaacaccagauaa

SEQ ID NO: 14843 - RNA, 1626 nt, Artificial Sequence
  CCT5__Homo_sapiens__NP_036205
auggccagcaugggcacccuggccuucgacgaguacggcagacccuuccugaucaucaaggaccaggacagaaagagcagacugaugggccuggaggcccugaagagccacaucauggccgccaaggccguggccaacaccaugagaaccagccugggccccaacggccuggacaagaugaugguggacaaggacggcgacgugaccgugaccaacgacggcgccaccauccugagcaugauggacguggaccaccagaucgccaagcugaugguggagcugagcaagagccaggacgacgagaucggcgacggcaccaccggcgugguggugcuggccggcgcccugcuggaggaggccgagcagcugcuggacagaggcauccaccccaucagaaucgccgacggcuacgagcaggccgccagaguggccaucgagcaccuggacaagaucagcgacagcgugcugguggacaucaaggacaccgagccccugauccagaccgccaagaccacccugggcagcaagguggugaacagcugccacagacagauggccgagaucgccgugaacgccgugcugaccguggccgacauggagagaagagacguggacuucgagcugaucaagguggagggcaaggugggcggcagacuggaggacaccaagcugaucaagggcgugaucguggacaaggacuucagccacccccagaugcccaagaagguggaggacgccaagaucgccauccugaccugccccuucgagccccccaagcccaagaccaagcacaagcuggacgugaccagcguggaggacuacaaggcccugcagaaguacgagaaggagaaguucgaggagaugauccagcagaucaaggagaccggcgccaaccuggccaucugccaguggggcuucgacgacgaggccaaccaccugcugcugcagaacaaccugcccgccgugagaugggugggcggccccgagaucgagcugaucgccaucgccaccggcggcagaaucgugcccagauucagcgagcugaccgccgagaagcugggcuucgccggccuggugcaggagaucagcuucggcaccaccaaggacaagaugcuggugaucgagcagugcaagaacagcagagccgugaccaucuucaucagaggcggcaacaagaugaucaucgaggaggccaagagaagccugcacgacgcccugugcgugaucagaaaccugaucagagacaacagagugguguacggcggcggcgccgccgagaucagcugcgcccuggccgugagccaggaggccgacaagugccccacccuggagcaguacgccaugagagccuucgccgacgcccuggaggugauccccauggcccugagcgagaacagcggcaugaaccccauccagaccaugaccgaggugagagccagacaggugaaggagaugaaccccgcccugggcaucgacugccugcacaagggcaccaacgacaugaagcagcagcacgugaucgagacccugaucggcaagaagcagcagaucagccuggccacccagauggugagaaugauccugaagaucgacgacaucagaaagcccggcgagagcgaggaguaa

SEQ ID NO: 14844 - RNA, 1461 nt, Artificial Sequence
  CCT6A__Homo_sapiens__NP_001009186
auggccgccgugaagacccugaaccccaaggccgagguggccagagcccaggccgcccuggccgugaacaucagcgccgccagaggccugcaggacgugcugagaaccaaccugggccccaagggcaccaugaagaugcuggugagcggcgccggcgacaucaagcugaccaaggacggcaacgugcugcugcacgagaugggccugcaccccagaaucaucaccgagggcuucgaggccgccaaggagaaggcccugcaguuccuggaggaggugaaggugagcagagagauggacagagagacccugaucgacguggccagaaccagccugagaaccaaggugcacgccgagcuggccgacgugcugaccgaggccgugguggacagcauccuggccaucaagaagcaggacgagcccaucgaccuguucaugaucgagaucauggagaugaagcacaagagcgagaccgacaccagccugaucagaggccuggugcuggaccacggcgccagacaccccgacaugaagaagagaguggaggacgccuacauccugaccugcaacgugagccuggaguacgagaagaccgaggugaacagcggcuucuucuacaagagcgccgaggagagagagaagcuggugaaggccgagagaaaguucaucgaggacagagugaagaagaucaucgagcugaagagaaaggugugcggcgacagcgacaagggcuucguggugaucaaccagaagggcaucgaccccuucagccuggacgcccugagcaaggagggcaucguggcccugagaagagccaagagaagaaacauggagagacugacccuggccugcggcggcguggcccugaacagcuucgacgaccugagccccgacugccugggccacgccggccugguguacgaguacacccugggcgaggagaaguucaccuucaucgagaagugcaacaaccccagaagcgugacccugcugaucaagggccccaacaagcacacccugacccagaucaaggacgccgugagagacggccugagagccgugaagaacgccaucgacgacggcugcguggugcccggcgccggcgccguggagguggccauggccgaggcccugaucaagcacaagcccagcgugaagggcagagcccagcugggcgugcaggccuucgccgacgcccugcugaucauccccaaggugcuggcccagaacagcggcuucgaccugcaggagacccuggugaagauccaggccgagcacagcgagagcggccagcuggugggcguggaccugaacaccggcgagcccaugguggccgccgaggugggcgugugggacaacuacugcgugaagaagcagcugcugcacagcugcaccgugaucgccaccaacauccugcugguggacgagaucaugagagccggcaugagcagccugaagggcuaa

SEQ ID NO: 14845 - RNA, 1482 nt, Artificial Sequence
  CCT6B__Homo_sapiens__NP_001180458
auggccgccaucaaggccgugaacagcaaggccgagguggccagagccagagccgcccuggccgugaacaucugcgccgccagaggccugcaggacgugcugagaaccaaccugggccccaagggcaccaugaagaugcuggugagcggcgccggcgacaucaagcugaccaaggacggcaacgugcugcuggacgagaugcagauccagcaccccaccgccagccugaucgccaagguggccaccgcccaggacgacgugaccggcgacggcaccaccagcaacgugcugaucaucggcgagcugcugaagcaggccgaccuguacaucagcgagggccugcaccccagaaucaucgccgagggcuucgaggccgccaagaucaaggcccuggaggugcuggaggaggugaaggugaccaaggagaugaagagaaagauccugcuggacguggccagaaccagccugcagaccaaggugcacgccgagcuggccgacgugcugaccgagguggugguggacagcgugcuggccgugagaagacccggcuaccccaucgaccuguucaugguggagaucauggagaugaagcacaagcugggcaccgacaccaaggaggugaacagcggcuucuucuacaagaccgccgaggagaaggagaagcuggugaaggccgagagaaaguucaucgaggacagagugcagaagaucaucgaccugaaggacaaggugugcgcccagagcaacaagggcuucguggugaucaaccagaagggcaucgaccccuucagccuggacagccuggccaagcacggcaucguggcccugagaagagccaagagaagaaacauggagagacugagccuggccugcggcggcauggccgugaacagcuucgaggaccugaccguggacugccugggccacgccggccugguguacgaguacacccugggcgaggagaaguucaccuucaucgaggagugcgugaaccccugcagcgugacccugcuggugaagggccccaacaagcacacccugacccaggugaaggacgccaucagagacggccugagagccaucaagaacgccaucgaggacggcugcauggugcccggcgccggcgccaucgagguggccauggccgaggcccuggugaccuacaagaacagcaucaagggcagagccagacugggcgugcaggccuucgccgacgcccugcugaucauccccaaggugcuggcccagaacgccggcuacgacccccaggagacccuggugaaggugcaggccgagcacguggagagcaagcagcuggugggcguggaccugaacaccggcgagcccaugguggccgccgacgccggcgugugggacaacuacugcgugaagaagcagcugcugcacagcugcaccgugaucgccaccaacauccugcugguggacgagaucaugagagccggcaugagcagccugaaguaa

SEQ ID NO: 14846 - RNA, 1020 nt, Artificial Sequence
  CCT7__Homo_sapiens__NP_001009570
augauggacagccagcugguggccggcguggccuucaagaagaccuucagcuacgccggcuucgagaugcagcccaagaaguaccacaaccccaagaucgcccugcugaacguggagcuggagcugaaggccgagaaggacaacgccgagaucagagugcacaccguggaggacuaccaggccaucguggacgccgaguggaacauccuguacgacaagcuggagaagauccaccacagcggcgccaagguggugcugagcaagcugcccaucggcgacguggccacccaguacuucgccgacagagacauguucugcgccggcagagugcccgaggaggaccugaagagaaccaugauggccugcggcggcagcauccagaccagcgugaacgcccugagcgccgacgugcugggcagaugccagguguucgaggagacccagaucggcggcgagagauacaacuucuucaccggcugccccaaggccaagaccugcaccuucauccugagaggcggcgccgagcaguucauggaggagaccgagagaagccugcacgacgccaucaugaucgugagaagagccaucaagaacgacagcgugguggccggcggcggcgccaucgagauggagcugagcaaguaccugagagacuacagcagaaccauccccggcaagcagcagcugcugaucggcgccuacgccaaggcccuggagaucauccccagacagcugugcgacaacgccggcuucgacgccaccaacauccugaacaagcugagagccagacacgcccagggcggcaccugguacggcguggacaucaacaacgaggacaucgccgacaacuucgaggccuucgugugggagcccgccauggugagaaucaacgcccugaccgccgccagcgaggccgccugccugaucgugagcguggacgagaccaucaagaaccccagaagcaccguggacgcccccaccgccgccggcagaggcagaggcagaggcagaccccacuaa

SEQ ID NO: 14847 - RNA, 4287 nt, Artificial Sequence
  CD109__Homo_sapiens__NP_001153059
augcagggccccccccugcugaccgccgcccaccugcugugcgugugcaccgccgcccuggccguggcccccggccccagauuccuggugaccgcccccggcaucaucagacccggcggcaacgugaccaucggcguggagcugcuggagcacugccccagccaggugaccgugaaggccgagcugcugaagaccgccagcaaccugaccgugagcgugcuggaggccgagggcguguucgagaagggcagcuucaagacccugacccugcccagccugccccugaacagcgccgacgagaucuacgagcugagagugaccggcagaacccaggacgagauccuguucagcaacagcaccagacugagcuucgagaccaagagaaucagcguguucauccagaccgacaaggcccuguacaagcccaagcaggaggugaaguucagaaucgugacccuguucagcgacuucaagcccuacaagaccagccugaacauccugaucaaggaccccaagagcaaccugauccagcaguggcugagccagcagagcgaccugggcgugaucagcaagaccuuccagcugagcagccaccccauccugggcgacuggagcauccaggugcaggugaacgaccagaccuacuaccagagcuuccaggugagcgaguacgugcugcccaaguucgaggugacccugcagaccccccuguacugcagcaugaacagcaagcaccugaacggcaccaucaccgccaaguacaccuacggcaagcccgugaagggcgacgugacccugaccuuccugccccugagcuucuggggcaagaagaagaacaucaccaagaccuucaagaucaacggcagcgccaacuucagcuucaacgacgaggagaugaagaacgugauggacagcagcaacggccugagcgaguaccuggaccugagcagccccggccccguggagauccugaccaccgugaccgagagcgugaccggcaucagcagaaacgugagcaccaacguguucuucaagcagcacgacuacaucaucgaguucuucgacuacaccaccgugcugaagcccagccugaacuucaccgccaccgugaaggugaccagagccgacggcaaccagcugacccuggaggagagaagaaacaacguggugaucaccgugacccagagaaacuacaccgaguacuggagcggcagcaacagcggcaaccagaagauggaggccgugcagaagaucaacuacaccgugccccagagcggcaccuucaagaucgaguuccccauccuggaggacagcagcgagcugcagcugaaggccuacuuccugggcagcaagagcagcauggccgugcacagccuguucaagagccccagcaagaccuacauccagcugaagaccagagacgagaacaucaaggugggcagccccuucgagcugguggugagcggcaacaagagacugaaggagcugagcuacaugguggugagcagaggccagcugguggccgugggcaagcagaacagcaccauguucagccugacccccgagaacagcuggacccccaaggccugcgugaucguguacuacaucgaggacgacggcgagaucaucagcgacgugcugaagauccccgugcagcugguguucaagaacaagaucaagcuguacuggagcaaggugaaggccgagcccagcgagaaggugagccugagaaucagcgugacccagcccgacagcaucgugggcaucguggccguggacaagagcgugaaccugaugaacgccagcaacgacaucaccauggagaacguggugcacgagcuggagcuguacaacaccggcuacuaccugggcauguucaugaacagcuucgccguguuccaggagugcggccugugggugcugaccgacgccaaccugaccaaggacuacaucgacggcguguacgacaacgccgaguacgccgagagauucauggaggagaacgagggccacaucguggacauccacgacuucagccugggcagcagcccccacgugagaaagcacuuccccgagaccuggaucuggcuggacaccaacaugggcuacagaaucuaccaggaguucgaggugaccgugcccgacagcaucaccagcuggguggccaccggcuucgugaucagcgaggaccugggccugggccugaccaccacccccguggagcugcaggccuuccagcccuucuucaucuuccugaaccugcccuacagcgugaucagaggcgaggaguucgcccuggagaucaccaucuucaacuaccugaaggacgccaccgaggugaaggugaucaucgagaagagcgacaaguucgacauccugaugaccagcaacgagaucaacgccaccggccaccagcagacccugcuggugcccagcgaggacggcgccaccgugcuguuccccaucagacccacccaccugggcgagauccccaucaccgugaccgcccugagccccaccgccagcgacgccgugacccagaugauccuggugaaggccgagggcaucgagaagagcuacagccagagcauccugcuggaccugaccgacaacagacugcagagcacccugaagacccugagcuucagcuucccccccaacaccgugaccggcagcgagagagugcagaucaccgccaucggcgacgugcugggccccagcaucaacggccuggccagccugaucagaaugcccuacggcugcggcgagcagaacaugaucaacuucgcccccaacaucuacauccuggacuaccugaccaagaagaagcagcugaccgacaaccugaaggagaaggcccugagcuucaugagacagggcuaccagagagagcugcuguaccagagagaggacggcagcuucagcgccuucggcaacuacgaccccagcggcagcaccuggcugagcgccuucgugcugagaugcuuccuggaggccgaccccuacaucgacaucgaccagaacgugcugcacagaaccuacaccuggcugaagggccaccagaagagcaacggcgaguucugggaccccggcagagugauccacagcgagcugcagggcggcaacaagagccccgugacccugaccgccuacaucgugaccagccugcugggcuacagaaaguaccagcccaacaucgacgugcaggagagcauccacuuccuggagagcgaguucagcagaggcaucagcgacaacuacacccuggcccugaucaccuacgcccugagcagcgugggcagccccaaggccaaggaggcccugaacaugcugaccuggagagccgagcaggagggcggcaugcaguucugggugagcagcgagagcaagcugagcgacagcuggcagcccagaagccuggacaucgagguggccgccuacgcccugcugagccacuuccugcaguuccagaccagcgagggcauccccaucaugagauggcugagcagacagagaaacagccugggcggcuucgccagcacccaggacaccaccguggcccugaaggcccugagcgaguucgccgcccugaugaacaccgagagaaccaacauccaggugaccgugaccggccccagcagccccagcccccuggccguggugcagcccaccgccgugaacaucagcgccaacggcuucggcuucgccaucugccagcugaacgugguguacaacgugaaggccagcggcagcagcagaagaagaagaagcauccagaaccaggaggccuucgaccuggacguggccgugaaggagaacaaggacgaccugaaccacguggaccugaacgugugcaccagcuucagcggccccggcagaagcggcauggcccugauggaggugaaccugcugagcggcuucauggugcccagcgaggccaucagccugagcgagaccgugaagaagguggaguacgaccacggcaagcugaaccuguaccuggacagcgugaacgagacccaguucugcgugaacauccccgccgugagaaacuucaaggugagcaacacccaggacgccagcgugagcaucguggacuacuacgagcccagaagacaggccgugagaagcuacaacagcgaggugaagcugagcagcugcgaccugugcagcgacgugcagggcugcagacccugcgaggacggcgccagcggcagccaccaccacagcagcgugaucuucaucuucugcuucaagcugcuguacuucauggagcuguggcuguaa

SEQ ID NO: 14848 - RNA, 1128 nt, Artificial Sequence
  CD14__Homo_sapiens__NP_001167576
auggagagagccagcugccugcugcugcugcugcugccccuggugcacgugagcgccaccacccccgagcccugcgagcuggacgacgaggacuucagaugcgugugcaacuucagcgagccccagcccgacuggagcgaggccuuccagugcgugagcgccguggagguggagauccacgccggcggccugaaccuggagcccuuccugaagagaguggacgccgacgccgaccccagacaguacgccgacaccgugaaggcccugagagugagaagacugaccgugggcgccgcccaggugcccgcccagcugcuggugggcgcccugagagugcuggccuacagcagacugaaggagcugacccuggaggaccugaagaucaccggcaccaugcccccccugccccuggaggccaccggccuggcccugagcagccugagacugagaaacgugagcugggccaccggcagaagcuggcuggccgagcugcagcaguggcugaagcccggccugaaggugcugagcaucgcccaggcccacagccccgccuucagcugcgagcaggugagagccuuccccgcccugaccagccuggaccugagcgacaaccccggccugggcgagagaggccugauggccgcccugugcccccacaaguuccccgccauccagaaccuggcccugagaaacaccggcauggagacccccaccggcgugugcgccgcccuggccgccgccggcgugcagccccacagccuggaccugagccacaacagccugagagccaccgugaaccccagcgcccccagaugcauguggagcagcgcccugaacagccugaaccugagcuucgccggccuggagcaggugcccaagggccugcccgccaagcugagagugcuggaccugagcugcaacagacugaacagagccccccagcccgacgagcugcccgagguggacaaccugacccuggacggcaaccccuuccuggugcccggcaccgcccugccccacgagggcagcaugaacagcggcguggugcccgccugcgccagaagcacccugagcgugggcgugagcggcacccuggugcugcugcagggcgccagaggcuucgccuaa

SEQ ID NO: 14849 - RNA, 762 nt, Artificial Sequence
  CD151__Homo_sapiens__NP_001034579
augggcgaguucaacgagaagaagaccaccugcggcaccgugugccugaaguaccugcuguucaccuacaacugcugcuucuggcuggccggccuggccgugauggccgugggcaucuggacccuggcccugaagagcgacuacaucagccugcuggccagcggcaccuaccuggccaccgccuacauccuggugguggccggcaccguggugauggugaccggcgugcugggcugcugcgccaccuucaaggagagaagaaaccugcugagacuguacuucauccugcugcugaucaucuuccugcuggagaucaucgccggcauccuggccuacgccuacuaccagcagcugaacaccgagcugaaggagaaccugaaggacaccaugaccaagagauaccaccagcccggccacgaggccgugaccagcgccguggaccagcugcagcaggaguuccacugcugcggcagcaacaacagccaggacuggagagacagcgaguggaucagaagccaggaggccggcggcagaguggugcccgacagcugcugcaagaccgugguggcccugugcggccagagagaccacgccagcaacaucuacaagguggagggcggcugcaucaccaagcuggagaccuucauccaggagcaccugagagugaucggcgccgugggcaucggcaucgccugcgugcagguguucggcaugaucuucaccugcugccuguacagaagccugaagcuggagcacuacuaa

SEQ ID NO: 14850 - RNA, 3471 nt, Artificial Sequence
  CD163__Homo_sapiens__NP_004235
augagcaagcugagaauggugcugcuggaggacagcggcagcgccgacuucagaagacacuucgugaaccugagccccuucaccaucaccguggugcugcugcugagcgccugcuucgugaccagcagccugggcggcaccgacaaggagcugagacugguggacggcgagaacaagugcagcggcagaguggaggugaaggugcaggaggaguggggcaccgugugcaacaacggcuggagcauggaggccgugagcgugaucugcaaccagcugggcugccccaccgccaucaaggcccccggcugggccaacagcagcgccggcagcggcagaaucuggauggaccacgugagcugcagaggcaacgagagcgcccugugggacugcaagcacgacggcuggggcaagcacagcaacugcacccaccagcaggacgccggcgugaccugcagcgacggcagcaaccuggagaugagacugaccagaggcggcaacaugugcagcggcagaaucgagaucaaguuccagggcagauggggcaccgugugcgacgacaacuucaacaucgaccacgccagcgugaucugcagacagcuggagugcggcagcgccgugagcuucagcggcagcagcaacuucggcgagggcagcggccccaucugguucgacgaccugaucugcaacggcaacgagagcgcccuguggaacugcaagcaccagggcuggggcaagcacaacugcgaccacgccgaggacgccggcgugaucugcagcaagggcgccgaccugagccugagacugguggacggcgugaccgagugcagcggcagacuggaggugagauuccagggcgaguggggcaccaucugcgacgacggcugggacagcuacgacgccgccguggccugcaagcagcugggcugccccaccgccgugaccgccaucggcagagugaacgccagcaagggcuucggccacaucuggcuggacagcgugagcugccagggccacgagcccgccaucuggcagugcaagcaccacgaguggggcaagcacuacugcaaccacaacgaggacgccggcgugaccugcagcgacggcagcgaccuggagcugagacugagaggcggcggcagcagaugcgccggcaccguggagguggagauccagagacugcugggcaaggugugcgacagaggcuggggccugaaggaggccgacguggugugcagacagcugggcugcggcagcgcccugaagaccagcuaccagguguacagcaagauccaggccaccaacaccuggcuguuccugagcagcugcaacggcaacgagaccagccugugggacugcaagaacuggcaguggggcggccugaccugcgaccacuacgaggaggccaagaucaccugcagcgcccacagagagcccagacuggugggcggcgacauccccugcagcggcagaguggaggugaagcacggcgacaccuggggcagcaucugcgacagcgacuucagccuggaggccgccagcgugcugugcagagagcugcagugcggcaccguggugagcauccugggcggcgcccacuucggcgagggcaacggccagaucugggccgaggaguuccagugcgagggccacgagagccaccugagccugugccccguggcccccagacccgagggcaccugcagccacagcagagacgugggcguggugugcagcagauacaccgagaucagacuggugaacggcaagacccccugcgagggcagaguggagcugaagacccugggcgccuggggcagccugugcaacagccacugggacaucgaggacgcccacgugcugugccagcagcugaagugcggcguggcccugagcacccccggcggcgccagauucggcaagggcaacggccagaucuggagacacauguuccacugcaccggcaccgagcagcacaugggcgacugccccgugaccgcccugggcgccagccugugccccagcgagcagguggccagcgugaucugcagcggcaaccagagccagacccugagcagcugcaacagcagcagccugggccccaccagacccaccauccccgaggagagcgccguggccugcaucgagagcggccagcugagacuggugaacggcggcggcagaugcgccggcagaguggagaucuaccacgagggcagcuggggcaccaucugcgacgacagcugggaccugagcgacgcccacguggugugcagacagcugggcugcggcgaggccaucaacgccaccggcagcgcccacuucggcgagggcaccggccccaucuggcuggacgagaugaagugcaacggcaaggagagcagaaucuggcagugccacagccacggcuggggccagcagaacugcagacacaaggaggacgccggcgugaucugcagcgaguucaugagccugagacugaccagcgaggccagcagagaggccugcgccggcagacuggagguguucuacaacggcgccuggggcaccgugggcaagagcagcaugagcgagaccaccgugggcguggugugcagacagcugggcugcgccgacaagggcaagaucaaccccgccagccuggacaaggccaugagcauccccauguggguggacaacgugcagugccccaagggccccgacacccuguggcagugccccagcagccccugggagaagagacuggccagccccagcgaggagaccuggaucaccugcgacaacaagaucagacugcaggagggccccaccagcugcagcggcagaguggagaucuggcacggcggcagcuggggcaccgugugcgacgacagcugggaccuggacgacgcccagguggugugccagcagcugggcugcggccccgcccugaaggccuucaaggaggccgaguucggccagggcaccggccccaucuggcugaacgaggugaagugcaagggcaacgagagcagccugugggacugccccgccagaagauggggccacagcgagugcggccacaaggaggacgccgccgugaacugcaccgacaucagcgugcagaagaccccccagaaggccaccaccggcagaagcagcagacagagcagcuucaucgccgugggcauccugggcguggugcugcuggccaucuucguggcccuguucuuccugaccaagaagagaagacagagacagagacuggccgugagcagcagaggcgagaaccuggugcaccagauccaguacagagagaugaacagcugccugaacgccgacgaccuggaccugaugaacagcagcgagaacagccacgagagcgccgacuucagcgccgccgagcugaucagcgugagcaaguuccugcccaucagcggcauggagaaggaggccauccugagccacaccgagaaggagaacggcaaccuguaa

SEQ ID NO: 14851 - RNA, 4362 nt, Artificial Sequence
  CD163L1__Homo_sapiens__NP_777601
augaugcugccccagaacagcuggcacaucgacuucggcagaugcugcugccaccagaaccuguucagcgccguggugaccugcauccugcugcugaacagcugcuuccugaucagcagcuucaacggcaccgaccuggagcugagacuggugaacggcgacggccccugcagcggcaccguggaggugaaguuccagggccaguggggcaccgugugcgacgacggcuggaacaccaccgccagcaccguggugugcaagcagcugggcugccccuucagcuucgccauguucagauucggccaggccgugaccagacacggcaagaucuggcuggacgacgugagcugcuacggcaacgagagcgcccugugggagugccagcacagagaguggggcagccacaacugcuaccacggcgaggacgugggcgugaacugcuacggcgaggccaaccugggccugagacugguggacggcaacaacagcugcagcggcagaguggaggugaaguuccaggagagauggggcaccaucugcgacgacggcuggaaccugaacaccgccgccguggugugcagacagcugggcugccccagcagcuucaucagcagcggcguggugaacagccccgccgugcugagacccaucuggcuggacgacauccugugccagggcaacgagcuggcccuguggaacugcagacacagaggcuggggcaaccacgacugcagccacaacgaggacgugacccugaccugcuacgacagcagcgaccuggagcugagacuggugggcggcaccaacagaugcaugggcagaguggagcugaagauccagggcagauggggcaccgugugccaccacaaguggaacaacgccgccgccgacguggugugcaagcagcugggcugcggcaccgcccugcacuucgccggccugccccaccugcagagcggcagcgacgugguguggcuggacggcgugagcugcagcggcaacgagagcuuccugugggacugcagacacagcggcaccgugaacuucgacugccugcaccagaacgacgugagcgugaucugcagcgacggcgccgaccuggagcugagacuggccgacggcagcaacaacugcagcggcagaguggaggugagaauccacgagcagugguggaccaucugcgaccagaacuggaagaacgagcaggcccugguggugugcaagcagcugggcugccccuucagcguguucggcagcagaagagccaagcccagcaacgaggccagagacaucuggaucaacagcaucagcugcaccggcaacgagagcgcccugugggacugcaccuacgacggcaaggccaagagaaccugcuucagaagaagcgacgccggcgugaucugcagcgacaaggccgaccuggaccugagacuggugggcgcccacagccccugcuacggcagacuggaggugaaguaccagggcgaguggggcaccgugugccacgacagauggagcaccagaaacgccgccguggugugcaagcagcugggcugcggcaagcccaugcacguguucggcaugaccuacuucaaggaggccagcggccccaucuggcuggacgacgugagcugcaucggcaacgagagcaacaucugggacugcgagcacagcggcuggggcaagcacaacugcgugcacagagaggacgugaucgugaccugcagcggcgacgccaccuggggccugagacuggugggcggcagcaacagaugcagcggcagacuggagguguacuuccagggcagauggggcaccgugugcgacgacggcuggaacagcaaggccgccgccguggugugcagccagcuggacugccccagcagcaucaucggcaugggccugggcaacgccagcaccggcuacggcaagaucuggcuggacgacgugagcugcgacggcgacgagagcgaccuguggagcugcagaaacagcggcuggggcaacaacgacugcagccacagcgaggacgugggcgugaucugcagcgacgccagcgacauggagcugagacuggugggcggcagcagcagaugcgccggcaagguggaggugaacgugcagggcgccgugggcauccugugcgccaacggcuggggcaugaacaucgccgagguggugugcagacagcuggagugcggcagcgccaucagagugagcagagagccccacuucaccgagagaacccugcacauccugaugagcaacagcggcugcaccggcggcgaggccagccugugggacugcaucagaugggaguggaagcagaccgccugccaccugaacauggaggccagccugaucugcagcgcccacagacagcccagacuggugggcgccgacaugcccugcagcggcagaguggaggugaagcacgccgacaccuggagaagcgugugcgacagcgacuucagccugcacgccgccaacgugcugugcagagagcugaacugcggcgacgccaucagccugagcgugggcgaccacuucggcaagggcaacggccugaccugggccgagaaguuccagugcgagggcagcgagacccaccuggcccugugccccaucgugcagcaccccgaggacaccugcauccacagcagagaggugggcguggugugcagcagauacaccgacgugagacuggugaacggcaagagccagugcgacggccagguggagaucaacgugcugggccacuggggcagccugugcgacacccacugggaccccgaggacgccagagugcugugcagacagcugagcugcggcaccgcccugagcaccaccggcggcaaguacaucggcgagagaagcgugagaguguggggccacagauuccacugccugggcaacgagagccugcuggacaacugccagaugaccgugcugggcgccccccccugcauccacggcaacaccgugagcgugaucugcaccggcagccugacccagccccuguuccccugccuggccaacgugagcgaccccuaccugagcgccgugcccgagggcagcgcccugaucugccuggaggacaagagacugagacugguggacggcgacagcagaugcgccggcagaguggagaucuaccacgacggcuucuggggcaccaucugcgacgacggcugggaccugagcgacgcccacguggugugccagaagcugggcugcggcguggccuucaacgccaccgugagcgcccacuucggcgagggcagcggccccaucuggcuggacgaccugaacugcaccggcauggagagccaccuguggcagugccccagcagaggcuggggccagcacgacugcagacacaaggaggacgccggcgugaucugcagcgaguucaccgcccugagacuguacagcgagaccgagaccgagagcugcgccggcagacuggagguguucuacaacggcaccuggggcagcgugggcagaagaaacaucaccaccgccaucgccggcaucgugugcagacagcugggcugcggcgagaacggcguggugagccuggccccccugagcaagaccggcagcggcuucauguggguggacgacauccagugccccaagacccacaucagcaucuggcagugccugagcgcccccugggagagaagaaucagcagccccgccgaggagaccuggaucaccugcgaggacagaaucagagugagaggcggcgacaccgagugcagcggcagaguggagaucuggcacgccggcagcuggggcaccgugugcgacgacagcugggaccuggccgaggccgagguggugugccagcagcugggcugcggcagcgcccuggccgcccugagagacgccagcuucggccagggcaccggcaccaucuggcuggacgacaugagaugcaagggcaacgagagcuuccugugggacugccacgccaagcccuggggccagagcgacugcggccacaaggaggacgccggcgugagaugcagcggccagagccugaagagccugaacgccagcagcggccaccuggcccugauccugagcagcaucuucggccugcugcugcuggugcuguucauccuguuccugaccuggugcagagugcagaagcagaagcaccugccccugagagugagcaccagaagaagaggcagccuggaggagaaccuguuccacgagauggagaccugccugaagagagaggacccccacggcaccagaaccagcgacgacacccccaaccacggcugcgaggacgccagcgacaccagccugcugggcgugcugcccgccagcgaggccaccaaguaa

SEQ ID NO: 14852 - RNA, 555 nt, Artificial Sequence
  CD164__Homo_sapiens__NP_001135873
augagcagacugagcagaagccugcugugggccgccaccugccugggcgugcugugcgugcugagcgccgacaagaacaccacccagcaccccaacgugaccacccuggcccccaucagcaacgugaccagcgcccccgugaccagccugccccuggugaccacccccgcccccgagaccugcgagggcagaaacagcugcgugagcugcuucaacgugagcguggugaacaccaccugcuucuggaucgagugcaaggacgagagcuacugcagccacaacagcaccgugagcgacugccaggugggcaacaccaccgacuucugcagcgccaagcccaccgugcagcccagccccagcaccaccagcaagaccgugaccaccagcggcaccaccaacaacaccgugacccccaccagccagcccgugagaaagagcaccuucgacgccgccagcuucaucggcggcaucgugcuggugcugggcgugcaggccgugaucuucuuccuguacaaguucugcaagagcaaggagagaaacuaccacacccuguaa

SEQ ID NO: 14853 - RNA, 1314 nt, Artificial Sequence
  CD177__Homo_sapiens__NP_065139
augagcgccgugcugcugcuggcccugcugggcuucauccugccccugcccggcgugcaggcccugcugugccaguucggcaccgugcagcacguguggaaggugagcgaccugcccagacaguggacccccaagaacaccagcugcgacagcggccugggcugccaggacacccugaugcugaucgagagcggcccccaggugagccuggugcugagcaagggcugcaccgaggccaaggaccaggagcccagagugaccgagcacagaaugggccccggccugagccugaucagcuacaccuucgugugcagacaggaggacuucugcaacaaccuggugaacagccugccccugugggccccccagccccccgccgaccccggcagccugagaugccccgugugccugagcauggagggcugccuggagggcaccaccgaggagaucugccccaagggcaccacccacugcuacgacggccugcugagacugagaggcggcggcaucuucagcaaccugagagugcagggcugcaugccccagcccgugugcaaccugcugaacggcacccaggagaucggccccgugggcaugaccgagaacugcgacaugaaggacuuccugaccugccacagaggcaccaccaucaugacccacggcaaccuggcccaggagcccaccgacuggaccaccagcaacaccgagaugugcgaggugggccaggugugccaggagacccugcugcugcuggacgugggccugaccagcacccuggugggcaccaagggcugcagcaccgugggcgcccagaacagccagaagaccaccauccacagcgccccccccggcgugcugguggccagcuacacccacuucugcagcagcgaccugugcaacagcgccagcagcagcagcgugcugcugaacagccugcccccccaggccgcccccgugcccggcgacagacagugccccaccugcgugcagccccugggcaccugcagcagcggcagccccagaaugaccugccccagaggcgccacccacugcuacgacggcuacauccaccugagcggcggcggccugagcaccaagaugagcauccagggcugcguggcccagcccagcagcuuccugcugaaccacaccagacagaucggcaucuucagcgccagagagaagagagacgugcagccccccgccagccagcacgagggcggcggcgccgagggccuggagagccugaccuggggcgugggccuggcccuggcccccgcccugugguggggcguggugugccccagcugcuaa

SEQ ID NO: 14854 - RNA, 1986 nt, Artificial Sequence
  CD180__Homo_sapiens__NP_005573
auggccuucgacgugagcugcuucuucuggguggugcuguucagcgccggcugcaaggugaucaccagcugggaccagaugugcaucgagaaggaggccaacaagaccuacaacugcgagaaccugggccugagcgagauccccgacacccugcccaacaccaccgaguuccuggaguucagcuucaacuuccugcccaccauccacaacagaaccuucagcagacugaugaaccugaccuuccuggaccugaccagaugccagaucaacuggauccacgaggacaccuuccagagccaccaccagcugagcacccuggugcugaccggcaacccccugaucuucauggccgagaccagccugaacggccccaagagccugaagcaccuguuccugauccagaccggcaucagcaaccuggaguucauccccgugcacaaccuggagaaccuggagagccuguaccugggcagcaaccacaucagcagcaucaaguuccccaaggacuuccccgccagaaaccugaaggugcuggacuuccagaacaacgccauccacuacaucagcagagaggacaugagaagccuggagcaggccaucaaccugagccugaacuucaacggcaacaacgugaagggcaucgagcugggcgccuucgacagcaccaucuuccagagccugaacuucggcggcacccccaaccugagcgugaucuucaacggccugcagaacagcaccacccagagccuguggcugggcaccuucgaggacaucgacgacgaggacaucagcagcgccaugcugaagggccugugcgagaugagcguggagagccugaaccugcaggagcacagauucagcgacaucagcagcaccaccuuccagugcuucacccagcugcaggagcuggaccugaccgccacccaccugaagggccugcccagcggcaugaagggccugaaccugcugaagaagcuggugcugagcgugaaccacuucgaccagcugugccagaucagcgccgccaacuuccccagccugacccaccuguacaucagaggcaacgugaagaagcugcaccugggcgugggcugccuggagaagcugggcaaccugcagacccuggaccugagccacaacgacaucgaggccagcgacugcugcagccugcagcugaagaaccugagccaccugcagacccugaaccugagccacaacgagccccugggccugcagagccaggccuucaaggagugcccccagcuggagcugcuggaccuggccuucaccagacugcacaucaacgccccccagagccccuuccagaaccugcacuuccugcaggugcugaaccugaccuacugcuuccuggacaccagcaaccagcaccugcuggccggccugcccgugcugagacaccugaaccugaagggcaaccacuuccaggacggcaccaucaccaagaccaaccugcugcagaccgugggcagccuggaggugcugauccugagcagcugcggccugcugagcaucgaccagcaggccuuccacagccugggcaagaugagccacguggaccugagccacaacagccugaccugcgacagcaucgacagccugagccaccugaagggcaucuaccugaaccuggccgccaacagcaucaacaucaucagccccagacugcugcccauccugagccagcagagcaccaucaaccugagccacaacccccuggacugcaccugcagcaacauccacuuccugaccugguacaaggagaaccugcacaagcuggagggcagcgaggagaccaccugcgccaacccccccagccugagaggcgugaagcugagcgacgugaagcugagcugcggcaucaccgccaucggcaucuucuuccugaucguguuccugcugcugcuggccauccugcuguucuucgccgugaaguaccugcugagauggaaguaccagcacaucuaa

SEQ ID NO: 14855 - RNA, 1674 nt, Artificial Sequence
  CD19__Homo_sapiens__NP_001171569
augcccccccccagacugcuguucuuccugcuguuccugacccccauggaggugagacccgaggagccccugguggugaagguggaggagggcgacaacgccgugcugcagugccugaagggcaccagcgacggccccacccagcagcugaccuggagcagagagagcccccugaagcccuuccugaagcugagccugggccugcccggccugggcauccacaugagaccccuggccaucuggcuguucaucuucaacgugagccagcagaugggcggcuucuaccugugccagcccggcccccccagcgagaaggccuggcagcccggcuggaccgugaacguggagggcagcggcgagcuguucagauggaacgugagcgaccugggcggccugggcugcggccugaagaacagaagcagcgagggccccagcagccccagcggcaagcugaugagccccaagcuguacgugugggccaaggacagacccgagaucugggagggcgagccccccugccugccccccagagacagccugaaccagagccugagccaggaccugaccauggcccccggcagcacccuguggcugagcugcggcgugccccccgacagcgugagcagaggcccccugagcuggacccacgugcaccccaagggccccaagagccugcugagccuggagcugaaggacgacagacccgccagagacaugugggugauggagaccggccugcugcugcccagagccaccgcccaggacgccggcaaguacuacugccacagaggcaaccugaccaugagcuuccaccuggagaucaccgccagacccgugcuguggcacuggcugcugagaaccggcggcuggaaggugagcgccgugacccuggccuaccugaucuucugccugugcagccuggugggcauccugcaccugcagagagcccuggugcugagaagaaagagaaagagaaugaccgaccccaccagaagauucuucaaggugacccccccccccggcagcggcccccagaaccaguacggcaacgugcugagccugcccacccccaccagcggccugggcagagcccagagaugggccgccggccugggcggcaccgcccccagcuacggcaaccccagcagcgacgugcaggccgacggcgcccugggcagcagaagcccccccggcgugggccccgaggaggaggagggcgagggcuacgaggagcccgacagcgaggaggacagcgaguucuacgagaacgacagcaaccugggccaggaccagcugagccaggacggcagcggcuacgagaaccccgaggacgagccccugggccccgaggacgaggacagcuucagcaacgccgagagcuacgagaacgaggacgaggagcugacccagcccguggccagaaccauggacuuccugagcccccacggcagcgccugggaccccagcagagaggccaccagccuggccggcagccagagcuacgaggacaugagaggcauccuguacgccgccccccagcugagaagcaucagaggccagcccggccccaaccacgaggaggacgccgacagcuacgagaacauggacaaccccgacggccccgaccccgccuggggcggcggcggcagaaugggcaccuggagcaccagauaa

SEQ ID NO: 14856 - RNA, 984 nt, Artificial Sequence
  CD1A__Homo_sapiens__NP_001754
augcuguuccugcugcugccccugcuggccgugcugcccggcgacggcaacgccgacggccugaaggagccccugagcuuccacgugaccuggaucgccagcuucuacaaccacagcuggaagcagaaccuggugagcggcuggcugagcgaccugcagacccacaccugggacagcaacagcagcaccaucguguuccugugccccuggagcagaggcaacuucagcaacgaggaguggaaggagcuggagacccuguucagaaucagaaccaucagaagcuucgagggcaucagaagauacgcccacgagcugcaguucgaguaccccuucgagauccaggugaccggcggcugcgagcugcacagcggcaaggugagcggcagcuuccugcagcuggccuaccagggcagcgacuucgugagcuuccagaacaacagcuggcugcccuaccccguggccggcaacauggccaagcacuucugcaaggugcugaaccagaaccagcacgagaacgacaucacccacaaccugcugagcgacaccugccccagauucauccugggccugcuggacgccggcaaggcccaccugcagagacaggugaagcccgaggccuggcugagccacggccccagccccggccccggccaccugcagcuggugugccacgugagcggcuucuaccccaagcccgugugggugauguggaugagaggcgagcaggagcagcagggcacccagagaggcgacauccugcccagcgccgacggcaccugguaccugagagccacccuggagguggccgccggcgaggccgccgaccugagcugcagagugaagcacagcagccuggagggccaggacaucgugcuguacugggagcaccacagcagcgugggcuucaucauccuggccgugaucgugccccugcugcugcugaucggccuggcccugugguucagaaagagaugcuucugcuaa

SEQ ID NO: 14857 - RNA, 1002 nt, Artificial Sequence
  CD1B__Homo_sapiens__NP_001755
augcugcugcugcccuuccagcugcuggccgugcuguuccccggcggcaacagcgagcacgccuuccagggccccaccagcuuccacgugauccagaccagcagcuucaccaacagcaccugggcccagacccagggcagcggcuggcuggacgaccugcagauccacggcugggacagcgacagcggcaccgccaucuuccugaagcccuggagcaagggcaacuucagcgacaaggagguggccgagcuggaggagaucuucagaguguacaucuucggcuucgccagagaggugcaggacuucgccggcgacuuccagaugaaguaccccuucgagauccagggcaucgccggcugcgagcugcacagcggcggcgccaucgugagcuuccugagaggcgcccugggcggccuggacuuccugagcgugaagaacgccagcugcgugcccagccccgagggcggcagcagagcccagaaguucugcgcccugaucauccaguaccagggcaucauggagaccgugagaauccugcuguacgagaccugccccagauaccugcugggcgugcugaacgccggcaaggccgaccugcagagacaggugaagcccgaggccuggcugagcagcggccccagccccggccccggcagacugcagcuggugugccacgugagcggcuucuaccccaagcccgugugggugauguggaugagaggcgagcaggagcagcagggcacccagcugggcgacauccugcccaacgccaacuggaccugguaccugagagccacccuggacguggccgacggcgaggccgccggccugagcugcagagugaagcacagcagccuggagggccaggacaucauccuguacuggagaaaccccaccagcaucggcagcaucgugcuggccaucaucgugcccagccugcugcugcugcugugccuggcccugugguacaugagaagaagaagcuaccagaacauccccuaa

SEQ ID NO: 14858 - RNA, 1002 nt, Artificial Sequence
  CD1C__Homo_sapiens__NP_001756
augcuguuccugcaguuccugcugcuggcccugcugcugcccggcggcgacaacgccgacgccagccaggagcacgugagcuuccacgugauccagaucuucagcuucgugaaccagagcugggccagaggccagggcagcggcuggcuggacgagcugcagacccacggcugggacagcgagagcggcaccaucaucuuccugcacaacuggagcaagggcaacuucagcaacgaggagcugagcgaccuggagcugcuguucagauucuaccuguucggccugaccagagagauccaggaccacgccagccaggacuacagcaaguaccccuucgaggugcaggugaaggccggcugcgagcugcacagcggcaagagccccgagggcuucuuccagguggccuucaacggccuggaccugcugagcuuccagaacaccaccugggugcccagccccggcugcggcagccuggcccagagcgugugccaccugcugaaccaccaguacgagggcgugaccgagaccguguacaaccugaucagaagcaccugccccagauuccugcugggccugcuggacgccggcaagauguacgugcacagacaggugagacccgaggccuggcugagcagcagacccagccugggcagcggccagcugcugcuggugugccacgccagcggcuucuaccccaagcccgugugggugaccuggaugagaaacgagcaggagcagcugggcaccaagcacggcgacauccugcccaacgccgacggcaccugguaccugcaggugauccuggagguggccagcgaggagcccgccggccugagcugcagagugagacacagcagccugggcggccaggacaucauccuguacuggggccaccacuucagcaugaacuggaucgcccugguggugaucgugccccuggugauccugaucgugcuggugcugugguucaagaagcacugcagcuaccaggacauccuguaa

SEQ ID NO: 14859 - RNA, 1008 nt, Artificial Sequence
  CD1D__Homo_sapiens__NP_001757
augggcugccugcuguuccugcugcugugggcccugcugcaggccuggggcagcgccgaggugccccagagacuguucccccugagaugccugcagaucagcagcuucgccaacagcagcuggaccagaaccgacggccuggccuggcugggcgagcugcagacccacagcuggagcaacgacagcgacaccgugagaagccugaagcccuggagccagggcaccuucagcgaccagcagugggagacccugcagcacaucuucagaguguacagaagcagcuucaccagagacgugaaggaguucgccaagaugcugagacugagcuacccccuggagcugcaggugagcgccggcugcgaggugcaccccggcaacgccagcaacaacuucuuccacguggccuuccagggcaaggacauccugagcuuccagggcaccagcugggagcccacccaggaggccccccugugggugaaccuggccauccaggugcugaaccaggacaaguggaccagagagaccgugcaguggcugcugaacggcaccugcccccaguucgugagcggccugcuggagagcggcaagagcgagcugaagaagcaggugaagcccaaggccuggcugagcagaggccccagccccggccccggcagacugcugcuggugugccacgugagcggcuucuaccccaagcccgugugggugaaguggaugagaggcgagcaggagcagcagggcacccagcccggcgacauccugcccaacgccgacgagaccugguaccugagagccacccuggacgugguggccggcgaggccgccggccugagcugcagagugaagcacagcagccuggagggccaggacaucgugcuguacuggggcggcagcuacaccagcaugggccugaucgcccuggccgugcuggccugccugcuguuccugcugaucgugggcuucaccagcagauucaagagacagaccagcuaccagggcgugcuguaa

SEQ ID NO: 14860 - RNA, 1131 nt, Artificial Sequence
  CD1E__Homo_sapiens__NP_001036048
augcugcugcuguuccugcuguucgagggccugugcugccccggcgagaacaccgccgccccccaggcccugcagagcuaccaccuggccgccgaggagcagcugagcuucagaaugcugcagaccagcagcuucgccaaccacagcugggcccacagcgagggcagcggcuggcugggcgaccugcagacccacggcugggacaccgugcugggcaccaucagauuccugaagcccuggagccacggcaacuucagcaagcaggagcugaagaaccugcagagccuguuccagcuguacuuccacagcuucauccagaucgugcaggccagcgccggccaguuccagcuggaguaccccuucgagauccagauccuggccggcugcagaaugaacgccccccagaucuuccugaacauggccuaccagggcagcgacuuccugagcuuccagggcaucagcugggagcccagccccggcgccggcaucagagcccagaacaucugcaaggugcugaacagauaccuggacaucaaggagauccugcagagccugcugggccacaccugccccagauuccuggccggccugauggaggccggcgagagcgagcugaagagaaaggugaagcccgaggccuggcugagcugcggccccagccccggccccggcagacugcagcuggugugccacgugagcggcuucuaccccaagcccgugugggugauguggaugagaggcgagcaggagcagagaggcacccagagaggcgacgugcugcccaacgccgacgagaccugguaccugagagccacccuggacguggccgccggcgaggccgccggccugagcugcagagugaagcacagcagccugggcggccacgaccugaucauccacuggggcggcuacagcaucuuccugauccugaucugccugaccgugaucgugacccuggugauccugguggugguggacagcagacugaagaagcagagccccguguuccugaugggcgccaacacccaggacaccaagaacagcagacaccaguucugccuggcccaggugagcuggaucaagaacagagugcugaagaaguggaagaccagacugaaccagcugugguaa

SEQ ID NO: 14861 - RNA, 885 nt, Artificial Sequence
  CD200__Homo_sapiens__NP_001004196
auggagagacugacccugaccagaaccaucggcggcccccugcugaccgccacccugcugggcaagaccaccaucaacgacuaccaggugaucagaaugcccuucagccaccugagcaccuacagccuggugugggugauggccgccguggugcugugcaccgcccaggugcagguggugacccaggacgagagagagcagcuguacacccccgccagccugaagugcagccugcagaacgcccaggaggcccugaucgugaccuggcagaagaagaaggccgugagccccgagaacauggugaccuucagcgagaaccacggcguggugauccagcccgccuacaaggacaagaucaacaucacccagcugggccugcagaacagcaccaucaccuucuggaacaucacccuggaggacgagggcugcuacaugugccuguucaacaccuucggcuucggcaagaucagcggcaccgccugccugaccguguacgugcagcccaucgugagccugcacuacaaguucagcgaggaccaccugaacaucaccugcagcgccaccgccagacccgcccccaugguguucuggaaggugcccagaagcggcaucgagaacagcaccgugacccugagccaccccaacggcaccaccagcgugaccagcauccugcacaucaaggaccccaagaaccaggugggcaaggaggugaucugccaggugcugcaccugggcaccgugaccgacuucaagcagaccgugaacaagggcuacugguucagcgugccccugcugcugagcaucgugagccuggugauccugcuggugcugaucagcauccugcuguacuggaagagacacagaaaccaggacagagagcccuaa

SEQ ID NO: 14862 - RNA, 1047 nt, Artificial Sequence
  CD200R1__Homo_sapiens__NP_620161
augcugugccccuggagaaccgccaaccugggccugcugcugauccugaccaucuuccugguggccgaggccgagggcgccgcccagcccaacaacagccugaugcugcagaccagcaaggagaaccacgcccuggccagcagcagccugugcauggacgagaagcagaucacccagaacuacagcaaggugcuggccgaggugaacaccagcuggcccgugaagauggccaccaacgccgugcugugcugcccccccaucgcccugagaaaccugaucaucaucaccugggagaucauccugagaggccagcccagcugcaccaaggccuacaagaaggagaccaacgagaccaaggagaccaacugcaccgacgagagaaucaccugggugagcagacccgaccagaacagcgaccugcagaucagaaccguggccaucacccacgacggcuacuacagaugcaucauggugacccccgacggcaacuuccacagaggcuaccaccugcaggugcuggugacccccgaggugacccuguuccagaacagaaacagaaccgccgugugcaaggccguggccggcaagcccgccgcccacaucagcuggauccccgagggcgacugcgccaccaagcaggaguacuggagcaacggcaccgugaccgugaagagcaccugccacugggaggugcacaacgugagcaccgugaccugccacgugagccaccugaccggcaacaagagccuguacaucgagcugcugcccgugcccggcgccaagaagagcgccaagcuguacauccccuacaucauccugaccaucaucauccugaccaucgugggcuucaucuggcugcugaaggugaacggcugcagaaaguacaagcugaacaagaccgagagcacccccgugguggaggaggacgagaugcagcccuacgccagcuacaccgagaagaacaacccccuguacgacaccaccaacaaggugaaggccagcgaggcccugcagagcgagguggacaccgaccugcacacccuguaa

SEQ ID NO: 14863 - RNA, 987 nt, Artificial Sequence
  CD207__Homo_sapiens__NP_056532
augaccguggagaaggaggcccccgacgcccacuucaccguggacaagcagaacaucagccuguggcccagagagcccccccccaagagcggccccagccuggugcccggcaagacccccaccgugagagccgcccugaucugccugacccuggugcugguggccagcgugcugcugcaggccgugcuguaccccagauucaugggcaccaucagcgacgugaagaccaacgugcagcugcugaagggcagaguggacaacaucagcacccuggacagcgagaucaagaagaacagcgacggcauggaggccgccggcgugcagauccagauggugaacgagagccugggcuacgugagaagccaguuccugaagcugaagaccagcguggagaaggccaacgcccagauccagauccugaccagaagcugggaggaggugagcacccugaacgcccagauccccgagcugaagagcgaccuggagaaggccagcgcccugaacaccaagaucagagcccugcagggcagccuggagaacaugagcaagcugcugaagagacagaacgacauccugcagguggugagccagggcuggaaguacuucaagggcaacuucuacuacuucagccugauccccaagaccugguacagcgccgagcaguucugcgugagcagaaacagccaccugaccagcgugaccagcgagagcgagcaggaguuccuguacaagaccgccggcggccugaucuacuggaucggccugaccaaggccggcauggagggcgacuggagcuggguggacgacacccccuucaacaaggugcagagcgugagauucuggauccccggcgagcccaacaacgccggcaacaacgagcacugcggcaacaucaaggcccccagccugcaggccuggaacgacgcccccugcgacaagaccuuccuguucaucugcaagagacccuacgugcccagcgagcccuaa

SEQ ID NO: 14864 - RNA, 807 nt, Artificial Sequence
  CD209__Homo_sapiens__NP_001138365
augagcgacagcaaggagcccagacugcagcagcugggccugcuggugagcaaggugcccagcagcaucagccaggagcagagcagacaggacgccaucuaccagaaccugacccagcugaaggccgccgugggcgagcugagcgagaagagcaagcugcaggagaucuaccaggagcugacccagcugaaggccgccgugggcgagcugcccgagaagagcaagcugcaggagaucuaccaggagcugaccagacugaaggccgccgugggcgagcugcccgagaagagcaagcugcaggagaucuaccaggagcugaccuggcugaaggccgccguggagagacugugccaccccugccccugggaguggaccuucuuccagggcaacugcuacuucaugagcaacagccagagaaacuggcacgacagcaucaccgccugcaaggaggugggcgcccagcugguggugaucaagagcgccgaggagcagaacuuccugcagcugcagagcagcagaagcaacagauucaccuggaugggccugagcgaccugaaccaggagggcaccuggcaguggguggacggcagcccccugcugcccagcuucaagcaguacuggaacagaggcgagcccaacaacgugggcgaggaggacugcgccgaguucagcggcaacggcuggaacgacgacaagugcaaccuggccaaguucuggaucugcaagaagagcgccgccagcugcagcagagacgaggagcaguuccugagccccgcccccgccacccccaaccccccccccgccuaa

SEQ ID NO: 14865 - RNA, 1011 nt, Artificial Sequence
  CD226__Homo_sapiens__NP_001290547
auggacuaccccacccugcugcuggcccugcugcacguguacagagcccugugcgaggaggugcuguggcacaccagcgugcccuucgccgagaacaugagccuggagugcguguaccccagcaugggcauccugacccagguggagugguucaagaucggcacccagcaggacagcaucgccaucuucagccccacccacggcauggugaucagaaagcccuacgccgagagaguguacuuccugaacagcaccauggccagcaacaacaugacccuguucuucagaaacgccagcgaggacgacgugggcuacuacagcugcagccuguacaccuacccccagggcaccuggcagaaggugauccagguggugcagagcgacagcuucgaggccgccgugcccagcaacagccacaucgugagcgagcccggcaagaacgugacccugaccugccagccccagaugaccuggcccgugcaggccgugagaugggagaagauccagcccagacagaucgaccugcugaccuacugcaaccuggugcacggcagaaacuucaccagcaaguuccccagacagaucgugagcaacugcagccacggcagauggagcgugaucgugauccccgacgugaccgugagcgacagcggccuguacagaugcuaccugcaggccagcgccggcgagaacgagaccuucgugaugagacugaccguggccgagggcaagaccgacaaccaguacacccuguucguggccggcggcaccgugcugcugcugcuguucgugaucagcaucaccaccaucaucgugaucuuccugaacagaagaagaagaagagagagaagagaccuguucaccgagagcugggacacccagaaggcccccaacaacuacagaagccccaucagcaccagccagcccaccaaccagagcauggacgacaccagagaggacaucuacgugaacuaccccaccuucagcagaagacccaagaccagaguguaa

SEQ ID NO: 14866 - RNA, 2280 nt, Artificial Sequence
  CD22__Homo_sapiens__NP_001172028
augcaccugcugggccccuggcugcugcugcuggugcuggaguaccuggccuucagcgacagcagcaaguggguguucgagcaccccgagacccuguacgccugggagggcgccugcguguggauccccugcaccuacagagcccuggacggcgaccuggagagcuucauccuguuccacaaccccgaguacaacaagaacaccagcaaguucgacggcaccagacuguacgagagcaccaaggacggcaaggugcccagcgagcagaagagagugcaguuccugggcgacaagaacaagaacugcacccugagcauccaccccgugcaccugaacgacagcggccagcugggccugagaauggagagcaagaccgagaaguggauggagagaauccaccugaacgugagcgagagacccuuccccccccacauccagcugccccccgagauccaggagagccaggaggugacccugaccugccugcugaacuucagcugcuacggcuaccccauccagcugcaguggcugcuggagggcgugcccaugagacaggccgccgugaccagcaccagccugaccaucaagagcguguucaccagaagcgagcugaaguucagcccccaguggagccaccacggcaagaucgugaccugccagcugcaggacgccgacggcaaguuccugagcaacgacaccgugcagcugaacgugaagcacacccccaagcuggagaucaaggugacccccagcgacgccaucgugagagagggcgacagcgugaccaugaccugcgaggugagcagcagcaaccccgaguacaccaccgugagcuggcugaaggacggcaccagccugaagaagcagaacaccuucacccugaaccugagagaggugaccaaggaccagagcggcaaguacugcugccaggugagcaacgacgugggccccggcagaagcgaggagguguuccugcaggugcaguacccccccaagaaggugaccaccgugauccagaaccccaugcccaucagagagggcgacaccgugacccugagcugcaacuacaacagcagcaaccccagcgugaccagauacgaguggaagccccacggcgccugggaggagcccagccugggcgugcugaagauccagaacgugggcugggacaacaccaccaucgccugcgccgccugcaacagcuggugcagcugggccagccccguggcccugaacgugcaguacgcccccagagacgugagagugagaaagaucaagccccugagcgagauccacagcggcaacagcgugagccugcagugcgacuucagcagcagccaccccaaggaggugcaguucuucugggagaagaacggcagacugcugggcaaggagagccagcugaacuucgacagcaucagccccgaggacgccggcagcuacagcugcugggugaacaacagcaucggccagaccgccagcaaggccuggacccuggaggugcuguacgcccccagaagacugagagugagcaugagccccggcgaccaggugauggagggcaagagcgccacccugaccugcgagagcgacgccaacccccccgugagccacuacaccugguucgacuggaacaaccagagccugcccuaccacagccagaagcugagacuggagcccgugaaggugcagcacagcggcgccuacuggugccagggcaccaacagcgugggcaagggcagaagcccccugagcacccugaccguguacuacagccccgagaccaucggcagaagaguggccgugggccugggcagcugccuggccauccugauccuggccaucugcggccugaagcugcagagaagauggaagagaacccagagccagcagggccugcaggagaacagcagcggccagagcuucuucgugagaaacaagaaggugagaagagccccccugagcgagggcccccacagccugggcugcuacaaccccaugauggaggacggcaucagcuacaccacccugagauuccccgagaugaacauccccagaaccggcgacgccgagagcagcgagaugcagagacccccccccgacugcgacgacaccgugaccuacagcgcccugcacaagagacaggugggcgacuacgagaacgugauccccgacuuccccgaggacgagggcauccacuacagcgagcugauccaguucggcgugggcgagagaccccaggcccaggagaacguggacuacgugauccugaagcacuaa

SEQ ID NO: 14867 - RNA, 1113 nt, Artificial Sequence
  CD244__Homo_sapiens__NP_001160135
augcugggccagguggugacccugauccugcugcugcugcugaagguguaccagggcaagggcugccagggcagcgccgaccacguggugagcaucagcggcgugccccugcagcugcagcccaacagcauccagaccaagguggacagcaucgccuggaagaagcugcugcccagccagaacggcuuccaccacauccugaagugggagaacggcagccugcccagcaacaccagcaacgacagauucagcuucaucgugaagaaccugagccugcugaucaaggccgcccagcagcaggacagcggccuguacugccuggaggugaccagcaucagcggcaaggugcagaccgccaccuuccagguguucguguucgagagccugcugcccgacaagguggagaagcccagacugcagggccagggcaagauccuggacagaggcagaugccagguggcccugagcugccuggugagcagagacggcaacgugagcuacgccugguacagaggcagcaagcugauccagaccgccggcaaccugaccuaccuggacgaggagguggacaucaacggcacccacaccuacaccugcaacgugagcaaccccgugagcugggagagccacacccugaaccugacccaggacugccagaacgcccaccaggaguucagauucuggcccuuccuggugaucaucgugauccugagcgcccuguuccugggcacccuggccugcuucugcguguggagaagaaagagaaaggagaagcagagcgagaccagccccaaggaguuccugaccaucuacgaggacgugaaggaccugaagaccagaagaaaccacgagcaggagcagaccuuccccggcggcggcagcaccaucuacagcaugauccagagccagagcagcgcccccaccagccaggagcccgccuacacccuguacagccugauccagcccagcagaaagagcggcagcagaaagagaaaccacagccccagcuucaacagcaccaucuacgaggugaucggcaagagccagcccaaggcccagaaccccgccagacugagcagaaaggagcuggagaacuucgacguguacagcuaa

SEQ ID NO: 14868 - RNA, 492 nt, Artificial Sequence
  CD247__Homo_sapiens__NP_000725
augaaguggaaggcccuguucaccgccgccauccugcaggcccagcugcccaucaccgaggcccagagcuucggccugcuggaccccaagcugugcuaccugcuggacggcauccuguucaucuacggcgugauccugaccgcccuguuccugagagugaaguucagcagaagcgccgacgcccccgccuaccagcagggccagaaccagcuguacaacgagcugaaccugggcagaagagaggaguacgacgugcuggacaagagaagaggcagagaccccgagaugggcggcaagcccagaagaaagaacccccaggagggccuguacaacgagcugcagaaggacaagauggccgaggccuacagcgagaucggcaugaagggcgagagaagaagaggcaagggccacgacggccuguaccagggccugagcaccgccaccaaggacaccuacgacgcccugcacaugcaggcccugccccccagauaa

SEQ ID NO: 14869 - RNA, 2274 nt, Artificial Sequence
  CD248__Homo_sapiens__NP_065137
augcugcugagacugcugcuggccugggccgccgccggccccacccugggccaggaccccugggccgccgagcccagagccgccugcggccccagcagcugcuacgcccuguuccccagaagaagaaccuuccuggaggccuggagagccugcagagagcugggcggcgaccuggccacccccagaacccccgaggaggcccagagaguggacagccuggugggcgccggccccgccagcagacugcuguggaucggccugcagagacaggccagacagugccagcugcagagaccccugagaggcuucaccuggaccaccggcgaccaggacaccgccuucaccaacugggcccagcccgccagcggcggccccugccccgcccagagaugcguggcccuggaggccagcggcgagcacagauggcuggagggcagcugcacccuggccguggacggcuaccugugccaguucggcuucgagggcgccugccccgcccugcaggacgaggccggccaggccggccccgccguguacaccacccccuuccaccuggugagcaccgaguucgaguggcugcccuucggcagcguggccgccgugcagugccaggccggcagaggcgccagccugcugugcgugaagcagcccgagggcggcgugggcuggagcagagccggcccccugugccugggcaccggcugcagccccgacaacggcggcugcgagcacgagugcguggaggagguggacggccacgugagcugcagaugcaccgagggcuucagacuggccgccgacggcagaagcugcgaggaccccugcgcccaggcccccugcgagcagcagugcgagcccggcggcccccagggcuacagcugccacugcagacugggcuucagacccgccgaggacgacccccacagaugcguggacaccgacgagugccagaucgccggcgugugccagcagaugugcgugaacuacgugggcggcuucgagugcuacugcagcgagggccacgagcuggaggccgacggcaucagcugcagccccgccggcgccaugggcgcccaggccagccaggaccugggcgacgagcugcuggacgacggcgaggacgaggaggacgaggacgaggccuggaaggccuucaacggcggcuggaccgagaugcccggcauccuguggauggagcccacccagccccccgacuucgcccuggccuacagacccagcuuccccgaggacagagagccccagauccccuaccccgagcccaccuggccccccccccugagcgcccccagagugcccuaccacagcagcgugcugagcgugaccagacccgugguggugagcgccacccaccccacccugcccagcgcccaccagccccccgugauccccgccacccaccccgcccugagcagagaccaccagauccccgugaucgccgccaacuaccccgaccugcccagcgccuaccagcccggcauccugagcgugagccacagcgcccagccccccgcccaccagccccccaugaucagcaccaaguaccccgagcuguuccccgcccaccagagccccauguuccccgacaccagaguggccggcacccagaccaccacccaccugcccggcaucccccccaaccacgccccccuggugaccacccugggcgcccagcugcccccccaggcccccgacgcccuggugcugagaacccaggccacccagcugcccaucauccccaccgcccagcccagccugaccaccaccagcagaagccccgugagccccgcccaccagaucagcgugcccgccgccacccagcccgccgcccugcccacccugcugcccagccagagccccaccaaccagaccagccccaucagccccacccacccccacagcaaggccccccagauccccagagaggacggccccagccccaagcuggcccuguggcugcccagccccgcccccaccgccgcccccaccgcccugggcgaggccggccuggccgagcacagccagagagacgacagauggcugcugguggcccugcuggugcccaccugcguguuccugguggugcugcuggcccugggcaucguguacugcaccagaugcggcccccacgcccccaacaagagaaucaccgacugcuacagaugggugauccacgccggcagcaagagccccaccgagcccaugccccccagaggcagccugaccggcgugcagaccugcagaaccagcguguaa

SEQ ID NO: 14870 - RNA, 411 nt, Artificial Sequence
  CD24__Homo_sapiens__XP_011533677
augagaaccagagacgcccccgugagcagccugagacuggccgacaccagaagaagccagaacaaggccagagccagcggcagagccagacccagaggcagagccagaagaagccugagaaccagaaccccccccgccagaagcgccgaccagcccggcagagugagagccagaagaagacccggccccgugggccagggccuggccggcagccccagaagcccccccugccugagaccccccggcgccagcggcagccccagcacccagcaccccgccagaagagccgcccacagaagaagaggccacggccagagcaacggcggccaggccagagccggcgccgccgccgccggcaccgcccccacccacgccgugagaugcgcccccgagcccagcagcauccuguaa

SEQ ID NO: 14871 - RNA, 531 nt, Artificial Sequence
  CD274__Homo_sapiens__NP_001254635
augagaaucuucgccguguucaucuucaugaccuacuggcaccugcugaacgcccccuacaacaagaucaaccagagaauccuggugguggaccccgugaccagcgagcacgagcugaccugccaggccgagggcuaccccaaggccgaggugaucuggaccagcagcgaccaccaggugcugagcggcaagaccaccaccaccaacagcaagagagaggagaagcuguucaacgugaccagcacccugagaaucaacaccaccaccaacgagaucuucuacugcaccuucagaagacuggaccccgaggagaaccacaccgccgagcuggugauccccgagcugccccuggcccacccccccaacgagagaacccaccuggugauccugggcgccauccugcugugccugggcguggcccugaccuucaucuucagacugagaaagggcagaaugauggacgugaagaagugcggcauccaggacaccaacagcaagaagcagagcgacacccaccuggaggagaccuaa

SEQ ID NO: 14872 - RNA, 951 nt, Artificial Sequence
  CD276__Homo_sapiens__NP_079516
augcugagaagaagaggcagccccggcaugggcgugcacgugggcgccgcccugggcgcccugugguucugccugaccggcgcccuggaggugcaggugcccgaggaccccgugguggcccuggugggcaccgacgccacccugugcugcagcuucagccccgagcccggcuucagccuggcccagcugaaccugaucuggcagcugaccgacaccaagcagcuggugcacagcuucgccgagggccaggaccagggcagcgccuacgccaacagaaccgcccuguuccccgaccugcuggcccagggcaacgccagccugagacugcagagagugagaguggccgacgagggcagcuucaccugcuucgugagcaucagagacuucggcagcgccgccgugagccugcagguggccgcccccuacagcaagcccagcaugacccuggagcccaacaaggaccugagacccggcgacaccgugaccaucaccugcagcagcuacagaggcuaccccgaggccgagguguucuggcaggacggccagggcgugccccugaccggcaacgugaccaccagccagauggccaacgagcagggccuguucgacgugcacagcgugcugagaguggugcugggcgccaacggcaccuacagcugccuggugagaaaccccgugcugcagcaggacgcccacggcagcgugaccaucaccggccagcccaugaccuucccccccgaggcccugugggugaccgugggccugagcgugugccugaucgcccugcugguggcccuggccuucgugugcuggagaaagaucaagcagagcugcgaggaggagaacgccggcgccgaggaccaggacggcgagggcgagggcagcaagaccgcccugcagccccugaagcacagcgacagcaaggaggacgacggccaggagaucgccuaa

SEQ ID NO: 14873 - RNA, 783 nt, Artificial Sequence
  CD27__Homo_sapiens__NP_001233
auggccagaccccaccccugguggcugugcgugcugggcacccuggugggccugagcgccacccccgcccccaagagcugccccgagagacacuacugggcccagggcaagcugugcugccagaugugcgagcccggcaccuuccuggugaaggacugcgaccagcacagaaaggccgcccagugcgaccccugcauccccggcgugagcuucagccccgaccaccacaccagaccccacugcgagagcugcagacacugcaacagcggccugcuggugagaaacugcaccaucaccgccaacgccgagugcgccugcagaaacggcuggcagugcagagacaaggagugcaccgagugcgacccccugcccaaccccagccugaccgccagaagcagccaggcccugagcccccacccccagcccacccaccugcccuacgugagcgagaugcuggaggccagaaccgccggccacaugcagacccuggccgacuucagacagcugcccgccagaacccugagcacccacuggcccccccagagaagccugugcagcagcgacuucaucagaauccuggugaucuucagcggcauguuccugguguucacccuggccggcgcccuguuccugcaccagagaagaaaguacagaagcaacaagggcgagagccccguggagcccgccgagcccugcagauacagcugccccagagaggaggagggcagcaccauccccauccaggaggacuacagaaagcccgagcccgccugcagccccuaa

SEQ ID NO: 14874 - RNA, 306 nt, Artificial Sequence
  CD28__Homo_sapiens__NP_001230007
augcugagacugcugcuggcccugaaccuguuccccagcauccaggugaccggcaagcaccugugccccagcccccuguuccccggccccagcaagcccuucugggugcuggugguggugggcggcgugcuggccugcuacagccugcuggugaccguggccuucaucaucuucugggugagaagcaagagaagcagacugcugcacagcgacuacaugaacaugacccccagaagacccggccccaccagaaagcacuaccagcccuacgccccccccagagacuucgccgccuacagaagcuaa

SEQ ID NO: 14875 - RNA, 1920 nt, Artificial Sequence
  CD2AP__Homo_sapiens__NP_036252
augguggacuacaucguggaguacgacuacgacgccgugcacgacgacgagcugaccaucagagugggcgagaucaucagaaacgugaagaagcugcaggaggagggcuggcuggagggcgagcugaacggcagaagaggcauguuccccgacaacuucgugaaggagaucaagagagagaccgaguucaaggacgacagccugcccaucaagagagagagacacggcaacguggccagccuggugcagagaaucagcaccuacggccugcccgccggcggcauccagccccacccccagaccaagaacaucaagaagaagaccaagaagagacagugcaaggugcuguucgaguacaucccccagaacgaggacgagcuggagcugaaggugggcgacaucaucgacaucaacgaggagguggaggagggcugguggagcggcacccugaacaacaagcugggccuguuccccagcaacuucgugaaggagcuggaggugaccgacgacggcgagacccacgaggcccaggacgacagcgagaccgugcuggccggccccaccagccccauccccagccugggcaacgugagcgagaccgccagcggcagcgugacccagcccaagaagaucagaggcaucggcuucggcgacaucuucaaggagggcagcgugaagcugagaaccagaaccagcagcagcgagaccgaggagaagaagcccgagaagccccugauccugcagagccugggccccaagacccagagcguggagaucaccaagaccgacaccgagggcaagaucaaggccaaggaguacugcagaacccuguucgccuacgagggcaccaacgaggacgagcugaccuucaaggagggcgagaucauccaccugaucagcaaggagaccggcgaggccggcugguggagaggcgagcugaacggcaaggagggcguguuccccgacaacuucgccgugcagaucaacgagcuggacaaggacuuccccaagcccaagaagccccccccccccgccaaggcccccgcccccaagcccgagcugaucgccgccgagaagaaguacuucagccugaagcccgaggagaaggacgagaagagcacccuggagcagaagcccagcaagcccgccgccccccaggugccccccaagaagcccaccccccccaccaaggccagcaaccugcugagaagcagcggcaccguguaccccaagagacccgagaagcccgugcccccccccccccccaucgccaagaucaacggcgaggugagcagcaucagcagcaaguucgagaccgagcccgugagcaagcugaagcuggacagcgagcagcugccccugagacccaagagcguggacuucgacagccugaccgugagaaccagcaaggagaccgacguggugaacuucgacgacaucgccagcagcgagaaccugcugcaccugaccgccaacagacccaagaugcccggcagaagacugcccggcagauucaacggcggccacagccccacccacagccccgagaagauccugaagcugcccaaggaggaggacagcgccaaccugaagcccagcgagcugaagaaggacaccugcuacagccccaagcccagcguguaccugagcacccccagcagcgccagcaaggccaacaccaccgccuuccugaccccccuggagaucaaggccaagguggagaccgacgacgugaagaagaacagccuggacgagcugagagcccagaucaucgagcugcugugcaucguggaggcccugaagaaggaccacggcaaggagcuggagaagcugagaaaggaccuggaggaggagaagaccaugagaagcaaccuggagauggagaucgagaagcugaagaaggccgugcugagcagcuaa

SEQ ID NO: 14876 - RNA, 561 nt, Artificial Sequence
  CD300A__Homo_sapiens__NP_001243770
auguggcugcccugggcccugcugcugcugugggugcccgccagcaccagcaugacccccgccagcaucaccgccgccaagaccagcaccaucaccaccgccuucccccccgugagcagcaccacccuguucgccgugggcgccacccacagcgccagcauccaggaggagaccgaggagguggugaacagccagcugccccugcugcugagccugcuggcccugcugcugcugcugcuggugggcgccagccugcuggccuggagaauguuccagaaguggaucaaggccggcgaccacagcgagcugagccagaaccccaagcaggccgccacccagagcgagcugcacuacgccaaccuggagcugcugauguggccccugcaggagaagcccgccccccccagagagguggagguggaguacagcaccguggccagccccagagaggagcugcacuacgccagcgugguguucgacagcaacaccaacagaaucgccgcccagagacccagagaggaggagcccgacagcgacuacagcgugaucagaaagaccuaa

SEQ ID NO: 14877 - RNA, 675 nt, Artificial Sequence
  CD300C__Homo_sapiens__NP_006669
augaccgccagagccugggccagcuggagaagcagcgcccugcugcugcugcuggugcccggcuacuucccccugagccaccccaugaccguggccggccccgugggcggcagccugagcgugcagugcagauacgagaaggagcacagaacccugaacaaguucuggugcagacccccccagauccugagaugcgacaagaucguggagaccaagggcagcgccggcaagagaaacggcagagugagcaucagagacagccccgccaaccugagcuucaccgugacccuggagaaccugaccgaggaggacgccggcaccuacuggugcggcguggacacccccuggcugagagacuuccacgaccccaucguggagguggaggugagcguguuccccgccggcaccaccaccgccagcagcccccagagcagcaugggcaccagcggcccccccaccaagcugcccgugcacaccuggcccagcgugaccagaaaggacagccccgagcccagcccccaccccggcagccuguucagcaacgugagauuccugcugcuggugcugcuggagcugccccugcugcugagcaugcugggcgccgugcugugggugaacagaccccagagaagcagcagaagcagacagaacuggcccaagggcgagaaccaguaa

SEQ ID NO: 14878 - RNA, 585 nt, Artificial Sequence
  CD300LF__Homo_sapiens__NP_001276011
auguggcugccccagcuggaccugaugagagugaucagcgccaagagccagggcuacagcaucgugacccagaucaccggccccaccaccgugaacggccuggagagaggcagccugaccgugcagugcguguacagaagcggcugggagaccuaccugaagugguggugcagaggcgccaucuggagagacugcaagauccuggugaagaccagcggcagcgagcaggaggugaagagagacagagugagcaucaaggacaaccagaagaacagaaccuucaccgugaccauggaggaccugaugaagaccgacgccgacaccuacuggugcggcaucgagaagaccggcaacgaccugggcgugaccgugcaggugaccaucgaccccgcccccgugacccaggaggagaccagcagcagccccacccugaccggccaccaccuggacaacagcagcagagacgugcccagagccggcaccgccgcccccggcggcagaccccugcugugcagacccgaccccgccgccggcagaaaccugcccgccaagggcuaccacgaggccuuccugugccccggcuaa

SEQ ID NO: 14879 - RNA, 525 nt, Artificial Sequence
  CD302__Homo_sapiens__NP_001185692
augcugagagccgcccugcccgcccugcugcugccccugcugggccuggccgccgccgccguggccgacugccccagcagcaccuggauccaguuccaggacagcugcuacaucuuccugcaggaggccaucaagguggagagcaucgaggacgugagaaaccagugcaccgaccacggcgccgacaugaucagcauccacaacgaggaggagaacgccuucauccuggacacccugaagaagcaguggaagggccccgacgacauccugcugggcauguucuacgacaccgacgugcccuacaagagaaaguaccugagcgacaaccacauccugaucagcgcccuggugaucgccagcaccgugauccugaccgugcugggcgccaucaucugguuccuguacaagaagcacagcgacagcagauucaccaccguguucagcaccgccccccagagccccuacaacgaggacugcgugcugguggugggcgaggagaacgaguaccccgugcaguucgacuaa

SEQ ID NO: 14880 - RNA, 723 nt, Artificial Sequence
  CD320__Homo_sapiens__NP_001159367
augagcggcggcuggauggcccaggugggcgccuggagaaccggcgcccugggccuggcccugcugcugcugcugggccugggccugggccuggaggccgccgccagcccccugagcacccccaccagcgcccaggccgccggcaucgagcccugcacccagaagggccagugcccccccccccccggccugcccugccccugcaccggcgugagcgacugcagcggcggcaccgacaagaagcugagaaacugcagcagacuggccugccuggccggcgagcugagaugcacccugagcgacgacugcaucccccugaccuggagaugcgacggccaccccgacugccccgacagcagcgacgagcugggcugcggcaccaacgagauccugcccgagggcgacgccaccaccaugggcccccccgugacccuggagagcgugaccagccugagaaacgccaccaccaugggcccccccgugacccuggagagcgugcccagcgugggcaacgccaccagcagcagcgccggcgaccagagcggcagccccaccgccuacggcgugaucgccgccgccgccgugcugagcgccagccuggugaccgccacccugcugcugcugagcuggcugagagcccaggagagacugagaccccugggccugcugguggccaugaaggagagccugcugcugagcgagcagaagaccagccugcccuaa

SEQ ID NO: 14881 - RNA, 714 nt, Artificial Sequence
  CD33__Homo_sapiens__NP_001076087
augccccugcugcugcugcugccccugcugugggccgaccugacccacagacccaagauccugauccccggcacccuggagcccggccacagcaagaaccugaccugcagcgugagcugggccugcgagcagggcaccccccccaucuucagcuggcugagcgccgcccccaccagccugggccccagaaccacccacagcagcgugcugaucaucacccccagaccccaggaccacggcaccaaccugaccugccaggugaaguucgccggcgccggcgugaccaccgagagaaccauccagcugaacgugaccuacgugccccagaaccccaccaccggcaucuuccccggcgacggcagcggcaagcaggagaccagagccggcguggugcacggcgccaucggcggcgccggcgugaccgcccugcuggcccugugccugugccugaucuucuucaucgugaagacccacagaagaaaggccgccagaaccgccgugggcagaaacgacacccaccccaccaccggcagcgccagccccaagcaccagaagaagagcaagcugcacggccccaccgagaccagcagcugcagcggcgccgcccccaccguggagauggacgaggagcugcacuacgccagccugaacuuccacggcaugaaccccagcaaggacaccagcaccgaguacagcgaggugagaacccaguaa

SEQ ID NO: 14882 - RNA, 1158 nt, Artificial Sequence
  CD34__Homo_sapiens__NP_001020280
augcuggugagaagaggcgccagagccggccccagaaugcccagaggcuggaccgcccugugccugcugagccugcugcccagcggcuucaugagccuggacaacaacggcaccgccacccccgagcugcccacccagggcaccuucagcaacgugagcaccaacgugagcuaccaggagaccaccacccccagcacccugggcagcaccagccugcaccccgugagccagcacggcaacgaggccaccaccaacaucaccgagaccaccgugaaguucaccagcaccagcgugaucaccagcguguacggcaacaccaacagcagcgugcagagccagaccagcgugaucagcaccguguucaccacccccgccaacgugagcacccccgagaccacccugaagcccagccugagccccggcaacgugagcgaccugagcaccaccagcaccagccuggccaccagccccaccaagcccuacaccagcagcagccccauccugagcgacaucaaggccgagaucaagugcagcggcaucagagaggugaagcugacccagggcaucugccuggagcagaacaagaccagcagcugcgccgaguucaagaaggacagaggcgagggccuggccagagugcugugcggcgaggagcaggccgacgccgacgccggcgcccaggugugcagccugcugcuggcccagagcgaggugagaccccagugccugcugcuggugcuggccaacagaaccgagaucagcagcaagcugcagcugaugaagaagcaccagagcgaccugaagaagcugggcauccuggacuucaccgagcaggacguggccagccaccagagcuacagccagaagacccugaucgcccuggugaccagcggcgcccugcuggccgugcugggcaucaccggcuacuuccugaugaacagaagaagcuggagccccaccggcgagagacugggcgaggaccccuacuacaccgagaacggcggcggccagggcuacagcagcggccccggcaccagccccgaggcccagggcaaggccagcgugaacagaggcgcccaggagaacggcaccggccaggccaccagcagaaacggccacagcgccagacagcacgugguggccgacaccgagcuguaa

SEQ ID NO: 14883 - RNA, 1419 nt, Artificial Sequence
  CD36__Homo_sapiens__NP_001001547
augggcugcgacagaaacugcggccugaucgccggcgccgugaucggcgccgugcuggccguguucggcggcauccugaugcccgugggcgaccugcugauccagaagaccaucaagaagcagguggugcuggaggagggcaccaucgccuucaagaacugggugaagaccggcaccgagguguacagacaguucuggaucuucgacgugcagaacccccaggaggugaugaugaacagcagcaacauccaggugaagcagagaggccccuacaccuacagagugagauuccuggccaaggagaacgugacccaggacgccgaggacaacaccgugagcuuccugcagcccaacggcgccaucuucgagcccagccugagcgugggcaccgaggccgacaacuucaccgugcugaaccuggccguggccgccgccagccacaucuaccagaaccaguucgugcagaugauccugaacagccugaucaacaagagcaagagcagcauguuccaggugagaacccugagagagcugcuguggggcuacagagaccccuuccugagccuggugcccuaccccgugaccaccaccgugggccuguucuaccccuacaacaacaccgccgacggcguguacaagguguucaacggcaaggacaacaucagcaagguggccaucaucgacaccuacaagggcaagagaaaccugagcuacugggagagccacugcgacaugaucaacggcaccgacgccgccagcuucccccccuucguggagaagagccaggugcugcaguucuucagcagcgacaucugcagaagcaucuacgccguguucgagagcgacgugaaccugaagggcauccccguguacagauucgugcugcccagcaaggccuucgccagccccguggagaaccccgacaacuacugcuucugcaccgagaagaucaucagcaagaacugcaccagcuacggcgugcuggacaucagcaagugcaaggagggcagacccguguacaucagccugccccacuuccuguacgccagccccgacgugagcgagcccaucgacggccugaaccccaacgaggaggagcacagaaccuaccuggacaucgagcccaucaccggcuucacccugcaguucgccaagagacugcaggugaaccugcuggugaagcccagcgagaagauccaggugcugaagaaccugaagagaaacuacaucgugcccauccuguggcugaacgagaccggcaccaucggcgacgagaaggccaacauguucagaagccaggugaccggcaagaucaaccugcugggccugaucgagaugauccugcugagcgugggcguggugauguucguggccuucaugaucagcuacugcgccugcagaagcaagaccaucaaguaa

SEQ ID NO: 14884 - RNA, 846 nt, Artificial Sequence
  CD37__Homo_sapiens__NP_001765
augagcgcccaggagagcugccugagccugaucaaguacuuccuguucguguucaaccuguucuucuucgugcugggcagccugaucuucugcuucggcaucuggauccugaucgacaagaccagcuucgugagcuucgugggccuggccuucgugccccugcagaucuggagcaaggugcuggccaucagcggcaucuucaccaugggcaucgcccugcugggcugcgugggcgcccugaaggagcugagaugccugcugggccuguacuucggcaugcugcugcugcuguucgccacccagaucacccugggcauccugaucagcacccagagagcccagcuggagagaagccugagagacgugguggagaagaccauccagaaguacggcaccaaccccgaggagaccgccgccgaggagagcugggacuacgugcaguuccagcugagaugcugcggcuggcacuacccccaggacugguuccaggugcugauccugagaggcaacggcagcgaggcccacagagugcccugcagcugcuacaaccugagcgccaccaacgacagcaccauccuggacaaggugauccugccccagcugagcagacugggccaccuggccagaagcagacacagcgccgacaucugcgccgugcccgccgagagccacaucuacagagagggcugcgcccagggccugcagaaguggcugcacaacaaccugaucagcaucgugggcaucugccugggcgugggccugcuggagcugggcuucaugacccugagcaucuuccugugcagaaaccuggaccacguguacaacagacuggccagauacagauaa

SEQ ID NO: 14885 - RNA, 903 nt, Artificial Sequence
  CD38__Homo_sapiens__NP_001766
auggccaacugcgaguucagccccgugagcggcgacaagcccugcugcagacugagcagaagagcccagcugugccugggcgugagcauccuggugcugauccuggugguggugcuggccgugguggugcccagauggagacagcaguggagcggccccggcaccaccaagagauuccccgagaccgugcuggccagaugcgugaaguacaccgagauccaccccgagaugagacacguggacugccagagcgugugggacgccuucaagggcgccuucaucagcaagcaccccugcaacaucaccgaggaggacuaccagccccugaugaagcugggcacccagaccgugcccugcaacaagauccugcuguggagcagaaucaaggaccuggcccaccaguucacccaggugcagagagacauguucacccuggaggacacccugcugggcuaccuggccgacgaccugaccuggugcggcgaguucaacaccagcaagaucaacuaccagagcugccccgacuggagaaaggacugcagcaacaaccccgugagcguguucuggaagaccgugagcagaagauucgccgaggccgccugcgacguggugcacgugaugcugaacggcagcagaagcaagaucuucgacaagaacagcaccuucggcagcguggaggugcacaaccugcagcccgagaaggugcagacccuggaggccugggugauccacggcggcagagaggacagcagagaccugugccaggaccccaccaucaaggagcuggagagcaucaucagcaagagaaacauccaguucagcugcaagaacaucuacagacccgacaaguuccugcagugcgugaagaaccccgaggacagcagcugcaccagcgagaucuaa

SEQ ID NO: 14886 - RNA, 516 nt, Artificial Sequence
  CD3D__Homo_sapiens__NP_000723
auggagcacagcaccuuccugagcggccuggugcuggccacccugcugagccaggugagccccuucaagauccccaucgaggagcuggaggacagaguguucgugaacugcaacaccagcaucaccuggguggagggcaccgugggcacccugcugagcgacaucaccagacuggaccugggcaagagaauccuggaccccagaggcaucuacagaugcaacggcaccgacaucuacaaggacaaggagagcaccgugcaggugcacuacagaaugugccagagcugcguggagcuggaccccgccaccguggccggcaucaucgugaccgacgugaucgccacccugcugcuggcccugggcguguucugcuucgccggccacgagaccggcagacugagcggcgccgccgacacccaggcccugcugagaaacgaccagguguaccagccccugagagacagagacgacgcccaguacagccaccugggcggcaacugggccagaaacaaguaa

SEQ ID NO: 14887 - RNA, 1533 nt, Artificial Sequence
  CD3EAP__Homo_sapiens__NP_036231
auggaggagccccaggccggcgacgccgccagauucagcugcccccccaacuucaccgccaagccccccgccagcgagagccccagauucagccuggaggcccugaccggccccgacaccgagcuguggcugauccaggcccccgccgacuucgcccccgagugcuucaacggcagacacgugccccugagcggcagccagaucgugaagggcaagcuggccggcaagagacacagauacagagugcugagcagcugcccccaggccggcgaggccacccugcuggcccccagcaccgaggccggcggcggccugaccugcgccagcgccccccagggcacccugagaauccuggagggcccccagcagagccugagcggcagcccccugcagcccauccccgccagcccccccccccagaucccccccggccugagacccagauucugcgccuucggcggcaacccccccgugaccggccccagaagcgcccuggcccccaaccugcugaccagcggcaagaagaagaaggagaugcaggugaccgaggcccccgugacccaggaggccgugaacggccacggcgcccuggagguggacauggcccugggcagccccgagauggacgugagaaagaagaagaagaagaagaaccagcagcugaaggagcccgaggccgccggccccgugggcaccgagcccaccguggagacccuggagccccugggcgugcuguuccccagcaccaccaagaagagaaagaagcccaagggcaaggagaccuucgagcccgaggacaagaccgugaagcaggagcagaucaacaccgagccccuggaggacaccgugcugagccccaccaagaagagaaagagacagaagggcaccgagggcauggagcccgaggagggcgugaccguggagagccagccccaggugaagguggagccccuggaggaggccaucccccugccccccaccaagaagagaaagaaggagaagggccagauggccaugauggagcccggcaccgaggccauggagcccguggagcccgagaugaagccccuggagagccccggcggcaccauggccccccagcagcccgagggcgccaagccccaggcccaggccgcccuggccgcccccaagaagaagaccaagaaggagaagcagcaggacgccaccguggagcccgagaccgagguggugggccccgagcugcccgacgaccuggagccccaggccgcccccaccagcaccaagaagaagaagaagaagaaggagagaggccacaccgugaccgagcccauccagccccuggagcccgagcugcccggcgagggccagcccgaggccagagccacccccggcagcaccaagaagagaaagaagcagagccaggagagcagaaugcccgagaccgugccccaggaggagaugcccggccccccccugaacagcgagagcggcgaggaggcccccaccggcagagacaagaagagaaagcagcagcagcagcagcccguguaa

SEQ ID NO: 14888 - RNA, 624 nt, Artificial Sequence
  CD3E__Homo_sapiens__NP_000724
augcagagcggcacccacuggagagugcugggccugugccugcugagcgugggcguguggggccaggacggcaacgaggagaugggcggcaucacccagacccccuacaaggugagcaucagcggcaccaccgugauccugaccugcccccaguaccccggcagcgagauccuguggcagcacaacgacaagaacaucggcggcgacgaggacgacaagaacaucggcagcgacgaggaccaccugagccugaaggaguucagcgagcuggagcagagcggcuacuacgugugcuaccccagaggcagcaagcccgaggacgccaacuucuaccuguaccugagagccagagugugcgagaacugcauggagauggacgugaugagcguggccaccaucgugaucguggacaucugcaucaccggcggccugcugcugcugguguacuacuggagcaagaacagaaaggccaaggccaagcccgugaccagaggcgccggcgccggcggcagacagagaggccagaacaaggagagacccccccccgugcccaaccccgacuacgagcccaucagaaagggccagagagaccuguacagcggccugaaccagagaagaaucuaa

SEQ ID NO: 14889 - RNA, 549 nt, Artificial Sequence
  CD3G__Homo_sapiens__NP_000064
auggagcagggcaagggccuggccgugcugauccuggccaucauccugcugcagggcacccuggcccagagcaucaagggcaaccaccuggugaagguguacgacuaccaggaggacggcagcgugcugcugaccugcgacgccgaggccaagaacaucaccugguucaaggacggcaagaugaucggcuuccugaccgaggacaagaagaaguggaaccugggcagcaacgccaaggaccccagaggcauguaccagugcaagggcagccagaacaagagcaagccccugcagguguacuacagaaugugccagaacugcaucgagcugaacgccgccaccaucagcggcuuccuguucgccgagaucgugagcaucuucgugcuggccgugggcguguacuucaucgccggccaggacggcgugagacagagcagagccagcgacaagcagacccugcugcccaacgaccagcuguaccagccccugaaggacagagaggacgaccaguacagccaccugcagggcaaccagcugagaagaaacuaa

SEQ ID NO: 14890 - RNA, 834 nt, Artificial Sequence
  CD40__Homo_sapiens__NP_001241
auggugagacugccccugcagugcgugcuguggggcugccugcugaccgccgugcaccccgagccccccaccgccugcagagagaagcaguaccugaucaacagccagugcugcagccugugccagcccggccagaagcuggugagcgacugcaccgaguucaccgagaccgagugccugcccugcggcgagagcgaguuccuggacaccuggaacagagagacccacugccaccagcacaaguacugcgaccccaaccugggccugagagugcagcagaagggcaccagcgagaccgacaccaucugcaccugcgaggagggcuggcacugcaccagcgaggccugcgagagcugcgugcugcacagaagcugcagccccggcuucggcgugaagcagaucgccaccggcgugagcgacaccaucugcgagcccugccccgugggcuucuucagcaacgugagcagcgccuucgagaagugccaccccuggaccagcugcgagaccaaggaccugguggugcagcaggccggcaccaacaagaccgacguggugugcggcccccaggacagacugagagcccugguggugauccccaucaucuucggcauccuguucgccauccugcuggugcugguguucaucaagaagguggccaagaagcccaccaacaaggccccccaccccaagcaggagccccaggagaucaacuuccccgacgaccugcccggcagcaacaccgccgcccccgugcaggagacccugcacggcugccagcccgugacccaggaggacggcaaggagagcagaaucagcgugcaggagagacaguaa

SEQ ID NO: 14891 - RNA, 786 nt, Artificial Sequence
  CD40LG__Homo_sapiens__NP_000065
augaucgagaccuacaaccagaccagccccagaagcgccgccaccggccugcccaucagcaugaagaucuucauguaccugcugaccguguuccugaucacccagaugaucggcagcgcccuguucgccguguaccugcacagaagacuggacaagaucgaggacgagagaaaccugcacgaggacuucguguucaugaagaccauccagagaugcaacaccggcgagagaagccugagccugcugaacugcgaggagaucaagagccaguucgagggcuucgugaaggacaucaugcugaacaaggaggagaccaagaaggagaacagcuucgagaugcagaagggcgaccagaacccccagaucgccgcccacgugaucagcgaggccagcagcaagaccaccagcgugcugcagugggccgagaagggcuacuacaccaugagcaacaaccuggugacccuggagaacggcaagcagcugaccgugaagagacagggccuguacuacaucuacgcccaggugaccuucugcagcaacagagaggccagcagccaggcccccuucaucgccagccugugccugaagagccccggcagauucgagagaauccugcugagagccgccaacacccacagcagcgccaagcccugcggccagcagagcauccaccugggcggcguguucgagcugcagcccggcgccagcguguucgugaacgugaccgaccccagccaggugagccacggcaccggcuucaccagcuucggccugcugaagcuguaa

SEQ ID NO: 14892 - RNA, 2229 nt, Artificial Sequence
  CD44__Homo_sapiens__NP_000601
auggacaaguucugguggcacgccgccuggggccugugccuggugccccugagccuggcccagaucgaccugaacaucaccugcagauucgccggcguguuccacguggagaagaacggcagauacagcaucagcagaaccgaggccgccgaccugugcaaggccuucaacagcacccugcccaccauggcccagauggagaaggcccugagcaucggcuucgagaccugcagauacggcuucaucgagggccacguggugauccccagaauccaccccaacagcaucugcgccgccaacaacaccggcguguacauccugaccagcaacaccagccaguacgacaccuacugcuucaacgccagcgccccccccgaggaggacugcaccagcgugaccgaccugcccaacgccuucgacggccccaucaccaucaccaucgugaacagagacggcaccagauacgugcagaagggcgaguacagaaccaaccccgaggacaucuaccccagcaaccccaccgacgacgacgugagcagcggcagcagcagcgagagaagcagcaccagcggcggcuacaucuucuacaccuucagcaccgugcaccccauccccgacgaggacagccccuggaucaccgacagcaccgacagaauccccgccaccacccugaugagcaccagcgccaccgccaccgagaccgccaccaagagacaggagaccugggacugguucagcuggcuguuccugcccagcgagagcaagaaccaccugcacaccaccacccagauggccggcaccagcagcaacaccaucagcgccggcugggagcccaacgaggagaacgaggacgagagagacagacaccugagcuucagcggcagcggcaucgacgacgacgaggacuucaucagcagcaccaucagcaccacccccagagccuucgaccacaccaagcagaaccaggacuggacccaguggaaccccagccacagcaaccccgaggugcugcugcagaccaccaccagaaugaccgacguggacagaaacggcaccaccgccuacgagggcaacuggaaccccgaggcccaccccccccugauccaccacgagcaccacgaggaggaggagaccccccacagcaccagcaccauccaggccacccccagcagcaccaccgaggagaccgccacccagaaggagcagugguucggcaacagauggcacgagggcuacagacagacccccaaggaggacagccacagcaccaccggcaccgccgccgccagcgcccacaccagccaccccaugcagggcagaaccacccccagccccgaggacagcagcuggaccgacuucuucaaccccaucagccaccccaugggcagaggccaccaggccggcagaagaauggacauggacagcagccacagcaucacccugcagcccaccgccaaccccaacaccggccugguggaggaccuggacagaaccggcccccugagcaugaccacccagcagagcaacagccagagcuucagcaccagccacgagggccuggaggaggacaaggaccaccccaccaccagcacccugaccagcagcaacagaaacgacgugaccggcggcagaagagaccccaaccacagcgagggcagcaccacccugcuggagggcuacaccagccacuacccccacaccaaggagagcagaaccuucauccccgugaccagcgccaagaccggcagcuucggcgugaccgccgugaccgugggcgacagcaacagcaacgugaacagaagccugagcggcgaccaggacaccuuccaccccagcggcggcagccacaccacccacggcagcgagagcgacggccacagccacggcagccaggagggcggcgccaacaccaccagcggccccaucagaaccccccagauccccgaguggcugaucauccuggccagccugcuggcccuggcccugauccuggccgugugcaucgccgugaacagcagaagaagaugcggccagaagaagaagcuggugaucaacagcggcaacggcgccguggaggacagaaagcccagcggccugaacggcgaggccagcaagagccaggagauggugcaccuggugaacaaggagagcagcgagacccccgaccaguucaugaccgccgacgagaccagaaaccugcagaacguggacaugaagaucggcguguaa

SEQ ID NO: 14893 - RNA, 1179 nt, Artificial Sequence
  CD46__Homo_sapiens__NP_002380
auggagccccccggcagaagagagugccccuuccccagcuggagauuccccggccugcugcuggccgccauggugcugcugcuguacagcuucagcgacgccugcgaggagccccccaccuucgaggccauggagcugaucggcaagcccaagcccuacuacgagaucggcgagagaguggacuacaagugcaagaagggcuacuucuacauccccccccuggccacccacaccaucugcgacagaaaccacaccuggcugcccgugagcgacgacgccugcuacagagagaccugccccuacaucagagacccccugaacggccaggccgugcccgccaacggcaccuacgaguucggcuaccagaugcacuucaucugcaacgagggcuacuaccugaucggcgaggagauccuguacugcgagcugaagggcagcguggccaucuggagcggcaagccccccaucugcgagaaggugcugugcacccccccccccaagaucaagaacggcaagcacaccuucagcgagguggagguguucgaguaccuggacgccgugaccuacagcugcgaccccgcccccggccccgaccccuucagccugaucggcgagagcaccaucuacugcggcgacaacagcguguggagcagagccgcccccgagugcaagguggugaagugcagauuccccgugguggagaacggcaagcagaucagcggcuucggcaagaaguucuacuacaaggccaccgugauguucgagugcgacaagggcuucuaccuggacggcagcgacaccaucgugugcgacagcaacagcaccugggacccccccgugcccaagugccugaaggugcugccccccagcagcaccaagccccccgcccugagccacagcgugagcaccagcagcaccaccaagagccccgccagcagcgccagcggccccagacccaccuacaagccccccgugagcaacuaccccggcuaccccaagcccgaggagggcauccuggacagccuggacgugugggugaucgccgugaucgugaucgccaucguggugggcguggccgugaucugcguggugcccuacagauaccugcagagaagaaagaagaagggcaccuaccugaccgacgagacccacagagaggugaaguucaccagccuguaa

SEQ ID NO: 14894 - RNA, 972 nt, Artificial Sequence
  CD47__Homo_sapiens__NP_001768
auguggccccugguggccgcccugcugcugggcagcgccugcugcggcagcgcccagcugcuguucaacaagaccaagagcguggaguucaccuucugcaacgacaccguggugauccccugcuucgugaccaacauggaggcccagaacaccaccgagguguacgugaaguggaaguucaagggcagagacaucuacaccuucgacggcgcccugaacaagagcaccgugcccaccgacuucagcagcgccaagaucgaggugagccagcugcugaagggcgacgccagccugaagauggacaagagcgacgccgugagccacaccggcaacuacaccugcgaggugaccgagcugaccagagagggcgagaccaucaucgagcugaaguacagaguggugagcugguucagccccaacgagaacauccugaucgugaucuuccccaucuucgccauccugcuguucuggggccaguucggcaucaagacccugaaguacagaagcggcggcauggacgagaagaccaucgcccugcugguggccggccuggugaucaccgugaucgugaucgugggcgccauccuguucgugcccggcgaguacagccugaagaacgccaccggccugggccugaucgugaccagcaccggcauccugauccugcugcacuacuacguguucagcaccgccaucggccugaccagcuucgugaucgccauccuggugauccaggugaucgccuacauccuggccguggugggccugagccugugcaucgccgccugcauccccaugcacggcccccugcugaucagcggccugagcauccuggcccuggcccagcugcugggccugguguacaugaaguucguggccagcaaccagaagaccauccagccccccagaaaggccguggaggagccccugaacgccuucaaggagagcaagggcaugaugaacgacgaguaa

SEQ ID NO: 14895 - RNA, 732 nt, Artificial Sequence
  CD48__Homo_sapiens__NP_001769
augugcagcagaggcugggacagcugccuggcccuggagcugcugcugcugccccugagccugcuggugaccagcauccagggccaccuggugcacaugaccguggugagcggcagcaacgugacccugaacaucagcgagagccugcccgagaacuacaagcagcugaccugguucuacaccuucgaccagaagaucguggagugggacagcagaaagagcaaguacuucgagagcaaguucaagggcagagugagacuggacccccagagcggcgcccuguacaucagcaaggugcagaaggaggacaacagcaccuacaucaugagagugcugaagaagaccggcaacgagcaggaguggaagaucaagcugcaggugcuggaccccgugcccaagcccgugaucaagaucgagaagaucgaggacauggacgacaacugcuaccugaagcugagcugcgugauccccggcgagagcgugaacuacaccugguacggcgacaagagacccuuccccaaggagcugcagaacagcgugcuggagaccacccugaugccccacaacuacagcagaugcuacaccugccaggugagcaacagcgugagcagcaagaacggcaccgugugccugagcccccccugcacccuggccagaagcuucggcguggaguggaucgccagcuggcugguggugaccgugcccaccauccugggccugcugcugaccuaa

SEQ ID NO: 14896 - RNA, 1377 nt, Artificial Sequence
  CD4__Homo_sapiens__NP_000607
augaacagaggcgugcccuucagacaccugcugcuggugcugcagcuggcccugcugcccgccgccacccagggcaagaagguggugcugggcaagaagggcgacaccguggagcugaccugcaccgccagccagaagaagagcauccaguuccacuggaagaacagcaaccagaucaagauccugggcaaccagggcagcuuccugaccaagggccccagcaagcugaacgacagagccgacagcagaagaagccugugggaccagggcaacuucccccugaucaucaagaaccugaagaucgaggacagcgacaccuacaucugcgagguggaggaccagaaggaggaggugcagcugcugguguucggccugaccgccaacagcgacacccaccugcugcagggccagagccugacccugacccuggagagcccccccggcagcagccccagcgugcagugcagaagccccagaggcaagaacauccagggcggcaagacccugagcgugagccagcuggagcugcaggacagcggcaccuggaccugcaccgugcugcagaaccagaagaagguggaguucaagaucgacaucguggugcuggccuuccagaaggccagcagcaucguguacaagaaggagggcgagcagguggaguucagcuucccccuggccuucaccguggagaagcugaccggcagcggcgagcugugguggcaggccgagagagccagcagcagcaagagcuggaucaccuucgaccugaagaacaaggaggugagcgugaagagagugacccaggaccccaagcugcagaugggcaagaagcugccccugcaccugacccugccccaggcccugccccaguacgccggcagcggcaaccugacccuggcccuggaggccaagaccggcaagcugcaccaggaggugaaccugguggugaugagagccacccagcugcagaagaaccugaccugcgagguguggggccccaccagccccaagcugaugcugagccugaagcuggagaacaaggaggccaaggugagcaagagagagaaggccgugugggugcugaaccccgaggccggcauguggcagugccugcugagcgacagcggccaggugcugcuggagagcaacaucaaggugcugcccaccuggagcacccccgugcagcccauggcccugaucgugcugggcggcguggccggccugcugcuguucaucggccugggcaucuucuucugcgugagaugcagacacagaagaagacaggccgagagaaugagccagaucaagagacugcugagcgagaagaagaccugccagugcccccacagauuccagaagaccugcagccccaucuaa

SEQ ID NO: 14897 - RNA, 1146 nt, Artificial Sequence
  CD55__Homo_sapiens__NP_000565
augaccguggccagacccagcgugcccgccgcccugccccugcugggcgagcugcccagacugcugcugcuggugcugcugugccugcccgccguguggggcgacugcggccugccccccgacgugcccaacgcccagcccgcccuggagggcagaaccagcuuccccgaggacaccgugaucaccuacaagugcgaggagagcuucgugaagauccccggcgagaaggacagcgugaucugccugaagggcagccaguggagcgacaucgaggaguucugcaacagaagcugcgaggugcccaccagacugaacagcgccagccugaagcagcccuacaucacccagaacuacuuccccgugggcaccgugguggaguacgagugcagacccggcuacagaagagagcccagccugagccccaagcugaccugccugcagaaccugaaguggagcaccgccguggaguucugcaagaagaagagcugccccaaccccggcgagaucagaaacggccagaucgacgugcccggcggcauccuguucggcgccaccaucagcuucagcugcaacaccggcuacaagcuguucggcagcaccagcagcuucugccugaucagcggcagcagcgugcaguggagcgacccccugcccgagugcagagagaucuacugccccgcccccccccagaucgacaacggcaucauccagggcgagagagaccacuacggcuacagacagagcgugaccuacgccugcaacaagggcuucaccaugaucggcgagcacagcaucuacugcaccgugaacaacgacgagggcgaguggagcggccccccccccgagugcagaggcaagagccugaccagcaaggugccccccaccgugcagaagcccaccaccgugaacgugcccaccaccgaggugagccccaccagccagaagaccaccaccaagaccaccacccccaacgcccaggccaccagaagcacccccgugagcagaaccaccaagcacuuccacgagaccacccccaacaagggcagcggcaccaccagcggcaccaccagacugcugagcggccacaccugcuucacccugaccggccugcugggcacccuggugaccaugggccugcugaccuaa

SEQ ID NO: 14898 - RNA, 387 nt, Artificial Sequence
  CD59__Homo_sapiens__NP_001120695
augggcauccagggcggcagcgugcuguucggccugcugcuggugcuggccguguucugccacagcggccacagccugcagugcuacaacugccccaaccccaccgccgacugcaagaccgccgugaacugcagcagcgacuucgacgccugccugaucaccaaggccggccugcagguguacaacaagugcuggaaguucgagcacugcaacuucaacgacgugaccaccagacugagagagaacgagcugaccuacuacugcugcaagaaggaccugugcaacuucaacgagcagcuggagaacggcggcaccagccugagcgagaagaccgugcugcugcuggugacccccuuccuggccgccgccuggagccugcaccccuaa

SEQ ID NO: 14899 - RNA, 1488 nt, Artificial Sequence
  CD5__Homo_sapiens__NP_055022
augcccaugggcagccugcagccccuggccacccuguaccugcugggcaugcugguggccagcugccugggcagacugagcugguacgaccccgacuuccaggccagacugaccagaagcaacagcaagugccagggccagcuggagguguaccugaaggacggcuggcacauggugugcagccagagcuggggcagaagcagcaagcagugggaggaccccagccaggccagcaaggugugccagagacugaacugcggcgugccccugagccugggccccuuccuggugaccuacaccccccagagcagcaucaucugcuacggccagcugggcagcuucagcaacugcagccacagcagaaacgacaugugccacagccugggccugaccugccuggagccccagaagaccaccccccccaccaccagacccccccccaccaccacccccgagcccaccgccccccccagacugcagcugguggcccagagcggcggccagcacugcgccggcgugguggaguucuacagcggcagccugggcggcaccaucagcuacgaggcccaggacaagacccaggaccuggagaacuuccugugcaacaaccugcagugcggcagcuuccugaagcaccugcccgagaccgaggccggcagagcccaggaccccggcgagcccagagagcaccagccccugcccauccaguggaagauccagaacagcagcugcaccagccuggagcacugcuucagaaagaucaagccccagaagagcggcagagugcuggcccugcugugcagcggcuuccagcccaaggugcagagcagacuggugggcggcagcagcaucugcgagggcaccguggaggugagacagggcgcccagugggccgcccugugcgacagcagcagcgccagaagcagccugagaugggaggaggugugcagagagcagcagugcggcagcgugaacagcuacagagugcuggacgccggcgaccccaccagcagaggccuguucugcccccaccagaagcugagccagugccacgagcugugggagagaaacagcuacugcaagaagguguucgugaccugccaggaccccaaccccgccggccuggccgccggcaccguggccagcaucauccuggcccuggugcugcugguggugcugcugguggugugcggcccccuggccuacaagaagcuggugaagaaguucagacagaagaagcagagacaguggaucggccccaccggcaugaaccagaacaugagcuuccacagaaaccacaccgccaccgugagaagccacgccgagaaccccaccgccagccacguggacaacgaguacagccagccccccagaaacagccaccugagcgccuaccccgcccuggagggcgcccugcacagaagcagcaugcagcccgacaacagcagcgacagcgacuacgaccugcacggcgcccagagacuguaa

SEQ ID NO: 14900 - RNA, 1044 nt, Artificial Sequence
  CD5L__Homo_sapiens__NP_005885
auggcccugcuguucagccugauccuggccaucugcaccagacccggcuuccuggccagccccagcggcgugagacuggugggcggccugcacagaugcgagggcagaguggagguggagcagaagggccaguggggcaccgugugcgacgacggcugggacaucaaggacguggccgugcugugcagagagcugggcugcggcgccgccagcggcacccccagcggcauccuguacgagccccccgccgagaaggagcagaaggugcugauccagagcgugagcugcaccggcaccgaggacacccuggcccagugcgagcaggaggagguguacgacugcagccacgacgaggacgccggcgccagcugcgagaaccccgagagcagcuucagccccgugcccgagggcgugagacuggccgacggccccggccacugcaagggcagaguggaggugaagcaccagaaccagugguacaccgugugccagaccggcuggagccugagagccgccaagguggugugcagacagcugggcugcggcagagccgugcugacccagaagagaugcaacaagcacgccuacggcagaaagcccaucuggcugagccagaugagcugcagcggcagagaggccacccugcaggacugccccagcggccccuggggcaagaacaccugcaaccacgacgaggacaccuggguggagugcgaggaccccuucgaccugagacuggugggcggcgacaaccugugcagcggcagacuggaggugcugcacaagggcguguggggcagcgugugcgacgacaacuggggcgagaaggaggaccagguggugugcaagcagcugggcugcggcaagagccugagccccagcuucagagacagaaagugcuacggccccggcgugggcagaaucuggcuggacaacgugagaugcagcggcgaggagcagagccuggagcagugccagcacagauucuggggcuuccacgacugcacccaccaggaggacguggccgugaucugcagcggcuaa

SEQ ID NO: 14901 - RNA, 648 nt, Artificial Sequence
  CD63__Homo_sapiens__NP_001244321
auggccguggagggcggcaugaagugcgugaaguuccugcuguacgugcugcugcuggccuucugcggcgccacccccggcagccugcugcccguggugaucaucgccgugggcguguuccuguuccugguggccuucgugggcugcugcggcgccugcaaggagaacuacugccugaugaucaccuucgccaucuuccugagccugaucaugcugguggagguggccgccgccaucgccggcuacguguucagagacaaggugaugagcgaguucaacaacaacuucagacagcagauggagaacuaccccaagaacaaccacaccgccagcauccuggacagaaugcaggccgacuucaagugcugcggcgccgccaacuacaccgacugggagaagauccccagcaugagcaagaacagagugcccgacagcugcugcaucaacgugaccgugggcugcggcaucaacuucaacgagaaggccauccacaaggagggcugcguggagaagaucggcggcuggcugagaaagaacgugcuggugguggccgccgccgcccugggcaucgccuucguggaggugcugggcaucguguucgccugcugccuggugaagagcaucagaagcggcuacgaggugauguaa

SEQ ID NO: 14902 - RNA, 984 nt, Artificial Sequence
  CD68__Homo_sapiens__NP_001035148
augagacuggccgugcuguucagcggcgcccugcugggccugcuggccgagagcaccggcaccaccagccacagaaccaccaagagccacaagaccaccacccacagaaccaccaccaccggcaccaccagccacggccccaccaccgccacccacaaccccaccaccaccagccacggcaacgugaccgugcaccccaccagcaacagcaccgccaccagccagggccccagcaccgccacccacagccccgccaccaccagccacggcaacgccaccgugcaccccaccagcaacagcaccgccaccagccccggcuucaccagcagcgcccaccccgagccccccccccccagccccagccccagccccaccagcaaggagaccaucggcgacuacaccuggaccaacggcagccagcccugcgugcaccugcaggcccagauccagaucagagugauguacaccacccagggcggcggcgaggccuggggcaucagcgugcugaaccccaacaagaccaaggugcagggcagcugcgagggcgcccacccccaccugcugcugagcuuccccuacggccaccugagcuucggcuucaugcaggaccugcagcagaaggugguguaccugagcuacauggccguggaguacaacgugagcuucccccacgccgcccaguggaccuucagcgcccagaacgccagccugagagaccugcaggccccccugggccagagcuucagcugcagcaacagcagcaucauccugagccccgccgugcaccuggaccugcugagccugagacugcaggccgcccagcugccccacaccggcguguucggccagagcuucagcugccccagcgacagaagcauccugcugccccugaucaucggccugauccugcugggccugcuggcccuggugcugaucgccuucugcaucaucagaagaagacccagcgccuaccaggcccuguaa

SEQ ID NO: 14903 - RNA, 600 nt, Artificial Sequence
  CD69__Homo_sapiens__NP_001772
augagcagcgagaacugcuucguggccgagaacagcagccugcaccccgagagcggccaggagaacgacgccaccagcccccacuucagcaccagacacgagggcagcuuccaggugcccgugcugugcgccgugaugaacgugguguucaucaccauccugaucaucgcccugaucgcccugagcgugggccaguacaacugccccggccaguacaccuucagcaugcccagcgacagccacgugagcagcugcagcgaggacugggugggcuaccagagaaagugcuacuucaucagcaccgugaagagaagcuggaccagcgcccagaacgccugcagcgagcacggcgccacccuggccgugaucgacagcgagaaggacaugaacuuccugaagagauacgccggcagagaggagcacugggugggccugaagaaggagcccggccaccccuggaaguggagcaacggcaaggaguucaacaacugguucaacgugaccggcagcgacaagugcguguuccugaagaacaccgaggugagcagcauggagugcgagaagaaccuguacuggaucugcaacaagcccuacaaguaa

SEQ ID NO: 14904 - RNA, 1806 nt, Artificial Sequence
  CD6__Homo_sapiens__NP_001241679
auguggcuguucuucggcaucaccggccugcugaccgccgcccugagcggccaccccagccccgccccccccgaccagcugaacaccagcagcgccgagagcgagcugugggagcccggcgagagacugcccgugagacugaccaacggcagcagcagcugcagcggcaccguggaggugagacuggaggccagcugggagcccgccugcggcgcccugugggacagcagagccgccgaggccgugugcagagcccugggcugcggcggcgccgaggccgccagccagcuggccccccccacccccgagcugccccccccccccgccgccggcaacaccagcguggccgccaacgccacccuggccggcgcccccgcccugcugugcagcggcgccgaguggagacugugcgaggugguggagcacgccugcagaagcgacggcagaagagccagagugaccugcgccgagaacagagcccugagacugguggacggcggcggcgccugcgccggcagaguggagaugcuggagcacggcgaguggggcagcgugugcgacgacaccugggaccuggaggacgcccacguggugugcagacagcugggcugcggcugggccgugcaggcccugcccggccugcacuucacccccggcagaggccccauccacagagaccaggugaacugcagcggcgccgaggccuaccugugggacugccccggccugcccggccagcacuacugcggccacaaggaggacgccggcgccgugugcagcgagcaccagagcuggagacugaccggcggcgccgacagaugcgagggccagguggaggugcacuucagaggcguguggaacaccgugugcgacagcgagugguaccccagcgaggccaaggugcugugccagagccugggcugcggcaccgccguggagagacccaagggccugccccacagccugagcggcagaauguacuacagcugcaacggcgaggagcugacccugagcaacugcagcuggagauucaacaacagcaaccugugcagccagagccuggccgccagagugcugugcagcgccagcagaagccugcacaaccugagcacccccgaggugcccgccagcgugcagaccgugaccaucgagagcagcgugaccgugaagaucgagaacaaggagagcagagagcugaugcugcugauccccagcaucgugcugggcauccugcugcugggcagccugaucuucaucgccuucauccugcugagaaucaagggcaaguacguguucaugcugcccauccaggugcaggcccccccccccgaggacagcgacagcggcagcgacagcgacuacgagcacuacgacuucagcgcccagccccccguggcccugaccaccuucuacaacagccagagacacagagugaccgacgaggaggugcagcagagcagauuccagaugcccccccuggaggagggccuggaggagcugcacgccagccacauccccaccgccaaccccggccacugcaucaccgacccccccagccugggcccccaguaccaccccagaagcaacagcgagagcagcaccagcagcggcgaggacuacugcaacagccccaagagcaagcugccccccuggaacccccagguguucagcagcgagagaagcagcuuccuggagcagccccccaaccuggagcuggccggcacccagcccgccuucagcggcagccccagcccccagcccgacagcaccgacaacgacgacuacgacgacaucagcgccgccuaa

SEQ ID NO: 14905 - RNA, 1080 nt, Artificial Sequence
  CD72__Homo_sapiens__NP_001773
auggccgaggccaucaccuacgccgaccugagauucgugaaggccccccugaagaagagcaucagcagcagacugggccaggaccccggcgccgacgacgacggcgagaucaccuacgagaacgugcaggugcccgccgugcugggcgugcccagcagccuggccagcagcgugcugggcgacaaggccgccgugaagagcgagcagcccaccgccagcuggagagccgugaccagccccgccgugggcagaauccugcccugcagaaccaccugccugagauaccugcugcugggccugcugcugaccugccugcugcugggcgugaccgccaucugccugggcgugagauaccugcaggugagccagcagcugcagcagaccaacagagugcuggaggugaccaacagcagccugagacagcagcugagacugaagaucacccagcugggccagagcgccgaggaccugcagggcagcagaagagagcuggcccagagccaggaggcccugcagguggagcagagagcccaccaggccgccgagggccagcugcaggccugccaggccgacagacagaagaccaaggagacccugcagagcgaggagcagcagagaagagcccuggagcagaagcugagcaacauggagaacagacugaagcccuucuucaccugcggcagcgccgacaccugcugccccagcggcuggaucaugcaccagaagagcugcuucuacaucagccugaccagcaagaacuggcaggagagccagaagcagugcgagacccugagcagcaagcuggccaccuucagcgagaucuacccccagagccacagcuacuacuuccugaacagccugcugcccaacggcggcagcggcaacagcuacuggaccggccugagcagcaacaaggacuggaagcugaccgacgacacccagagaaccagaaccuacgcccagagcagcaagugcaacaaggugcacaagaccuggagcugguggacccuggagagcgagagcugcagaagcagccugcccuacaucugcgagaugaccgccuucagauuccccgacuaa

SEQ ID NO: 14906 - RNA, 483 nt, Artificial Sequence
  CD74__Homo_sapiens__NP_001020329
augcacagaagaagaagcagaagcugcagagaggaccagaagcccgugauggacgaccagagagaccugaucagcaacaacgagcagcugcccaugcugggcagaagacccggcgcccccgagagcaagugcagcagaggcgcccuguacaccggcuucagcauccuggugacccugcugcuggccggccaggccaccaccgccuacuuccuguaccagcagcagggcagacuggacaagcugaccgugaccagccagaaccugcagcuggagaaccugagaaugaagcugcccaagccccccaagcccgugagcaagaugagaauggccaccccccugcugaugcaggcccugcccaugggcgcccugccccagggccccaugcagaacgccaccaaguacggcaacaugaccgaggaccacgugaugcaccugcugcagagccacuggaacuggagaaccagacugcugggcuggguguaa

SEQ ID NO: 14907 - RNA, 681 nt, Artificial Sequence
  CD79A__Homo_sapiens__NP_001774
augcccggcggccccggcgugcugcaggcccugcccgccaccaucuuccugcuguuccugcugagcgccguguaccugggccccggcugccaggcccuguggaugcacaaggugcccgccagccugauggugagccugggcgaggacgcccacuuccagugcccccacaacagcagcaacaacgccaacgugaccugguggagagugcugcacggcaacuacaccuggccccccgaguuccugggccccggcgaggaccccaacggcacccugaucauccagaacgugaacaagagccacggcggcaucuacgugugcagagugcaggagggcaacgagagcuaccagcagagcugcggcaccuaccugagagugagacagcccccccccagacccuuccuggacaugggcgagggcaccaagaacagaaucaucaccgccgagggcaucauccugcuguucugcgccguggugcccggcacccugcugcuguucagaaagagauggcagaacgagaagcugggccuggacgccggcgacgaguacgaggacgagaaccuguacgagggccugaaccuggacgacugcagcauguacgaggacaucagcagaggccugcagggcaccuaccaggacgugggcagccugaacaucggcgacgugcagcuggagaagcccuaa

SEQ ID NO: 14908 - RNA, 690 nt, Artificial Sequence
  CD79B__Homo_sapiens__NP_000617
auggccagacuggcccugagccccgugcccagccacuggaugguggcccugcugcugcugcugagcgccgagcccgugcccgccgccagaagcgaggacagauacagaaaccccaagggcagcgccugcagcagaaucuggcagagccccagauucaucgccagaaagagaggcuucaccgugaagaugcacugcuacaugaacagcgccagcggcaacgugagcuggcuguggaagcaggagauggacgagaacccccagcagcugaagcuggagaagggcagaauggaggagagccagaacgagagccuggccacccugaccauccagggcaucagauucgaggacaacggcaucuacuucugccagcagaagugcaacaacaccagcgagguguaccagggcugcggcaccgagcugagagugaugggcuucagcacccuggcccagcugaagcagagaaacacccugaaggacggcaucaucaugauccagacccugcugaucauccuguucaucaucgugcccaucuuccugcugcuggacaaggacgacagcaaggccggcauggaggaggaccacaccuacgagggccuggacaucgaccagaccgccaccuacgaggacaucgugacccugagaaccggcgaggugaaguggagcgugggcgagcaccccggccaggaguaa

SEQ ID NO: 14909 - RNA, 723 nt, Artificial Sequence
  CD7__Homo_sapiens__NP_006128
auggccggcccccccagacugcugcugcugccccugcugcuggcccuggccagaggccugcccggcgcccuggccgcccaggaggugcagcagagcccccacugcaccaccgugcccgugggcgccagcgugaacaucaccugcagcaccagcggcggccugagaggcaucuaccugagacagcugggcccccagccccaggacaucaucuacuacgaggacggcguggugcccaccaccgacagaagauucagaggcagaaucgacuucagcggcagccaggacaaccugaccaucaccaugcacagacugcagcugagcgacaccggcaccuacaccugccaggccaucaccgaggugaacguguacggcagcggcacccuggugcuggugaccgaggagcagagccagggcuggcacagaugcagcgacgccccccccagagccagcgcccugcccgccccccccaccggcagcgcccugcccgacccccagaccgccagcgcccugcccgacccccccgccgccagcgcccugcccgccgcccuggccgugaucagcuuccugcugggccugggccugggcguggccugcgugcuggccagaacccagaucaagaagcugugcagcuggagagacaagaacagcgccgccugcgugguguacgaggacaugagccacagcagaugcaacacccugagcagccccaaccaguaccaguaa

SEQ ID NO: 14910 - RNA, 867 nt, Artificial Sequence
  CD80__Homo_sapiens__NP_005182
augggccacaccagaagacagggcaccagccccagcaagugccccuaccugaacuucuuccagcugcuggugcuggccggccugagccacuucugcagcggcgugauccacgugaccaaggaggugaaggagguggccacccugagcugcggccacaacgugagcguggaggagcuggcccagaccagaaucuacuggcagaaggagaagaagauggugcugaccaugaugagcggcgacaugaacaucuggcccgaguacaagaacagaaccaucuucgacaucaccaacaaccugagcaucgugauccuggcccugagacccagcgacgagggcaccuacgagugcguggugcugaaguacgagaaggacgccuucaagagagagcaccuggccgaggugacccugagcgugaaggccgacuuccccacccccagcaucagcgacuucgagauccccaccagcaacaucagaagaaucaucugcagcaccagcggcggcuuccccgagccccaccugagcuggcuggagaacggcgaggagcugaacgccaucaacaccaccgugagccaggaccccgagaccgagcuguacgccgugagcagcaagcuggacuucaacaugaccaccaaccacagcuucaugugccugaucaaguacggccaccugagagugaaccagaccuucaacuggaacaccaccaagcaggagcacuuccccgacaaccugcugcccagcugggccaucacccugaucagcgugaacggcaucuucgugaucugcugccugaccuacugcuucgcccccagaugcagagagagaagaagaaacgagagacugagaagagagagcgugagacccguguaa

SEQ ID NO: 14911 - RNA, 711 nt, Artificial Sequence
  CD81__Homo_sapiens__NP_004347
augggcguggagggcugcaccaagugcaucaaguaccugcuguucguguucaacuucguguucuggcuggccggcggcgugauccugggcguggcccuguggcugagacacgacccccagaccaccaaccugcuguaccuggagcugggcgacaagcccgcccccaacaccuucuacgugggcaucuacauccugaucgccgugggcgccgugaugauguucgugggcuuccugggcugcuacggcgccauccaggagagccagugccugcugggcaccuucuucaccugccuggugauccuguucgccugcgagguggccgccggcaucuggggcuucgugaacaaggaccagaucgccaaggacgugaagcaguucuacgaccaggcccugcagcaggccgugguggacgacgacgccaacaacgccaaggccguggugaagaccuuccacgagacccuggacugcugcggcagcagcacccugaccgcccugaccaccagcgugcugaagaacaaccugugccccagcggcagcaacaucaucagcaaccuguucaaggaggacugccaccagaagaucgacgaccuguucagcggcaagcuguaccugaucggcaucgccgccaucgugguggccgugaucaugaucuucgagaugauccugagcauggugcugugcugcggcaucagaaacagcagcguguacuaa

SEQ ID NO: 14912 - RNA, 729 nt, Artificial Sequence
  CD82__Homo_sapiens__NP_001020015
augggcagcgccugcaucaaggugaccaaguacuuccuguuccuguucaaccugaucuucuucauccugggcgccgugauccugggcuucggcguguggauccuggccgacaagagcagcuucaucagcgugcugcagaccagcagcagcagccugagaaugggcgccuacguguucaucggcgugggcgccgugaccaugcugaugggcuuccugggcugcaucggcgccgugaacgaggugagaugccugcugggccugcugaagcaggagaugggcggcaucgugaccgagcugaucagagacuacaacagcagcagagaggacagccugcaggacgccugggacuacgugcaggcccaggugaagugcugcggcugggugagcuucuacaacuggaccgacaacgccgagcugaugaacagacccgaggugaccuaccccugcagcugcgaggugaagggcgaggaggacaacagccugagcgugagaaagggcuucugcgaggcccccggcaacagaacccagagcggcaaccaccccgaggacuggcccguguaccaggagggcugcauggagaaggugcaggccuggcugcaggagaaccugggcaucauccugggcgugggcgugggcguggccaucaucgagcugcugggcauggugcugagcaucugccugugcagacacgugcacagcgaggacuacagcaaggugcccaaguacuaa

SEQ ID NO: 14913 - RNA, 618 nt, Artificial Sequence
  CD83__Homo_sapiens__NP_004224
augagcagaggccugcagcugcugcugcugagcugcgccuacagccuggcccccgccacccccgaggugaagguggccugcagcgaggacguggaccugcccugcaccgcccccugggacccccaggugcccuacaccgugagcugggugaagcugcuggagggcggcgaggagagaauggagaccccccaggaggaccaccugagaggccagcacuaccaccagaagggccagaacggcagcuucgacgcccccaacgagagacccuacagccugaagaucagaaacaccaccagcugcaacagcggcaccuacagaugcacccugcaggaccccgacggccagagaaaccugagcggcaaggugauccugagagugaccggcugccccgcccagagaaaggaggagaccuucaagaaguacagagccgagaucgugcugcugcuggcccuggugaucuucuaccugacccugaucaucuucaccugcaaguucgccagacugcagagcaucuuccccgacuucagcaaggccggcauggagagagccuuccugcccgugaccagccccaacaagcaccugggccuggugaccccccacaagaccgagcugguguaa

SEQ ID NO: 14914 - RNA, 1038 nt, Artificial Sequence
  CD84__Homo_sapiens__NP_001171808
auggcccagcaccaccuguggauccugcugcugugccugcagaccuggcccgaggccgccggcaaggacagcgagaucuucaccgugaacggcauccugggcgagagcgugaccuuccccgugaacauccaggagcccagacaggugaagaucaucgccuggaccagcaagaccagcguggccuacgugacccccggcgacagcgagaccgcccccguggugaccgugacccacagaaacuacuacgagagaauccacgcccugggccccaacuacaaccuggugaucagcgaccugagaauggaggacgccggcgacuacaaggccgacaucaacacccaggccgaccccuacaccaccaccaagagauacaaccugcagaucuacagaagacugggcaagcccaagaucacccagagccugauggccagcgugaacagcaccugcaacgugacccugaccugcagcguggagaaggaggagaagaacgugaccuacaacuggagcccccugggcgaggagggcaacgugcugcagaucuuccagacccccgaggaccaggagcugaccuacaccugcaccgcccagaaccccgugagcaacaacagcgacagcaucagcgccagacagcugugcgccgacaucgccaugggcuucagaacccaccacaccggccugcugagcgugcuggccauguucuuccugcuggugcugauccugagcagcguguuccuguucagacuguucaagagaagacagggcagaaucuuccccgagggcagcugccugaacaccuucaccaagaaccccuacgccgccagcaagaagaccaucuacaccuacaucauggccagcagaaacacccagcccgccgagagcagaaucuacgacgagauccugcagagcaaggugcugcccagcaaggaggagcccgugaacaccguguacagcgaggugcaguucgccgacaagaugggcaaggccagcacccaggacagcaagccccccggcaccagcagcuacgagaucgugaucuaa

SEQ ID NO: 14915 - RNA, 654 nt, Artificial Sequence
  CD86__Homo_sapiens__NP_001193853
auggacccccagugcaccaugggccugagcaacauccuguucgugauggccuuccugcugagcgccaacuucagccagcccgagaucgugcccaucagcaacaucaccgagaacguguacaucaaccugaccugcagcagcauccacggcuaccccgagcccaagaagaugagcgugcugcugagaaccaagaacagcaccaucgaguacgacggcaucaugcagaagagccaggacaacgugaccgagcuguacgacgugagcaucagccugagcgugagcuuccccgacgugaccagcaacaugaccaucuucugcauccuggagaccgacaagaccagacugcugagcagccccuucagcaucgagcuggaggacccccagcccccccccgaccacauccccuggaucaccgccgugcugcccaccgugaucaucugcgugaugguguucugccugauccuguggaaguggaagaagaagaagagacccagaaacagcuacaagugcggcaccaacaccauggagagagaggagagcgagcagaccaagaagagagagaagauccacauccccgagagaagcgacgaggcccagagaguguucaagagcagcaagaccagcagcugcgacaagagcgacaccugcuucuaa

SEQ ID NO: 14916 - RNA, 708 nt, Artificial Sequence
  CD8A__Homo_sapiens__NP_001759
auggcccugcccgugaccgcccugcugcugccccuggcccugcugcugcacgccgccagacccagccaguucagagugagcccccuggacagaaccuggaaccugggcgagaccguggagcugaagugccaggugcugcugagcaaccccaccagcggcugcagcuggcuguuccagcccagaggcgccgccgccagccccaccuuccugcuguaccugagccagaacaagcccaaggccgccgagggccuggacacccagagauucagcggcaagagacugggcgacaccuucgugcugacccugagcgacuucagaagagagaacgagggcuacuacuucugcagcgcccugagcaacagcaucauguacuucagccacuucgugcccguguuccugcccgccaagcccaccaccacccccgcccccagaccccccacccccgcccccaccaucgccagccagccccugagccugagacccgaggccugcagacccgccgccggcggcgccgugcacaccagaggccuggacuucgccugcgacaucuacaucugggccccccuggccggcaccugcggcgugcugcugcugagccuggugaucacccuguacugcaaccacagaaacagaagaagagugugcaagugccccagacccguggugaagagcggcgacaagcccagccugagcgccagauacguguaa

SEQ ID NO: 14917 - RNA, 597 nt, Artificial Sequence
  CD8B__Homo_sapiens__NP_001171571
augagacccagacuguggcugcugcuggccgcccagcugaccgugcugcacggcaacagcgugcugcagcagacccccgccuacaucaaggugcagaccaacaagauggugaugcugagcugcgaggccaagaucagccugagcaacaugagaaucuacuggcugagacagagacaggcccccagcagcgacagccaccacgaguuccuggcccugugggacagcgccaagggcaccauccacggcgaggagguggagcaggagaagaucgccguguucagagacgccagcagauucauccugaaccugaccagcgugaagcccgaggacagcggcaucuacuucugcaugaucgugggcagccccgagcugaccuucggcaagggcacccagcugagcgugguggacuuccugcccaccaccgcccagcccaccaagaagagcacccugaagaagagagugugcagacugcccagacccgagacccagaagggccugaagggcaagguguaccaggagccccugagccccaacgccugcauggacaccaccgccauccugcagccccacagaagcugccugacccacggcagcuaa

SEQ ID NO: 14918 - RNA, 1959 nt, Artificial Sequence
  CD93__Homo_sapiens__NP_036204
auggccaccagcaugggccugcugcugcugcugcugcugcugcugacccagcccggcgccggcaccggcgccgacaccgaggccguggugugcgugggcaccgccugcuacaccgcccacagcggcaagcugagcgccgccgaggcccagaaccacugcaaccagaacggcggcaaccuggccaccgugaagagcaaggaggaggcccagcacgugcagagagugcuggcccagcugcugagaagagaggccgcccugaccgccagaaugagcaaguucuggaucggccugcagagagagaagggcaagugccuggaccccagccugccccugaagggcuucagcugggugggcggcggcgaggacacccccuacagcaacuggcacaaggagcugagaaacagcugcaucagcaagagaugcgugagccugcugcuggaccugagccagccccugcugcccagcagacugcccaaguggagcgagggccccugcggcagccccggcagccccggcagcaacaucgagggcuucgugugcaaguucagcuucaagggcaugugcagaccccuggcccugggcggccccggccaggugaccuacaccacccccuuccagaccaccagcagcagccuggaggccgugcccuucgccagcgccgccaacguggccugcggcgagggcgacaaggacgagacccagagccacuacuuccugugcaaggagaaggcccccgacguguucgacuggggcagcagcggcccccugugcgugagccccaaguacggcugcaacuucaacaacggcggcugccaccaggacugcuucgagggcggcgacggcagcuuccugugcggcugcagacccggcuucagacugcuggacgaccuggugaccugcgccagcagaaaccccugcagcagcagccccugcagaggcggcgccaccugcgugcugggcccccacggcaagaacuacaccugcagaugcccccagggcuaccagcuggacagcagccagcuggacugcguggacguggacgagugccaggacagccccugcgcccaggagugcgugaacacccccggcggcuucagaugcgagugcugggugggcuacgagcccggcggccccggcgagggcgccugccaggacguggacgagugcgcccugggcagaagccccugcgcccagggcugcaccaacaccgacggcagcuuccacugcagcugcgaggagggcuacgugcuggccggcgaggacggcacccagugccaggacguggacgagugcgugggccccggcggcccccugugcgacagccugugcuucaacacccagggcagcuuccacugcggcugccugcccggcugggugcuggcccccaacggcgugagcugcaccaugggccccgugagccugggcccccccagcggcccccccgacgaggaggacaagggcgagaaggagggcagcaccgugcccagagccgccaccgccagccccaccagaggccccgagggcacccccaaggccacccccaccaccagcagacccagccugagcagcgacgcccccaucaccagcgccccccugaagaugcuggcccccagcggcagccccggcguguggagagagcccagcauccaccacgccaccgccgccagcggcccccaggagcccgccggcggcgacagcagcguggccacccagaacaacgacggcaccgacggccagaagcugcugcuguucuacauccugggcaccgugguggccauccugcugcugcuggcccuggcccugggccugcugguguacagaaagagaagagccaagagagaggagaagaaggagaagaagccccagaacgccgccgacagcuacagcugggugcccgagagagccgagagcagagccauggagaaccaguacagccccacccccggcaccgacugcuaa

SEQ ID NO: 14919 - RNA, 1710 nt, Artificial Sequence
  CD96__Homo_sapiens__NP_005807
auggagaagaaguggaaguacugcgccguguacuacaucauccagauccacuucgugaagggcgugugggagaagaccgugaacaccgaggagaacguguacgccacccugggcagcgacgugaaccugaccugccagacccagaccgugggcuucuucgugcagaugcaguggagcaaggugaccaacaagaucgaccugaucgccguguaccacccccaguacggcuucuacugcgccuacggcagacccugcgagagccuggugaccuucaccgagacccccgagaacggcagcaaguggacccugcaccugagaaacaugagcugcagcgugagcggcagauacgagugcaugcuggugcuguaccccgagggcauccagaccaagaucuacaaccugcugauccagacccacgugaccgccgacgaguggaacagcaaccacaccaucgagaucgagaucaaccagacccuggagauccccugcuuccagaacagcagcagcaagaucagcagcgaguucaccuacgccuggagcguggaggacaacggcacccaggagacccugaucagccagaaccaccugaucagcaacagcacccugcugaaggacagagugaagcugggcaccgacuacagacugcaccugagccccgugcagaucuucgacgacggcagaaaguucagcugccacaucagagugggccccaacaagauccugagaagcagcaccaccgugaagguguucgccaagcccgagauccccgugaucguggagaacaacagcaccgacgugcugguggagagaagauucaccugccugcugaagaacguguuccccaaggccaacaucaccugguucaucgacggcagcuuccugcacgacgagaaggagggcaucuacaucaccaacgaggagagaaagggcaaggacggcuuccuggagcugaagagcgugcugaccagagugcacagcaacaagcccgcccagagcgacaaccugaccaucuggugcauggcccugagccccgugcccggcaacaagguguggaacaucagcagcgagaagaucaccuuccugcugggcagcgagaucagcagcaccgaccccccccugagcgugaccgagagcacccuggacacccagcccagccccgccagcagcgugagccccgccagauaccccgccaccagcagcgugacccugguggacgugagcgcccugagacccaacaccaccccccagcccagcaacagcagcaugaccaccagaggcuucaacuaccccuggaccagcagcggcaccgacaccaagaagagcgugagcagaauccccagcgagaccuacagcagcagccccagcggcgccggcagcacccugcacgacaacguguucaccagcaccgccagagccuucagcgaggugcccaccaccgccaacggcagcaccaagaccaaccacgugcacaucaccggcaucguggugaacaagcccaaggacggcaugagcuggcccgugaucguggccgcccugcuguucugcugcaugauccuguucggccugggcgugagaaaguggugccaguaccagaaggagaucauggagagacccccccccuucaagcccccccccccccccaucaaguacaccugcauccaggagcccaacgagagcgaccugcccuaccacgagauggagacccuguaa

SEQ ID NO: 14920 - RNA, 510 nt, Artificial Sequence
  CD99__Homo_sapiens__NP_001116370
auggccagaggcgccgcccuggcccugcugcuguucggccugcugggcgugcugguggccgcccccgacggcggcuucgaccugagcgacgcccugcccggcgacgacuucgaccugggcgacgccgugguggacggcgagaacgacgaccccagaccccccaacccccccaagcccaugcccaaccccaaccccaaccaccccagcagcagcggcagcuucagcgacgccgaccuggccgacggcgugagcggcggcgagggcaagggcggcagcgacggcggcggcagccacagaaaggagggcgaggaggccgacgcccccggcgugauccccggcaucgugggcgccguggugguggccguggccggcgccaucagcagcuucaucgccuaccagaagaagaagcugugcuucaaggagaacgccgagcagggcgagguggacauggagagccacagaaacgccaacgccgagcccgccgugcagagaacccugcuggagaaguaa

SEQ ID NO: 14921 - RNA, 687 nt, Artificial Sequence
  CD9__Homo_sapiens__NP_001760
augcccgugaagggcggcaccaagugcaucaaguaccugcuguucggcuucaacuucaucuucuggcuggccggcaucgccgugcuggccaucggccuguggcugagauucgacagccagaccaagagcaucuucgagcaggagaccaacaacaacaacagcagcuucuacaccggcguguacauccugaucggcgccggcgcccugaugaugcuggugggcuuccugggcugcugcggcgccgugcaggagagccagugcaugcugggccuguucuucggcuuccugcuggugaucuucgccaucgagaucgccgccgccaucuggggcuacagccacaaggacgaggugaucaaggaggugcaggaguucuacaaggacaccuacaacaagcugaagaccaaggacgagccccagagagagacccugaaggccauccacuacgcccugaacugcugcggccuggccggcggcguggagcaguucaucagcgacaucugccccaagaaggacgugcuggagaccuucaccgugaagagcugccccgacgccaucaaggagguguucgacaacaaguuccacaucaucggcgccgugggcaucggcaucgccguggugaugaucuucggcaugaucuucagcaugauccugugcugcgccaucagaagaaacagagagaugguguaa

SEQ ID NO: 14922 - RNA, 1476 nt, Artificial Sequence
  CDADC1__Homo_sapiens__NP_001180407
augaaggaggccggccagaugcagaaccuggagagcgccagagccggcagaagcgugagcacccagaccggcagcaugaccggccagauccccagacugagcaaggugaaccuguucacccugcugagccuguggauggagcuguuccccgccgaggcccagagacagaagagccagaagaacgaggagggcaagcacggcccccugggcgacaacgaggagagaaccagagugagcaccgacaagagacaggugaagagaaccggccuggugguggugaagaacaugaagaucgugggccugcacugcagcagcgaggaccugcacgccggccagaucgcccugaucaagcacggcagcagacugaagaacugcgaccuguacuucagcagaaagcccugcagcgccugccugaagaugaucgugaacgccggcgugaacagaaucagcuacuggcccgccgaccccgagaucagccugcugaccgaggccagcagcagcgaggacgccaagcuggacgccaaggccguggagagacugaagagcaacagcagagcccacgugugcgugcugcugcagccccuggugugcuacauggugcaguucguggaggagaccagcuacaagugcgacuucauccagaagaucaccaagacccugcccgacgccaacaccgacuucuacuacgagugcaagcaggagagaaucaaggaguacgagaugcuguuccuggugagcaacgaggagaugcacaagcagauccugaugaccaucggccuggagaaccugugcgagaaccccuacuucagcaaccugagacagaacaugaaggaccugauccugcugcuggccaccguggccagcagcgugcccaacuucaagcacuucggcuucuacagaagcaaccccgagcagaucaacgagauccacaaccagagccugccccaggagaucgccagacacugcauggugcaggccagacugcuggccuacagaaccgaggaccacaagaccggcgugggcgccgugaucugggccgagggcaagagcagaagcugcgacggcaccggcgccauguacuucgugggcugcggcuacaacgccuuccccgugggcagcgaguacgccgacuucccccacauggacgacaagcagaaggacagagagaucagaaaguucagauacaucauccacgccgagcagaacgcccugaccuucagaugccaggagaucaagcccgaggagagaagcaugaucuucgugaccaagugccccugcgacgagugcgugccccugaucaagggcgccggcaucaagcagaucuacgccggcgacguggacgugggcaagaagaaggccgacaucagcuacaugagauucggcgagcuggagggcgugagcaaguucaccuggcagcugaaccccagcggcgccuacggccuggagcagaacgagcccgagagaagagagagcuaa

SEQ ID NO: 14923 - RNA, 3684 nt, Artificial Sequence
  CDAN1__Homo_sapiens__NP_612486
auggccgccgugcuggagagccugcugagagaggaggugagcguggccgccguggugagauggaucgccagaagcacccagggcagcgaggacaacgccggcgaggccgccgcccugagcagccugagagcccugagaaaggaguucgugcccuuccugcugaacuuccugagagagcagagcagcagagugcugccccagggcccccccacccccgccaagacccccggcgccagcgccgcccugcccggcagacccggcggcccccccagaggcagcagaggcgccagaagccagcuguucccccccaccgaggcccagagcaccgccgccgaggccccccuggccagaagaggcggcagaagaagaggccccggccccgccagagagagaggcggcagaggccuggaggagggcgugagcggcgagagccugcccggcgccggcggcagaagacugagaggcagcggcagccccagcagacccagccugacccugagcgacccccccaaccugagcaaccuggaggaguucccccccgugggcagcgugccccccggccccaccggcaccaagcccagcagaagaaucaaccccacccccgugagcgaggagagaagccugagcaagcccaagaccugcuucaccagcccccccaucagcugcgugcccagcagccagcccagcgcccuggacaccagccccuggggccugggccugccccccggcugcagaagccugcaggaggagagagagaugcugagaaaggagagaagcaagcagcugcagcagagccccacccccaccugccccacccccgagcugggcagcccccugcccagcagaaccggcagccugaccgacgagcccgccgaccccgccagagugagcagcagacagagacuggagcugguggcccugguguacagcagcugcaucgccgagaaccuggugcccaaccuguuccuggagcuguucuucguguuccagcugcugaccgccagaagaauggugaccgccaaggacagcgaccccgagcugagccccgccgugcuggacagccuggagagcccccuguuccagagcauccacgacugcguguucuucgccgugcaggugcuggagugccacuuccaggugcugagcaaccuggacaagggcacccugaagcugcuggccgagaacgagagacugcugugcuucagccccgcccugcagggcagacugagagccgccuacgagggcagcguggccaaggugagccuggugaugccccccagcacccaggccgugagcuuccagcccgagaccgacaacagagccaacuucagcagcgacagagccuuccacaccuucaagaagcagagagacguguucuacgaggugcugagagagugggaggaccaccacgaggagcccggcugggacuucgagaagggccugggcagcagaaucagagccaugaugggccagcugagcgccgccugcagccacagccacuucgugagacuguuccagaagcagcugcugcagaugugccagagccccggcggcgccggcggcaccgugcugggcgaggcccccgacgugcugagcaugcugggcgccgacaagcugggcagacuguggagacugcaggagagacugauggccccccagagcagcggcggccccugccccccccccaccuuccccggcugccagggcuucuucagagacuucauccugagcgccagcagcuuccaguucaaccagcaccugauggacagccugagccugaagauccaggagcugaacggccuggcccugccccagcacgagcccaacgacgaggacggcgagagcgacguggacuggcagggcgagagaaagcaguucgccguggugcugcugagccugagacugcuggccaaguuccugggcuucguggccuuccugcccuacagaggccccgagcccccccccaccggcgagcugcaggacagcauccuggcccugagaagccaggugccccccgugcuggacgugagaacccugcugcagagaggccugcaggccagaagagccgugcugaccgugcccuggcugguggaguuccugagcuucgccgaccacguggugccccugcuggaguacuacagagacaucuucacccugcugcugagacugcacagaagccuggugcugagccaggagagcgagggcaagaugugcuuccugaacaagcugcugcugcuggccgugcugggcuggcuguuccagauccccaccgugcccgaggaccuguucuuccuggaggagggccccagcuacgccuucgagguggacaccguggcccccgagcacggccuggacaacgcccccgugguggaccagcagcugcuguacaccugcugccccuacaucggcgagcugagaaagcugcuggccagcugggugagcggcagcagcggcagaagcggcggcuucaugagaaagaucacccccaccaccaccaccagccugggcgcccagcccagccagaccagccagggccugcaggcccagcuggcccaggccuucuuccacaaccagccccccagccugagaagaaccguggaguucguggccgagagaaucggcagcaacugcgugaagcacaucaaggccacccugguggccgaccuggugagacaggccgagagccugcugcaggagcagcuggugacccagggcgaggagggcggcgaccccgcccagcugcuggagauccugugcagccagcugugcccccacggcgcccaggcccuggcccugggcagagaguucugccagagaaagagccccggcgccgugagagcccugcugcccgaggagacccccgccgccgugcugagcagcgccgagaacaucgccgugggccuggccaccgagaaggccugcgccuggcugagcgccaacaucaccgcccugaucagaagagaggugaaggccgccgugagcagaacccugagagcccagggccccgagcccgccgccagaggcgagagaagaggcugcagcagagccugcgagcaccacgccccccugcccagccaccugaucagcgagaucaaggacgugcugagccuggccgugggccccagagaccccgacgagggcgugagccccgagcaccuggagcagcugcugggccagcugggccagacccugagaugcagacaguuccugugcccccccgccgagcagcaccuggccaagugcagcguggagcuggccagccugcugguggccgaccagauccccauccugggcccccccgcccaguacagacuggagagaggccaggccagaagacugcugcacaugcugcugagccuguggaaggaggacuuccagggccccgugccccugcagcugcugcugagccccagaaacgugggccugcuggccgacaccagacccagagagugggaccugcugcuguuccugcugagagagcugguggagaagggccugaugggcagaauggagaucgaggccugccugggcagccugcaccaggcccaguggcccggcgacuucgccgaggagcuggccacccugagcaaccuguuccuggccgagccccaccugcccgagccccagcugagagccugcgagcuggugcagcccaacagaggcaccgugcuggcccagagcuaa

SEQ ID NO: 14924 - RNA, 1011 nt, Artificial Sequence
  CDC123__Homo_sapiens__NP_006014
augaagaaggagcacgugcugcacugccaguucagcgccugguaccccuucuucagaggcgugaccaucaagagcgugauccugccccugccccagaacgugaaggacuaccugcuggacgacggcacccugguggugagcggcagagacgacccccccacccacagccagcccgacagcgacgacgaggccgaggagauccaguggagcgacgacgagaacaccgccacccugaccgcccccgaguuccccgaguucgccaccaaggugcaggaggccaucaacagccugggcggcagcguguuccccaagcugaacuggagcgcccccagagacgccuacuggaucgccaugaacagcagccugaagugcaagacccugagcgacaucuuccugcuguucaagagcagcgacuucaucaccagagacuucacccagcccuucauccacugcaccgacgacagccccgaccccugcaucgaguacgagcuggugcugagaaaguggugcgagcugauccccggcgccgaguucagaugcuucgugaaggagaacaagcugaucggcaucagccagagagacuacacccaguacuacgaccacaucagcaagcagaaggaggagaucagaagaugcauccaggacuucuucaagaagcacauccaguacaaguuccuggacgaggacuucguguucgacaucuacagagacagcagaggcaagguguggcugaucgacuucaaccccuucggcgaggugaccgacagccugcuguucaccugggaggagcugaucagcgagaacaaccugaacggcgacuucagcgagguggacgcccaggagcaggacagccccgccuucagaugcaccaacagcgaggugaccgugcagcccagccccuaccugagcuacagacugcccaaggacuucguggaccugagcaccggcgaggacgcccacaagcugaucgacuuccugaagcugaagagaaaccagcaggaggacgacuaa

SEQ ID NO: 14925 - RNA, 1836 nt, Artificial Sequence
  CDC14A__Homo_sapiens__XP_011540643
auggacuucccccugggccagugcagacuggugugcagcagccuguacauguggcuggccaagagagaggacggcgccgccauccugaacaugcccagccccagcuucuacgccgacuucggcccccugaaccuggccaugguguacagauacugcugcaagcugaacaagaagcugaagagcuacagccugagcagaaagaagaucgugcacuacaccugcuucgaccagagaaagagagccaacgccgccuuccugaucggcgccuacgccgugaucuaccugaagaagacccccgaggaggccuacagagcccugcugagcggcagcaacccccccuaccugcccuucagagacgccagcuucggcaacugcaccuacaaccugaccauccuggacugccugcagggcaucagaaagggccugcagcacggcuucuucgacuucgagaccuucgacguggacgaguacgagcacuacgagagaguggagaacggcgacuucaacuggaucgugcccggcaaguuccuggccuucagcggcccccaccccaagagcaagaucgagaacggcuacccccugcacgcccccgaggccuacuuccccuacuucaagaagcacaacgugaccgccguggugagacugaacaagaagaucuacgaggccaagagauucaccgacgccggcuucgagcacuacgaccuguucuucaucgacggcagcacccccagcgacaacaucgugagaagauuccugaacaucugcgagaacaccgagggcgccaucgccgugcacugcaaggccggccugggcagaaccggcacccugaucgccugcuacgugaugaagcacuacagauucacccacgccgagaucaucgccuggaucagaaucugcagacccggcagcaucaucggcccccagcagcacuuccuggaggagaagcaggccagccugugggugcagggcgacaucuucagaagcaagcugaagaacagacccagcagcgagggcagcaucaacaagauccugagcggccuggacgacaugagcaucggcggcaaccugagcaagacccagaacauggagagauucggcgaggacaaccuggaggacgacgacguggagaugaagaacggcaucacccagggcgacaagcugagagcccugaagagccagagacagcccagaaccagccccagcugcgccuucagaagcgacgacaccaagggccaccccagagccgugagccagcccuucagacugagcagcagccugcagggcagcgccgugacccugaagaccagcaagauggcccugagccccagcgccaccgccaagagaaucaacagaaccagccugagcagcggcgccaccgugagaagcuucagcaucaacagcagacuggccagcagccugggcaaccugaacgccgccaccgacgaccccgagaacaagaagaccagcagcagcagcaaggccggcuucaccgccagccccuucaccaaccugcugaacggcagcagccagcccaccaccagaaacuaccccgagcugaacaacaaccaguacaacagaagcagcaacagcaacggcggcaaccugaacagcccccccggcccccacagcgccaagaccgaggagcacaccaccauccugagacccagcuacaccggccugagcagcagcagcgccagauuccugagcagaagcauccccgugagcgcccagacccccccccccggcccccagaaccccgagugcaacuucugcgcccugcccagccagcccagacugccccccaagaaguucaacagcgccaaggaggccuucuaa

SEQ ID NO: 14926 - RNA, 1386 nt, Artificial Sequence
  CDC14B__Homo_sapiens__NP_001070649
augagcagagagggcgccggcgccgcccugguggccgaggugaucaaggacagacugugcuucgccauccuguacagcagacccaagagcgccagcaacgugcacuacuucagcaucgacaacgagcuggaguacgagaacuucuacgccgacuucggcccccugaaccuggccaugguguacagauacugcugcaagaucaacaagaagcugaagagcaucaccaugcugagaaagaagaucgugcacuucaccggcagcgaccagagaaagcaggccaacgccgccuuccuggugggcugcuacauggugaucuaccugggcagaacccccgaggaggccuacagaauccugaucuucggcgagaccagcuacauccccuucagagacgccgccuacggcagcugcaacuucuacaucacccugcuggacugcuuccacgccgugaagaaggccaugcaguacggcuuccugaacuucaacagcuucaaccuggacgaguacgagcacuacgagaaggccgagaacggcgaccugaacuggaucauccccgacagauucaucgccuucugcggcccccacagcagagccagacuggagagcggcuaccaccagcacagccccgagaccuacauccaguacuucaagaaccacaacgugaccaccaucaucagacugaacaagagaauguacgacgccaagagauucaccgacgccggcuucgaccaccacgaccuguucuucgccgacggcagcacccccaccgacgccaucgugaaggaguuccuggacaucugcgagaacgccgagggcgccaucgccgugcacugcaaggccggccugggcagaaccggcacccugaucgccugcuacaucaugaagcacuacagaaugaccgccgccgagaccaucgccugggugagaaucugcagacccggcagcgugaucggcccccagcagcaguuccuggugaugaagcagaccaaccuguggcuggagggcgacuacuucagacagaagcugaagggccaggagaacggccagcacagagccgccuucagcaagcugcugagcggcguggacgacaucagcaucaacggcguggagaaccaggaccagcaggagcccgagcccuacagcgacgacgacgagaucaacggcgugacccagggcgacagacugagagcccugaagagcagaagacagagcaagaccaacgccaucccccugaccgugauccugcagagcagcgugcagagcugcaagaccagcgagcccaacaucagcggcagcgccggcaucaccaagagaaccaccagaagcgccagcagaaagagcagcgugaagagccugagcaucagcagaaccaagaccgugcugagauaa

SEQ ID NO: 14927 - RNA, 1863 nt, Artificial Sequence
  CDC16__Homo_sapiens__NP_003894
augaaccuggagagacugagaaagagagugagacaguaccuggaccagcagcaguaccagagcgcccuguucugggccgacaagguggccagccugagcagagaggagccccaggacaucuacuggcuggcccagugccuguaccugaccgcccaguaccacagagccgcccacgcccugagaagcagaaagcuggacaagcuguacgaggccugcagauaccuggccgccagaugccacuacgccgccaaggagcaccagcaggcccuggacgugcuggacauggaggagcccaucaacaagagacuguucgagaaguaccugaaggacgagagcggcuucaaggaccccagcagcgacugggagaugagccagagcagcaucaagagcagcaucugccugcugagaggcaagaucuacgacgcccuggacaacagaacccuggccaccuacagcuacaaggaggcccugaagcuggacguguacugcuucgaggccuucgaccugcugaccagccaccacaugcugaccgcccaggaggagaaggagcugcuggagagccugccccugagcaagcugugcaacgaggagcaggagcugcugagauuccuguucgagaacaagcugaagaaguacaacaagcccagcgagaccgugauccccgagagcguggacggccugcaggagaaccuggacgugguggugagccuggccgagagacacuacuacaacugcgacuucaagaugugcuacaagcugaccagcguggugauggagaaggaccccuuccacgccagcugccugcccgugcacaucggcacccugguggagcugaacaaggccaacgagcuguucuaccugagccacaagcugguggaccuguaccccagcaaccccgugagcugguucgccgugggcugcuacuaccugauggugggccacaagaacgagcacgccagaagauaccugagcaaggccaccacccuggagaagaccuacggccccgccuggaucgccuacggccacagcuucgccguggagagcgagcacgaccaggccauggccgccuacuucaccgccgcccagcugaugaagggcugccaccugcccaugcuguacaucggccuggaguacggccugaccaacaacagcaagcuggccgagagauucuucagccaggcccugagcaucgcccccgaggaccccuucgugaugcacgaggugggcgugguggccuuccagaacggcgaguggaagaccgccgagaagugguuccuggacgcccuggagaagaucaaggccaucggcaacgaggugaccguggacaagugggagccccugcugaacaaccugggccacgugugcagaaagcugaagaaguacgccgaggcccuggacuaccacagacaggcccuggugcugaucccccagaacgccagcaccuacagcgccaucggcuacauccacagccugaugggcaacuucgagaacgccguggacuacuuccacaccgcccugggccugagaagagacgacaccuucagcgugaccaugcugggccacugcaucgagauguacaucggcgacagcgaggccuacaucggcgccgacaucaaggacaagcugaagugcuacgacuucgacgugcacaccaugaagacccugaagaacaucaucagcccccccugggacuucagagaguucgagguggagaagcagaccgccgaggagaccggccugaccccccuggagaccagcagaaagacccccgacagcagacccagccuggaggagaccuucgagaucgagaugaacgagagcgacaugaugcuggagaccagcaugagcgaccacagcaccuaa

SEQ ID NO: 14928 - RNA, 1434 nt, Artificial Sequence
  CDC20B__Homo_sapiens__NP_001139206
auggaguggaagcuggagagaaccgcccccagaagagugagaaccgaggaggagaugcugugggagagcaucaugagagugcugagcaaggaccugaagcagaagagaagccaggacagcgccaacgugcuggacagcgugaacgccaccuacagcgacuucaagagcaacuucgccaagagacugagcgccgaggugcccguggccagcagccccaucaccaccagauggcagcagagccagaccagagcccugagcagcgacagcuucggcgaggagcagagcaccaccuaccugcccgaggccagcggcagcgugcugaagaccccccccgagaaggagacccugacccugggcagcagaaaggagcagcugaagacccccagcaagggcaucagcgagaccagcaacagcgcccugcacuucugcaaggccccccacgccauggacagagacuggaaggagagcguggccagcaagggccagaagugccugaagcagcuguucgugacccagaacguggugcagcaggccaacggcaagaugcagcugugcgagcagagcgagugcguguggaagggcugcaaggacggcgugagagacgagagcuuccaccugaagagcagcggcgacaucaacgacagcauccugcagcccgaggugaagauccacaucaccggccugagaaacgacuacuaccugaacauccuggacuggagcuuccagaaccugguggccaucgcccugggcagcgccguguacaucuggaacggcgagaaccacaacggcaucgagaacaucgaccugagccugaccugcaacuacaucagcagcgugagcuggaucaaggagggcaccugccuggccgugggcaccagcgagggcgaggugcagcugugggacguggugaccaagaagagacugagaaacaugcugggccaccugagcguggugggcgcccugagcuggaaccacuucauccugagcagcggcagcagacugggcagaguguaccaccacgacgugagaguggcccagcaccacgugggcacccugagacacaagcaggccgugugcgcccugaaguggagccccgacggcagacugcugagcagcggcugcagcgacggccugcugaccaucuggccccacgaccccggcgccagcgcccagggccagccccugaaggugaucacccagagcaccgccgugaagaucugcagccugaucuggcugcccaagaccaaggagaucgccaccggccagggcacccccaagaacgacgugaccguguggaccugccccaccgugagcagaagcggcggcuucuucggccacagaggcagagugcugcaccugagccugagccccgaccagaccagaguguucagcgccgccgccgacggcaccgccagcguguggaacugcuacuaa

SEQ ID NO: 14929 - RNA, 1794 nt, Artificial Sequence
  CDC23__Homo_sapiens__NP_004652
auggccgccagcaccagcauggugcccguggccgugaccgccgccguggcccccgugcugagcaucaacagcgacuucagcgaccugagagagaucaagaagcagcugcugcugaucgccggccugaccagagagagaggccugcugcacagcagcaaguggagcgccgagcuggccuucagccugcccgcccugccccuggccgagcugcagccccccccccccaucaccgaggaggacgcccaggacauggacgccuacacccuggccaaggccuacuucgacgugaaggaguacgacagagccgcccacuuccugcacggcugcaacagcaagaaggccuacuuccuguacauguacagcagauaccugagcggcgagaagaagaaggacgacgagaccguggacagccugggcccccuggagaagggccaggugaagaacgaggcccugagagagcugagaguggagcugagcaagaagcaccaggccagagagcuggacggcuucggccuguaccuguacggcguggugcugagaaagcuggaccuggugaaggaggccaucgacguguucguggaggccacccacgugcugccccugcacuggggcgccuggcuggagcugugcaaccugaucaccgacaaggagaugcugaaguuccugagccugcccgacaccuggaugaaggaguucuuccuggcccacaucuacaccgagcugcagcugaucgaggaggcccugcagaaguaccagaaccugaucgacgugggcuucagcaagagcagcuacaucgugagccagaucgccguggccuaccacaacaucagagacaucgacaaggcccugagcaucuucaacgagcugagaaagcaggaccccuacagaaucgagaacauggacaccuucagcaaccugcuguacgugagaagcaugaagagcgagcugagcuaccuggcccacaaccugugcgagaucgacaaguacagaguggagaccugcugcgugaucggcaacuacuacagccugagaagccagcacgagaaggccgcccuguacuuccagagagcccugaagcugaaccccagauaccugggcgccuggacccugaugggccacgaguacauggagaugaagaacaccagcgccgccauccaggccuacagacacgccaucgaggugaacaagagagacuacagagccugguacggccugggccagaccuacgagauccugaagaugcccuucuacugccuguacuacuacagaagagcccaccagcugagacccaacgacagcagaaugcugguggcccugggcgagugcuacgagaagcugaaccagcugguggaggccaagaagugcuacuggagagccuacgccgugggcgacguggagaagauggcccuggugaagcuggccaagcugcacgagcagcugaccgagagcgagcaggccgcccagugcuacaucaaguacauccaggacaucuacagcugcggcgagaucguggagcaccuggaggagagcaccgccuucagauaccuggcccaguacuacuucaagugcaagcugugggacgaggccagcaccugcgcccagaagugcugcgccuucaacgacaccagagaggagggcaaggcccugcugagacagauccugcagcugagaaaccagggcgagacccccaccaccgaggugcccgcccccuucuuccugcccgccagccugagcgccaacaacacccccaccagaagagugagcccccugaaccugagcagcgugacccccuaa

SEQ ID NO: 14930 - RNA, 1575 nt, Artificial Sequence
  CDC25A__Homo_sapiens__NP_001780
auggagcugggccccgagcccccccacagaagaagacugcuguucgccugcagccccccccccgccagccagcccguggugaaggcccuguucggcgccagcgccgccggcggccugagccccgugaccaaccugaccgugaccauggaccagcugcagggccugggcagcgacuacgagcagccccuggaggugaagaacaacagcaaccugcagagaaugggcagcagcgagagcaccgacagcggcuucugccuggacagccccggcccccuggacagcaaggagaaccuggagaaccccaugagaagaauccacagccugccccagaagcugcugggcugcagccccgcccugaagagaagccacagcgacagccuggaccacgacaucuuccagcugaucgaccccgacgagaacaaggagaacgaggccuucgaguucaagaagcccgugagacccgugagcagaggcugccugcacagccacggccugcaggagggcaaggaccuguucacccagagacagaacagcgcccccgccagaaugcugagcagcaacgagagagacagcagcgagcccggcaacuucaucccccuguucaccccccagagccccgugaccgccacccugagcgacgaggacgacggcuucguggaccugcuggacggcgagaaccugaagaacgaggaggagacccccagcugcauggccagccuguggaccgccccccuggugaugagaaccaccaaccuggacaacagaugcaagcuguucgacagccccagccugugcagcagcagcaccagaagcgugcugaagagacccgagagaagccaggaggagagcccccccggcagcaccaagagaagaaagagcaugagcggcgccagccccaaggagagcaccaaccccgagaaggcccacgagacccugcaccagagccugagccuggccagcagccccaagggcaccaucgagaacauccuggacaacgaccccagagaccugaucggcgacuucagcaagggcuaccuguuccacaccguggccggcaagcaccaggaccugaaguacaucagccccgagaucauggccagcgugcugaacggcaaguucgccaaccugaucaaggaguucgugaucaucgacugcagauaccccuacgaguacgagggcggccacaucaagggcgccgugaaccugcacauggaggaggagguggaggacuuccugcugaagaagcccaucgugcccaccgacggcaagagagugaucgugguguuccacugcgaguucagcagcgagagaggccccagaaugugcagauacgugagagagagagacagacugggcaacgaguaccccaagcugcacuaccccgagcuguacgugcugaagggcggcuacaaggaguucuucaugaagugccagagcuacugcgagccccccagcuacagacccaugcaccacgaggacuucaaggaggaccugaagaaguucagaaccaagagcagaaccugggccggcgagaagagcaagagagagauguacagcagacugaagaagcuguaa

SEQ ID NO: 14931 - RNA, 1551 nt, Artificial Sequence
  CDC25B__Homo_sapiens__NP_001274445
augcacagcgagacccccaagagccaggugggcacccugcuguucagaagcagaagcagacugacccaccugagccugagcagaagagccagcgagagcagccugagcagcgagagcagcgagagcagcgacgccggccugugcauggacagccccagccccauggacccccacauggccgagcagaccuucgagcaggccauccaggccgccagcagaaucaucagaaacgagcaguucgccaucagaagauuccagagcaugcccgugagacugcugggccacagccccgugcugagaaacaucaccaacagccaggcccccgacggcagaagaaagagcgaggccggcagcggcgccgccagcagcagcggcgaggacaaggagaacgacggcuucguguucaagaugcccuggaagcccacccaccccagcagcacccacgcccuggccgagugggccagcagaagagaggccuucgcccagagacccagcagcgcccccgaccugaugugccugagccccgacagaaagauggagguggaggagcugagcccccuggcccugggcagauucagccugacccccgccgagggcgacaccgaggaggacgacggcuucguggacauccuggagagcgaccugaaggacgacgacgccgugccccccggcauggagagccugaucagcgccccccuggugaagacccuggagaaggaggaggagaaggaccuggugauguacagcaagugccagagacuguucagaagccccagcaugcccugcagcgugaucagacccauccugaagagacuggagagaccccaggacagagacacccccgugcagaacaagagaagaagaagcgugaccccccccgaggagcagcaggaggccgaggagcccaaggccagagugcugagaagcaagagccugugccacgacgagaucgagaaccugcuggacagcgaccacagagagcugaucggcgacuacagcaaggccuuccugcugcagaccguggacggcaagcaccaggaccugaaguacaucagccccgagaccaugguggcccugcugaccggcaaguucagcaacaucguggacaaguucgugaucguggacugcagauaccccuacgaguacgagggcggccacaucaagaccgccgugaaccugccccuggagagagacgccgagagcuuccugcugaagagccccaucgcccccugcagccuggacaagagagugauccugaucuuccacugcgaguucagcagcgagagaggccccagaaugugcagauucaucagagagagagacagagccgugaacgacuaccccagccuguacuaccccgagauguacauccugaagggcggcuacaaggaguucuucccccagcaccccaacuucugcgagccccaggacuacagacccaugaaccacgaggccuucaaggacgagcugaagaccuucagacugaagaccagaagcugggccggcgagagaagcagaagagagcugugcagcagacugcaggaccaguaa

SEQ ID NO: 14932 - RNA, 1422 nt, Artificial Sequence
  CDC25C__Homo_sapiens__NP_001274511
augagcaccgagcuguucagcagcaccagagaggagggcagcagcggcagcggccccagcuucagaagcaaccagagaaagaugcugaaccugcugcuggagagagacaccagcuucaccgugugccccgacgugcccagaacccccgugggcaaguuccugggcgacagcgccaaccugagcauccugagcggcggcacccccaagagaugccuggaccugagcaaccugagcagcggcgagaucaccgccacccagcugaccaccagcgccgaccuggacgagaccggccaccuggacagcagcggccugcaggaggugcaccuggccggcaugaaccacgaccagcaccugaugaagugcagccccgcccagcugcugugcagcacccccaacggccuggacagaggccacagaaagagagacgccaugugcagcagcagcgccaacaaggagaacgacaacggcaaccugguggacagcgagaugaaguaccugggcagccccaucaccaccgugcccaagcuggacaagaaccccaaccugggcgaggaccaggccgaggagaucagcgacgagcugauggaguucagccugaaggaccaggaggccaaggugagcagaagcggccuguacagaagccccagcaugcccgagaaccugaacagacccagacugaagcagguggagaaguucaaggacaacaccauccccgacaaggugaagaagaaguacuucagcggccagggcaagcugagaaagggccugugccugaagaagaccgugagccugugcgacaucaccaucacccagaugcuggaggaggacagcaaccagggccaccugaucggcgacuucagcaaggugugcgcccugcccaccgugagcggcaagcaccaggaccugaaguacgugaaccccgagaccguggccgcccugcugagcggcaaguuccagggccugaucgagaaguucuacgugaucgacugcagauaccccuacgaguaccugggcggccacauccagggcgcccugaaccuguacagccaggaggagcuguucaacuucuuccugaagaagcccaucgugccccuggacacccagaagagaaucaucaucguguuccacugcgaguucagcagcgagagaggccccagaaugugcagaugccugagagaggaggacagaagccugaaccaguaccccgcccuguacuaccccgagcuguacauccugaagggcggcuacagagacuucuuccccgaguacauggagcugugcgagccccagagcuacugccccaugcaccaccaggaccacaagaccgagcugcugagaugcagaagccagagcaaggugcaggagggcgagagacagcugagagagcagaucgcccugcuggugaaggacaugagccccuaa

SEQ ID NO: 14933 - RNA, 2493 nt, Artificial Sequence
  CDC27__Homo_sapiens__NP_001107563
augaccgugcugcaggagcccgugcaggccgccaucuggcaggcccugaaccacuacgccuacagagacgccguguuccuggccgagagacuguacgccgaggugcacagcgaggaggcccuguuccugcuggccaccugcuacuacagaagcggcaaggccuacaaggccuacagacugcugaagggccacagcugcaccaccccccagugcaaguaccugcuggccaagugcugcguggaccugagcaagcuggccgagggcgagcagauccugagcggcggcguguucaacaagcagaagagccacgacgacaucgugaccgaguucggcgacagcgccugcuucacccugagccugcugggccacguguacugcaagaccgacagacuggccaagggcagcgagugcuaccagaagagccugagccugaaccccuuccuguggagccccuucgagagccugugcgagaucggcgagaagcccgaccccgaccagaccuucaaguucaccagccugcagaacuucagcaacugccugcccaacagcugcaccacccaggugcccaaccacagccugagccacagacagcccgagaccgugcugaccgagaccccccaggacaccaucgagcugaacagacugaaccuggagagcagcaacagcaaguacagccugaacaccgacagcagcgugagcuacaucgacagcgccgugaucagccccgacaccgugccccugggcaccggcaccagcauccugagcaagcaggugcagaacaagcccaagaccggcagaagccugcugggcggccccgccgcccugagcccccugacccccagcuucggcauccugccccuggagacccccagccccggcgacggcagcuaccugcagaacuacaccaacaccccccccgugaucgacgugcccagcaccggcgcccccagcaagaagaccuucagagugcugcagagcguggccagaaucggccagaccggcaccaagagcguguucagccagagcggcaacagcagagaggugacccccauccuggcccagacccagagcagcggcccccagaccagcaccaccccccaggugcugagccccaccaucaccagcccccccaacgcccugcccagaagaagcagcagacuguucaccagcgacagcagcaccaccaaggagaacagcaagaagcugaagaugaaguucccccccaagauccccaacagaaagaccaagagcaagaccaacaagggcggcaucacccagcccaacaucaacgacagccuggagaucaccaagcuggacagcagcaucaucagcgagggcaagaucagcaccaucaccccccagauccaggccuucaaccugcagaaggccgccgccgagggccugaugagccugcugagagagaugggcaagggcuaccuggcccugugcagcuacaacugcaaggaggccaucaacauccugagccaccugcccagccaccacuacaacaccggcugggugcugugccagaucggcagagccuacuucgagcugagcgaguacaugcaggccgagagaaucuucagcgaggugagaagaaucgagaacuacagaguggagggcauggagaucuacagcaccacccuguggcaccugcagaaggacguggcccugagcgugcugagcaaggaccugaccgacauggacaagaacagccccgaggccuggugcgccgccggcaacugcuucagccugcagagagagcacgacaucgccaucaaguucuuccagagagccauccagguggaccccaacuacgccuacgccuacacccugcugggccacgaguucgugcugaccgaggagcuggacaaggcccuggccugcuucagaaacgccaucagagugaaccccagacacuacaacgccugguacggccugggcaugaucuacuacaagcaggagaaguucagccuggccgagaugcacuuccagaaggcccuggacaucaacccccagagcagcgugcugcugugccacaucggcguggugcagcacgcccugaagaagagcgagaaggcccuggacacccugaacaaggccaucgugaucgaccccaagaacccccugugcaaguuccacagagccagcgugcuguucgccaacgagaaguacaagagcgcccugcaggagcuggaggagcugaagcagaucgugcccaaggagagccugguguacuuccugaucggcaagguguacaagaagcugggccagacccaccuggcccugaugaacuucagcugggccauggaccuggaccccaagggcgccaacaaccagaucaaggaggccaucgacaagagauaccugcccgacgacgaggagcccaucacccaggaggagcagaucaugggcaccgacgagagccaggagagcagcaugaccgacgccgacgacacccagcugcacgccgccgagagcgacgaguucuaa

SEQ ID NO: 14934 - RNA, 711 nt, Artificial Sequence
  CDC34__Homo_sapiens__NP_004350
auggccagaccccuggugcccagcagccagaaggcccugcugcuggagcugaagggccugcaggaggagcccguggagggcuucagagugacccugguggacgagggcgaccuguacaacugggagguggccaucuucggcccccccaacaccuacuacgagggcggcuacuucaaggccagacugaaguuccccaucgacuaccccuacagcccccccgccuucagauuccugaccaagauguggcaccccaacaucuacgagaccggcgacgugugcaucagcauccugcacccccccguggacgacccccagagcggcgagcugcccagcgagagauggaaccccacccagaacgugagaaccauccugcugagcgugaucagccugcugaacgagcccaacaccuucagccccgccaacguggacgccagcgugauguacagaaaguggaaggagagcaagggcaaggacagagaguacaccgacaucaucagaaagcaggugcugggcaccaagguggacgccgagagagacggcgugaaggugcccaccacccuggccgaguacugcgugaagaccaaggcccccgcccccgacgagggcagcgaccuguucuacgacgacuacuacgaggacggcgagguggaggaggaggccgacagcugcuucggcgacgacgaggacgacagcggcaccgaggagagcuaa

SEQ ID NO: 14935 - RNA, 1137 nt, Artificial Sequence
  CDC37__Homo_sapiens__NP_008996
augguggacuacagcgugugggaccacaucgaggugagcgacgacgaggacgagacccaccccaacaucgacaccgccagccuguucagauggagacaccaggccagaguggagagaauggagcaguuccagaaggagaaggaggagcuggacagaggcugcagagagugcaagagaaagguggccgagugccagagaaagcugaaggagcuggagguggccgagggcggcaaggccgagcuggagagacugcaggccgaggcccagcagcugagaaaggaggagagaagcugggagcagaagcuggaggagaugagaaagaaggagaagagcaugcccuggaacguggacacccugagcaaggacggcuucagcaagagcauggugaacaccaagcccgagaagaccgaggaggacagcgaggaggugagagagcagaagcacaagaccuucguggagaaguacgagaagcagaucaagcacuucggcaugcugagaagaugggacgacagccagaaguaccugagcgacaacgugcaccuggugugcgaggagaccgccaacuaccuggugaucuggugcaucgaccuggagguggaggagaagugcgcccugauggagcagguggcccaccagaccaucgugaugcaguucauccuggagcuggccaagagccugaagguggaccccagagccugcuucagacaguucuucaccaagaucaagaccgccgacagacaguacauggagggcuucaacgacgagcuggaggccuucaaggagagagugagaggcagagccaagcugagaaucgagaaggccaugaaggaguacgaggaggaggagagaaagaagagacugggccccggcggccuggaccccguggagguguacgagagccugcccgaggagcugcagaagugcuucgacgugaaggacgugcagaugcugcaggacgccaucagcaagauggaccccaccgacgccaaguaccacaugcagagaugcaucgacagcggccugugggugcccaacagcaaggccagcgaggccaaggagggcgaggaggccggccccggcgacccccugcuggaggccgugcccaagaccggcgacgagaaggacgugagcguguaa

SEQ ID NO: 14936 - RNA, 1014 nt, Artificial Sequence
  CDC37L1__Homo_sapiens__NP_060383
auggagcagcccuggcccccccccggccccuggagccugcccagagccgagggcgaggccgaggaggagagcgacuucgacguguuccccagcagccccagaugcccccagcugcccggcggcggcgcccagauguacagccacggcaucgagcuggccugccagaagcagaaggaguucgugaagagcagcguggccugcaaguggaaccuggccgaggcccagcagaagcugggcagccuggcccugcacaacagcgagagccuggaccaggagcacgccaaggcccagaccgccgugagcgagcugagacagagagaggaggaguggagacagaaggaggaggcccuggugcagagagagaagaugugccuguggagcaccgacgccaucagcaaggacguguucaacaagagcuucaucaaccaggacaagagaaaggacaccgaggacgaggacaagagcgagagcuucaugcagaaguacgagcagaagaucagacacuucggcaugcugagcagaugggacgacagccagagauuccugagcgaccaccccuaccuggugugcgaggagaccgccaaguaccugauccuguggugcuuccaccuggaggccgagaagaagggcgcccugauggagcagaucgcccaccaggccguggugaugcaguucaucauggagauggccaagaacugcaacguggaccccagaggcugcuucagacuguucuuccagaaggccaaggccgaggaggagggcuacuucgaggccuucaagaacgagcuggaggccuucaagagcagagugagacuguacagccagagccagagcuuccagcccaugaccgugcagaaccacgugccccacagcggcgugggcagcaucggccugcuggagagccugccccagaaccccgacuaccugcaguacagcaucagcaccgcccugugcagccugaacagcguggugcacaaggaggacgacgagcccaagaugauggacaccguguaa

SEQ ID NO: 14937 - RNA, 5160 nt, Artificial Sequence
  CDC42BPA__Homo_sapiens__NP_003598
augagcggcgaggugagacugagacagcuggagcaguucauccuggacggccccgcccagaccaacggccagugcuucagcguggagacccugcuggacauccugaucugccuguacgacgagugcaacaacagcccccugagaagagagaagaacauccuggaguaccuggagugggccaagcccuucaccagcaaggugaagcagaugagacugcacagagaggacuucgagauccugaaggugaucggcagaggcgccuucggcgagguggccguggugaagcugaagaacgccgacaagguguucgccaugaagauccugaacaagugggagaugcugaagagagccgagaccgccugcuucagagaggagagagacgugcuggugaacggcgacaacaaguggaucaccacccugcacuacgccuuccaggacgacaacaaccuguaccuggugauggacuacuacgugggcggcgaccugcugacccugcugagcaaguucgaggacagacugcccgaggacauggccagauucuaccuggccgagauggugaucgccaucgacagcgugcaccagcugcacuacgugcacagagacaucaagcccgacaacauccugauggacaugaacggccacaucagacuggccgacuucggcagcugccugaagcugauggaggacggcaccgugcagagcagcguggccgugggcacccccgacuacaucagccccgagauccugcaggccauggaggacggcaagggcagauacggccccgagugcgacugguggagccugggcgugugcauguacgagaugcuguacggcgagacccccuucuacgccgagagccugguggagaccuacggcaagaucaugaaccacaaggagagauuccaguuccccgcccaggugaccgacgugagcgagaacgccaaggaccugaucagaagacugaucugcagcagagagcacagacugggccagaacggcaucgaggacuucaagaagcaccccuucuucagcggcaucgacugggacaacaucagaaacugcgaggcccccuacauccccgaggugagcagccccaccgacaccagcaacuucgacguggacgacgacugccugaagaacagcgagaccaugcccccccccacccacaccgccuucagcggccaccaccugcccuucgugggcuucaccuacaccagcagcugcgugcugagcgacagaagcugccugagagugaccgccggccccaccagccuggaccuggacgugaacgugcagagaacccuggacaacaaccuggccaccgaggccuacgagagaagaaucaagagacuggagcaggagaagcuggagcugagcagaaagcugcaggagagcacccagaccgugcaggcccugcaguacagcaccguggacggcccccugaccgccagcaaggaccuggagaucaagaaccugaaggaggagaucgagaagcugagaaagcaggugaccgagagcagccaccuggagcagcagcuggaggaggccaacgccgugagacaggagcuggacgacgccuucagacagaucaaggccuacgagaagcagaucaagacccugcagcaggagagagaggaccugaacaaggagcuggugcaggccagcgagagacugaagaaccagagcaaggagcugaaggacgcccacugccagagaaagcuggccaugcaggaguucauggagaucaacgagagacugaccgagcugcacacccagaagcagaagcuggccagacacgugagagacaaggaggaggagguggaccuggugaugcagaagguggagagccugagacaggagcugagaagaaccgagagagccaagaaggagcuggaggugcacaccgaggcccuggccgccgaggccagcaaggacagaaagcugagagagcagagcgagcacuacagcaagcagcuggagaacgagcuggagggccugaagcagaagcagaucagcuacagccccggcgugugcagcaucgagcaccagcaggagaucaccaagcugaagaccgaccuggagaagaagagcaucuucuacgaggaggagcugagcaagagagagggcauccacgccaacgagaucaagaaccugaagaaggagcugcacgacagcgagggccagcagcuggcccugaacaaggagaucaugauccugaaggacaagcuggagaagaccagaagagagagccagagcgagagagaggaguucgagagcgaguucaagcagcaguacgagagagagaaggugcugcugaccgaggagaacaagaagcugaccagcgagcuggacaagcugaccacccuguacgagaaccugagcauccacaaccagcagcuggaggaggaggugaaggaccuggccgacaagaaggagagcguggcccacugggaggcccagaucaccgagaucauccagugggugagcgacgagaaggacgccagaggcuaccugcaggcccuggccagcaagaugaccgaggagcuggaggcccugagaaacagcagccugggcaccagagccaccgacaugcccuggaagaugagaagauucgccaagcuggacaugagcgccagacuggagcugcagagcgcccuggacgccgagaucagagccaagcaggccauccaggaggagcugaacaaggugaaggccagcaacaucaucaccgagugcaagcugaaggacagcgagaagaagaaccuggagcugcugagcgagaucgagcagcugaucaaggacaccgaggagcugagaagcgagaagggcaucgagcaccaggacagccagcacagcuuccuggccuuccugaacacccccaccgacgcccuggaccaguucgagaccguggacagcaccccccugagcgugcacacccccacccugagaaagaagggcugccccggcagcaccggcuucccccccaagagaaagacccaccaguucuucgugaagagcuucaccacccccaccaagugccaccagugcaccagccugauggugggccugaucagacagggcugcagcugcgaggugugcggcuucagcugccacaucaccugcgugaacaaggcccccaccaccugccccgugccccccgagcagaccaagggcccccugggcaucgacccccagaagggcaucggcaccgccuacgagggccacgugagaauccccaagcccgccggcgugaagaagggcuggcagagagcccuggccaucgugugcgacuucaagcuguuccuguacgacaucgccgagggcaaggccagccagcccagcguggugaucagccaggugaucgacaugagagacgaggaguucagcgugagcagcgugcuggccagcgacgugauccacgccagcagaaaggacauccccugcaucuucagagugaccgccagccagcugagcgccagcaacaacaagugcagcauccugaugcuggccgacaccgagaacgagaagaacaagugggugggcgugcugagcgagcugcacaagauccugaagaagaacaaguucagagacagaagcguguacgugcccaaggaggccuacgacagcacccugccccugaucaagaccacccaggccgccgccaucaucgaccacgagagaaucgcccugggcaacgaggagggccuguucguggugcacgugaccaaggacgagaucaucagagugggcgacaacaagaagauccaccagaucgagcugauccccaacgaccagcugguggccgugaucagcggcagaaacagacacgugagacuguuccccaugagcgcccuggacggcagagagaccgacuucuacaagcugagcgagaccaagggcugccagaccgugaccagcggcaaggugagacacggcgcccugaccugccugugcguggccaugaagagacaggugcugugcuacgagcuguuccagagcaagaccagacacagaaaguucaaggagauccaggugcccuacaacgugcaguggauggccaucuucagcgagcagcugugcgugggcuuccagagcggcuuccugagauacccccugaacggcgagggcaaccccuacagcaugcugcacagcaacgaccacacccugagcuucaucgcccaccagcccauggacgccaucugcgccguggagaucagcagcaaggaguaccugcugugcuucaacagcaucggcaucuacaccgacugccagggcagaagaagcagacagcaggagcugauguggcccgccaaccccagcagcugcugcuacaacgcccccuaccugagcguguacagcgagaacgccguggacaucuucgacgugaacagcauggaguggauccagacccugccccugaagaaggugagaccccugaacaacgagggcagccugaaccugcugggccuggagaccaucagacugaucuacuucaagaacaagauggccgagggcgacgagcugguggugcccgagaccagcgacaacagcagaaagcagauggugagaaacaucaacaacaagagaagauacagcuucagagugcccgaggaggagagaaugcagcagagaagagagaugcugagagaccccgagaugagaaacaagcugaucagcaaccccaccaacuucaaccacaucgcccacaugggccccggcgacggcauccagauccugaaggaccugcccaugaaccccagaccccaggagagcagaaccguguucagcggcagcgugagcauccccagcaucaccaagagcagacccgagcccggcagaagcaugagcgccagcagcggccugagcgccagaagcagcgcccagaacggcagcgcccugaagagagaguucagcggcggcagcuacagcgccaagagacagcccaugcccagccccagcgagggcagccugagcagcggcggcauggaccagggcagcgacgcccccgccagagacuucgacggcgaggacagcgacagccccagacacagcaccgccagcaacagcagcaaccugagcagcccccccagccccgccagccccagaaagaccaagagccugagccuggagagcaccgacagaggcagcugggaccccuaa

SEQ ID NO: 14938 - RNA, 5136 nt, Artificial Sequence
  CDC42BPB__Homo_sapiens__NP_006026
augagcgccaaggugagacugaagaagcuggagcagcugcugcuggacggccccuggagaaacgagagcgcccugagcguggagacccugcuggacgugcuggugugccuguacaccgagugcagccacagcgcccugagaagagacaaguacguggccgaguuccuggagugggccaagcccuucacccagcuggugaaggagaugcagcugcacagagaggacuucgagaucaucaaggugaucggcagaggcgccuucggcgagguggccguggugaagaugaagaacaccgagagaaucuacgccaugaagauccugaacaagugggagaugcugaagagagccgagaccgccugcuucagagaggagagagacgugcuggugaacggcgacugccaguggaucaccgcccugcacuacgccuuccaggacgagaaccaccuguaccuggugauggacuacuacgugggcggcgaccugcugacccugcugagcaaguucgaggacaagcugcccgaggacauggccagauucuacaucggcgagauggugcuggccaucgacagcauccaccagcugcacuacgugcacagagacaucaagcccgacaacgugcugcuggacgugaacggccacaucagacuggccgacuucggcagcugccugaagaugaacgacgacggcaccgugcagagcagcguggccgugggcacccccgacuacaucagccccgagauccugcaggccauggaggacggcaugggcaaguacggccccgagugcgacugguggagccugggcgugugcauguacgagaugcuguacggcgagacccccuucuacgccgagagccugguggagaccuacggcaagaucaugaaccacgaggagagauuccaguuccccagccacgugaccgacgugagcgaggaggccaaggaccugauccagagacugaucugcagcagagagagaagacugggccagaacggcaucgaggacuucaagaagcacgccuucuucgagggccugaacugggagaacaucagaaaccuggaggcccccuacauccccgacgugagcagccccagcgacaccagcaacuucgacguggacgacgacgugcugagaaacaccgagauccugccccccggcagccacaccggcuucagcggccugcaccugcccuucaucggcuucaccuucaccaccgagagcugcuucagcgacagaggcagccugaagagcaucaugcagagcaacacccugaccaaggacgaggacgugcagagagaccuggagcacagccugcagauggaggccuacgagagaagaaucagaagacuggagcaggagaagcuggagcugagcagaaagcugcaggagagcacccagaccgugcagagccugcacggcagcagcagagcccugagcaacagcaacagagacaaggagaucaagaagcugaacgaggagaucgagagacugaagaacaagaucgccgacagcaacagacuggagagacagcuggaggacaccguggcccugagacaggagagagaggacagcacccagagacugagaggccuggagaagcagcacagaguggugagacaggagaaggaggagcugcacaagcagcugguggaggccagcgagagacugaagagccaggccaaggagcugaaggacgcccaccagcagagaaagcuggcccugcaggaguucagcgagcugaacgagagaauggccgagcugagagcccagaagcagaaggugagcagacagcugagagacaaggaggaggagauggagguggccacccagaagguggacgccaugagacaggagaugagaagagccgagaagcugagaaaggagcuggaggcccagcuggacgacgccguggccgaggccagcaaggagagaaagcugagagagcacagcgagaacuucugcaagcagauggagagcgagcuggaggcccugaaggugaagcagggcggcagaggcgccggcgccacccuggagcaccagcaggagaucagcaagaucaagagcgagcuggagaagaaggugcuguucuacgaggaggagcuggugagaagagaggccagccacgugcuggaggugaagaacgugaagaaggaggugcacgacagcgagagccaccagcuggcccugcagaaggagauccugaugcugaaggacaagcuggagaagagcaagagagagagacacaacgagauggaggaggccgugggcaccaucaaggacaaguacgagagagagagagccaugcuguucgacgagaacaagaagcugaccgccgagaacgagaagcugugcagcuucguggacaagcugaccgcccagaacagacagcuggaggacgagcugcaggaccuggccgccaagaaggagagcguggcccacugggaggcccagaucgccgagaucauccagugggugagcgacgagaaggacgccagaggcuaccugcaggcccuggccagcaagaugaccgaggagcuggaggcccugagaagcagcagccugggcagcagaacccuggacccccuguggaaggugagaagaagccagaagcuggacaugagcgccagacuggagcugcagagcgcccuggaggccgagaucagagccaagcagcuggugcaggaggagcugagaaaggugaaggacgccaaccugacccuggagagcaagcugaaggacagcgaggccaagaacagagagcugcuggaggagauggagauccugaagaagaagauggaggagaaguucagagccgacaccggccugaagcugcccgacuuccaggacagcaucuucgaguacuucaacaccgccccccuggcccacgaccugaccuucagaaccagcagcgccagcgagcaggagacccaggcccccaagcccgaggccagccccagcaugagcguggccgccagcgagcagcaggaggacauggccagacccccccagagacccagcgccgugccccugcccaccacccaggcccuggcccuggccggccccaagcccaaggcccaccaguucagcaucaagagcuucagcagccccacccagugcagccacugcaccagccugauggugggccugaucagacagggcuacgccugcgaggugugcagcuucgccugccacgugagcugcaaggacggcgccccccaggugugccccaucccccccgagcagagcaagagaccccugggcguggacgugcagagaggcaucggcaccgccuacaagggccacgugaaggugcccaagcccaccggcgugaagaagggcuggcagagagccuacgccguggugugcgacugcaagcuguuccuguacgaccugcccgagggcaagagcacccagcccggcgugaucgccagccaggugcuggaccugagagacgacgaguucagcgugagcagcgugcuggccagcgacgugauccacgccaccagaagagacauccccugcaucuucagagugaccgccagccugcugggcgcccccagcaagaccagcagccugcugauccugaccgagaacgagaacgagaagagaaagugggugggcauccuggagggccugcagagcauccugcacaagaacagacugagaaaccagguggugcacgugccccuggaggccuacgacagcagccugccccugaucaaggccauccugaccgccgccaucguggacgccgacagaaucgccgugggccuggaggagggccuguacgugaucgaggugaccagagacgugaucgugagagccgccgacugcaagaaggugcaccagaucgagcuggcccccagagagaagaucgugauccugcugugcggcagaaaccaccacgugcaccuguaccccuggagcagccuggacggcgccgagggcagcuucgacaucaagcugcccgagaccaagggcugccagcugauggccaccgccacccugaagagaaacagcggcaccugccuguucguggccgugaagagacugauccugugcuacgagauccagagaaccaagcccuuccacagaaaguucaacgagaucguggcccccggcagcgugcagugccuggccgugcugagagacagacugugcgugggcuaccccagcggcuucugccugcugagcauccagggcgacggccagccccugaaccuggugaaccccaacgaccccagccuggccuuccugagccagcagagcuucgacgcccugugcgccguggagcuggagagcgaggaguaccugcugugcuucagccacaugggccuguacguggacccccagggcagaagagccagagcccaggagcugauguggcccgccgcccccguggccugcagcugcagccccacccacgugaccguguacagcgaguacggcguggacguguucgacgugagaaccauggagugggugcagaccaucggccugagaagaaucagaccccugaacagcgagggcacccugaaccugcugaacugcgagccccccagacugaucuacuucaagagcaaguucagcggcgccgugcugaacgugcccgacaccagcgacaacagcaagaagcagaugcugagaaccagaagcaagagaagauucguguucaaggugcccgaggaggagagacugcagcagagaagagagaugcugagagaccccgagcugagaagcaagaugaucagcaaccccaccaacuucaaccacguggcccacaugggccccggcgacggcaugcaggugcugauggaccugccccugagcgccgugccccccagccaggaggagagacccggccccgcccccaccaaccuggccagacagccccccagcagaaacaagcccuacaucagcuggcccagcagcggcggcagcgagcccagcgugaccgugccccugagaagcaugagcgaccccgaccaggacuucgacaaggagcccgacagcgacagcaccaagcacagcacccccagcaacagcagcaaccccagcggcccccccagccccaacagcccccacagaagccagcugccccuggagggccuggagcagcccgccugcgacaccuaa

SEQ ID NO: 14939 - RNA, 4656 nt, Artificial Sequence
  CDC42BPG__Homo_sapiens__NP_059995
auggagagaagacugagagcccuggagcagcuggccagaggcgaggccggcggcugccccggccuggacggccugcuggaccugcugcuggcccugcaccacgagcugagcagcggcccccugagaagagagagaagcguggcccaguuccugagcugggccagccccuucgugagcaaggugaaggagcugagacugcagagagacgacuucgagauccugaaggugaucggcagaggcgccuucggcgaggugaccguggugagacagagagacaccggccagaucuucgccaugaagaugcugcacaagugggagaugcugaagagagccgagaccgccugcuucagagaggagagagacgugcuggugaagggcgacagcagaugggugaccacccugcacuacgccuuccaggacgaggaguaccuguaccuggugauggacuacuacgccggcggcgaccugcugacccugcugagcagauucgaggacagacugccccccgagcuggcccaguucuaccuggccgagauggugcuggccauccacagccugcaccagcugggcuacgugcacagagacgugaagcccgacaacgugcugcuggacgugaacggccacaucagacuggccgacuucggcagcugccugagacugaacaccaacggcaugguggacagcagcguggccgugggcacccccgacuacaucagccccgagauccugcaggccauggaggagggcaagggccacuacggcccccagugcgacugguggagccugggcgugugcgccuacgagcugcuguucggcgagacccccuucuacgccgagagccugguggagaccuacggcaagaucaugaaccacgaggaccaccugcaguucccccccgacgugcccgacgugcccgccagcgcccaggaccugaucagacagcugcugugcagacaggaggagagacugggcagaggcggccuggacgacuucagaaaccaccccuucuucgagggcguggacugggagagacuggccagcagcaccgcccccuacauccccgagcugagaggccccauggacaccagcaacuucgacguggacgacgacacccugaaccaccccggcacccugcccccccccagccacggcgccuucagcggccaccaccugcccuucgugggcuucaccuacaccagcggcagccacagccccgagagcagcagcgaggccugggccgcccuggagagaaagcugcagugccuggagcaggagaagguggagcugagcagaaagcaccaggaggcccugcacgcccccaccgaccacagagagcuggagcagcugagaaaggaggugcagacccugagagacagacugcccgagaugcugagagacaaggccagccugagccagaccgacggcccccccgccggcagccccggccaggacagcgaccugagacaggagcuggacagacugcacagagagcuggccgagggcagagccggccugcaggcccaggagcaggagcugugcagagcccagggccagcaggaggagcugcugcagagacugcaggaggcccaggagagagaggccgccaccgccagccagaccagagcccugagcagccagcuggaggaggccagagccgcccagagagagcuggaggcccaggugagcagccugagcagacaggugacccagcugcagggccagugggagcagagacuggaggagagcagccaggccaagaccauccacaccgccagcgagaccaacggcaugggcccccccgagggcggcccccaggaggcccagcugagaaaggagguggccgcccugagagagcagcuggagcaggcccacagccacagacccagcggcaaggaggaggcccugugccagcugcaggaggagaacagaagacugagcagagagcaggagagacuggaggccgagcuggcccaggagcaggagagcaagcagagacuggagggcgagagaagagagaccgagagcaacugggaggcccagcuggccgacauccugagcugggugaacgacgagaaggugagcagaggcuaccugcaggcccuggccaccaagauggccgaggagcuggagagccugagaaacgugggcacccagacccugcccgccagaccccuggaccaccaguggaaggccagaagacugcagaagauggaggccagcgccagacuggagcugcagagcgcccuggaggccgagaucagagccaagcagggccugcaggagagacugacccaggugcaggaggcccagcugcaggccgagagaagacugcaggaggccgagaagcagagccaggcccugcagcaggagcuggccaugcugagagaggagcugagagccagaggccccguggacaccaagcccagcaacagccugauccccuuccugagcuucagaagcagcgagaaggacagcgccaaggaccccggcaucagcggcgaggccaccagacacggcggcgagcccgaccugagacccgagggcagaagaagccugagaaugggcgccguguuccccagagcccccaccgccaacaccgccagcaccgagggccugcccgccaagcccggcagccacacccugagacccagaagcuuccccagccccaccaagugccugagaugcaccagccugaugcugggccugggcagacagggccugggcugcgacgccugcggcuacuucugccacaccaccugcgccccccaggccccccccugccccgugccccccgaccugcugagaaccgcccugggcgugcaccccgagaccggcaccggcaccgccuacgagggcuuccugagcgugcccagacccagcggcgugagaagaggcuggcagagaguguucgccgcccugagcgacagcagacugcugcuguucgacgcccccgaccugagacugagcccccccagcggcgcccugcugcaggugcuggaccugagagacccccaguucagcgccacccccgugcuggccagcgacgugauccacgcccagagcagagaccugcccagaaucuucagagugaccaccagccagcuggccgugccccccaccaccugcaccgugcugcugcuggccgagagcgagggcgagagagagagauggcugcaggugcugggcgagcugcagagacugcugcuggacgccagacccagacccagacccguguacacccugaaggaggccuacgacaacggccugccccugcugccccacacccugugcgccgccauccuggaccaggacagacuggcccugggcaccgaggagggccuguucgugauccaccugagaagcaacgacaucuuccaggugggcgagugcagaagagugcagcagcugacccugagccccagcgccggccugcugguggugcugugcggcagaggccccagcgugagacuguucgcccuggccgagcuggagaacaucgagguggccggcgccaagauccccgagagcagaggcugccaggugcuggccgccggcagcauccugcaggccagaacccccgugcugugcguggccgugaagagacaggugcugugcuaccagcugggccccggccccggccccuggcagagaagaaucagagagcugcaggcccccgccaccgugcagagccugggccugcugggcgacagacugugcgugggcgccgccggcggcuucgcccuguacccccugcugaacgaggccgccccccuggcccugggcgccggccuggugcccgaggagcugccccccagcagaggcggccugggcgaggcccugggcgccguggagcugagccugagcgaguuccugcugcuguucaccaccgccggcaucuacguggacggcgccggcagaaagagcagaggccacgagcugcuguggcccgccgcccccaugggcuggggcuacgccgcccccuaccugaccguguucagcgagaacagcaucgacguguucgacgugagaagagccgagugggugcagaccgugccccugaagaaggugagaccccugaaccccgagggcagccuguuccuguacggcaccgagaaggugagacugaccuaccugagaaaccagcuggccgagaaggacgaguucgacauccccgaccugaccgacaacagcagaagacagcuguucagaaccaagagcaagagaagauucuucuucagagugagcgaggagcagcagaagcagcagagaagagagaugcugaaggaccccuucgugagaagcaagcugaucagcccccccaccaacuucaaccaccuggugcacgugggccccgccaacggcagacccggcgccagagacaagagccccgcccccgaggagaagggcagaguggccagaggcagcggcccccagagaccccacagcuucagcgaggcccugagaagacccgccagcaugggcagcgagggccugggcggcgacgccgaccccaugaagagaaagcccuggaccagccugagcagcgagagcgugagcugcccccagggcagccugagccccgccaccagccugaugcaggugagcgagagacccagaagccugccccugagccccgagcuggagagcagccccuaa

SEQ ID NO: 14940 - RNA, 1176 nt, Artificial Sequence
  CDC42EP1__Homo_sapiens__NP_689449
augcccggcccccagggcggcagaggcgccgccaccaugagccugggcaagcugagccccgugggcugggugagcagcagccagggcaagagaagacugaccgccgacaugaucagccacccccugggcgacuucagacacaccaugcacgugggcagaggcggcgacguguucggcgacaccagcuuccugagcaaccacggcggcagcagcggcagcacccacagaagccccagaagcuuccuggccaagaagcugcagcuggugagaagagugggcgccccccccagaagaauggccagcccccccgcccccagccccgccccccccgccaucagccccaucaucaagaacgccaucagccugccccagcugaaccaggccgccuacgacagccugguggugggcaagcugagcuucgacagcagccccaccagcagcaccgacggccacagcagcuacggccuggacagcggcuucugcaccaucagcagacugcccagaagcgagaagccccacgacagagacagagacggcagcuuccccagcgagcccggccugagaagaagcgacagccugcugagcuucagacuggaccuggaccugggccccagccugcugagcgagcugcugggcgugaugagccugcccgaggcccccgccgccgagacccccgcccccgccgccaacccccccgcccccaccgccaaccccaccggccccgccgccaacccccccgccaccaccgccaacccccccgcccccgccgccaaccccagcgcccccgccgccacccccaccggccccgccgccaacccccccgcccccgccgccagcagcaccccccacggccacugccccaacggcgugaccgccggccugggccccguggccgaggugaagagcagccccgugggcggcggccccagaggccccgccggccccgcccugggcagacacuggggcgccggcugggacggcggccaccacuaccccgagauggacgccagacaggagagaguggaggugcugccccaggccagagccagcugggagagccuggacgaggaguggagagccccccaggccggcagcagaacccccgugcccagcaccgugcaggccaacaccuucgaguucgccgacgccgaggaggacgacgaggugaagguguaa

SEQ ID NO: 14941 - RNA, 765 nt, Artificial Sequence
  CDC42EP3__Homo_sapiens__NP_006440
augcccgccaagacccccaucuaccugaaggccgccaacaacaagaagggcaagaaguucaagcugagagacauccugagccccgacaugaucagccccccccugggcgacuucagacacaccauccacaucggcaaggagggccagcacgacguguucggcgacaucagcuuccugcagggcaacuacgagcugcugcccggcaaccaggagaaggcccaccugggccaguuccccggccacaacgaguucuucagagccaacagcaccagcgacagcguguucaccgagacccccagccccgugcugaagaacgccaucagccugcccaccaucggcggcagccaggcccugaugcugccccugcugagccccgugaccuucaacagcaagcaggagagcuucggccccgccaagcugcccagacugagcugcgagcccgugauggaggagaaggcccaggagaagagcagccugcuggagaacggcaccgugcaccagggcgacaccagcuggggcagcagcggcagcgccagccagagcagccagggcagagacagccacagcagcagccugagcgagcaguaccccgacuggcccgccgaggacauguucgaccaccccacccccugcgagcugaucaagggcaagaccaagagcgaggagagccugagcgaccugaccggcagccugcugagccugcagcuggaccugggccccagccugcuggacgaggugcugaacgugauggacaagaacaaguaa

SEQ ID NO: 14942 - RNA, 255 nt, Artificial Sequence
  CDC42SE2__Homo_sapiens__NP_001033791
augagcgaguucuggcugugcuucaacugcugcaucgccgagcagccccagcccaagagaagaagaagaaucgacagaagcaugaucggcgagcccaccaacuucgugcacaccgcccacgugggcagcggcgaccuguucagcggcaugaacagcgugagcagcauccagaaccagaugcagagcaagggcggcuacggcggcggcaugcccgccaacgugcagaugcagcugguggacaccaaggccggcuaa

SEQ ID NO: 14943 - RNA, 1797 nt, Artificial Sequence
  CDC45__Homo_sapiens__XP_005261342
auguucgugagcgacuucagaaaggaguucuacgagguggugcagagccagagagugcugcuguucguggccagcgacguggacgcccugugcgccugcaagauccugcaggcccuguuccagugcgaccacgugcaguacacccuggugcccgugagcggcuggcaggagcuggagaccgccuuccuggagcacaaggagcaguuccacuacuucauccugaucaacugcggcgccaacguggaccugcuggacauccugcagcccgacgaggacaccaucuucuucgugugcgacacccacagacccgugaacguggugaacguguacaacgacacccagaucaagcugcugaucaagcaggacgacgaccuggaggugcccgccuacgaggacaucuucagagacgaggaggaggacgaggagcacagcggcaacgacagcgacggcagcgagcccagcgagaagagaaccagacuggaggaggagaucguggagcagaccaugagaagaagacagagaagagagugggaggccagaagcggcagcggcagcgagcccguggccgccgcccuggagaagagcagcagacuguucgccggccccaugagcgacagaaccgcccccagaagccccagaagagacauccuguucgacuacgagcaguacgaguaccacggcaccagcagcgccauggugauguucgagcuggccuggaugcugagcaaggaccugaacgacaugcuguggugggccaucgugggccugaccgaccagugggugcaggacaagaucacccagaugaaguacgugaccgacgugggcgugcugcagagacacgugagcagacacaaccacagaaacgaggacgaggagaacacccugagcguggacugcaccagaaucagcuucgaguacgaccugagacuggugcuguaccagcacuggagccugcacgacagccugugcaacaccagcuacaccgccgccagauucaagcuguggagcgugcacggccagaagagacugcaggaguuccuggccgacaugggccugccccugaagcaggugaagcagaaguuccaggccauggacaucagccugaaggagaaccugagagagaugaucgaggagagcgccaacaaguucggcaugaaggacaugagagugcagaccuucagcauccacuucggcuucaagcacaaguuccuggccagcgacgugguguucgccaccaugagccugauggagagccccgagaaggacggcagcggcaccgaccacuucauccaggcccuggacagccugagcagaagcaaccuggacaagcuguaccacggccuggagcuggccaagaagcagcugagagccacccagcagaccaucgccagcugccugugcaccaaccuggugaucagccagggccccuuccuguacugcagccugauggagggcacccccgacgugaugcuguucagcagacccgccagccugagccugcugagcaagcaccugcugaagagcuucgugugcagcaccaagaacagaagaugcaagcugcugccccuggugauggccgccccccugagcauggagcacggcaccgugaccguggugggcaucccccccgagaccgacagcagcgacagaaagaacuucuucggcagagccuucgagaaggccgccgagagcaccagcagcagaaugcugcacaaccacuucgaccugagcgugaucgagcugaaggccgaggacagaagcaaguuccuggacgcccugaucagccugcugagcuaa

SEQ ID NO: 14944 - RNA, 2409 nt, Artificial Sequence
  CDC5L__Homo_sapiens__NP_001244
augcccagaaucaugaucaagggcggcguguggagaaacaccgaggacgagauccugaaggccgccgugaugaaguacggcaagaaccaguggagcagaaucgccagccugcugcacagaaagagcgccaagcagugcaaggccagaugguacgaguggcuggaccccagcaucaagaagaccgaguggagcagagaggaggaggagaagcugcugcaccuggccaagcugaugcccacccaguggagaaccaucgcccccaucaucggcagaaccgccgcccagugccuggagcacuacgaguuccugcuggacaaggccgcccagagagacaacgaggaggagaccaccgacgaccccagaaagcugaagcccggcgagaucgaccccaaccccgagaccaagcccgccagacccgaccccaucgacauggacgaggacgagcuggagaugcugagcgaggccagagccagacuggccaacacccagggcaagaaggccaagagaaaggccagagagaagcagcuggaggaggccagaagacuggccgcccugcagaagagaagagagcugagagccgccggcaucgagauccagaagaagagaaagagaaagagaggcguggacuacaacgccgagauccccuucgagaagaagcccgcccugggcuucuacgacaccagcgaggagaacuaccaggcccuggacgccgacuucagaaagcugagacagcaggaccuggacggcgagcugagaagcgagaaggagggcagagacagaaagaaggacaagcagcaccugaagagaaagaaggagagcgaccugcccagcgccauccugcagaccagcggcgugagcgaguucaccaagaagagaagcaagcuggugcugcccgccccccagaucagcgacgccgagcugcaggagguggugaaggugggccaggccagcgagaucgccagacagaccgccgaggagagcggcaucaccaacagcgccagcagcacccugcugagcgaguacaacgugaccaacaacagcguggcccugagaacccccagaacccccgccagccaggacagaauccugcaggaggcccagaaccugauggcccugaccaacguggacaccccccugaagggcggccugaacaccccccugcacgagagcgacuucagcggcgugaccccccagagacagguggugcagacccccaacaccgugcugagcacccccuucagaacccccagcaacggcgccgagggccugacccccagaagcggcaccacccccaagcccgugaucaacagcacccccggcagaaccccccugagagacaagcugaacaucaaccccgaggacggcauggccgacuacagcgaccccagcuacgugaagcagauggagagagagagcagagagcaccugagacugggccugcugggccugcccgcccccaagaacgacuucgagaucgugcugcccgagaacgccgagaaggagcuggaggagagagagaucgacgacaccuacaucgaggacgccgccgacguggacgccagaaagcaggccaucagagacgccgagagagugaaggagaugaagagaaugcacaaggccgugcagaaggaccugcccagacccagcgaggugaacgagaccauccugagaccccugaacguggagcccccccugaccgaccugcagaagagcgaggagcugaucaagaaggagaugaucaccaugcugcacuacgaccugcugcaccaccccuacgagcccagcggcaacaagaagggcaagaccgugggcuucggcaccaacaacagcgagcacaucaccuaccuggagcacaaccccuacgagaaguucagcaaggaggagcugaagaaggcccaggacgugcuggugcaggagauggagguggugaagcagggcaugagccacggcgagcugagcagcgaggccuacaaccaggugugggaggagugcuacagccaggugcuguaccugcccggccagagcagauacaccagagccaaccuggccagcaagaaggacagaaucgagagccuggagaagagacuggagaucaacagaggccacaugaccaccgaggccaagagagccgccaagauggagaagaagaugaagauccugcugggcggcuaccagagcagagccaugggccugaugaagcagcugaacgaccugugggaccagaucgagcaggcccaccuggagcugagaaccuucgaggagcugaagaagcacgaggacagcgccauccccagaagacuggagugccugaaggaggacgugcagagacagcaggagagagagaaggagcugcagcacagauacgccgaccugcugcuggagaaggagacccugaagagcaaguucuaa

SEQ ID NO: 14945 - RNA, 1683 nt, Artificial Sequence
  CDC6__Homo_sapiens__NP_001245
augccccagaccagaagccaggcccaggccaccaucagcuuccccaagagaaagcugagcagagcccugaacaaggccaagaacagcagcgacgccaagcuggagcccaccaacgugcagaccgugaccugcagccccagagugaaggcccugccccugagccccagaaagagacugggcgacgacaaccugugcaacaccccccaccugccccccugcagcccccccaagcagggcaagaaggagaacggccccccccacagccacacccugaagggcagaagacugguguucgacaaccagcugaccaucaagagccccagcaagagagagcuggccaaggugcaccagaacaagauccugagcagcgugagaaagagccaggagaucaccaccaacagcgagcagagaugcccccugaagaaggagagcgccugcgugagacuguucaagcaggagggcaccugcuaccagcaggccaagcuggugcugaacaccgccgugcccgacagacugcccgccagagagagagagauggacgugaucagaaacuuccugagagagcacaucugcggcaagaaggccggcagccuguaccugagcggcgcccccggcaccggcaagaccgccugccugagcagaauccugcaggaccugaagaaggagcugaagggcuucaagaccaucaugcugaacugcaugagccugagaaccgcccaggccguguuccccgccaucgcccaggagaucugccaggaggaggugagcagacccgccggcaaggacaugaugagaaagcuggagaagcacaugaccgccgagaagggccccaugaucgugcuggugcuggacgagauggaccagcuggacagcaagggccaggacgugcuguacacccuguucgaguggcccuggcugagcaacagccaccuggugcugaucggcaucgccaacacccuggaccugaccgacagaauccugcccagacugcaggccagagagaagugcaagccccagcugcugaacuucccccccuacaccagaaaccagaucgugaccauccugcaggacagacugaaccaggugagcagagaccaggugcuggacaacgccgccgugcaguucugcgccagaaaggugagcgccgugagcggcgacgugagaaaggcccuggacgugugcagaagagccaucgagaucguggagagcgacgugaagagccagaccauccugaagccccugagcgagugcaagagccccagcgagccccugauccccaagagagugggccugauccacaucagccaggugaucagcgagguggacggcaacagaaugacccugagccaggagggcgcccaggacagcuucccccugcagcagaagauccuggugugcagccugaugcugcugaucagacagcugaagaucaaggaggugacccugggcaagcuguacgaggccuacagcaaggugugcagaaagcagcagguggccgccguggaccagagcgagugccugagccugagcggccugcuggaggccagaggcauccugggccugaagagaaacaaggagaccagacugaccaagguguucuucaagaucgaggagaaggagaucgagcacgcccugaaggacaaggcccugaucggcaacauccuggccaccggccugcccuaa

SEQ ID NO: 14946 - RNA, 1596 nt, Artificial Sequence
  CDC73__Homo_sapiens__NP_078805
auggccgacgugcugagcgugcugagacaguacaacauccagaagaaggagaucguggugaagggcgacgaggugaucuucggcgaguucagcuggcccaagaacgugaagaccaacuacgugguguggggcaccggcaaggagggccagcccagagaguacuacacccuggacagcauccuguuccugcugaacaacgugcaccugagccaccccguguacgugagaagagccgccaccgagaacauccccguggugagaagacccgacagaaaggaccugcugggcuaccugaacggcgaggccagcaccagcgccagcaucgacagaagcgccccccuggagaucggccugcagagaagcacccaggugaagagagccgccgacgaggugcuggccgaggccaagaagcccagaaucgaggacgaggagugcgugagacuggacaaggagagacuggccgccagacuggagggccacaaggagggcaucgugcagaccgagcagaucagaagccugagcgaggccaugagcguggagaagaucgccgccaucaaggccaagaucauggccaagaagagaagcaccaucaagaccgaccuggacgacgacaucaccgcccugaagcagagaagcuucguggacgccgagguggacgugaccagagacaucgugagcagagagagaguguggagaaccagaaccaccauccugcagagcaccggcaagaacuucagcaagaacaucuucgccauccugcagagcgugaaggccagagaggagggcagagcccccgagcagagacccgcccccaacgccgcccccguggaccccacccugagaaccaagcagcccauccccgccgccuacaacagauacgaccaggagagauucaagggcaaggaggagaccgagggcuucaagaucgacaccaugggcaccuaccacggcaugacccugaagagcgugaccgagggcgccagcgccagaaagacccagacccccgccgcccagcccgugcccagacccgugagccaggccagacccccccccaaccagaagaagggcagcagaacccccaucaucaucauccccgccgccaccaccagccugaucaccaugcugaacgccaaggaccugcugcaggaccugaaguucgugcccagcgacgagaagaagaagcagggcugccagagagagaacgagacccugauccagagaagaaaggaccagaugcagcccggcggcaccgccaucagcgugaccgugcccuacagagugguggaccagccccugaagcugaugccccaggacugggacagagugguggccguguucgugcagggccccgccuggcaguucaagggcuggcccuggcugcugcccgacggcagccccguggacaucuucgccaagaucaaggccuuccaccugaaguacgacgaggugagacuggaccccaacgugcagaagugggacgugaccgugcuggagcugagcuaccacaagagacaccuggacagacccguguuccugagauucugggagacccuggacagauacauggugaagcacaagagccaccugagauucuaa

SEQ ID NO: 14947 - RNA, 1725 nt, Artificial Sequence
  CDC7__Homo_sapiens__XP_011540528
auggaggccagccugggcauccagauggacgagcccauggccuucagcccccagagagacagauuccaggccgagggcagccugaagaagaacgagcagaacuucaagcuggccggcgugaagaaggacaucgagaagcuguacgaggccgugccccagcugagcaacguguucaagaucgaggacaagaucggcgagggcaccuucagcagcguguaccuggccaccgcccagcugcaggugggccccgaggagaagaucgcccugaagcaccugauccccaccagccaccccaucagaaucgccgccgagcugcagugccugaccguggccggcggccaggacaacgugaugggcgugaaguacugcuucagaaagaacgaccacguggugaucgccaugcccuaccuggagcacgagagcuuccuggacauccugaacagccugagcuuccaggaggugagagaguacaugcugaaccuguucaaggcccugaagagaauccaccaguucggcaucgugcacagagacgugaagcccagcaacuuccuguacaacagaagacugaagaaguacgcccugguggacuucggccuggcccagggcacccacgacaccaagaucgagcugcugaaguucgugcagagcgaggcccagcaggagagaugcagccagaacaagagccacaucaucaccggcaacaagaucccccugagcggccccgugcccaaggagcuggaccagcagagcaccaccaaggccagcgugaagagacccuacaccaacgcccagauccagaucaagcagggcaaggacggcaaggagggcagcgugggccugagcgugcagagaagcguguucggcgagagaaacuucaacauccacagcagcaucagccacgagagccccgccgugaagcugaugaagcagagcaagaccguggacgugcugagcagaaagcuggccaccaagaagaaggccaucagcaccaaggugaugaacagcgccgugaugagaaagaccgccagcagcugccccgccagccugaccugcgacugcuacgccaccgacaaggugugcagcaucugccugagcagaagacagcagguggcccccagagccggcacccccggcuucagagcccccgaggugcugaccaagugccccaaccagaccaccgccaucgacauguggagcgccggcgugaucuuccugagccugcugagcggcagauaccccuucuacaaggccagcgacgaccugaccgcccuggcccagaucaugaccaucagaggcagcagagagaccauccaggccgccaagaccuucggcaagagcauccugugcagcaaggaggugcccgcccaggaccugagaaagcugugcgagagacugagaggcauggacagcagcacccccaagcugaccagcgacauccagggccacgccagccaccagcccgccaucagcgagaagaccgaccacaaggccagcugccuggugcagaccccccccggccaguacagcggcaacagcuucaagaagggcgacagcaacagcugcgagcacugcuucgacgaguacaacaccaaccuggagggcuggaacgaggugcccgacgaggccuacgaccugcuggacaagcugcuggaccugaaccccgccagcagaaucaccgccgaggaggcccugcugcaccccuucuucaaggacaugagccuguaa

SEQ ID NO: 14948 - RNA, 3072 nt, Artificial Sequence
  CDCA2__Homo_sapiens__NP_689775
auggacgccaacagcaaggacaagccccccgagaccaaggagagcgccaugaacaacgccggcaacgccagcuucauccugggcaccggcaagaucgugaccccccagaagcacgccgagcugccccccaaccccugcacccccgacaccuucaagagcccccugaacuucagcaccgugaccguggagcagcugggcaucacccccgagagcuucgugagaaacagcgccggcaagagcagcagcuaccugaagaagugcagaagaagaagcgccgugggcgccagaggcagccccgagaccaaccaccugaucagauucaucgccagacagcagaacaucaagaacgccagaaagagcccccuggcccaggacagccccagccagggcagccccgcccuguacagaaacgugaacacccugagagagagaaucagcgccuuccagagcgccuuccacagcaucaaggagaacgagaagaugaccggcugccuggaguucagcgaggccggcaaggagagcgagaugaccgaccugaccagaaaggagggccugagcgccugccagcagagcggcuuccccgccgugcugagcagcaagagaagaagaaucagcuaccagagagacagcgacgagaaccugaccgacgccgagggcaaggugaucggccugcagaucuucaacaucgacaccgacagagccugcgccguggagaccagcguggaccugagcgagaucagcagcaagcugggcagcacccagagcggcuuccugguggaggagagccugccccugagcgagcugaccgagaccagcaacgcccugaagguggccgacugcguggugggcaagggcagcagcgacgccgugagccccgacaccuucaccgccgaggugagcagcgacgccgugcccgacgugagaagccccgccacccccgccugcagaagagaccugcccacccccaagaccuucgugcugagaagcgugcugaagaagcccagcgugaagaugugccuggagagccugcaggagcacugcaacaaccuguacgacgacgacggcacccaccccagccugaucagcaaccugcccaacugcugcaaggagaaggaggccgaggacgaggagaacuucgaggcccccgccuuccugaacaugagaaagagaaagagagugaccuucggcgaggaccugagccccgagguguucgacgagagccugcccgccaacaccccccugagaaagggcggcacccccgugugcaagaaggacuucagcggccugagcagccugcugcuggagcagagccccgugcccgagccccugccccagcccgacuucgacgacaagggcgagaaccuggagaacaucgagccccugcaggugagcuucgccgugcugagcagccccaacaagagcagcaucagcgagacccugagcggcaccgacaccuucagcagcagcaacaaccacgagaagaucagcagccccaaggugggcagaaucaccagaaccagcaacagaagaaaccagcuggugagcgugguggaggagagcgugugcaaccugcugaacaccgaggugcagcccugcaaggagaagaagaucaacagaagaaagagccaggagaccaagugcaccaagagagcccugcccaagaagagccaggugcugaagagcugcagaaagaagaagggcaagggcaagaagagcgugcagaagagccuguacggcgagagagacaucgccagcaagaagccccugcugagccccauccccgagcugcccgaggugcccgagaugacccccagcauccccagcaucagaagacugggcagcggcuacuucagcagcaacggcaagcuggaggaggugaagacccccaagaaccccgugaagagaaaggaccugcugagacacgaccccgaccugcacaugcaccagggcuacgacaaguacgacgugagcgaguucugcagcuacaucaagagcagcagcagccugggcaacgccaccagcgacgaggaccccaacaccaacaucaugaacaucaacgagaacaagaacauccccaaggccaagaacaagagcgagagcgagaacgagcccaaggccggcaccgacagccccgugagcugcgccagcgugaccgaggagagaguggccagcgacagccccaagcccgcccugacccugcagcagggccaggaguucagcgccggcggccagaacgccgagaaccugugccaguucuucaagaucagccccgaccugaacaucaagugcgagagaaaggacgacuuccugggcgccgccgagggcaagcugcagugcaacagacugaugcccaacagccagaaggacugccacugccugggcgacgugcugaucgagaacaccaaggagagcaagagccagagcgaggaccugggcagaaagcccauggagagcagcagcguggugagcugcagagacagaaaggacagaagaagaagcaugugcuacagcgacggcagaagccugcaccuggagaagaacggcaaccacacccccagcagcagcgugggcagcagcguggagaucagccuggagaacagcgagcuguucaaggaccugagcgacgccaucgagcagaccuuccagagaagaaacagcgagaccaaggugagaagaagcaccagacugcagaaggaccuggagaacgagggccugguguggaucagccugccccugcccagcaccagccagaaggccaagagaagaaccaucugcaccuucgacagcagcggcuucgagagcaugagccccaucaaggagaccgugagcagcagacagaagccccagauggccccccccgugagcgaccccgagaacagccagggccccgccgccggcagcagcgacgagcccggcaagagaagaaagagcuucugcaucagcacccuggccaacaccaaggccaccagccaguucaagggcuacagaagaagaagcagccugaacggcaagggcgagagcagccugaccgcccuggagagaaucgagcacaacggcgagagaaagcaguaa

SEQ ID NO: 14949 - RNA, 807 nt, Artificial Sequence
  CDCA3__Homo_sapiens__NP_112589
augggcagcgccaagagcgugcccgugacccccgccagaccccccccccacaacaagcaccuggccagaguggccgaccccagaagccccagcgccggcauccugagaacccccauccagguggagagcagcccccagcccggccugcccgccggcgagcagcuggagggccugaagcacgcccaggacagcgaccccagaagccccacccugggcaucgccagaacccccaugaagaccagcagcggcgacccccccagcccccuggugaagcagcugagcgagguguucgagaccgaggacagcaagagcaaccugccccccgagcccgugcugccccccgaggccccccugagcagcgagcuggaccugccccugggcacccagcugagcguggaggagcagaugccccccuggaaccagaccgaguuccccagcaagcagguguucagcaaggaggaggccagacagcccaccgagacccccguggccagccagagcagcgacaagcccagcagagaccccgagacccccagaagcagcggcagcaugagaaacagauggaagcccaacagcagcaaggugcugggcagaagcccccugaccauccugcaggacgacaacagccccggcacccugacccugagacagggcaagagacccagcccccugagcgagaacgugagcgagcugaaggagggcgccauccugggcaccggcagacugcugaagaccggcggcagagccugggagcagggccaggaccacgacaaggagaaccagcacuucccccugguggagagcuaa

SEQ ID NO: 14950 - RNA, 759 nt, Artificial Sequence
  CDCA5__Homo_sapiens__NP_542399
augagcggcagaagaaccagaagcggcggcgccgcccagagaagcggccccagagcccccagccccaccaagccccugagaagaagccagagaaagagcggcagcgagcugcccagcauccugcccgagaucuggcccaagacccccagcgccgccgccgugagaaagcccaucgugcugaagagaaucguggcccacgccguggaggugcccgccgugcagagccccagaagaagccccagaaucagcuucuuccuggagaaggagaacgagccccccggcagagagcugaccaaggaggaccuguucaagacccacagcgugcccgccacccccaccagcacccccgugcccaaccccgaggccgagagcagcagcaaggagggcgagcuggacgccagagaccuggagaugagcaagaaggugagaagaagcuacagcagacuggagacccugggcagcgccagcaccagcacccccggcagaagaagcugcuucggcuucgagggccugcugggcgccgaggaccugagcggcgugagccccguggugugcagcaagcugaccgaggugcccagagugugcgccaagcccugggcccccgacaugacccugcccggcaucagccccccccccgagaagcagaagagaaagaagaagaagaugcccgagauccugaagaccgagcuggacgagugggccgccgccaugaacgccgaguucgaggccgccgagcaguucgaccugcugguggaguaa

SEQ ID NO: 14951 - RNA, 1353 nt, Artificial Sequence
  CDCA7__Homo_sapiens__NP_114148
auggacgccagaagagugccccagaaggaccugagagugaagaagaaccugaagaaguucagauacgugaagcugaucagcauggagaccagcagcagcagcgacgacagcugcgacagcuucgccagcgacaacuucgccaacaccaagcccaaguucagaagcgacaucagcgaggagcuggccaacguguucuacgaggacagcgacaacgagagcuucugcggcuucagcgagagcgaggugcaggacgugcuggaccacugcggcuuccugcagaagcccagacccgacgugaccaacgagcuggccggcaucuuccacgccgacagcgacgacgagagcuucugcggcuucagcgagagcgagauccaggacggcaugagacugcagagcgugagagagggcugcagaaccagaagccagugcagacacagcggcccccugagaguggccaugaaguuccccgccagaagcaccagaggcgccaccaacaagaaggccgagagcagacagcccagcgagaacagcgugaccgacagcaacagcgacagcgaggacgagagcggcaugaacuuccuggagaagagagcccugaacaucaagcagaacaaggccaugcuggccaagcugaugagcgagcuggagagcuuccccggcagcuucagaggcagacacccccugcccggcagcgacagccagagcagaagacccagaagaagaaccuuccccggcguggccagcagaagaaaccccgagagaagagccagaccccugaccagaagcagaagcagaauccugggcagccuggacgcccugcccauggaggaggaggaggaggaggacaaguacaugcuggugagaaagagaaagaccguggacggcuacaugaacgaggacgaccugcccagaagcagaagaagcagaagcagcgugacccugccccacaucaucagacccguggaggagaucaccgaggaggagcuggagaacgugugcagcaacagcagagagaagaucuacaacagaagccugggcagcaccugccaccagugcagacagaagaccaucgacaccaagaccaacugcagaaaccccgacugcuggggcgugagaggccaguucugcggccccugccugagaaacagauacggcgaggaggugagagacgcccugcuggaccccaacuggcacugcccccccugcagaggcaucugcaacugcagcuucugcagacagagagacggcagaugcgccaccggcgugcugguguaccuggccaaguaccacggcuucggcaacgugcacgccuaccugaagagccugaagcaggaguucgagaugcaggccuaa

SEQ ID NO: 14952 - RNA, 1263 nt, Artificial Sequence
  CDCA7L__Homo_sapiens__NP_001120842
auggagacccugagcagcgaggagagcugcgacagcuucgacagccuggagagcggcaagcagcaggacgugagauuccacagcaaguacuucaccgaggagcugagaagaaucuucaucgaggacaccgacagcgagaccgaggacuucgccggcuucacccagagcgaccugaacggcaagaccaaccccgaggugauggugguggagagcgaccugagcgacgacggcaaggccagccuggugagcgaggaggaggaggacgaggaggaggacaaggccacccccagaagaagcagaagcagaagaagcagcaucggccugagaguggccuuccaguuccccaccaagaagcuggccaacaagcccgacaagaacagcagcagcgagcagcuguucagcagcgccagacugcagaacgagaagaagaccauccuggagagaaagaaggacugcagacaggugauccagagagaggacagcaccagcgagagcgaggacgacagcagagacgagagccaggagagcagcgacgcccugcugaagagaaccaugaacaucaaggagaacaaggccaugcuggcccagcugcuggccgagcugaacagcaugcccgacuucuuccccgugagaacccccaccagcgccagcagaaagaagaccgugagaagagccuucagcgagggccagaucaccagaagaaugaaccccaccagaagcgccagaccccccgagaaguucgcccuggagaacuucaccgugagcgccgccaaguucgccgaggaguucuacagcuucagaagaagaaagaccaucggcggcaagugcagagaguacagaagaagacacagaaucagcagcuucagacccguggaggacaucaccgaggaggaccuggagaacguggccaucaccgugagagacaagaucuacgacaaggugcugggcaacaccugccaccagugcagacagaagaccaucgacaccaagaccgugugcagaaaccagggcugcugcggcgugagaggccaguucugcggccccugccugagaaacagauacggcgaggacgugagaagcgcccugcuggaccccgacugggugugcccccccugcagaggcaucugcaacugcagcuacugcagaaagagagacggcagaugcgccaccggcauccugauccaccuggccaaguucuacggcuacgacaacgugaaggaguaccuggagagccugcagaaggagcugguggaggacaacuaa

SEQ ID NO: 14953 - RNA, 2511 nt, Artificial Sequence
  CDCP1__Homo_sapiens__NP_073753
auggccggccugaacugcggcgugagcaucgcccugcugggcgugcugcugcugggcgccgccagacugcccagaggcgccgaggccuucgagaucgcccugcccagagagagcaacaucaccgugcugaucaagcugggcacccccacccugcuggccaagcccugcuacaucgugaucagcaagagacacaucaccaugcugagcaucaagagcggcgagagaaucguguucaccuucagcugccagagccccgagaaccacuucgugaucgagauccagaagaacaucgacugcaugagcggccccugccccuucggcgaggugcagcugcagcccagcaccagccugcugcccacccugaacagaaccuucaucugggacgugaaggcccacaagagcaucggccuggagcugcaguucagcauccccagacugagacagaucggccccggcgagagcugccccgacggcgugacccacagcaucagcggcagaaucgacgccaccguggugagaaucggcaccuucugcagcaacggcaccgugagcagaaucaagaugcaggagggcgugaagauggcccugcaccugcccugguuccaccccagaaacgugagcggcuucagcaucgccaacagaagcagcaucaagagacugugcaucaucgagagcguguucgagggcgagggcagcgccacccugaugagcgccaacuaccccgagggcuuccccgaggacgagcugaugaccuggcaguucguggugcccgcccaccugagagccagcgugagcuuccugaacuucaaccugagcaacugcgagagaaaggaggagagaguggaguacuacauccccggcagcaccaccaaccccgagguguucaagcuggaggacaagcagcccggcaacauggccggcaacuucaaccugagccugcagggcugcgaccaggacgcccagagccccggcauccugagacugcaguuccaggugcuggugcagcacccccagaacgagagcaacaagaucuacgugguggaccugagcaacgagagagccaugagccugaccaucgagcccagacccgugaagcagagcagaaaguucgugcccggcugcuucgugugccuggagagcagaaccugcagcagcaaccugacccugaccagcggcagcaagcacaagaucagcuuccugugcgacgaccugaccagacuguggaugaacguggagaagaccaucagcugcaccgaccacagauacugccagagaaagagcuacagccugcaggugcccagcgacauccugcaccugcccguggagcugcacgacuucagcuggaagcugcuggugcccaaggacagacugagccuggugcuggugcccgcccagaagcugcagcagcacacccacgagaagcccugcaacaccagcuucagcuaccugguggccagcgccauccccagccaggaccuguacuucggcagcuucugccccggcggcagcaucaagcagauccaggugaagcagaacaucagcgugacccugagaaccuucgcccccagcuuccagcaggaggccagcagacagggccugaccgugagcuucauccccuacuucaaggaggagggcguguucaccgugacccccgacaccaagagcaagguguaccugagaacccccaacugggacagaggccugcccagccugaccagcgugagcuggaacaucagcgugcccagagaccagguggccugccugaccuucuucaaggagagaagcggcguggugugccagaccggcagagccuucaugaucauccaggagcagagaaccagagccgaggagaucuucagccuggacgaggacgugcugcccaagcccagcuuccaccaccacagcuucugggugaacaucagcaacugcagccccaccagcggcaagcagcuggaccugcuguucagcgugacccugacccccagaaccguggaccugaccgugauccugaucgccgccgugggcggcggcgugcugcugcugagcgcccugggccugaucaucugcugcgugaagaagaagaagaagaagaccaacaagggccccgccgugggcaucuacaacgacaacaucaacaccgagaugcccagacagcccaagaaguuccagaagggcagaaaggacaacgacagccacguguacgccgugaucgaggacaccaugguguacggccaccugcugcaggacagcagcggcagcuuccugcagcccgagguggacaccuacagacccuuccagggcaccaugggcgugugcccccccagcccccccaccaucugcagcagagcccccaccgccaagcuggccaccgaggagcccccccccagaagcccccccgagagcgagagcgagcccuacaccuucagccaccccaacaacggcgacgugagcagcaaggacaccgacaucccccugcugaacacccaggagcccauggagcccgccgaguaa

SEQ ID NO: 14954 - RNA, 2367 nt, Artificial Sequence
  CDH10__Homo_sapiens__NP_006718
augaccauccaccaguuccugcugcuguuccuguucugggugugccugccccacuucugcagccccgagaucauguucagaagaacccccgugccccagcagagaauccugagcagcagagugcccagaagcgacggcaagauccugcacagacagaagagaggcuggauguggaaccaguucuuccugcuggaggaguacaccggcagcgacuaccaguacgugggcaagcugcacagcgaccaggacaagggcgacggcagccugaaguacauccugagcggcgacggcgccggcacccuguucaucaucgacgagaagaccggcgacauccacgccaccagaagaaucgacagagaggagaaggccuucuacacccugagagcccaggccaucaacagaagaacccugagacccguggagcccgagagcgaguucgugaucaagauccacgacaucaacgacaacgagcccaccuuccccgaggagaucuacaccgccagcgugcccgagaugagcguggugggcaccagcguggugcaggugaccgccaccgacgccgacgaccccagcuacggcaacagcgccagagugaucuacagcauccugcagggccagcccuacuucagcguggagcccgagaccggcaucaucagaaccgcccugcccaacaugaacagagagaacagagagcaguaccagguggugauccaggccaaggacaugggcggccagaugggcggccugagcggcaccaccaccgugaacaucacccugaccgacgugaacgacaacccccccagauucccccagaacaccauccaccugagagugcuggagagcagccccgugggcaccgccaucggcagcgugaaggccaccgacgccgacaccggcaagaacgccgagguggaguacagaaucaucgacggcgacggcaccgacauguucgacaucgugaccgagaaggacacccaggagggcaucaucaccgugaagaagccccuggacuacgagagcagaagacuguacacccugaagguggaggccgagaacacccacguggaccccagauucuacuaccugggccccuucaaggacaccaccaucgugaagaucagcaucgaggacguggacgagccccccguguucagcagaagcagcuaccuguucgaggugcacgaggacaucgaggugggcaccaucaucggcaccgugauggccagagaccccgacagcaucagcagccccaucagauucagccuggacagacacaccgaccuggacagaaucuucaacauccacagcggcaacggcagccuguacaccagcaagccccuggacagagagcugagccaguggcacaaccugaccgugaucgccgccgagaucaacaaccccaaggagaccaccagaguggccguguucgugagaauccuggacgugaacgacaacgccccccaguucgccguguucuacgacaccuucgugugcgagaacgccagacccggccagcugauccagaccaucagcgccguggacaaggacgacccccugggcggccagaaguucuucuucagccuggccgccgugaaccccaacuucaccgugcaggacaacgaggacaacaccgccagaauccugaccagaaagaacggcuucaacagacacgagaucagcaccuaccugcugcccguggugaucagcgacaacgacuaccccauccagagcagcaccggcacccugaccaucagagugugcgccugcgacagccagggcaacaugcagagcugcagcgccgaggcccugcugcugcccgccggccugagcaccggcgcccugaucgccauccugcugugcaucaucauccugcuggugaucguggugcuguucgccgcccugaagagacagagaaagaaggagccccugauccugagcaaggaggacaucagagacaacaucgugagcuacaacgacgagggcggcggcgaggaggacacccaggccuucgacaucggcacccugagaaaccccgccgccaucgaggagaagaagcugagaagagacaucauccccgagacccuguucauccccagaagaacccccaccgcccccgacaacaccgacgugagagacuucaucaacgagagacugaaggagcacgaccuggaccccaccgccccccccuacgacagccuggccaccuacgccuacgagggcaacgacagcaucgccgagagccugagcagccuggagagcggcaccaccgagggcgaccagaacuacgacuaccugagagaguggggccccagauucaacaagcuggccgagauguacggcggcggcgagagcgacaaggacagcuaa

SEQ ID NO: 14955 - RNA, 2391 nt, Artificial Sequence
  CDH11__Homo_sapiens__NP_001788
augaaggagaacuacugccugcaggccgcccuggugugccugggcaugcugugccacagccacgccuucgcccccgagagaagaggccaccugagacccagcuuccacggccaccacgagaagggcaaggagggccaggugcugcagagaagcaagagaggcuggguguggaaccaguucuucgugaucgaggaguacaccggccccgaccccgugcuggugggcagacugcacagcgacaucgacagcggcgacggcaacaucaaguacauccugagcggcgagggcgccggcaccaucuucgugaucgacgacaagagcggcaacauccacgccaccaagacccuggacagagaggagagagcccaguacacccugauggcccaggccguggacagagacaccaacagaccccuggagccccccagcgaguucaucgugaaggugcaggacaucaacgacaacccccccgaguuccugcacgagaccuaccacgccaacgugcccgagagaagcaacgugggcaccagcgugauccaggugaccgccagcgacgccgacgaccccaccuacggcaacagcgccaagcugguguacagcauccuggagggccagcccuacuucagcguggaggcccagaccggcaucaucagaaccgcccugcccaacauggacagagaggccaaggaggaguaccacguggugauccaggccaaggacaugggcggccacaugggcggccugagcggcaccaccaaggugaccaucacccugaccgacgugaacgacaacccccccaaguucccccagagcguguaccagaugagcgugagcgaggccgccgugcccggcgaggaggugggcagagugaaggccaaggaccccgacaucggcgagaacggccuggugaccuacaacaucguggacggcgacggcauggagagcuucgagaucaccaccgacuacgagacccaggagggcgugaucaagcugaagaagcccguggacuucgagaccaagagagccuacagccugaagguggaggccgccaacgugcacaucgaccccaaguucaucagcaacggccccuucaaggacaccgugaccgugaagaucagcguggaggacgccgacgagccccccauguuccuggcccccagcuacauccacgaggugcaggagaacgccgccgccggcaccguggugggcagagugcacgccaaggaccccgacgccgccaacagccccaucagauacagcaucgacagacacaccgaccuggacagauucuucaccaucaaccccgaggacggcuucaucaagaccaccaagccccuggacagagaggagaccgccuggcugaacaucaccguguucgccgccgagauccacaacagacaccaggaggccaaggugcccguggccaucagagugcuggacgugaacgacaacgcccccaaguucgccgcccccuacgagggcuucaucugcgagagcgaccagaccaagccccugagcaaccagcccaucgugaccaucagcgccgacgacaaggacgacaccgccaacggccccagauucaucuucagccugccccccgagaucauccacaaccccaacuucaccgugagagacaacagagacaacaccgccggcguguacgccagaagaggcggcuucagcagacagaagcaggaccuguaccugcugcccaucgugaucagcgacggcggcaucccccccaugagcagcaccaacacccugaccaucaaggugugcggcugcgacgugaacggcgcccugcugagcugcaacgccgaggccuacauccugaacgccggccugagcaccggcgcccugaucgccauccuggccugcaucgugauccugcuggugaucguggugcuguucgugacccugagaagacagaagaaggagccccugaucguguucgaggaggaggacgugagagagaacaucaucaccuacgacgacgagggcggcggcgaggaggacaccgaggccuucgacaucgccacccugcagaaccccgacggcaucaacggcuucauccccagaaaggacaucaagcccgaguaccaguacaugcccagacccggccugagacccgcccccaacagcguggacguggacgacuucaucaacaccagaauccaggaggccgacaacgaccccaccgccccccccuacgacagcauccagaucuacggcuacgagggcagaggcagcguggccggcagccugagcagccuggagagcgccaccaccgacagcgaccuggacuacgacuaccugcagaacuggggccccagauucaagaagcuggccgaccuguacggcagcaaggacaccuucgacgacgacagcuaa

SEQ ID NO: 14956 - RNA, 2283 nt, Artificial Sequence
  CDH13__Homo_sapiens__NP_001207417
augaagaccccccccggcgccagcagcagaaccaagugcagcagagagcugagaagcuucugcgccuucagcugccccagagccaagcagcccaccugcaccgccugguucccccagcaggagcaccccagcgagaacggcccccagaugcccggcagagacccccccgccgccagcaccaugcaggugcugcugcugaccagcgccgaggaccuggacugcacccccggcuuccagcagaagguguuccacaucaaccagcccgccgaguucaucgaggaccagagcauccugaaccugaccuucagcgacugcaagggcaacgacaagcugagauacgaggugagcagccccuacuucaaggugaacagcgacggcggccugguggcccugagaaacaucaccgccgugggcaagacccuguucgugcacgccagaaccccccacgccgaggacauggccgagcuggugaucgugggcggcaaggacauccagggcagccugcaggacaucuucaaguucgccagaaccagccccgugcccagacagaagagaagcaucguggugagccccauccugauccccgagaaccagagacagcccuuccccagagacgugggcaaggugguggacagcgacagacccgagagaagcaaguucagacugaccggcaagggcguggaccaggagcccaagggcaucuucagaaucaacgagaacaccggcagcgugagcgugaccagaacccuggacagagaggugaucgccguguaccagcuguucguggagaccaccgacgugaacggcaagacccuggagggccccgugccccuggaggugaucgugaucgaccagaacgacaacagacccaucuucagagagggccccuacaucggccacgugauggagggcagccccaccggcaccaccgugaugagaaugaccgccuucgacgccgacgaccccgccaccgacaacgcccugcugagauacaacaucagacagcagacccccgacaagcccagccccaacauguucuacaucgaccccgagaagggcgacaucgugaccguggugagccccgcccugcuggacagagagacccuggagaaccccaaguacgagcugaucaucgaggcccaggacauggccggccuggacgugggccugaccggcaccgccaccgccaccaucaugaucgacgacaagaacgaccacagccccaaguucaccaagaaggaguuccaggccaccguggaggagggcgccgugggcgugaucgugaaccugaccguggaggacaaggacgaccccaccaccggcgccuggagagccgccuacaccaucaucaacggcaaccccggccagagcuucgagauccacaccaacccccagaccaacgagggcaugcugagcguggugaagccccuggacuacgagaucagcgccuuccacacccugcugaucaagguggagaacgaggacccccuggugcccgacgugagcuacggccccagcagcaccgccaccgugcacaucaccgugcuggacgugaacgagggccccguguucuaccccgaccccaugauggugaccagacaggaggaccugagcgugggcagcgugcugcugaccgugaacgccaccgaccccgacagccugcagcaccagaccaucagauacagcguguacaaggaccccgccggcuggcugaacaucaaccccaucaacggcaccguggacaccaccgccgugcuggacagagagagccccuucguggacaacagcguguacaccgcccuguuccuggccaucgacagcggcaacccccccgccaccggcaccggcacccugcugaucacccuggaggacgugaacgacaacgcccccuucaucuaccccaccguggccgaggugugcgacgacgccaagaaccugagcguggugauccugggcgccagcgacaaggaccugcaccccaacaccgaccccuucaaguucgagauccacaagcaggccgugcccgacaagguguggaagaucagcaagaucaacaacacccacgcccuggugagccugcugcagaaccugaacaaggccaacuacaaccugcccaucauggugaccgacagcggcaagccccccaugaccaacaucaccgaccugagagugcaggugugcagcugcagaaacagcaagguggacugcaacgccgccggcgcccugagauucagccugcccagcgugcugcugcugagccuguucagccuggccugccuguaa

SEQ ID NO: 14957 - RNA, 2445 nt, Artificial Sequence
  CDH15__Homo_sapiens__NP_004924
auggacgccgccuuccugcuggugcugggccugcuggcccagagccugugccugagccugggcgugcccggcuggagaagacccaccacccuguaccccuggagaagagcccccgcccugagcagagugagaagagccugggugaucccccccaucagcgugagcgagaaccacaagagacugcccuacccccuggugcagaucaagagcgacaagcagcagcugggcagcgugaucuacagcauccagggccccggcguggacgaggagcccagaggcguguucagcaucgacaaguucaccggcaagguguuccugaacgccaugcuggacagagagaagaccgacagauucagacugagagccuucgcccuggaccugggcggcagcacccuggaggaccccaccgaccuggagaucguggugguggaccagaacgacaacagacccgccuuccugcaggaggccuucaccggcagagugcuggagggcgccgugcccggcaccuacgugaccagagccgaggccaccgacgccgacgaccccgagaccgacaacgccgcccugagauucagcauccugcagcagggcagccccgagcuguucagcaucgacgagcugaccggcgagaucagaaccgugcaggugggccuggacagagaggugguggccguguacaaccugacccugcagguggccgacaugagcggcgacggccugaccgccaccgccagcgccaucaucacccuggacgacaucaacgacaacgcccccgaguucaccagagacgaguucuucauggaggccaucgaggccgugagcggcguggacgugggcagacuggagguggaggacagagaccugcccggcagccccaacuggguggccagauucaccauccuggagggcgaccccgacggccaguucaccaucagaaccgaccccaagaccaacgagggcgugcugagcaucgugaaggcccuggacuacgagagcugcgagcacuacgagcugaaggugagcgugcagaacgaggccccccugcaggccgccgcccugagagccgagagaggccaggccaaggugagagugcacgugcaggacaccaacgagccccccguguuccaggagaacccccugagaaccagccuggccgagggcgccccccccggcacccugguggccaccuucagcgccagagaccccgacaccgagcagcugcagagacugagcuacagcaaggacuacgaccccgaggacuggcugcagguggacgccgccaccggcagaauccagacccagcacgugcugagccccgccagccccuuccugaagggcggcugguacagagccaucgugcuggcccaggacgacgccagccagcccagaaccgccaccggcacccugagcaucgagauccuggaggugaacgaccacgcccccgugcuggccccccccccccccggcagccugugcagcgagccccaccagggccccggccugcugcugggcgccaccgacgaggaccugcccccccacggcgcccccuuccacuuccagcugagccccagacugcccgagcugggcagaaacuggagccugagccaggugaacgugagccacgccagacugagacccagacaccaggugcccgagggccugcacagacugagccugcugcugagagacagcggccagcccccccagcagagagagcagccccugaacgugaccgugugcagaugcggcaaggacggcgugugccugcccggcgccgccgcccugcuggccggcggcaccggccugagccugggcgcccuggugaucgugcuggccagcgcccugcugcugcuggugcuggugcugcugguggcccugagagccagauucuggaagcagagcagaggcaagggccugcugcacggcccccaggacgaccugagagacaacgugcugaacuacgacgagcagggcggcggcgaggaggaccaggacgccuacgacaucagccagcugagacaccccaccgcccugagccugccccugggcccccccccccugagaagagacgccccccagggcagacugcacccccagccccccagagugcugcccaccagcccccuggacaucgccgacuucaucaacgacggccuggaggccgccgacagcgaccccagcgugccccccuacgacaccgcccugaucuacgacuacgagggcgacggcagcguggccggcacccugagcagcauccugagcagccagggcgacgaggaccaggacuacgacuaccugagagacuggggccccagauucgccagacuggccgacauguacggccaccccugcggccuggaguacggcgccagaugggaccaccaggccagagagggccugagccccggcgcccugcugcccagacacagaggcagaaccgccuaa

SEQ ID NO: 14958 - RNA, 2424 nt, Artificial Sequence
  CDH16__Homo_sapiens__NP_001191673
auggugcccgccuggcuguggcugcugugcgugagcgugccccaggcccugcccaaggcccagcccgccgagcugagcguggaggugcccgagaacuacggcggcaacuucccccuguaccugaccaagcugccccugcccagagagggcgccgagggccagaucgugcugagcggcgacagcggcaaggccaccgagggccccuucgccauggaccccgacagcggcuuccugcuggugaccagagcccuggacagagaggagcaggccgaguaccagcugcaggugacccuggagaugcaggacggccacgugcuguggggcccccagcccgugcuggugcacgugaaggacgagaacgaccaggugccccacuucagccaggccaucuacagagccagacugagcagaggcaccagacccggcauccccuuccuguuccuggaggccagcgacagagacgagcccggcaccgccaacagcgaccugagauuccacauccugagccaggcccccgcccagcccagccccgacauguuccagcuggagcccagacugggcgcccuggcccugagccccaagggcagcaccagccuggaccacgcccuggagagaaccuaccagcugcuggugcaggugaaggacaugggcgaccaggccagcggccaccaggccaccgccaccguggaggugagcaucaucgagagcaccugggugagccuggagcccauccaccuggccgagaaccugaaggugcuguacccccaccacauggcccaggugcacuggagcggcggcgacgugcacuaccaccuggagagccacccccccggccccuucgaggugaacgccgagggcaaccuguacgugaccagagagcuggacagagaggcccaggccgaguaccugcugcaggugagagcccagaacagccacggcgaggacuacgccgccccccuggagcugcacgugcuggugauggacgagaacgacaacgugcccaucugcccccccagagaccccaccgugagcauccccgagcugagcccccccggcaccgaggugaccagacugagcgccgaggacgccgacgcccccggcagccccaacagccacgugguguaccagcugcugagccccgagcccgaggacggcguggagggcagagccuuccagguggaccccaccagcggcagcgugacccugggcgugcugccccugagagccggccagaacauccugcugcuggugcuggccauggaccuggccggcgccgagggcggcuucagcagcaccugcgagguggagguggccgugaccgacaucaacgaccacgcccccgaguucaucaccagccagaucggccccaucagccugcccgaggacguggagcccggcacccugguggccaugcugaccgccaucgacgccgaccuggagcccgccuucagacugauggacuucgccaucgagagaggcgacaccgagggcaccuucggccuggacugggagcccgacagcggccacgugagacugagacugugcaagaaccugagcuacgaggccgcccccagccacgaggugguggugguggugcagagcguggccaagcuggugggccccggccccggccccggcgccaccgccaccgugaccgugcugguggagagagugaugcccccccccaagcuggaccaggagagcuacgaggccagcgugcccaucagcgcccccgccggcagcuuccugcugaccauccagcccagcgaccccaucagcagaacccugagauucagccuggugaacgacagcgagggcuggcugugcaucgagaaguucagcggcgaggugcacaccgcccagagccugcagggcgcccagcccggcgacaccuacaccgugcugguggaggcccaggacaccgcccugacccuggcccccgugcccagccaguaccugugcacccccagacaggaccacggccugaucgugagcggccccagcaaggaccccgaccuggccagcggccacggccccuacagcuucacccugggccccaaccccaccgugcagagagacuggagacugcagacccugaacggcagccacgccuaccugacccuggcccugcacuggguggagcccagagagcacaucauccccgugguggugagccacaacgcccagauguggcagcugcuggugagagugaucgugugcagaugcaacguggagggccagugcaugagaaaggugggcagaaugaagggcaugcccaccaagcugagcgccgugggcauccuggugggcacccugguggccaucggcaucuuccugauccugaucuucacccacuggaccaugagcagaaagaaggaccccgaccagcccgccgacagcgugccccugaaggccaccguguaa

SEQ ID NO: 14959 - RNA, 2499 nt, Artificial Sequence
  CDH17__Homo_sapiens__NP_001138135
augauccugcaggcccaccugcacagccugugccugcugaugcuguaccuggccaccggcuacggccaggagggcaaguucagcggcccccugaagcccaugaccuucagcaucuacgagggccaggagcccagccagaucaucuuccaguucaaggccaacccccccgccgugaccuucgagcugaccggcgagaccgacaacaucuucgugaucgagagagagggccugcuguacuacaacagagcccuggacagagagaccagaagcacccacaaccugcagguggccgcccuggacgccaacggcaucaucguggagggccccgugcccaucaccaucaaggugaaggacaucaacgacaacagacccaccuuccugcagagcaaguacgagggcagcgugagacagaacagcagacccggcaagcccuuccuguacgugaacgccaccgaccuggacgaccccgccacccccaacggccagcuguacuaccagaucgugauccagcugcccaugaucaacaacgugauguacuuccagaucaacaacaagaccggcgccaucagccugaccagagagggcagccaggagcugaaccccgccaagaaccccagcuacaaccuggugaucagcgugaaggacaugggcggccagagcgagaacagcuucagcgacaccaccagcguggacaucaucgugaccgagaacaucuggaaggcccccaagcccguggagaugguggagaacagcaccgacccccaccccaucaagaucacccaggugagauggaacgaccccggcgcccaguacagccugguggacaaggagaagcugcccagauuccccuucagcaucgaccaggagggcgacaucuacgugacccagccccuggacagagaggagaaggacgccuacguguucuacgccguggccaaggacgaguacggcaagccccugagcuacccccuggagauccacgugaaggugaaggacaucaacgacaacccccccaccugccccagccccgugaccguguucgaggugcaggagaacgagagacugggcaacagcaucggcacccugaccgcccacgacagagacgaggagaacaccgccaacagcuuccugaacuacagaaucguggagcagacccccaagcugcccauggacggccuguuccugauccagaccuacgccggcaugcugcagcuggccaagcagagccugaagaagcaggacaccccccaguacaaccugaccaucgaggugagcgacaaggacuucaagacccugugcuucgugcagaucaacgugaucgacaucaacgaccagauccccaucuucgagaagagcgacuacggcaaccugacccuggccgaggacaccaacaucggcagcaccauccugaccauccaggccaccgacgccgacgagcccuucaccggcagcagcaagauccuguaccacaucaucaagggcgacagcgagggcagacugggcguggacaccgacccccacaccaacaccggcuacgugaucaucaagaagccccuggacuucgagaccgccgccgugagcaacaucguguucaaggccgagaaccccgagccccugguguucggcgugaaguacaacgccagcagcuucgccaaguucacccugaucgugaccgacgugaacgaggccccccaguucagccagcacguguuccaggccaaggugagcgaggacguggccaucggcaccaaggugggcaacgugaccgccaaggaccccgagggccuggacaucagcuacagccugagaggcgacaccagaggcuggcugaagaucgaccacgugaccggcgagaucuucagcguggccccccuggacagagaggccggcagccccuacagagugcaggugguggccaccgaggugggcggcagcagccugagcagcgugagcgaguuccaccugauccugauggacgugaacgacaacccccccagacuggccaaggacuacaccggccuguucuucugccacccccugagcgcccccggcagccugaucuucgaggccaccgacgacgaccagcaccuguucagaggcccccacuucaccuucagccugggcagcggcagccugcagaacgacugggaggugagcaagaucaacggcacccacgccagacugagcaccagacacaccgaguucgaggagagagaguacguggugcugaucagaaucaacgacggcggcagacccccccuggagggcaucgugagccugcccgugaccuucugcagcugcguggagggcagcugcuucagacccgccggccaccagaccggcauccccaccgugggcauggccgugggcauccugcugaccacccugcuggugaucggcaucauccuggccgugguguucaucagaaucaagaaggacaagggcaaggacaacguggagagcgcccaggccagcgaggugaagccccugagaagcuaa

SEQ ID NO: 14960 - RNA, 1725 nt, Artificial Sequence
  CDH18__Homo_sapiens__NP_001161139
augaagaucaccagcaccagcugcaucugccccgugcuggugugccugugcuucgugcagagaugcuacggcaccgcccaccacagcagcaucaaggugaugagaaaccagaccaagcacaucgagggcgagaccgaggugcaccacagacccaagagaggcuggguguggaaccaguucuucgugcuggaggagcacaugggccccgacccccaguacgugggcaagcugcacagcaacagcgacaagggcgacggcagcgugaaguacauccugaccggcgagggcgccggcaccaucuucaucaucgacgacaccaccggcgacauccacagcaccaagagccuggacagagagcagaagacccacuacgugcugcacgcccaggccaucgacagaagaaccaacaagccccuggagcccgagagcgaguucaucaucaaggugcaggacaucaacgacaacgcccccaaguucaccgacggccccuacaucgugaccgugcccgagaugagcgacaugggcaccagcgugcugcaggugaccgccaccgacgccgacgaccccaccuacggcaacagcgccagagugguguacagcauccugcagggccagcccuacuucagcguggaccccaagaccggcgugaucagaaccgcccugcacaacauggacagagaggccagagagcacuacagcguggugauccaggccaaggacauggccggccaggugggcggccugagcggcagcaccaccgugaacaucacccugaccgacgugaacgacaacccccccagauucccccagaagcacuaccagcuguacgugcccgagagcgcccaggugggcagcgccgugggcaagaucaaggccaacgacgccgacaccggcagcaacgccgacaugaccuacagcaucaucaacggcgacggcaugggcaucuucagcaucagcaccgacaaggagaccagagagggcauccugagccugaagaagccccugaacuacgagaagaagaagagcuacacccugaacaucgagggcgccaacacccaccuggacuucagauucagccaccugggccccuucaaggacgccaccaugcugaagaucaucgugggcgacguggacgagcccccccuguucagcaugcccagcuaccugauggagguguacgagaacgccaagaucggcaccguggugggcaccgugcuggcccaggaccccgacagcaccaacagccuggugagauacuucaucaacuacaacguggaggacgacagauucuucaacaucgacgccaacaccggcaccaucagaaccaccaaggugcuggacagagaggagacccccugguacaacaucaccgugaccgccagcgagaucgacaaccccgaccugcugagccacgugaccgugggcaucagagugcuggacgugaacgacaacccccccgagcuggccagagaguacgacaucaucgugugcgagaacagcaagcccggccaggugauccacaccaucagcgccaccgacaaggacgacuucgccaacggccccagauucaacuucuuccuggacgagagacugcccgugaaccccaacuucacccugaaggacaacgaggccgccgcccccagccccagcggcuucgugcacgccagagagaugggcgugugcggccccgccaugcagaagcccagcugccccagacugguguaa

SEQ ID NO: 14961 - RNA, 1473 nt, Artificial Sequence
  CDH19__Homo_sapiens__NP_001257957
augaacugcuaccugcugcugagauucaugcugggcaucccccugcuguggcccugccugggcgccaccgagaacagccagaccaagaaggugaagcagcccgugagaagccaccugagagugaagagaggcuggguguggaaccaguucuucgugcccgaggagaugaacaccaccagccaccacaucggccagcugagaagcgaccuggacaacggcaacaacagcuuccaguacaagcugcugggcgccggcgccggcagcaccuucaucaucgacgagagaaccggcgacaucuacgccauccagaagcuggacagagaggagagaagccuguacauccugagagcccaggugaucgacaucgccaccggcagagccguggagcccgagagcgaguucgugaucaaggugagcgacaucaacgacaacgagcccaaguuccuggacgagcccuacgaggccaucgugcccgagaugagccccgagggcacccuggugauccaggugaccgccagcgacgccgacgaccccagcagcggcaacaacgccagacugcuguacagccugcugcagggccagcccuacuucagcguggagcccaccaccggcgugaucagaaucagcagcaagauggacagagagcugcaggacgaguacugggugaucauccaggccaaggacaugaucggccagcccggcgcccugagcggcaccaccagcgugcugaucaagcugagcgacgugaacgacaacaagcccaucuucaaggagagccuguacagacugaccgugagcgagagcgcccccaccggcaccagcaucggcaccaucauggccuacgacaacgacaucggcgagaacgccgagauggacuacagcaucgaggaggacgacagccagaccuucgacaucaucaccaaccacgagacccaggagggcaucgugauccugaagaagaagguggacuucgagcaccagaaccacuacggcaucagagccaaggugaagaaccaccacgugcccgagcagcugaugaaguaccacaccgaggccagcaccaccuucaucaagauccagguggaggacguggacgagcccccccuguuccugcugcccuacuacguguucgagguguucgaggagaccccccagggcagcuucgugggcguggugagcgccaccgaccccgacaacagaaagagccccaucagauacagcaucaccagaagcaagguguucaacaucaacgacaacggcaccaucaccaccagcaacagccuggacagagagaucagcgccugguacaaccugagcaucaccgccaccgagaaguacaacaucgagcagaucagcagcaucccccuguacgugcaggugcugaacaucaacgaccacgcccccgaguucagccaguacuacgagaccuacgugugcgagaacgccggcagcggccagggccuguucuucuaa

SEQ ID NO: 14962 - RNA, 2649 nt, Artificial Sequence
  CDH1__Homo_sapiens__NP_004351
augggccccuggagcagaagccugagcgcccugcugcugcugcugcaggugagcagcuggcugugccaggagcccgagcccugccaccccggcuucgacgccgagagcuacaccuucaccgugcccagaagacaccuggagagaggcagagugcugggcagagugaacuucgaggacugcaccggcagacagagaaccgccuacuucagccuggacaccagauucaaggugggcaccgacggcgugaucaccgugaagagaccccugagauuccacaacccccagauccacuuccugguguacgccugggacagcaccuacagaaaguucagcaccaaggugacccugaacaccgugggccaccaccacagaccccccccccaccaggccagcgugagcggcauccaggccgagcugcugaccuuccccaacagcagccccggccugagaagacagaagagagacugggugaucccccccaucagcugccccgagaacgagaagggccccuuccccaagaaccuggugcagaucaagagcaacaaggacaaggagggcaagguguucuacagcaucaccggccagggcgccgacaccccccccgugggcguguucaucaucgagagagagaccggcuggcugaaggugaccgagccccuggacagagagagaaucgccaccuacacccuguucagccacgccgugagcagcaacggcaacgccguggaggaccccauggagauccugaucaccgugaccgaccagaacgacaacaagcccgaguucacccaggagguguucaagggcagcgugauggagggcgcccugcccggcaccagcgugauggaggugaccgccaccgacgccgacgacgacgugaacaccuacaacgccgccaucgccuacaccauccugagccaggaccccgagcugcccgacaagaacauguucaccaucaacagaaacaccggcgugaucagcguggugaccaccggccuggacagagagagcuuccccaccuacacccugguggugcaggccgccgaccugcagggcgagggccugagcaccaccgccaccgccgugaucaccgugaccgacaccaacgacaacccccccaucuucaaccccaccaccuacaagggccaggugcccgagaacgaggccaacguggugaucaccacccugaaggugaccgacgccgacgcccccaacacccccgccugggaggccguguacaccauccugaacgacgacggcggccaguucguggugaccaccaaccccgugaacaacgacggcauccugaagaccgccaagggccuggacuucgaggccaagcagcaguacauccugcacguggccgugaccaacguggugcccuucgaggugagccugaccaccagcaccgccaccgugaccguggacgugcuggacgugaacgaggcccccaucuucgugccccccgagaagagaguggaggugagcgaggacuucggcgugggccaggagaucaccagcuacaccgcccaggagcccgacaccuucauggagcagaagaucaccuacagaaucuggagagacaccgccaacuggcuggagaucaaccccgacaccggcgccaucagcaccagagccgagcuggacagagaggacuucgagcacgugaagaacagcaccuacaccgcccugaucaucgccaccgacaacggcagccccguggccaccggcaccggcacccugcugcugauccugagcgacgugaacgacaacgcccccauccccgagcccagaaccaucuucuucugcgagagaaaccccaagccccaggugaucaacaucaucgacgccgaccugccccccaacaccagccccuucaccgccgagcugacccacggcgccagcgccaacuggaccauccaguacaacgaccccacccaggagagcaucauccugaagcccaagauggcccuggaggugggcgacuacaagaucaaccugaagcugauggacaaccagaacaaggaccaggugaccacccuggaggugagcgugugcgacugcgagggcgccgccggcgugugcagaaaggcccagcccguggaggccggccugcagauccccgccauccugggcauccugggcggcauccuggcccugcugauccugauccugcugcugcugcuguuccugagaagaagagccguggugaaggagccccugcugccccccgaggacgacaccagagacaacguguacuacuacgacgaggagggcggcggcgaggaggaccaggacuucgaccugagccagcugcacagaggccuggacgccagacccgaggugaccagaaacgacguggcccccacccugaugagcgugcccagauaccugcccagacccgccaaccccgacgagaucggcaacuucaucgacgagaaccugaaggccgccgacaccgaccccaccgccccccccuacgacagccugcugguguucgacuacgagggcagcggcagcgaggccgccagccugagcagccugaacagcagcgagagcgacaaggaccaggacuacgacuaccugaacgaguggggcaacagauucaagaagcuggccgacauguacggcggcggcgaggacgacuaa

SEQ ID NO: 14963 - RNA, 2406 nt, Artificial Sequence
  CDH20__Homo_sapiens__XP_005266739
auguggaccagcggcagaaugagcaacgccaagaacuggcugggccugggcaugagccuguacuucuggggccugauggaccugaccaccaccgugcugagcgacacccccaccccccagggcgagcuggaggcccugcugagcgacaagccccagagccaccagagaaccaagagaagcuggguguggaaccaguucuucgugcuggaggaguacaccggcaccgacccccuguacgugggcaagcugcacagcgacauggacagaggcgacggcagcaucaaguacauccugagcggcgagggcgccggcaucguguucaccaucgacgacaccaccggcgacauccacgccauccagagacuggacagagaggagagagcccaguacacccugagagcccaggcccuggacagaagaaccggcagacccauggagcccgagagcgaguucaucaucaagauccaggacaucaacgacaacgagcccaaguuccuggacggccccuacguggccaccgugcccgagaugagccccgugggcaccagcgugauccaggugaccgccaccgacgccgacgaccccaccuacggcaacagcgccagagugguguacagcauccugcagggccagcccuacuucagcguggacagcaagaccggcgugaucagaaccgcccugaugaacauggacagagaggccaaggaguacuacgaggugaucauccaggccaaggacaugggcggccagcugggcggccuggccggcaccaccaccgugaacaucacccugagcgacgugaacgacaacccccccagauucccccagaagcacuaccagaugagcgugcuggagagcgcccccaucagcagcaccgugggcagaguguucgccaaggaccuggacgagggcaucaacgccgagaugaaguacaccaucguggacggcgacggcgccgacgccuucgacaucagcaccgaccccaacuuccaggugggcaucaucaccgugaagaagccccugagcuucgagagcaagaagagcuacacccugaagguggagggcgccaacccccaccuggagaugagauuccugaaccugggccccuuccaggacaccaccaccgugcacaucagcguggaggacguggacgagccccccguguucgagcccggcuucuacuucguggaggugcccgaggacguggccaucggcaccaccauccagaucaucagcgccaaggaccccgacgugaccaacaacagcaucagauacagcaucgacagaagcagcgaccccggcagauucuucuacguggacaucaccaccggcgcccugaugaccgccagaccccuggacagagaggaguucagcuggcacaacaucaccgugcuggccauggagaugaacaaccccagccaggugggcagcgugcccgugaccaucaaggugcuggacgugaacgacaacgcccccgaguuccccagauucuacgaggccuucgugugcgagaacgccaaggccggccagcugauccagaccgugagcgccguggaccaggacgaccccagaaacggccagcacuucuacuacagccuggcccccgaggccgccaacaaccccaacuucaccaucagagacaaccaggacaacaccgccagaauccugaccagaagaagcggcuucagacagcaggagcagagcguguuccaccugcccauccugaucgccgacagcggccagcccgugcugagcagcaccggcacccugaccauccaggugugcagcugcgacgacgacggccacgugaugagcugcagccccgaggccuacaugcugcccgugagccugagcagaggcgcccugaucgccauccuggccugcaucuucgugcugcuggugcuggugcugcugauccugagcaugagaagacacagaaagcagcccuacaucaucgacgacgaggagaacauccacgagaacaucgugagauacgacgacgagggcggcggcgaggaggacaccgaggccuucgacaucgccgccauguggaaccccagagaggcccaggccggcgccgcccccaagaccagacaggacaugcugcccgagaucgagagccugagcagauacgugccccagaccugcgccgugaacagcaccgugcacagcuacgugcuggccaagcuguacgaggccgacauggaccugugggccccccccuucgacagccugcagaccuacauguucgagggcgacggcagcguggccggcagccugagcagccugcagagcgccaccagcgacagcgagcagagcuucgacuuccugaccgacuggggccccagauucagaaagcuggccgagcuguacggcgccagcgagggccccgccccccugugguaa

SEQ ID NO: 14964 - RNA, 2487 nt, Artificial Sequence
  CDH22__Homo_sapiens__XP_011527296
augagacccagacccgagggcagaggccugagagccggcguggcccugagccccgcccugcugcugcugcugcugcugccccccccccccacccugcugggcagacugugggccgccggcacccccagccccagcgcccccggcgccagacaggacggcgcccugggcgccggcagagugaagagaggcuggguguggaaccaguucuucgugguggaggaguacaccggcaccgagccccuguacgugggcaagauccacagcgacagcgacgagggcgacggcgccaucaaguacaccaucagcggcgagggcgccggcaccaucuuccugaucgacgagcugaccggcgacauccacgccauggagagacuggacagagagcagaagaccuucuacacccugagagcccaggccagagacagagccaccaacagacugcuggagcccgagagcgaguucaucaucaaggugcaggacaucaacgacagcgagcccagauuccugcacggccccuacaucggcagcguggccgagcugagccccaccggcaccagcgugaugcaggugauggccagcgacgccgacgaccccaccuacggcagcagcgccagacugguguacagcgugcuggacggcgagcaccacuucaccguggaccccaagaccggcgugaucagaaccgccgugcccgaccuggacagagagagccaggagagauacgagguggugauccaggccaccgacauggccggccagcugggcggccugagcggcagcaccaccgugaccaucguggugaccgacgugaacgacaacccccccagauucccccagaagauguaccaguucagcauccaggagagcgcccccaucggcaccgccgugggcagagugaaggccgaggacagcgacgugggcgagaacaccgacaugaccuaccaccugaaggacgagagcagcagcggcggcgacguguucaaggugaccaccgacagcgacacccaggaggccaucaucguggugcagaagagacuggacuucgagagccagcccgugcacaccgugauccuggaggcccugaacaaguucguggaccccagauucgccgaccugggcaccuucagagaccaggccaucgugagaguggccgugaccgacguggacgagccccccgaguucagaccccccagcggccugcuggaggugcaggaggacgcccaggugggcagccuggugggcguggugaccgccagagaccccgacgccgccaacagacccgugagauacgccaucgacagagagagcgaccuggaccagaucuucgacaucgacgccgacaccggcgccaucgugaccggcaagggccuggacagagagaccgccggcuggcacaacaucaccgugcuggccauggaggccgacaaccacgcccagcugagcagagccagccugagaaucagaauccuggacgugaacgacaacccccccgagcuggccacccccuacgaggccgccgugugcgaggacgccaagcccggccagcugauccagaccaucagcgugguggacagagacgagccccagggcggccacagauucuacuucagacuggugcccgaggcccccagcaacccccacuucagccugcuggacauccaggacaacaccgccgccgugcacacccagcacgugggcuucaacagacaggagcaggacguguucuuccugcccauccuggugguggacagcggcccccccacccugagcagcaccggcacccugaccaucagaaucugcggcugcgacagcagcggcaccauccagagcugcaacaccaccgccuucgugauggccgccagccugagccccggcgcccugaucgcccugcuggugugcgugcugauccugguggugcuggugcugcugauccugacccugagaagacaccacaagagccaccugagcagcgacgaggacgaggacaugagagacaacgugaucaaguacaacgacgagggcggcggcgagcaggacaccgaggccuacgacaugagcgcccugagaagccuguacgacuucggcgagcugaagggcggcgacggcggcggcagcgccggcggcggcgccggcggcggcagcggcggcggcgccggcagccccccccaggcccaccugcccagcgagagacacagccugccccagggcccccccagccccgagcccgacuucagcguguucagagacuucaucagcagaaagguggcccuggccgacggcgaccugagcgugccccccuacgacgccuuccagaccuacgccuucgagggcgccgacagccccgccgccagccugagcagccugcacagcggcagcagcggcagcgagcaggacuucgccuaccugagcagcuggggccccagauucagaccccuggccgcccuguacgccggccacagaggcgacgacgaggcccaggccagcuaa

SEQ ID NO: 14965 - RNA, 4146 nt, Artificial Sequence
  CDH23__Homo_sapiens__NP_001165401
augggcagacacguggccaccagcugccacguggccuggcugcuggugcugaucagcggcugcuggggccaggugaacagacugcccuucuucaccaaccacuucuucgacaccuaccugcugaucagcgaggacacccccgugggcagcagcgugacccagcugcuggcccaggacauggacaacgacccccugguguucggcgugagcggcgaggaggccagcagauucuucgccguggagcccgacaccggcgugguguggcugagacagccccuggacagagagaccaagagcgaguucaccguggaguucagcgugagcgaccaccagggcgugaucaccagaaaggugaacauccaggugggcgacgugaacgacaacgcccccaccuuccacaaccagcccuacagcgugagaauccccgagaacacccccgugggcacccccaucuucaucgugaacgccaccgaccccgaccugggcgccggcggcagcgugcuguacagcuuccagccccccagccaguucuucgccaucgacagcgccagaggcaucgugaccgugaucagagagcuggacuacgagaccacccaggccuaccagcugaccgugaacgccaccgaccaggacaagaccagaccccugagcacccuggccaaccuggccaucaucaucaccgacgugcaggacauggaccccaucuucaucaaccugcccuacagcaccaacaucuacgagcacagcccccccggcaccaccgugagaaucaucaccgccaucgaccaggacaagggcagacccagaggcaucggcuacaccaucgugagcggcaacaccaacagcaucuucgcccuggacuacaucagcggcgugcugacccugaacggccugcuggacagagagaacccccuguacagccacggcuucauccugaccgugaagggcaccgagcugaacgacgacagaacccccagcgacgccaccgugaccaccaccuucaacauccuggugaucgacaucaacgacaacgcccccgaguucaacagcagcgaguacagcguggccaucaccgagcuggcccaggugggcuucgcccugccccuguucauccaggugguggacaaggacgagaaccugggccugaacagcauguucgagguguaccuggugggcaacaacagccaccacuucaucaucagccccaccagcgugcagggcaaggccgacaucagaaucagaguggccaucccccuggacuacgagaccguggacagauacgacuucgaccuguucgccaacgagagcgugcccgaccacgugggcuacgccaaggugaagaucacccugaucaacgagaacgacaacagacccaucuucagccagccccuguacaacaucagccuguacgagaacgugaccgugggcaccagcgugcugaccgugcuggccaccgacaacgacgccggcaccuucggcgaggugagcuacuucuucagcgacgaccccgacagauucagccuggacaaggacaccggccugaucaugcugaucgccagacuggacuacgagcugauccagagauucacccugaccaucaucgccagagacggcggcggcgaggagaccaccggcagagugagaaucaacgugcuggacgugaacgacaacgugcccaccuuccagaaggacgccuacgugggcgcccugagagagaacgagcccagcgugacccagcuggugagacugagagccaccgacgaggacagcccccccaacaaccagaucaccuacagcaucgugagcgccagcgccuucggcagcuacuucgacaucagccuguacgagggcuacggcgugaucagcgugagcagaccccuggacuacgagcagaucagcaacggccugaucuaccugaccgugauggccauggacgccggcaaccccccccugaacagcaccgugcccgugaccaucgagguguucgacgagaacgacaacccccccaccuucagcaagcccgccuacuucgugagcgugguggagaacaucauggccggcgccaccgugcuguuccugaacgccaccgaccuggacagaagcagagaguacggccaggagagcaucaucuacagccuggagggcagcacccaguucagaaucaacgccagaagcggcgagaucaccaccaccagccugcuggacagagagaccaagagcgaguacauccugaucgugagagccguggacggcggcgugggccacaaccagaagaccggcaucgccaccgugaacaucacccugcuggacaucaacgacaaccaccccaccuggaaggacgcccccuacuacaucaaccugguggagaugaccccccccgacagcgacgugaccaccgugguggccguggaccccgaccugggcgagaacggcacccugguguacagcauccagccccccaacaaguucuacagccugaacagcaccaccggcaagaucagaaccacccacgccaugcuggacagagagaaccccgacccccacgaggccgagcugaugagaaagaucguggugagcgugaccgacugcggcagacccccccugaaggccaccagcagcgccaccguguucgugaaccugcuggaccugaacgacaacgaccccaccuuccagaaccugcccuucguggccgaggugcuggagggcauccccgccggcgugagcaucuaccaggugguggccaucgaccuggacgagggccugaacggccuggugagcuacagaaugcccgugggcaugcccagaauggacuuccugaucaacagcagcagcggcgugguggugaccaccaccgagcuggacagagagagaaucgccgaguaccagcugagagugguggccagcgacgccggcacccccaccaagagcagcaccagcacccugaccauccacgugcuggacgugaacgacgagacccccaccuucuuccccgccguguacaacgugagcgugagcgaggacgugcccagagaguucagagugguguggcugaacugcaccgacaacgacgugggccugaacgccgagcugagcuacuucaucaccggcggcaacguggacggcaaguucagcgugggcuacagagacgccguggugagaaccguggugggccuggacagagagaccaccgccgccuacaugcugauccuggaggccaucgacaacggccccgugggcaagagacacaccggcaccgccaccguguucgugaccgugcuggacgugaacgacaacagacccaucuuccugcagagcagcuacgaggccagcgugcccgaggacauccccgagggccacagcauccugcagcugaaggccaccgacgccgacgagggcgaguucggcagagugugguacagaauccugcacggcaaccacggcaacaacuucagaauccacgugagcaacggccugcugaugagaggccccagaccccuggacagagagagaaacagcagccacgugcugaucguggaggccuacaaccacgaccugggccccaugagaagcagcgugagagugaucguguacguggaggacaucaacgacgaggcccccguguucacccagcagcaguacagcagacugggccugagagagaccgccggcaucggcaccagcgugaucguggugcaggccaccgacagagacagcggcgacggcggccuggugaacuacagaauccugagcggcgccgagggcaaguucgagaucgacgagagcaccggccugaucaucaccgugaacuaccuggacuacgagaccaagaccagcuacaugaugaacgugagcgccaccgaccaggccccccccuucaaccagggcuucugcagcguguacaucacccugcugaacgagcuggacgaggccgugcaguucagcaacgccagcuacgaggccgccauccuggagaaccuggcccugggcaccgagaucgugagagugcaggccuacagcaucgacaaccugaaccagaucaccuacagauucaacgccuacaccagcacccaggccaaggcccuguucaagaucgacgccaucaccgugagaggcuggggccagggcgcccccuuccugcccaucuaa

SEQ ID NO: 14966 - RNA, 498 nt, Artificial Sequence
  CDH26__Homo_sapiens__NP_068582
augaagccccugaucuggaccuggagcgacguggagggccagagacccgcccugcugaucugcaccgccgccgccggccccacccagggcgugaaggaccuggaggaggugccccccagcgccgccagccagagcgcccaggccagaugcgcccugggcagcuggggcuacggcaagcccuucgagcccagaagcgugaagaacauccacagcacccccgccuaccccgacgccaccaugcacagacagcugcuggcccccguggagggcagaauggccgagacccugaaccagaagcugcacguggccaacgugcuggaggacgaccccggcuaccugccccacguguacagcgaggagggcgagugcggcggcgcccccagccugagcagccuggccagccuggagcaggagcugcagcccgaccugcuggacagccugggcagcaaggccacccccuucgaggagaucuacagcgagagcggcgugcccagcuaa

SEQ ID NO: 14967 - RNA, 2721 nt, Artificial Sequence
  CDH2__Homo_sapiens__NP_001783
augugcagaaucgccggcgcccugagaacccugcugccccugcuggccgcccugcugcaggccagcguggaggccagcggcgagaucgcccugugcaagaccggcuuccccgaggacguguacagcgccgugcugagcaaggacgugcacgagggccagccccugcugaacgugaaguucagcaacugcaacggcaagagaaaggugcaguacgagagcagcgagcccgccgacuucaagguggacgaggacggcaugguguacgccgugagaagcuucccccugagcagcgagcacgccaaguuccugaucuacgcccaggacaaggagacccaggagaaguggcagguggccgugaagcugagccugaagcccacccugaccgaggagagcgugaaggagagcgccgagguggaggagaucguguuccccagacaguucagcaagcacagcggccaccugcagagacagaagagagacugggugaucccccccaucaaccugcccgagaacagcagaggccccuucccccaggagcuggugagaaucagaagcgacagagacaagaaccugagccugagauacagcgugaccggccccggcgccgaccagccccccaccggcaucuucaucaucaaccccaucagcggccagcugagcgugaccaagccccuggacagagagcagaucgccagauuccaccugagagcccacgccguggacaucaacggcaaccagguggagaaccccaucgacaucgugaucaacgugaucgacaugaacgacaacagacccgaguuccugcaccagguguggaacggcaccgugcccgagggcagcaagcccggcaccuacgugaugaccgugaccgccaucgacgccgacgaccccaacgcccugaacggcaugcugagauacagaaucgugagccaggcccccagcacccccagccccaacauguucaccaucaacaacgagaccggcgacaucaucaccguggccgccggccuggacagagagaaggugcagcaguacacccugaucauccaggccaccgacauggagggcaaccccaccuacggccugagcaacaccgccaccgccgugaucaccgugaccgacgugaacgacaacccccccgaguucaccgccaugaccuucuacggcgaggugcccgagaacagaguggacaucaucguggccaaccugaccgugaccgacaaggaccagccccacacccccgccuggaacgccguguacagaaucagcggcggcgaccccaccggcagauucgccauccagaccgaccccaacagcaacgacggccuggugaccguggugaagcccaucgacuucgagaccaacagaauguucgugcugaccguggccgccgagaaccaggugccccuggccaagggcauccagcaccccccccagagcaccgccaccgugagcgugaccgugaucgacgugaacgagaaccccuacuucgcccccaaccccaagaucaucagacaggaggagggccugcacgccggcaccaugcugaccaccuucaccgcccaggaccccgacagauacaugcagcagaacaucagauacaccaagcugagcgaccccgccaacuggcugaagaucgaccccgugaacggccagaucaccaccaucgccgugcuggacagagagagccccaacgugaagaacaacaucuacaacgccaccuuccuggccagcgacaacggcaucccccccaugagcggcaccggcacccugcagaucuaccugcuggacaucaacgacaacgccccccaggugcugccccaggaggccgagaccugcgagacccccgaccccaacagcaucaacaucaccgcccuggacuacgacaucgaccccaacgccggccccuucgccuucgaccugccccugagccccgugaccaucaagagaaacuggaccaucaccagacugaacggcgacuucgcccagcugaaccugaagaucaaguuccuggaggccggcaucuacgaggugcccaucaucaucaccgacagcggcaacccccccaagagcaacaucagcauccugagagugaaggugugccagugcgacagcaacggcgacugcaccgacguggacagaaucgugggcgccggccugggcaccggcgccaucaucgccauccugcugugcaucaucauccugcugauccuggugcugauguucgugguguggaugaagagaagagacaaggagagacaggccaagcagcugcugaucgaccccgaggacgacgugagagacaacauccugaaguacgacgaggagggcggcggcgaggaggaccaggacuacgaccugagccagcugcagcagcccgacaccguggagcccgacgccaucaagcccgugggcaucagaagaauggacgagagacccauccacgccgagccccaguaccccgugagaagcgccgccccccaccccggcgacaucggcgacuucaucaacgagggccugaaggccgccgacaacgaccccaccgccccccccuacgacagccugcugguguucgacuacgagggcagcggcagcaccgccggcagccugagcagccugaacagcagcagcagcggcggcgagcaggacuacgacuaccugaacgacuggggccccagauucaagaagcuggccgacauguacggcggcggcgacgacuaa

SEQ ID NO: 14968 - RNA, 2490 nt, Artificial Sequence
  CDH3__Homo_sapiens__NP_001784
augggccugcccagaggcccccuggccagccugcugcugcugcaggugugcuggcugcagugcgccgccagcgagcccugcagagccguguucagagaggccgaggugacccuggaggccggcggcgccgagcaggagcccggccaggcccugggcaagguguucaugggcugccccggccaggagcccgcccuguucagcaccgacaacgacgacuucaccgugagaaacggcgagaccgugcaggagagaagaagccugaaggagagaaacccccugaagaucuuccccagcaagagaauccugagaagacacaagagagacugggugguggcccccaucagcgugcccgagaacggcaagggccccuucccccagagacugaaccagcugaagagcaacaaggacagagacaccaagaucuucuacagcaucaccggccccggcgccgacagcccccccgagggcguguucgccguggagaaggagaccggcuggcugcugcugaacaagccccuggacagagaggagaucgccaaguacgagcuguucggccacgccgugagcgagaacggcgccagcguggaggaccccaugaacaucagcaucaucgugaccgaccagaacgaccacaagcccaaguucacccaggacaccuucagaggcagcgugcuggagggcgugcugcccggcaccagcgugaugcaggugaccgccaccgacgaggacgacgccaucuacaccuacaacggcgugguggccuacagcauccacagccaggagcccaaggacccccacgaccugauguucaccauccacagaagcaccggcaccaucagcgugaucagcagcggccuggacagagagaaggugcccgaguacacccugaccauccaggccaccgacauggacggcgacggcagcaccaccaccgccguggccgugguggagauccuggacgccaacgacaacgcccccauguucgacccccagaaguacgaggcccacgugcccgagaacgccgugggccacgaggugcagagacugaccgugaccgaccuggacgcccccaacagccccgccuggagagccaccuaccugaucaugggcggcgacgacggcgaccacuucaccaucaccacccaccccgagagcaaccagggcauccugaccaccagaaagggccuggacuucgaggccaagaaccagcacacccuguacguggaggugaccaacgaggcccccuucgugcugaagcugcccaccagcaccgccaccaucguggugcacguggaggacgugaacgaggcccccguguucgugccccccagcaaggugguggaggugcaggagggcauccccaccggcgagcccgugugcguguacaccgccgaggaccccgacaaggagaaccagaagaucagcuacagaauccugagagaccccgccggcuggcuggccauggaccccgacagcggccaggugaccgccgugggcacccuggacagagaggacgagcaguucgugagaaacaacaucuacgaggugauggugcuggccauggacaacggcagcccccccaccaccggcaccggcacccugcugcugacccugaucgacgugaacgaccacggccccgugcccgagcccagacagaucaccaucugcaaccagagccccgugagacaggugcugaacaucaccgacaaggaccugagcccccacaccagccccuuccaggcccagcugaccgacgacagcgacaucuacuggaccgccgaggugaacgaggagggcgacaccguggugcugagccugaagaaguuccugaagcaggacaccuacgacgugcaccugagccugagcgaccacggcaacaaggagcagcugaccgugaucagagccaccgugugcgacugccacggccacguggagaccugccccggccccuggaagggcggcuucauccugcccgugcugggcgccgugcuggcccugcuguuccugcugcuggugcugcugcugcuggugagaaagaagagaaagaucaaggagccccugcugcugcccgaggacgacaccagagacaacguguucuacuacggcgaggagggcggcggcgaggaggaccaggacuacgacaucacccagcugcacagaggccuggaggccagacccgagguggugcugagaaacgacguggcccccaccaucauccccacccccauguacagacccagacccgccaaccccgacgagaucggcaacuucaucaucgagaaccugaaggccgccaacaccgaccccaccgccccccccuacgacacccugcugguguucgacuacgagggcagcggcagcgacgccgccagccugagcagccugaccagcagcgccagcgaccaggaccaggacuacgacuaccugaacgaguggggcagcagauucaagaagcuggccgacauguacggcggcggcgaggacgacuaa

SEQ ID NO: 14969 - RNA, 2640 nt, Artificial Sequence
  CDH4__Homo_sapiens__NP_001239267
augaacggcagcugcgacuucauccugagcgccagcuuccugcccugcuucaaggaggugaaguucagcagcugcgugggcaccaagggcacccaguacgagaccaacagcauggacuucaaggugggcgccgacggcaccguguucgccaccagagagcugcaggugcccagcgagcagguggccuucaccgugaccgccugggacagccagaccgccgagaagugggacgccguggugagacugcugguggcccagaccagcagcccccacagcggccacaagccccagaagggcaagaaggugguggcccuggaccccagccccccccccaaggacacccugcugcccuggccccagcaccagaacgccaacggccugagaagaagaaagagagacugggugaucccccccaucaacgugcccgagaacagcagaggccccuucccccagcagcuggugagaaucagaagcgacaaggacaacgacauccccaucagauacagcaucaccggcgugggcgccgaccagccccccauggagguguucagcaucgacagcaugagcggcagaauguacgugaccagacccauggacagagaggagcacgccagcuaccaccugagagcccacgccguggacaugaacggcaacaagguggagaaccccaucgaccuguacaucuacgugaucgacaugaacgacaacagacccgaguucaucaaccagguguacaacggcagcguggacgagggcagcaagcccggcaccuacgugaugaccgugaccgccaacgacgccgacgacagcaccaccgccaacggcauggugagauacagaaucgugacccagaccccccagagccccagccagaacauguucaccaucaacagcgagaccggcgacaucgugaccguggccgccggccuggacagagagaaggugcagcaguacaccgugaucgugcaggccaccgacauggagggcaaccugaacuacggccugagcaacaccgccaccgccaucaucaccgugaccgacgugaacgacaacccccccgaguucaccgccagcaccuucgccggcgaggugcccgagaacagaguggagaccgugguggccaaccugaccgugauggacagagaccagccccacagccccaacuggaacgccguguacagaaucaucagcggcgaccccagcggccacuucagcgugagaaccgaccccgugaccaacgagggcauggugaccguggugaaggccguggacuacgagcugaacagagccuucaugcugaccgugauggugagcaaccaggccccccuggccagcggcauccagaugagcuuccagagcaccgccggcgugaccaucagcaucauggacaucaacgaggcccccuacuuccccagcaaccacaagcugaucagacuggaggagggcgugccccccggcaccgugcugaccaccuucagcgccguggaccccgacagauucaugcagcaggccgugagauacagcaagcugagcgaccccgccagcuggcugcacaucaacgccaccaacggccagaucaccaccgccgccgugcuggacagagagagccuguacaccaagaacaacguguacgaggccaccuuccuggccgccgacaacggcaucccccccgccagcggcaccggcacccugcagaucuaccugaucgacaucaacgacaacgcccccgagcugcugcccaaggaggcccagaucugcgagaagcccaaccugaacgccaucaacaucaccgccgccgacgccgacguggaccccaacaucggccccuacguguucgagcugcccuucgugcccgccgccgugagaaagaacuggaccaucaccagacugaacggcgacuacgcccagcugagccugagaauccuguaccuggaggccggcauguacgacgugcccaucaucgugaccgacagcggcaaccccccccugagcaacaccagcaucaucaaggugaaggugugccccugcgacgacaacggcgacugcaccaccaucggcgccguggccgccgccggccugggcaccggcgccaucguggccauccugaucugcauccugauccugcugaccauggugcugcuguucgugauguggaugaagagaagagagaaggagagacacaccaagcagcugcugaucgaccccgaggacgacgugagagacaacauccugaaguacgacgaggagggcggcggcgaggaggaccaggacuacgaccugagccagcugcagcagcccgaggccaugggccacgugcccagcaaggcccccggcgugagaagaguggacgagagacccgugggcgccgagccccaguaccccaucagacccauggugccccaccccggcgacaucggcgacuucaucaacgagggccugagagccgccgacaacgaccccaccgccccccccuacgacagccugcugguguucgacuacgagggcagcggcagcaccgccggcagcgugagcagccugaacagcagcagcagcggcgaccaggacuacgacuaccugaacgacuggggccccagauucaagaagcuggccgacauguacggcggcggcgaggaggacuaa

SEQ ID NO: 14970 - RNA, 2355 nt, Artificial Sequence
  CDH5__Homo_sapiens__NP_001786
augcagagacugaugaugcugcuggccaccagcggcgccugccugggccugcuggccguggccgccguggccgccgccggcgccaaccccgcccagagagacacccacagccugcugcccacccacagaagacagaagagagacuggaucuggaaccagaugcacaucgacgaggagaagaacaccagccugccccaccacgugggcaagaucaagagcagcgugagcagaaagaacgccaaguaccugcugaagggcgaguacgugggcaagguguucagaguggacgccgagaccggcgacguguucgccaucgagagacuggacagagagaacaucagcgaguaccaccugaccgccgugaucguggacaaggacaccggcgagaaccuggagacccccagcagcuucaccaucaaggugcacgacgugaacgacaacuggcccguguucacccacagacuguucaacgccagcgugcccgagagcagcgccgugggcaccagcgugaucagcgugaccgccguggacgccgacgaccccaccgugggcgaccacgccagcgugauguaccagauccugaagggcaaggaguacuucgccaucgacaacagcggcagaaucaucaccaucaccaagagccuggacagagagaagcaggccagauacgagaucgugguggaggccagagacgcccagggccugagaggcgacagcggcaccgccaccgugcuggugacccugcaggacaucaacgacaacuuccccuucuucacccagaccaaguacaccuucguggugcccgaggacaccagagugggcaccagcgugggcagccuguucguggaggaccccgacgagccccagaacagaaugaccaaguacagcauccugagaggcgacuaccaggacgccuucaccaucgagaccaaccccgcccacaacgagggcaucaucaagcccaugaagccccuggacuacgaguacauccagcaguacagcuucaucguggaggccaccgaccccaccaucgaccugagauacaugagcccccccgccggcaacagagcccaggugaucaucaacaucaccgacguggacgagccccccaucuuccagcagcccuucuaccacuuccagcugaaggagaaccagaagaagccccugaucggcaccgugcuggccauggaccccgacgccgccagacacagcaucggcuacagcaucagaagaaccagcgacaagggccaguucuucagagugaccaagaagggcgacaucuacaacgagaaggagcuggacagagagguguaccccugguacaaccugaccguggaggccaaggagcuggacagcaccggcacccccaccggcaaggagagcaucgugcaggugcacaucgaggugcuggacgagaacgacaacgcccccgaguucgccaagcccuaccagcccaaggugugcgagaacgccgugcacggccagcuggugcugcagaucagcgccaucgacaaggacaucacccccagaaacgugaaguucaaguucauccugaacaccgagaacaacuucacccugaccgacaaccacgacaacaccgccaacaucaccgugaaguacggccaguucgacagagagcacaccaaggugcacuuccugcccguggugaucagcgacaacggcaugcccagcagaaccggcaccagcacccugaccguggccgugugcaagugcaacgagcagggcgaguucaccuucugcgaggacauggccgcccaggugggcgugagcauccaggccgugguggccauccugcugugcauccugaccaucaccgugaucacccugcugaucuuccugagaagaagacugagaaagcaggccagagcccacggcaagagcgugcccgagauccacgagcagcuggugaccuacgacgaggagggcggcggcgagauggacaccaccagcuacgacgugagcgugcugaacagcgugagaagaggcggcgccaagccccccagacccgcccuggacgccagacccagccuguacgcccaggugcagaagccccccagacacgcccccggcgcccacggcggccccggcgagauggccgccaugaucgaggugaagaaggacgaggccgaccacgacggcgacggcccccccuacgacacccugcacaucuacggcuacgagggcagcgagagcaucgccgagagccugagcagccugggcaccgacagcagcgacagcgacguggacuacgacuuccugaacgacuggggccccagauucaagaugcuggccgagcuguacggcagcgaccccagagaggagcugcuguacuaa

SEQ ID NO: 14971 - RNA, 2373 nt, Artificial Sequence
  CDH6__Homo_sapiens__XP_011512223
augagaaccuacagauacuuccugcugcuguucugggugggccagcccuaccccacccugagcaccccccugagcaagagaaccagcggcuuccccgccaagaagagagcccuggagcugagcggcaacagcaagaacgagcugaacagaagcaagagaagcuggauguggaaccaguucuuccugcuggaggaguacaccggcagcgacuaccaguacgugggcaagcugcacagcgaccaggacagaggcgacggcagccugaaguacauccugagcggcgacggcgccggcgaccuguucaucaucaacgagaacaccggcgacauccaggccaccaagagacuggacagagaggagaagcccguguacauccugagagcccaggccaucaacagaagaaccggcagacccguggagcccgagagcgaguucaucaucaagauccacgacaucaacgacaacgagcccaucuucaccaaggagguguacaccgccaccgugcccgagaugagcgacgugggcaccuucguggugcaggugaccgccaccgacgccgacgaccccaccuacggcaacagcgccaaggugguguacagcauccugcagggccagcccuacuucagcguggagagcgagaccggcaucaucaagaccgcccugcugaacauggacagagagaacagagagcaguaccagguggugauccaggccaaggacaugggcggccagaugggcggccugagcggcaccaccaccgugaacaucacccugaccgacgugaacgacaacccccccagauucccccagagcaccuaccaguucaagacccccgagagcagcccccccggcacccccaucggcagaaucaaggccagcgacgccgacgugggcgagaacgccgagaucgaguacagcaucaccgacggcgagggccuggacauguucgacgugaucaccgaccaggagacccaggagggcaucaucaccgugaagaagcugcuggacuucgagaagaagaagguguacacccugaagguggaggccagcaaccccuacguggagcccagauuccuguaccugggccccuucaaggacagcgccaccgugagaaucgugguggaggacguggacgagccccccguguucagcaagcuggccuacauccugcagaucagagaggacgcccagaucaacaccaccaucggcagcgugaccgcccaggaccccgacgccgccagaaaccccgugaaguacagcguggacagacacaccgacauggacagaaucuucaacaucgacagcggcaacggcagcaucuucaccagcaagcugcuggacagagagacccugcuguggcacaacaucaccgugaucgccaccgagaucaacaaccccaagcagagcagcagagugccccuguacaucaaggugcuggacgugaacgacaacgcccccgaguucgccgaguucuacgagaccuucgugugcgagaaggccaaggccgaccagcugauccagacccugcacgccguggacaaggacgaccccuacagcggccaccaguucagcuucagccuggcccccgaggccgccagcggcagcaacuucaccauccaggacaacaaggacaacaccgccggcauccugaccagaaagaacggcuacaacagacacgagaugagcaccuaccugcugcccguggugaucagcgacaacgacuaccccgugcagagcagcaccggcaccgugaccgugagagugugcgccugcgaccaccacggcaacaugcagagcugccacgccgaggcccugauccaccccaccggccugagcaccggcgcccugguggccauccugcugugcaucgugauccugcuggugaccguggugcuguucgccgcccugagaagacagagaaagaaggagccccugaucaucagcaaggaggacaucagagacaacaucgugagcuacaacgacgagggcggcggcgaggaggacacccaggccuucgacaucggcacccugagaaaccccgaggccaucgaggacaacaagcugagaagagacaucgugcccgaggcccuguuccugcccagaagaacccccaccgccagagacaacaccgacgugagagacuucaucaaccagagacugaaggagaacgacaccgaccccaccgccccccccuacgacagccuggccaccuacgccuacgagggcaccggcagcguggccgacagccugagcagccuggagagcgugaccaccgacgccgaccaggacuacgacuaccugagcgacuggggccccagauucaagaagcuggccgacauguacggcggcguggacagcgacaaggacagcuaa

SEQ ID NO: 14972 - RNA, 2358 nt, Artificial Sequence
  CDH7__Homo_sapiens__NP_387450
augaagcugggcaagguggaguucugccacuuccugcagcugaucgcccuguuccugugcuucagcggcaugagccaggccgagcugagcagaagcagaagcaagcccuacuuccagagcggcagaagcagaaccaagagaagcuggguguggaaccaguucuucgugcuggaggaguacaugggcagcgacccccuguacgugggcaagcugcacagcgacguggacaagggcgacggcagcaucaaguacauccugagcggcgagggcgccagcagcaucuucaucaucgacgagaacaccggcgacauccacgccaccaagagacuggacagagaggagcaggccuacuacacccugagagcccaggcccuggacagacugaccaacaagcccguggagcccgagagcgaguucgugaucaagauccaggacaucaacgacaacgagcccaaguuccuggacggccccuacaccgccggcgugcccgagaugagccccgugggcaccagcguggugcaggugaccgccaccgacgccgacgaccccaccuacggcaacagcgccagagugguguacagcauccugcagggccagcccuacuucagcguggagcccaagaccggcgugaucaagaccgcccugcccaacauggacagagaggccaaggaccaguaccugcuggugauccaggccaaggacauggugggccagaacggcggccugagcggcaccaccagcgugaccgugacccugaccgacgugaacgacaacccccccagauuccccagaagaagcuaccaguacaacgugcccgagagccugcccguggccagcgugguggccagaaucaaggccgccgacgccgacaucggcgccaacgccgagauggaguacaagaucguggacggcgacggccugggcaucuucaagaucagcguggacaaggagacccaggagggcaucaucaccauccagaaggagcuggacuucgaggccaagaccagcuacacccugagaaucgaggccgccaacaaggacgccgaccccagauuccugagccugggccccuucagcgacaccaccaccgugaagaucaucguggaggacguggacgagccccccguguucagcagcccccuguaccccauggaggugagcgaggccacccaggugggcaacaucaucggcaccguggccgcccacgaccccgacagcagcaacagccccgugagauacagcaucgacagaaacaccgaccuggagagauacuucaacaucgacgccaacagcggcgugaucaccaccgccaagagccuggacagagagaccaacgccauccacaacaucaccgugcuggccauggagagccagaaccccagccaggugggcagaggcuacguggccaucaccauccuggacaucaacgacaacgcccccgaguucgccauggacuacgagaccaccgugugcgagaacgcccagcccggccaggugauccagaagaucagcgccguggacaaggacgagcccagcaacggccaccaguucuacuucagccugaccaccgacgccaccaacaaccacaacuucagccugaaggacaacaaggacaacaccgccagcauccugaccagaagaaacggcuucagaagacaggagcagagcguguacuaccugcccaucuucaucguggacagcggcagccccagccugagcagcaccaacacccugaccaucagagugugcgacugcgacgccgacggcguggcccagaccugcaacgccgaggccuacgugcugcccgccggccugagcaccggcgcccugaucgccauccuggccugcgugcugacccugcuggugcugauccugcugaucgugaccaugagaagaagaaagaaggagccccugaucuucgacgaggagagagacaucagagagaacaucgugagauacgacgacgagggcggcggcgaggaggacaccgaggccuucgacauggccgcccugagaaaccugaacgugaucagagacaccaagaccagaagagacgugacccccgagauccaguuccugagcagacccgccuucaagagcauccccgacaacgugaucuucagagaguucaucugggagagacugaaggaggccgacguggaccccggcgccccccccuacgacagccugcagaccuacgccuucgagggcaacggcagcguggccgagagccugagcagccuggacagcaucagcagcaacagcgaccagaacuacgacuaccugagcgacuggggccccagauucaagagacuggccgacauguacggcaccggccaggagagccuguacagcuaa

SEQ ID NO: 14973 - RNA, 2400 nt, Artificial Sequence
  CDH8__Homo_sapiens__NP_001787
augcccgagagacuggccgagaugcugcuggaccuguggaccccccugaucauccuguggaucacccugccccccugcaucuacauggcccccaugaaccagagccaggugcugaugagcggcagcccccuggagcugaacagccugggcgaggagcagagaauccugaacagaagcaagagaggcuggguguggaaccagauguucgugcuggaggaguucagcggccccgagcccauccuggugggcagacugcacaccgaccuggaccccggcagcaagaagaucaaguacauccugagcggcgacggcgccggcaccaucuuccagaucaacgacgugaccggcgacauccacgccaucaagagacuggacagagaggagaaggccgaguacacccugaccgcccaggccguggacugggagaccagcaagccccuggagccccccagcgaguucaucaucaaggugcaggacaucaacgacaacgcccccgaguuccugaacggccccuaccacgccaccgugcccgagaugagcauccugggcaccagcgugaccaacgugaccgccaccgacgccgacgaccccguguacggcaacagcgccaagcugguguacagcauccuggagggccagcccuacuucagcaucgagcccgagaccgccaucaucaagaccgcccugcccaacauggacagagaggccaaggaggaguaccugguggugauccaggccaaggacaugggcggccacagcggcggccugagcggcaccaccacccugaccgugacccugaccgacgugaacgacaacccccccaaguucgcccagagccuguaccacuucagcgugcccgaggacguggugcugggcaccgccaucggcagagugaaggccaacgaccaggacaucggcgagaacgcccagagcagcuacgacaucaucgacggcgacggcaccgcccuguucgagaucaccagcgacgcccaggcccaggacggcaucaucagacugagaaagccccuggacuucgagaccaagaagagcuacacccugaagguggaggccgccaacgugcacaucgaccccagauucagcggcagaggccccuucaaggacaccgccaccgugaagaucgugguggaggacgccgacgagccccccguguucagcagccccaccuaccugcuggaggugcacgagaacgccgcccugaacagcgugaucggccaggugaccgccagagaccccgacaucaccagcagccccaucagauucagcaucgacagacacaccgaccuggagagacaguucaacaucaacgccgacgacggcaagaucacccuggccaccccccuggacagagagcugagcguguggcacaacaucaccaucaucgccaccgagaucagaaaccacagccagaucagcagagugcccguggccaucaaggugcuggacgugaacgacaacgcccccgaguucgccagcgaguacgaggccuuccugugcgagaacggcaagcccggccaggugauccagaccgugagcgccauggacaaggacgaccccaagaacggccacuacuuccuguacagccugcugcccgagauggugaacaaccccaacuucaccaucaagaagaacgaggacaacagccugagcauccuggccaagcacaacggcuucaacagacagaagcaggagguguaccugcugcccaucaucaucagcgacagcggcaaccccccccugagcagcaccagcacccugaccaucagagugugcggcugcagcaacgacggcguggugcagagcugcaacguggaggccuacgugcugcccaucggccugagcaugggcgcccugaucgccauccuggccugcaucauccugcugcuggugaucguggugcuguucgugacccugagaagacacaagaacgagccccugaucaucaaggacgacgaggacgugagagagaacaucaucagauacgacgacgagggcggcggcgaggaggacaccgaggccuucgacaucgccacccugcagaaccccgacggcaucaacggcuuccugcccagaaaggacaucaagcccgaccugcaguucaugcccagacagggccuggcccccgugcccaacggcguggacguggacgaguucaucaacgugagacugcacgaggccgacaacgaccccaccgccccccccuacgacagcauccagaucuacggcuacgagggcagaggcagcguggccggcagccugagcagccuggagagcaccaccagcgacagcgaccagaacuucgacuaccugagcgacuggggccccagauucaagagacugggcgagcuguacagcgugggcgagagcgacaaggagaccuaa

SEQ ID NO: 14974 - RNA, 2370 nt, Artificial Sequence
  CDH9__Homo_sapiens__XP_011512224
augagaaccuaccacuacaucccccuguucaucuggaccuacauguuccacaccguggacaccauccugcugcaggagaagcccaacagcuaccugagcagcaagaagaucgccggccugaccaaggacgacggcaagaugcugagaagaaccaagagaggcuggauguggaaccaguucuuccugcuggaggaguacaccggcaccgacacccaguacgugggcaagcugcacaccgaccaggacaagggcgacggcaaccugaaguacauccugaccggcgacggcgccggcagccuguucgugaucgacgagaacaccggcgacauccacgccgccaagaagcuggacagagaggagaagagccuguacauccugagagccaaggccaucgacagaaagaccggcagacagguggagcccgagagcgaguucaucaucaagauccacgacaucaacgacaacgagcccaaguucaccaaggaccuguacaccgccagcgugcccgagaugagcggcgugggcaccagcgugauccaggugaccgccaccgacgccgacgacgccaacuacggcaacagcgccaaggugguguacagcauccugcagggccagcccuacuucagcguggaccccgagagcggcaucaucaagaccgcccugcccgacaugagcagagagaacagagagcaguaccagguggugauccaggccaaggacaugggcggccagaugggcggccugagcggcaccaccaccgugaacaucacccugaccgacgugaacaacaacccccccagauucccccagagcaccuaccaguucaacagccccgagagcgugccccugggcacccaccugggcagaaucaaggccaacgaccccgacgugggcgagaacgccgagauggaguacagcaucgccgagggcgacggcgccgacauguucgacgugaucaccgacaaggacacccaggagggcaucaucaccgugaagcagaaccuggacuucgagaaccagaugcuguacacccugagaguggacgccagcaacacccaccccgaccccagauuccugcaccugggccccuucaaggacaccgccguggugaagaucagcguggaggacaucgacgagccccccguguucaccaaggugagcuaccugaucgagguggacgaggacgugaaggagggcagcaucaucggccaggugaccgccuacgaccccgacgccagaaacaaccugaucaaguacagcguggacagacacaccgacauggacagaaucuucggcauccacagcgagaacggcagcaucuucacccugaaggcccuggacagagagagcagccccuggcacaacaucaccgugaccgccaccgagaucaacaaccccaagcagagcagccacauccccguguucaucagaauccuggacaucaacgaccacgcccccgaguucgccauguacuacgagaccuucgugugcgagaacgccaagcccggccagcugauccagaccgugagcgugauggacaaggacgacccccccagaggccacaaguucuucuucgagcccgugcccgaguucacccugaaccccaacuucaccaucguggacaacaaggacaacaccgccggcaucaugaccagaaaggacggcuacagcagaaacaagaugagcaccuaccugcugcccauccugaucuucgacaacgacuaccccauccagagcagcaccggcacccugaccaucagagugugcgccugcgacaaccagggcaacaugcagagcugcaccgccgaggcccugauccugagcgccggccugagcaccggcgcccugguggccauccugcugugcgugcugauccugcugauccugguggugcuguucgccgcccugaagagacagagaaagaaggagccccugaucaucagcaaggacgacgugagagacaacaucgugaccuacaacgacgagggcggcggcgaggaggacacccaggccuucgacaucggcacccugagaaaccccgaggccagagaggacagcaagcugagaagagacgugaugcccgagaccaucuuccagaucagaagaaccgugccccugugggagaacaucgacgugcaggacuucauccacagaagacugaaggagaacgacgccgaccccagcgccccccccuacgacagccuggccaccuacgccuacgagggcaacgacagcaucgccgacagccugagcagccuggagagccugaccgccgacugcaaccaggacuacgacuaccugagcgacuggggccccagauucaagaagcuggccgacauguacggcggcgacgacagcgacagagacuaa

SEQ ID NO: 14975 - RNA, 2238 nt, Artificial Sequence
  CDHR1__Homo_sapiens__NP_001165442
augagaagaugcagaugggccgcccuggcccugggccugcugagacugugccuggcccaggccaacuucgccccccacuucuucgacaacggcgugggcagcaccaacggcaacauggcccuguucagccugcccgaggacacccccgugggcagccacguguacacccugaacggcaccgaccccgagggcgaccccaucagcuaccacaucagcuucgaccccagcaccagaagcguguucagcguggaccccaccuucggcaacaucacccugguggaggagcuggacagagagagagaggacgagaucgaggccaucaucagcaucagcgacggccugaaccugguggccgagaagguggugauccuggugaccgacgccaacgacgaggcccccagauucauccaggagcccuacguggcccuggugcccgaggacauccccgccggcagcaucaucuucaaggugcacgccguggacagagacaccggcagcggcggcagcgugaccuacuuccugcagaaccugcacagccccuucgccguggacagacacagcggcgugcugagacugcaggccggcgccacccuggacuacgagagaagcagaacccacuacaucaccgugguggccaaggacggcggcggcagacugcacggcgccgacgugguguucagcgccaccaccaccgugaccgugaacguggaggacgugcaggacauggcccccguguucgugggcacccccuacuacggcuacguguacgaggacacccugcccggcagcgaggugcugaaggugguggccauggacggcgacagaggcaagcccaacagaauccuguacagccuggugaacggcaacgacggcgccuucgagaucaacgagaccagcggcgccaucagcaucacccagagccccgcccagcugcagagagagguguacgagcugcacgugcaggugaccgagaugagccccgccggcagccccgccgcccaggccaccgugcccgugaccaucagaaucguggaccugaacaaccacccccccaccuucuacggcgagagcggcccccagaacagauucgagcugagcaugaacgagcaccccccccagggcgagauccugagaggccugaagaucaccgugaacgacagcgaccagggcgccaacgccaaguucaaccugcagcuggugggccccagaggcaucuucagaguggugccccagaccgugcugaacgaggcccaggugaccaucaucguggagaacagcgccgccaucgacuucgagaagagcaaggugcugaccuucaagcugcuggccguggaggugaacacccccgagaaguucagcagcaccgccgacguggugauccagcugcuggacaccaacgacaacgugcccaaguucgacagccuguacuacguggccagaauccccgagaacgcccccggcggcagcagcgugguggccgugaccgccguggaccccgacaccggccccuggggcgaggugaaguacagcaccuacggcaccggcgccgaccuguuccugauccaccccagcaccggccugaucuacacccagcccugggccagccuggacgccgaggccaccgccagauacaacuucuacgugaaggccgaggacauggagggcaaguacagcguggccgagguguucaucacccugcuggacgugaacgaccaccccccccaguucggcaagagcgugcagaagaagaccauggugcugggcacccccgugaagaucgaggccaucgacgaggacgccgaggagcccaacaaccugguggacuacagcaucacccacgccgagcccgccaacguguucgacaucaacagccacaccggcgagaucuggcugaagaacagcaucagaagccuggacgcccugcacaacaucacccccggcagagacugccuguggagccuggaggugcaggccaaggacagaggcagccccagcuucagcaccaccgcccugcugaagaucgacaucaccgacgccgaggugagaagacugagauacaugaagaacagcaacuuccccggcaccaccaagagcgugagaaagcccaaguucaagcccaagaagccccacagcagccagggccuguuccugcacccccacugcgagaucgcccuguucaaccugagcaacgugaaccuguacagcagaguguuccagggcgccgcccaggccagcuaa

SEQ ID NO: 14976 - RNA, 3933 nt, Artificial Sequence
  CDHR2__Homo_sapiens__NP_001165447
auggcccagcuguggcugagcugcuuccugcugcccgcccugguggugagcguggccgccaacguggcccccaaguuccuggccaacaugaccagcgugauccugcccgaggaccugcccgugggcgcccaggccuucuggcugguggccgaggaccaggacaacgacccccugaccuacggcaugagcggccccaacgccuacuucuucgccgugacccccaagaccggcgaggugaagcuggccagcgcccuggacuacgagacccuguacaccuucaaggugaccaucagcgugagcgaccccuacauccaggugcagagagagaugcuggugaucguggaggacagaaacgacaacgcccccguguuccagaacaccgccuucagcaccagcaucaacgagacccugcccgugggcagcgugguguucagcgugcuggccguggacaaggacaugggcagcgccggcauggugguguacagcaucgagaaggugauccccagcaccggcgacagcgagcaccuguucagaauccuggccaacggcagcaucgugcugaacggcagccugagcuacaacaacaagagcgccuucuaccagcuggagcugaaggccugcgaccugggcggcauguaccacaacaccuucaccauccagugcagccugcccguguuccugagcaucagcgugguggaccagcccgaccuggacccccaguucgugagagaguucuacagcgccagcguggccgaggacgccgccaagggcaccagcgugcugaccguggaggccguggacggcgacaagggcaucaacgaccccgugaucuacagcaucagcuacagcaccagacccggcugguucgacaucggcgccgacggcgugaucagagugaacggcagccuggacagagagcagcugcuggaggccgacgaggaggugcagcugcaggugaccgccaccgagacccaccugaacaucuacggccaggaggccaaggugagcaucugggugaccgugagagugauggacgugaacgaccacaagcccgaguucuacaacugcagccugcccgccugcaccuucacccccgaggaggcccaggugaacuucaccggcuacguggacgagcacgccagccccagaauccccaucgacgaccugaccauggugguguacgaccccgacaagggcagcaacggcaccuuccugcugagccugggcggccccgacgccgaggccuucagcgugagccccgagagagccgugggcagcgccagcgugcaggugcuggugagagugagcgcccugguggacuacgagagacagaccgccauggccgugcaggugguggccaccgacagcgugagccagaacuucagcguggccauggugaccauccaccugagagacaucaacgaccacagacccaccuucccccagagccuguacgugcugaccgugcccgagcacagcgccaccggcagcguggugaccgacagcauccacgccaccgaccccgacaccggcgccuggggccagaucaccuacagccugcugcccggcaacggcgccgaccuguuccagguggaccccgugagcggcaccgugaccgugagaaacggcgagcugcuggacagagagagccaggccguguacuaccugacccugcaggccaccgacggcggcaaccugagcagcagcaccacccugcagauccaccugcuggacaucaacgacaacgcccccguggugagcggcagcuacaacaucuucgugcaggaggaggagggcaacgugagcgugaccauccaggcccacgacaacgacgagcccggcaccaacaacagcagacugcuguucaaccugcugcccggccccuacagccacaacuucagccuggaccccgacaccggccugcugagaaaccugggcccccuggacagagaggccaucgaccccgcccuggagggcagaaucgugcugaccgugcuggugagcgacugcggcgagcccgugcugggcaccaaggugaacgugaccaucaccguggaggacaucaacgacaaccugcccaucuucaaccagagcagcuacaacuucaccgugaaggaggaggaccccggcgugcuggugggcguggugaaggccugggacgccgaccagaccgaggccaacaacagaaucagcuucagccugagcggcagcggcgccaacuacuucaugaucagaggccuggugcugggcgccggcugggccgagggcuaccugagacugccccccgacgugagccuggacuacgagacccagcccguguucaaccugaccgugagcgccgagaaccccgacccccagggcggcgagaccaucguggacgugugcgugaacgugaaggacgugaacgacaacccccccacccuggacguggccagccugagaggcaucagaguggccgagaacggcagccagcacggccagguggccguggugguggccagcgacguggacaccagcgcccagcuggagauccagcuggugaacauccugugcaccaaggccggcguggacgugggcagccugugcuggggcugguucagcguggccgccaacggcagcguguacaucaaccagagcaaggccaucgacuacgaggccugcgaccuggugacccugguggugagagccugcgaccuggccaccgaccccggcuuccaggccuacagcaacaacggcagccugcugaucaccaucgaggacgugaacgacaacgcccccuacuuccugcccgagaacaagaccuucgugaucauccccgagcuggugcugcccaacagagagguggccagcgugagagccagagacgacgacagcggcaacaacggcgugauccuguucagcauccugagaguggacuucaucagcaaggacggcgccaccauccccuuccagggcguguucagcaucuucaccagcagcgaggccgacguguucgccggcagcauccagcccgugaccagccuggacagcacccugcagggcaccuaccaggugaccgugcaggccagagacagacccagccugggccccuuccuggaggccaccaccacccugaaccuguucaccguggaccagagcuacagaagcagacugcaguucagcacccccaaggaggaggugggcgccaacagacaggccaucaacgccgcccugacccaggccaccagaaccaccguguacaucguggacauccaggacaucgacagcgccgccagagccagaccccacagcuaccuggacgccuacuucguguuccccaacggcagcgcccugacccuggacgagcugagcgugaugaucagaaacgaccaggacagccugacccagcugcugcagcugggccugguggugcugggcagccaggagagccaggagagcgaccugagcaagcagcugaucagcgugaucaucggccugggcguggcccugcugcuggugcuggugaucaugaccauggccuucgugugcgugagaaagagcuacaacagaaagcugcaggccaugaaggccgccaaggaggccagaaagaccgccgccggcgugaugcccagcgcccccgccauccccggcaccaacauguacaacaccgagagagccaaccccaugcugaaccugcccaacaaggaccugggccuggaguaccugagccccagcaacgaccuggacagcgugagcgugaacagccuggacgacaacagcguggacguggacaagaacagccaggagaucaaggagcacagacccccccacaccccccccgagcccgaccccgagccccugagcguggugcugcugggcagacaggccggcgccagcggccagcuggagggccccagcuacaccaacgccggccuggacaccaccgaccuguaa

SEQ ID NO: 14977 - RNA, 2658 nt, Artificial Sequence
  CDHR3__Homo_sapiens__NP_689963
augcaggaggccaucauccugcuggcccugcugggcgccaugagcggcggcgaggcccugcaccugauccugcugcccgccaccggcaacguggccgagaacagcccccccggcaccagcgugcacaaguucagcgugaagcugagcgccagccugagccccgugauccccggcuucccccagaucgugaacagcaacccccugaccgaggccuucagagugaacuggcugagcggcaccuacuucgagguggugaccaccggcauggagcagcuggacuucgagaccggccccaacaucuucgaccugcagaucuacgugaaggacgaggugggcgugaccgaccugcaggugcugaccgugcaggugaccgacgugaacgagcccccccaguuccagggcaaccuggccgagggccugcaccuguacaucguggagagagccaaccccggcuucaucuaccagguggaggccuucgaccccgaggacaccagcagaaacaucccccugagcuacuuccugaucagcccccccaagagcuucagaaugagcgccaacggcacccuguucagcaccaccgagcuggacuucgaggccggccacagaagcuuccaccugaucguggaggugagagacagcggcggccugaaggccagcaccgagcugcaggugaacaucgugaaccugaacgacgaggugcccagauucaccagccccaccagaguguacaccgugcuggaggagcugagccccggcaccaucguggccaacaucaccgccgaggaccccgacgacgagggcuuccccagccaccugcuguacagcaucaccaccgugagcaaguacuucaugaucaaccagcugaccggcaccauccagguggcccagagaaucgacagagacgccggcgagcugagacagaaccccaccaucagccuggaggugcuggugaaggacagacccuacggcggccaggagaacagaauccagaucaccuucaucguggaggacgugaacgacaaccccgccaccugccagaaguucaccuucagcaucauggugcccgagagaaccgccaagggcacccugcugcuggaccugaacaaguucugcuucgacgacgacagcgaggcccccaacaacagauucaacuucaccaugcccagcggcgugggcagcggcagcagauuccugcaggaccccgccggcagcggcaagaucgugcugaucggcgaccuggacuacgagaaccccagcaaccuggccgccggcaacaaguacaccgugaucauccaggugcaggacguggccccccccuacuacaagaacaacguguacguguacauccugaccagccccgagaacgaguucccccugaucuucgacagacccagcuacguguucgacgugagcgagagaagacccgccagaaccagagugggccaggugagagccaccgacaaggaccugccccagagcagccugcuguacagcaucagcaccggcggcgccagccugcaguaccccaacguguucuggaucaaccccaagaccggcgagcugcagcuggugaccaagguggacugcgagaccacccccaucuacauccugagaauccaggccaccaacaacgaggacaccagcagcgugaccgugaccgugaacauccuggaggagaacgacgagaagcccaucugcacccccaacagcuacuuccuggcccugcccguggaccugaaggugggcaccaacauccagaacuucaagcugaccugcaccgaccuggacagcagccccagaagcuucagauacagcaucggccccggcaacgugaacaaccacuucaccuucagccccaacgccggcagcaacgugaccagacugcugcugaccagcagauucgacuacgccggcggcuucgacaagaucugggacuacaagcugcugguguacgugaccgacgacaaccugaugagcgacagaaagaaggccgaggcccugguggagaccggcaccgugacccugagcaucaaggugaucccccaccccaccaccaucaucaccaccacccccagacccagagugaccuaccaggugcugagaaagaacguguacagccccagcgccugguacgugcccuucgugaucacccugggcagcauccugcugcugggccugcugguguaccugguggugcugcuggccaaggccauccacagacacugccccugcaagaccggcaagaacaaggagccccugaccaagaagggcgagaccaagaccgccgagagagacguggugguggagaccauccagaugaacaccaucuucgacggcgaggccaucgaccccgugaccggcgagaccuacgaguucaacagcaagaccggcgccagaaaguggaaggacccccugacccagaugcccaaguggaaggagagcagccaccagggcgccgcccccagaagagugaccgccggcgagggcaugggcagccugagaagcgccaacugggaggaggacgagcugagcggcaaggccugggccgaggacgccggccugggcagcagaaacgagggcggcaagcugggcaaccccaagaacagaaaccccgccuucaugaacagagccuaccccaagccccaccccggcaaguaa

SEQ ID NO: 14978 - RNA, 2520 nt, Artificial Sequence
  CDHR5__Homo_sapiens__NP_001165439
augggcagcugggcccugcuguggcccccccugcuguucaccggccugcuggugagaccccccggcaccauggcccaggcccaguacugcagcgugaacaaggacaucuucgagguggaggagaacaccaacgugaccgagccccugguggacauccacgugcccgagggccaggaggugacccugggcgcccugagcacccccuucgccuucagaauccagggcaaccagcuguuccugaacgugacccccgacuacgaggagaagagccugcuggaggcccagcugcugugccagagcggcggcacccuggugacccagcugagaguguucgugagcgugcuggacgugaacgacaacgcccccgaguuccccuucaagaccaaggagaucagaguggaggaggacaccaaggugaacagcaccgugauccccgagacccagcugcaggccgaggacagagacaaggacgacauccuguucuacacccugcaggagaugaccgccggcgccagcgacuacuucagccuggugagcgugaacagacccgcccugagacuggacagaccccuggacuucuacgagagacccaacaugaccuucuggcugcuggugagagacacccccggcgagaacguggagcccagccacaccgccaccgccacccuggugcugaacguggugcccgccgaccugagaccccccugguuccugcccugcaccuucagcgacggcuacgugugcauccaggcccaguaccacggcgccgugcccaccggccacauccugcccagcccccuggugcugagacccggccccaucuacgccgaggacggcgacagaggcaucaaccagcccaucaucuacagcaucuucagaggcaacgugaacggcaccuucaucauccaccccgacagcggcaaccugaccguggccagaagcgugcccagccccaugaccuuccugcugcuggugaagggccagcaggccgaccuggccagauacagcgugacccaggugaccguggaggccguggccgccgccggcagcccccccagauucccccagagacuguacagaggcaccguggccagaggcgccggcgccggcgugguggugaaggacgccgccgcccccagccagccccugagaauccaggcccaggaccccgaguucagcgaccugaacagcgccaucaccuacagaaucaccaaccacagccacuucagaauggagggcgagguggugcugaccaccaccacccuggcccaggccggcgccuucuacgccgagguggaggcccacaacaccgugaccagcggcaccgccaccaccgugaucgagauccaggugagcgagcaggagccccccagcaccgaggccggcggcaccaccggccccuggaccagcaccaccagcgaggugcccagaccccccgagcccagccagggccccagcaccaccagcagcggcggcggcaccggcccccacccccccagcggcaccacccugagaccccccaccagcagcacccccggcggcccccccggcgccgagaacagcaccagccaccagcccgccacccccggcggcgacaccgcccagacccccaagcccggcaccagccagcccaugccccccggcgugggcaccagcaccagccaccagcccgccacccccagcggcggcaccgcccagacccccgagcccggcaccagccagcccaugccccccagcaugggcaccagcaccagccaccagcccgccacccccggcggcggcaccgcccagacccccgaggccggcaccagccagcccaugccccccggcaugggcaccagcaccagccaccagcccaccacccccggcggcggcaccgcccagacccccgagcccggcaccagccagcccaugccccugagcaagagcacccccagcagcggcggcggccccagcgaggacaagagauucagcgugguggacauggccgcccugggcggcgugcugggcgcccugcugcugcuggcccugcugggccuggccgugcuggugcacaagcacuacggccccagacugaagugcugcagcggcaaggcccccgagccccagccccagggcuucgacaaccaggccuuccugcccgaccacaaggccaacugggcccccgugcccagccccacccacgaccccaagcccgccgaggcccccaugcccgccgagcccgccccccccggccccgccagccccggcggcgcccccgagccccccgccgccgccagagccggcggcagccccaccgccgugagaagcauccugaccaaggagagaagacccgagggcggcuacaaggccgugugguucggcgaggacaucggcaccgaggccgacgugguggugcugaacgcccccacccuggacguggacggcgccagcgacagcggcagcggcgacgagggcgagggcgccggcagaggcggcggccccuacgacgcccccggcggcgacgacagcuacaucuaa

SEQ ID NO: 14979 - RNA, 642 nt, Artificial Sequence
  CDIPT__Homo_sapiens__NP_006310
augcccgacgagaacaucuuccuguucgugcccaaccugaucggcuacgccagaaucguguucgccaucaucagcuucuacuucaugcccugcugcccccugaccgccagcagcuucuaccugcugagcggccugcuggacgccuucgacggccacgccgccagagcccugaaccagggcaccagauucggcgccaugcuggacaugcugaccgacagaugcagcaccaugugccugcuggugaaccuggcccugcuguaccccggcgccacccuguucuuccagaucagcaugagccuggacguggccagccacuggcugcaccugcacagcagcguggugagaggcagcgagagccacaagaugaucgaccugagcggcaaccccgugcugagaaucuacuacaccagcagacccgcccuguucacccugugcgccggcaacgagcuguucuacugccugcuguaccuguuccacuucagcgagggcccccuggugggcagcgugggccuguucagaaugggccugugggugaccgcccccaucgcccugcugaagagccugaucagcgugauccaccugaucaccgccgccagaaacauggccgcccuggacgccgccgacagagccaagaagaaguaa

SEQ ID NO: 14980 - RNA, 819 nt, Artificial Sequence
  CDK10__Homo_sapiens__NP_443713
auggacaaggagaaggacggcauccccaucagcagccugagagagaucacccugcugcugagacugagacaccccaacaucguggagcugaaggaggugguggugggcaaccaccuggagagcaucuuccuggugaugggcuacugcgagcaggaccuggccagccugcuggagaacaugcccacccccuucagcgaggcccaggugaagugcaucgugcugcaggugcugagaggccugcaguaccugcacagaaacuucaucauccacagagaccugaaggugagcaaccugcugaugaccgacaagggcugcgugaagaccgccgacuucggccuggccagagccuacggcgugcccgugaagcccaugacccccaagguggugacccugugguacagagcccccgagcugcugcugggcaccaccacccagaccaccagcaucgacaugugggccgugggcugcauccuggccgagcugcuggcccacagaccccugcugcccggcaccagcgagauccaccagaucgaccugaucgugcagcugcugggcacccccagcgagaacaucuggcccggcuucagcaagcugccccuggugggccaguacagccugagaaagcagcccuacaacaaccugaagcacaaguuccccuggcugagcgaggccggccugagacugcugcacuuccuguucauguacgaccccaagaagagagccaccgccggcgacugccuggagagcagcuacuucaaggagaagccccugagacugcccaucagcggcgugugcgagggcugcagagagcccggcuaa

SEQ ID NO: 14981 - RNA, 2388 nt, Artificial Sequence
  CDK11B__Homo_sapiens__NP_001778
augggcgacgagaaggacagcuggaaggugaagacccuggacgagauccugcaggagaagaagagaagaaaggagcaggaggagaaggccgagaucaagagacugaagaacagcgacgacagagacagcaagagagacagccuggaggagggcgagcugagagaccacagaauggagaucaccaucagaaacagccccuacagaagagaggacagcauggaggacagaggcgaggaggacgacagccuggccaucaagcccccccagcagaugagcagaaaggagaaggcccaccacagaaaggacgagaagagaaaggagaagagaagacacagaagccacagcgccgagggcggcaagcacgccagagugaaggagaaggagagagagcacgagagaagaaagagacacagagaggagcaggacaaggccagaagagagugggagagacagaagagaagagagauggccagagagcacagcagaagagagagagacagacuggagcagcuggagagaaagagagagagagagagaaagaugagagagcagcagaaggagcagagagagcagaaggagagagagagaagagccgaggagagaagaaaggagagagaggccagaagagaggugagcgcccaccacagaaccaugagagaggacuacagcgacaaggugaaggccagccacuggagcagaagcccccccagaccccccagagagagauucgagcugggcgacggcagaaagcccggcgaggccagacccgcccccgcccagaagcccgcccagcugaaggaggagaagauggaggagagagaccugcugagcgaccugcaggacaucagcgacagcgagagaaagaccagcagcgccgagagcagcagcgccgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgccgaggaggugagcgaggaggagaugagcgaggacgaggagagagagaacgagaaccaccugcugguggugcccgagagcagauucgacagagacagcggcgagagcgaggaggccgaggaggaggugggcgagggcaccccccagagcagcgcccugaccgagggcgacuacgugcccgacagccccgcccugagccccaucgagcugaagcaggagcugcccaaguaccugcccgcccugcagggcugcagaagcguggaggaguuccagugccugaacagaaucgaggagggcaccuacggcgugguguacagagccaaggacaagaagaccgacgagaucguggcccugaagagacugaagauggagaaggagaaggagggcuuccccaucaccagccugagagagaucaacaccauccugaaggcccagcaccccaacaucgugaccgugagagagaucguggugggcagcaacauggacaagaucuacaucgugaugaacuacguggagcacgaccugaagagccugauggagaccaugaagcagcccuuccugcccggcgaggugaagacccugaugauccagcugcugagaggcgugaagcaccugcacgacaacuggauccugcacagagaccugaagaccagcaaccugcugcugagccacgccggcauccugaaggugggcgacuucggccuggccagagaguacggcagcccccugaaggccuacacccccgugguggugacccugugguacagagcccccgagcugcugcugggcgccaaggaguacagcaccgccguggacauguggagcgugggcugcaucuucggcgagcugcugacccagaagccccuguuccccggcaagagcgagaucgaccagaucaacaagguguucaaggaccugggcacccccagcgagaagaucuggcccggcuacagcgagcugcccgccgugaagaagaugaccuucagcgagcaccccuacaacaaccugagaaagagauucggcgcccugcugagcgaccagggcuucgaccugaugaacaaguuccugaccuacuuccccggcagaagaaucagcgccgaggacggccugaagcacgaguacuucagagagaccccccugcccaucgaccccagcauguuccccaccuggcccgccaagagcgagcagcagagagugaagagaggcaccagccccagaccccccgagggcggccugggcuacagccagcugggcgacgacgaccugaaggagaccggcuuccaccugaccaccaccaaccagggcgccagcgccgccggccccggcuucagccugaaguucuaa

SEQ ID NO: 14982 - RNA, 4446 nt, Artificial Sequence
  CDK12__Homo_sapiens__NP_055898
augcccaacagcgagagacacggcggcaagaaggacggcagcggcggcgccagcggcacccugcagcccagcagcggcggcggcagcagcaacagcagagagagacacagacuggugagcaagcacaagagacacaagagcaagcacagcaaggacaugggccuggugacccccgaggccgccagccugggcaccgugaucaagccccugguggaguacgacgacaucagcagcgacagcgacaccuucagcgacgacauggccuucaagcuggacagaagagagaacgacgagagaagaggcagcgacagaagcgacagacugcacaagcacagacaccaccagcacagaagaagcagagaccugcugaaggccaagcagaccgagaaggagaagagccaggaggugagcagcaagagcggcagcaugaaggacagaaucagcggcagcagcaagagaagcaacgaggagaccgacgacuacggcaaggcccagguggccaagagcagcagcaaggagagcagaagcagcaagcugcacaaggagaagaccagaaaggagagagagcugaagagcggccacaaggacagaagcaagagccacagaaagagagagacccccaagagcuacaagaccguggacagccccaagagaagaagcagaagcccccacagaaaguggagcgacagcagcaagcaggacgacagccccagcggcgccagcuacggccaggacuacgaccugagccccagcagaagccacaccagcagcaacuacgacagcuacaagaagagccccggcagcaccagcagaagacagagcgugagcccccccuacaaggagcccagcgccuaccagagcagcaccagaagccccagccccuacagcagaagacagagaagcgugagccccuacagcagaagaagaagcagcagcuacgagagaagcggcagcuacagcggcagaagccccagccccuacggcagaagaagaagcagcagccccuuccugagcaagagaagccugagcagaagcccccugcccagcagaaagagcaugaagagcagaagcagaagccccgccuacagcagacacagcagcagccacagcaagaagaagagaagcagcagcagaagcagacacagcagcaucagccccgugagacugccccugaacagcagccugggcgccgagcugagcagaaagaagaaggagagagccgccgccgccgccgccgccaagauggacggcaaggagagcaagggcagccccguguuccugcccagaaaggagaacagcagcguggaggccaaggacagcggccuggagagcaagaagcugcccagaagcgugaagcuggagaagagcgcccccgacaccgagcuggugaacgugacccaccugaacaccgaggugaagaacagcagcgacaccggcaaggugaagcuggacgagaacagcgagaagcaccuggugaaggaccugaaggcccagggcaccagagacagcaagcccaucgcccugaaggaggagaucgugacccccaaggagaccgagaccagcgagaaggagaccccccccccccugcccaccaucgccagccccccccccccccugcccaccaccaccccccccccccagacccccccccugcccccccugccccccauccccgcccugccccagcagcccccccugccccccagccagcccgccuucagccaggugcccgccagcagcaccagcacccugccccccagcacccacagcaagaccagcgccgugagcagccaggccaacagccagccccccgugcaggugagcgugaagacccaggugagcgugaccgccgccaucccccaccugaagaccagcacccugcccccccugccccugcccccccugcugcccggcgacgacgacauggacagccccaaggagacccugcccagcaagcccgugaagaaggagaaggagcagagaaccagacaccugcugaccgaccugccccugccccccgagcugcccggcggcgaccugagcccccccgacagccccgagcccaaggccaucacccccccccagcagcccuacaagaagagacccaagaucugcugccccagauacggcgagagaagacagaccgagagcgacuggggcaagagaugcguggacaaguucgacaucaucggcaucaucggcgagggcaccuacggccagguguacaaggccaaggacaaggacaccggcgagcugguggcccugaagaaggugagacuggacaacgagaaggagggcuuccccaucaccgccaucagagagaucaagauccugagacagcugauccacagaagcguggugaacaugaaggagaucgugaccgacaagcaggacgcccuggacuucaagaaggacaagggcgccuucuaccugguguucgaguacauggaccacgaccugaugggccugcuggagagcggccuggugcacuucagcgaggaccacaucaagagcuucaugaagcagcugauggagggccuggaguacugccacaagaagaacuuccugcacagagacaucaagugcagcaacauccugcugaacaacagcggccagaucaagcuggccgacuucggccuggccagacuguacaacagcgaggagagcagacccuacaccaacaaggugaucacccugugguacagaccccccgagcugcugcugggcgaggagagauacacccccgccaucgacguguggagcugcggcugcauccugggcgagcuguucaccaagaagcccaucuuccaggccaaccuggagcuggcccagcuggagcugaucagcagacugugcggcagccccugccccgccguguggcccgacgugaucaagcugcccuacuucaacaccaugaagcccaagaagcaguacagaagaagacugagagaggaguucagcuucauccccagcgccgcccuggaccugcuggaccacaugcugacccuggaccccagcaagagaugcaccgccgagcagacccugcagagcgacuuccugaaggacguggagcugagcaagauggccccccccgaccugccccacuggcaggacugccacgagcuguggagcaagaagagaagaagacagagacagagcggcguggugguggaggagcccccccccagcaagaccagcagaaaggagaccaccagcggcaccagcaccgagcccgugaagaacagcagccccgcccccccccagcccgcccccggcaagguggagagcggcgccggcgacgccaucggccuggccgacaucacccagcagcugaaccagagcgagcuggccgugcugcugaaccugcugcagagccagaccgaccugagcaucccccagauggcccagcugcugaacauccacagcaaccccgagaugcagcagcagcuggaggcccugaaccagagcaucagcgcccugaccgaggccaccagccagcagcaggacagcgagaccauggcccccgaggagagccugaaggaggcccccagcgcccccgugauccugcccagcgccgagcagaccacccuggaggccagcagcacccccgccgacaugcagaacauccuggccgugcugcugagccagcugaugaagacccaggagcccgccggcagccuggaggagaacaacagcgacaagaacagcggcccccagggccccagaagaacccccaccaugccccaggaggaggccgccgagaagagaccccccgagccccccggcccccccccccccccccccccccccccccugguggagggcgaccugagcagcgccccccaggagcugaaccccgccgugaccgccgcccugcugcagcugcugagccagcccgaggccgagccccccggccaccugccccacgagcaccaggcccugagacccauggaguacagcaccagacccagacccaacagaaccuacggcaacaccgacggccccgagaccggcuucagcgccaucgacaccgacgagagaaacagcggccccgcccugaccgagagccuggugcagacccuggugaagaacagaaccuucagcggcagccugagccaccugggcgagagcagcagcuaccagggcaccggcagcgugcaguuccccggcgaccaggaccugagauucgccagagugccccuggcccugcaccccguggugggccagcccuuccugaaggccgagggcagcagcaacagcguggugcacgccgagaccaagcugcagaacuacggcgagcugggccccggcaccaccggcgccagcagcagcggcgccggccugcacuggggcggccccacccagagcagcgccuacggcaagcuguacagaggccccaccagagugccccccagaggcggcagaggcagaggcgugcccuacuaa

SEQ ID NO: 14983 - RNA, 4539 nt, Artificial Sequence
  CDK13__Homo_sapiens__NP_003709
augcccagcagcagcgacaccgcccugggcggcggcggcggccugagcugggccgagaagaagcuggaggagagaagaaagagaagaagauuccugagcccccagcagcccccccugcugcugccccugcugcagccccagcugcugcagccccccccccccccccccccccugcuguuccuggccgcccccggcaccgccgccgccgccgccgccgccgccgccgccagcagcagcugcuucagccccggccccccccuggaggugaagagacuggccagaggcaagagaagagccggcggcagacagaagagaagaagaggccccagagccggccaggaggccgagaagagaagaguguucagccugccccagccccagcaggacggcggcggcggcgccagcagcggcggcggcgugaccccccugguggaguacgaggacgugagcagccagagcgagcagggccugcugcugggcggcgccagcgccgccaccgccgccaccgccgccggcggcaccggcggcagcggcggcagccccgccagcagcagcggcacccagagaagaggcgagggcagcgagagaagacccagaagagacagaagaagcagcagcggcagaagcaaggagagacacagagagcacagaagaagagacggccagagaggcggcagcgaggccagcaagagcagaagcagacacagccacagcggcgaggagagagccgagguggccaagagcggcagcagcagcagcagcggcggcagaagaaagagcgccagcgccaccagcagcagcagcagcagcagaaaggacagagacagcaaggcccacagaagcagaaccaagagcagcaaggagccccccagcgccuacaaggagccccccaaggccuacagagaggacaagaccgagcccaaggccuacagaagaagaagaagccugagcccccugggcggcagagacgacagccccgugagccacagagccagccagagccugagaagcagaaagagccccagccccgccggcggcggcagcagccccuacagcagaagacugcccagaagccccagccccuacagcagaagaagaagccccagcuacagcagacacagcagcuacgagagaggcggcgacgugagccccagccccuacagcagcagcagcuggagaagaagcagaagccccuacagccccgugcugagaagaagcggcaagagcagaagcagaagccccuacagcagcagacacagcagaagcagaagcagacacagacugagcagaagcagaagcagacacagcagcaucagccccagcacccugacccugaagagcagccuggccgccgagcugaacaagaacaagaaggccagagccgccgaggccgccagagccgccgaggccgccaaggccgccgaggccaccaaggccgccgaggccgccgccaaggccgccaaggccagcaacaccagcacccccaccaagggcaacaccgagaccagcgccagcgccagccagaccaaccacgugaaggacgugaagaagaucaagaucgagcacgcccccagccccagcagcggcggcacccugaagaacgacaaggccaagaccaagcccccccugcaggugaccaagguggagaacaaccugaucguggacaaggccaccaagaaggccgugaucgugggcaaggagagcaagagcgccgccaccaaggaggagagcgugagccugaaggagaagaccaagccccugacccccagcaucggcgccaaggagaaggagcagcacguggcccuggugaccagcacccugcccccccugccccugccccccaugcugcccgaggacaaggaggccgacagccugagaggcaacaucagcgugaaggccgugaagaaggagguggagaagaagcugagaugccugcuggccgaccugccccugccccccgagcugcccggcggcgacgaccugagcaagagccccgaggagaagaagaccgccacccagcugcacagcaagagaagacccaagaucugcggccccagauacggcgagaccaaggagaaggacaucgacuggggcaagagaugcguggacaaguucgacaucaucggcaucaucggcgagggcaccuacggccagguguacaaggccagagacaaggacaccggcgagaugguggcccugaagaaggugagacuggacaacgagaaggagggcuuccccaucaccgccaucagagagaucaagauccugagacagcugacccaccagagcaucaucaacaugaaggagaucgugaccgacaaggaggacgcccuggacuucaagaaggacaagggcgccuucuaccugguguucgaguacauggaccacgaccugaugggccugcuggagagcggccuggugcacuucaacgagaaccacaucaagagcuucaugagacagcugauggagggccuggacuacugccacaagaagaacuuccugcacagagacaucaagugcagcaacauccugcugaacaacagaggccagaucaagcuggccgacuucggccuggccagacuguacagcagcgaggagagcagacccuacaccaacaaggugaucacccugugguacagaccccccgagcugcugcugggcgaggagagauacacccccgccaucgacguguggagcugcggcugcauccugggcgagcuguucaccaagaagcccaucuuccaggccaaccaggagcuggcccagcuggagcugaucagcagaaucugcggcagccccugccccgccguguggcccgacgugaucaagcugcccuacuucaacaccaugaagcccaagaagcaguacagaagaaagcugagagaggaguucguguucauccccgccgccgcccuggaccuguucgacuacaugcuggcccuggaccccagcaagagaugcaccgccgagcaggcccugcagugcgaguuccugagagacguggagcccagcaagaugcccccccccgaccugccccuguggcaggacugccacgagcuguggagcaagaagagaagaagacagaagcagaugggcaugaccgacgacgugagcaccaucaaggcccccagaaaggaccugagccugggccuggacgacagcagaaccaacaccccccagggcgugcugcccagcagccagcugaagagccagggcagcagcaacguggcccccgugaagaccggccccggccagcaccugaaccacagcgagcuggccauccugcugaaccugcugcagagcaagaccagcgugaacauggccgacuucgugcaggugcugaacaucaaggugaacagcgagacccagcagcagcugaacaagaucaaccugcccgccggcauccuggccaccggcgagaagcagaccgaccccagcaccccccagcaggagagcagcaagccccugggcggcauccagcccagcagccagaccauccagcccaagguggagaccgacgccgcccaggccgccgugcagagcgccuucgccgugcugcugacccagcugaucaaggcccagcagagcaagcagaaggacgugcugcuggaggagagagagaacggcagcggccacgaggccagccugcagcugagacccccccccgagcccagcacccccgugagcggccaggacgaccugauccagcaccaggacaugagaauccuggagcugacccccgagcccgacagacccagaauccugccccccgaccagagaccccccgagccccccgagcccccccccgugaccgaggaggaccuggacuacagaaccgagaaccagcacgugcccaccaccagcagcagccugaccgacccccacgccggcgugaaggccgcccugcugcagcugcuggcccagcaccagccccaggacgaccccaagagagagggcggcaucgacuaccaggccggcgacaccuacgugagcaccagcgacuacaaggacaacuucggcagcagcagcuucagcagcgcccccuacgugagcaacgacggccugggcagcagcagcgcccccccccuggagagaagaagcuucaucggcaacagcgacauccagagccuggacaacuacagcaccgccagcagccacagcggcggccccccccagcccagcgccuucagcgagagcuuccccagcagcguggccggcuacggcgacaucuaccugaacgccggccccaugcuguucagcggcgacaaggaccacagauucgaguacagccacggccccaucgccgugcuggccaacagcagcgaccccagcaccggccccgagagcacccacccccugcccgccaagaugcacaacuacaacuacggcggcaaccugcaggagaaccccagcggccccagccugaugcacggccagaccuggaccagccccgcccagggccccggcuacagccagggcuacagaggccacaucagcaccagcaccggcagaggcagaggcagaggccugcccuacuaa

SEQ ID NO: 14984 - RNA, 1410 nt, Artificial Sequence
  CDK14__Homo_sapiens__NP_001274064
augugcgaccugaucgagccccagcccgccgagaagaucggcaagaugaagaagcugagaagaacccugagcgagagcuucagcagaaucgcccugaagaaggacgacaccaccuucgacgagaucugcgugaccaagaugagcaccagaaacugccagggcauggacagcgugaucaagccccuggacaccauccccgaggacaagaaggugagagugcagagaacccagagcaccuucgaccccuucgagaagcccgccaaccaggugaagagagugcacagcgagaacaacgccugcaucaacuucaagaccagcagcaccggcaaggagagccccaaggugagaagacacagcagccccagcagccccaccagccccaaguucggcaaggccgacagcuacgagaagcuggagaagcugggcgagggcagcuacgccaccguguacaagggcaagagcaaggugaacggcaagcugguggcccugaaggugaucagacugcaggaggaggagggcacccccuucaccgccaucagagaggccagccugcugaagggccugaagcacgccaacaucgugcugcugcacgacaucauccacaccaaggagacccugacccugguguucgaguacgugcacaccgaccugugccaguacauggacaagcaccccggcggccugcaccccgacaacgugaagcuguuccuguuccagcugcugagaggccugagcuacauccaccagagauacauccugcacagagaccugaagccccagaaccugcugaucagcgacaccggcgagcugaagcuggccgacuucggccuggccagagccaagagcgugcccagccacaccuacagcaacgagguggugacccugugguacagaccccccgacgugcugcugggcagcaccgaguacagcaccugccuggacauguggggcgugggcugcaucuucguggagaugauccagggcguggccgccuuccccggcaugaaggacauccaggaccagcuggagagaaucuuccuggugcugggcacccccaacgaggacaccuggcccggcgugcacagccugccccacuucaagcccgagagauucacccuguacagcagcaagaaccugagacaggccuggaacaagcugagcuacgugaaccacgccgaggaccuggccagcaagcugcugcagugcagccccaagaacagacugagcgcccaggccgcccugagccacgaguacuucagcgaccugccccccagacugugggagcugaccgacaugagcagcaucuucaccgugcccaacgugagacugcagcccgaggccggcgagagcaugagagccuucggcaagaacaacagcuacggcaagagccugagcaacagcaagcacuaa

SEQ ID NO: 14985 - RNA, 1290 nt, Artificial Sequence
  CDK15__Homo_sapiens__NP_001248364
augggccaggagcugugcgccaagaccgugcagcccggcugcagcugcuaccacugcagcgagggcggcgaggcccacagcugcagaagaagccagcccgagaccaccgaggccgccuucaagcugaccgaccugaaggaggccagcugcagcaugaccagcuuccaccccagaggccugcaggccgccagagcccagaaguucaagagcaagagacccagaagcaacagcgacugcuuccaggaggaggaccugagacagggcuuccaguggagaaagagccugcccuucggcgccgccagcagcuaccugaaccuggagaagcugggcgagggcagcuacgccaccguguacaagggcaucagcagaaucaacggccagcugguggcccugaaggugaucagcaugaacgccgaggagggcgugcccuucaccgccaucagagaggccagccugcugaagggccugaagcacgccaacaucgugcugcugcacgacaucauccacaccaaggagacccugaccuucguguucgaguacaugcacaccgaccuggcccaguacaugagccagcaccccggcggccugcacccccacaacgugagacuguucauguuccagcugcugagaggccuggccuacauccaccaccagcacgugcugcacagagaccugaagccccagaaccugcugaucagccaccugggcgagcugaagcuggccgacuucggccuggccagagccaagagcauccccagccagaccuacagcagcgagguggugacccugugguacagaccccccgacgcccugcugggcgccaccgaguacagcagcgagcuggacaucuggggcgccggcugcaucuucaucgagauguuccagggccagccccuguuccccggcgugagcaacauccuggagcagcuggagaagaucugggaggugcugggcgugcccaccgaggacaccuggcccggcgugagcaagcugcccaacuacaaccccgagugguucccccugcccacccccagaagccugcacgugguguggaacagacugggcagagugcccgaggccgaggaccuggccagccagaugcugaagggcuuccccagagacagagugagcgcccaggaggcccuggugcacgacuacuucagcgcccugcccagccagcuguaccagcugcccgacgugagcggcgugagacugaagcccgagaugugcgaccugcuggccagcuaccagaagggccaccaccccgcccaguucagcaagugcugguaa

SEQ ID NO: 14986 - RNA, 1713 nt, Artificial Sequence
  CDK16__Homo_sapiens__NP_001163931
augccccuguacggcagagccagagaccacgugacccaccccagcauccugggcaccagacccggcagacccauggccggccccaucaccgccgccgugcccgagaagaucugcaacggcgccuucugcagcugcagcggcgccuucccccuggaccccaacaaccccagccugggcccccugcccagcaucagccaccugaaccugagaacccagaucgccauggacagaaugaagaagaucaagagacagcugagcaugacccugagaggcggcagaggcaucgacaagaccaacggcgcccccgagcagaucggccuggacgagagcggcggcggcggcggcagcgaccccggcgaggcccccaccagagccgcccccggcgagcugagaagcgccagaggcccccugagcagcgcccccgagaucgugcacgaggaccugaagaugggcagcgacggcgagagcgaccaggccagcgccaccagcagcgacgaggugcagagccccgugagagugagaaugagaaaccacccccccagaaagaucagcaccgaggacaucaacaagagacugagccugcccgccgacaucagacugcccgagggcuaccuggagaagcugacccugaacagccccaucuucgacaagccccugagcagaagacugagaagagugagccugagcgagaucggcuucggcaagcuggagaccuacaucaagcuggacaagcugggcgagggcaccuacgccaccguguacaagggcaagagcaagcugaccgacaaccugguggcccugaaggagaucagacuggagcacgaggagggcgcccccugcaccgccaucagagaggugagccugcugaaggaccugaagcacgccaacaucgugacccugcacgacaucauccacaccgagaagagccugacccugguguucgaguaccuggacaaggaccugaagcaguaccuggacgacugcggcaacaucaucaacaugcacaacgugaagcuguuccuguuccagcugcugagaggccuggccuacugccacagacagaaggugcugcacagagaccugaagccccagaaccugcugaucaacgagagaggcgagcugaagcuggccgacuucggccuggccagagccaagagcauccccaccaagaccuacagcaacgagguggugacccugugguacagaccccccgacauccugcugggcagcaccgacuacagcacccagaucgacauguggggcgugggcugcaucuucuacgagauggccaccggcagaccccuguuccccggcagcaccguggaggagcagcugcacuucaucuucagaauccugggcacccccaccgaggagaccuggcccggcauccugagcaacgaggaguucaagaccuacaacuaccccaaguacagagccgaggcccugcugagccacgcccccagacuggacagcgacggcgccgaccugcugaccaagcugcugcaguucgagggcagaaacagaaucagcgccgaggacgccaugaagcaccccuucuuccugagccugggcgagagaauccacaagcugcccgacaccaccagcaucuucgcccugaaggagauccagcugcagaaggaggccagccugagaagcagcagcaugcccgacagcggcagacccgccuucagagugguggacaccgaguucuaa

SEQ ID NO: 14987 - RNA, 1572 nt, Artificial Sequence
  CDK17__Homo_sapiens__NP_002586
augaagaaguucaagagaagacugagccugacccugagaggcagccagaccaucgacgagagccugagcgagcuggccgagcagaugaccaucgaggagaacagcagcaaggacaacgagcccaucgugaagaacggcagaccccccaccagccacagcaugcacagcuuccugcaccaguacaccggcagcuucaagaagcccccccugagaagaccccacagcgugaucggcggcagccugggcagcuucauggccaugcccagaaacggcagcagacuggacaucgugcacgagaaccugaagaugggcagcgacggcgagagcgaccaggccagcggcaccagcagcgacgaggugcagagccccaccggcgugugccugagaaacagaauccacagaagaaucagcauggaggaccugaacaagagacugagccugcccgccgacaucagaauccccgacggcuaccuggagaagcugcagaucaacagcccccccuucgaccagcccaugagcagaagaagcagaagagccagccugagcgagaucggcuucggcaagauggagaccuacaucaagcuggagaagcugggcgagggcaccuacgccaccguguacaagggcagaagcaagcugaccgagaaccugguggcccugaaggagaucagacuggagcacgaggagggcgcccccugcaccgccaucagagaggugagccugcugaaggaccugaagcacgccaacaucgugacccugcacgacaucgugcacaccgacaagagccugacccugguguucgaguaccuggacaaggaccugaagcaguacauggacgacugcggcaacaucaugagcaugcacaacgugaagcuguuccuguaccagauccugagaggccuggccuacugccacagaagaaaggugcugcacagagaccugaagccccagaaccugcugaucaacgagaagggcgagcugaagcuggccgacuucggccuggccagagccaagagcgugcccaccaagaccuacagcaacgagguggugacccugugguacagaccccccgacgugcugcugggcagcagcgaguacagcacccagaucgacauguggggcgugggcugcaucuucuucgagauggccagcggcagaccccuguuccccggcagcaccguggaggacgagcugcaccugaucuucagacugcugggcacccccagccaggagaccuggcccggcaucagcagcaacgaggaguucaagaacuacaacuuccccaaguacaagccccagccccugaucaaccacgcccccagacuggacagcgagggcaucgagcugaucaccaaguuccugcaguacgagagcaagaagagagugagcgccgaggaggccaugaagcacguguacuucagaagccugggccccagaauccacgcccugcccgagagcgugagcaucuucagccugaaggagauccagcugcagaaggaccccggcuucagaaacagcagcuaccccgagaccggccacggcaagaacagaagacagagcaugcuguucuaa

SEQ ID NO: 14988 - RNA, 1425 nt, Artificial Sequence
  CDK18__Homo_sapiens__NP_002587
augaucaugaacaagaugaagaacuucaagagaagauucagccugagcgugcccagaaccgagaccaucgaggagagccuggccgaguucaccgagcaguucaaccagcugcacaacagaagaaacgagaaccugcagcugggcccccugggcagagaccccccccaggagugcagcaccuucagccccaccgacagcggcgaggagcccggccagcugagccccggcgugcaguuccagagaagacagaaccagagaagauucagcauggaggacgugagcaagagacugagccugcccauggacaucagacugccccaggaguuccugcagaagcugcagauggagagccccgaccugcccaagccccugagcagaaugagcagaagagccagccugagcgacaucggcuucggcaagcuggagaccuacgugaagcuggacaagcugggcgagggcaccuacgccaccguguucaagggcagaagcaagcugaccgagaaccugguggcccugaaggagaucagacuggagcacgaggagggcgcccccugcaccgccaucagagaggugagccugcugaagaaccugaagcacgccaacaucgugacccugcacgaccugauccacaccgacagaagccugacccugguguucgaguaccuggacagcgaccugaagcaguaccuggaccacugcggcaaccugaugagcaugcacaacgugaagaucuucauguuccagcugcugagaggccuggccuacugccaccacagaaagauccugcacagagaccugaagccccagaaccugcugaucaacgagagaggcgagcugaagcuggccgacuucggccuggccagagccaagagcgugcccaccaagaccuacagcaacgagguggugacccugugguacagaccccccgacgugcugcugggcagcaccgaguacagcacccccaucgacauguggggcgugggcugcauccacuacgagauggccaccggcagaccccuguuccccggcagcaccgugaaggaggagcugcaccugaucuucagacugcugggcacccccaccgaggagaccuggcccggcgugaccgccuucagcgaguucagaaccuacagcuuccccugcuaccugccccagccccugaucaaccacgcccccagacuggacaccgacggcauccaccugcugagcagccugcugcuguacgagagcaagagcagaaugagcgccgaggccgcccugagccacagcuacuucagaagccugggcgagagagugcaccagcuggaggacaccgccagcaucuucagccugaaggagauccagcugcagaaggaccccggcuacagaggccuggccuuccagcagcccggcagaggcaagaacagaagacagagcaucuucuaa

SEQ ID NO: 14989 - RNA, 1329 nt, Artificial Sequence
  CDK19__Homo_sapiens__NP_001287892
augagcgccugcagagagaucgcccugcugagagagcugaagcaccccaacgugaucgcccugcagaagguguuccugagccacagcgacagaaagguguggcugcuguucgacuacgccgagcacgaccuguggcacaucaucaaguuccacagagccagcaaggccaacaagaagcccaugcagcugcccagaagcauggugaagagccugcuguaccagauccuggacggcauccacuaccugcacgccaacugggugcugcacagagaccugaagcccgccaacauccuggugaugggcgagggccccgagagaggcagagugaagaucgccgacaugggcuucgccagacuguucaacagcccccugaagccccuggccgaccuggaccccgugguggugaccuucugguacagagcccccgagcugcugcugggcgccagacacuacaccaaggccaucgacaucugggccaucggcugcaucuucgccgagcugcugaccagcgagcccaucuuccacugcagacaggaggacaucaagaccagcaaccccuuccaccacgaccagcuggacagaaucuucagcgugaugggcuuccccgccgacaaggacugggaggacaucagaaagaugcccgaguaccccacccugcagaaggacuucagaagaaccaccuacgccaacagcagccugaucaaguacauggagaagcacaaggugaagcccgacagcaagguguuccugcugcugcagaagcugcugaccauggaccccaccaagagaaucaccagcgagcaggcccugcaggaccccuacuuccaggaggacccccugcccacccuggacguguucgccggcugccagauccccuaccccaagagagaguuccugaacgaggacgaccccgaggagaagggcgacaagaaccagcagcagcagcagaaccagcaccagcagcccaccgcccccccccagcaggccgccgcccccccccaggccccccccccccagcagaacagcacccagaccaacggcaccgccggcggcgccggcgccggcgugggcggcaccggcgccggccugcagcacagccaggacagcagccugaaccaggugccccccaacaagaagcccagacugggccccagcggcgccaacagcggcggccccgugaugcccagcgacuaccagcacagcagcagcagacugaacuaccagagcagcgugcagggcagcagccagagccagagcacccugggcuacagcagcagcagccagcagagcagccaguaccaccccagccaccaggcccacagauacuaa

SEQ ID NO: 14990 - RNA, 723 nt, Artificial Sequence
  CDK1__Homo_sapiens__NP_203698
auggaggacuacaccaagaucgagaagaucggcgagggcaccuacggcgugguguacaagggcagacacaagaccaccggccaggugguggccaugaagaagaucagacuggagagcgaggaggagggcgugcccagcaccgccaucagagagaucagccugcugaaggagcugagacaccccaacaucgugagccugcaggacgugcugaugcaggacagcagacuguaccugaucuucgaguuccugagcauggaccugaagaaguaccuggacagcaucccccccggccaguacauggacagcagccuggugaagguggugacccugugguacagaagccccgaggugcugcugggcagcgccagauacagcacccccguggacaucuggagcaucggcaccaucuucgccgagcuggccaccaagaagccccuguuccacggcgacagcgagaucgaccagcuguucagaaucuucagagcccugggcacccccaacaacgagguguggcccgagguggagagccugcaggacuacaagaacaccuuccccaaguggaagcccggcagccuggccagccacgugaagaaccuggacgagaacggccuggaccugcugagcaagaugcugaucuacgaccccgccaagagaaucagcggcaagauggcccugaaccaccccuacuucaacgaccuggacaaccagaucaagaagauguaa

SEQ ID NO: 14991 - RNA, 1041 nt, Artificial Sequence
  CDK20__Homo_sapiens__NP_001034892
auggaccaguacugcauccugggcagaaucggcgagggcgcccacggcaucguguucaaggccaagcacguggagaccggcgagaucguggcccugaagaagguggcccugagaagacuggaggacggcuuccccaaccaggcccugagagagaucaaggcccugcaggagauggaggacaaccaguacguggugcagcugaaggccguguucccccacggcggcggcuucgugcuggccuucgaguucaugcugagcgaccuggccgagguggugagacacgcccagagaccccuggcccaggcccaggugaagagcuaccugcagaugcugcugaagggcguggccuucugccacgccaacaacaucgugcacagagaccugaagcccgccaaccugcugaucagcgccagcggccagcugaagaucgccgacuucggccuggccagaguguucagccccgacggcagcagacuguacacccaccagguggccaccagaugguacagagcccccgagcugcuguacggcgccagacaguacgaccagggcguggaccuguggagcgugggcugcaucaugggcgagcugcugaacggcagcccccuguuccccggcaagaacgacaucgagcagcugugcuacgugcugagaauccugggcacccccaacccccagguguggcccgagcugaccgagcugcccgacuacaacaagaucagcuucaaggagcaggugcccaugccccuggaggaggugcugcccgacgugagcccccaggcccuggaccugcugggccaguuccugcuguaccccccccaccagagaaucgccgccagcaaggcccugcugcaccaguacuucuucaccgccccccugcccgcccaccccagcgagcugcccaucccccagagacugggcggccccgcccccaaggcccaccccggccccccccacauccacgacuuccacguggacagaccccuggaggagagccugcugaaccccgagcugaucagacccuucauccuggagggcuaa

SEQ ID NO: 14992 - RNA, 348 nt, Artificial Sequence
  CDK2AP1__Homo_sapiens__NP_004633
augagcuacaagcccaaccuggccgcccacaugcccgccgccgcccugaacgccgccggcagcgugcacagccccagcaccagcauggccaccagcagccaguacagacagcugcugagcgacuacggcccccccagccugggcuacacccagggcaccggcaacagccaggugccccagagcaaguacgccgagcugcuggccaucaucgaggagcugggcaaggagaucagacccaccuacgccggcagcaagagcgccauggagagacugaagagaggcaucauccacgccagaggccuggugagagagugccuggccgagaccgagagaaacgccagaagcuaa

SEQ ID NO: 14993 - RNA, 381 nt, Artificial Sequence
  CDK2AP2__Homo_sapiens__NP_005842
augagcuacaagcccaucgcccccgcccccagcagcacccccggcagcagcacccccggccccggcacccccgugcccaccggcagcgugcccagccccagcggcagcgugcccggcgccggcgcccccuucagaccccuguucaacgacuucggcccccccagcaugggcuacgugcaggccaugaagccccccggcgcccagggcagccagagcaccuacaccgaccugcugagcgugaucgaggagaugggcaaggagaucagacccaccuacgccggcagcaagagcgccauggagagacugaagagaggcaucauccacgccagagcccuggugagagagugccuggccgagaccgagagaaacgccagaaccuaa

SEQ ID NO: 14994 - RNA, 897 nt, Artificial Sequence
  CDK2__Homo_sapiens__NP_001789
auggagaacuuccagaagguggagaagaucggcgagggcaccuacggcgugguguacaaggccagaaacaagcugaccggcgaggugguggcccugaagaagaucagacuggacaccgagaccgagggcgugcccagcaccgccaucagagagaucagccugcugaaggagcugaaccaccccaacaucgugaagcugcuggacgugauccacaccgagaacaagcuguaccugguguucgaguuccugcaccaggaccugaagaaguucauggacgccagcgcccugaccggcaucccccugccccugaucaagagcuaccuguuccagcugcugcagggccuggccuucugccacagccacagagugcugcacagagaccugaagccccagaaccugcugaucaacaccgagggcgccaucaagcuggccgacuucggccuggccagagccuucggcgugcccgugagaaccuacacccacgagguggugacccugugguacagagcccccgagauccugcugggcugcaaguacuacagcaccgccguggacaucuggagccugggcugcaucuucgccgagauggugaccagaagagcccuguuccccggcgacagcgagaucgaccagcuguucagaaucuucagaacccugggcacccccgacgaggugguguggcccggcgugaccagcaugcccgacuacaagcccagcuuccccaagugggccagacaggacuucagcaagguggugcccccccuggacgaggacggcagaagccugcugagccagaugcugcacuacgaccccaacaagagaaucagcgccaaggccgcccuggcccaccccuucuuccaggacgugaccaagcccgugccccaccugagacuguaa

SEQ ID NO: 14995 - RNA, 918 nt, Artificial Sequence
  CDK3__Homo_sapiens__NP_001249
auggacauguuccagaagguggagaagaucggcgagggcaccuacggcgugguguacaaggccaagaacagagagaccggccagcugguggcccugaagaagaucagacuggaccuggagauggagggcgugcccagcaccgccaucagagagaucagccugcugaaggagcugaagcaccccaacaucgugagacugcuggacguggugcacaacgagagaaagcuguaccugguguucgaguuccugagccaggaccugaagaaguacauggacagcacccccggcagcgagcugccccugcaccugaucaagagcuaccuguuccagcugcugcagggcgugagcuucugccacagccacagagugauccacagagaccugaagccccagaaccugcugaucaacgagcugggcgccaucaagcuggccgacuucggccuggccagagccuucggcgugccccugagaaccuacacccacgagguggugacccugugguacagagcccccgagauccugcugggcagcaaguucuacaccaccgccguggacaucuggagcaucggcugcaucuucgccgagauggugaccagaaaggcccuguuccccggcgacagcgagaucgaccagcuguucagaaucuucagaaugcugggcacccccagcgaggacaccuggcccggcgugacccagcugcccgacuacaagggcagcuuccccaaguggaccagaaagggccuggaggagaucgugcccaaccuggagcccgagggcagagaccugcugaugcagcugcugcaguacgaccccagccagagaaucaccgccaagaccgcccuggcccaccccuacuucagcagccccgagcccagccccgccgccagacaguacgugcugcagagauucagacacuaa

SEQ ID NO: 14996 - RNA, 912 nt, Artificial Sequence
  CDK4__Homo_sapiens__NP_000066
auggccaccagcagauacgagcccguggccgagaucggcgugggcgccuacggcaccguguacaaggccagagacccccacagcggccacuucguggcccugaagagcgugagagugcccaacggcggcggcggcggcggcggccugcccaucagcaccgugagagagguggcccugcugagaagacuggaggccuucgagcaccccaacguggugagacugauggacgugugcgccaccagcagaaccgacagagagaucaaggugacccugguguucgagcacguggaccaggaccugagaaccuaccuggacaaggcccccccccccggccugcccgccgagaccaucaaggaccugaugagacaguuccugagaggccuggacuuccugcacgccaacugcaucgugcacagagaccugaagcccgagaacauccuggugaccagcggcggcaccgugaagcuggccgacuucggccuggccagaaucuacagcuaccagauggcccugacccccgugguggugacccugugguacagagcccccgaggugcugcugcagagcaccuacgccacccccguggacauguggagcgugggcugcaucuucgccgagauguucagaagaaagccccuguucugcggcaacagcgaggccgaccagcugggcaagaucuucgaccugaucggccugccccccgaggacgacuggcccagagacgugagccugcccagaggcgccuucccccccagaggccccagacccgugcagagcguggugcccgagauggaggagagcggcgcccagcugcugcuggagaugcugaccuucaacccccacaagagaaucagcgccuucagagcccugcagcacagcuaccugcacaaggacgagggcaaccccgaguaa

SEQ ID NO: 14997 - RNA, 783 nt, Artificial Sequence
  CDK5__Homo_sapiens__NP_001157882
augcagaaguacgagaagcuggagaagaucggcgagggcaccuacggcaccguguucaaggccaagaacagagagacccacgagaucguggcccugaagagagugagacuggacgacgacgacgagggcgugcccagcagcgcccugagagagaucugccugcugaaggagcugaagcacaagaacaucgugagacugcacgacgugcugcacagcgacaagaagcugacccugguguucgaguucugcgaccaggaccugaagaaguacuucgacagcugcaacggcgaccuggaccccgagaucgugaagaacggcgagcugaagcuggccgacuucggccuggccagagccuucggcauccccgugagaugcuacagcgccgagguggugacccugugguacagaccccccgacgugcuguucggcgccaagcuguacagcaccagcaucgacauguggagcgccggcugcaucuucgccgagcuggccaacgccggcagaccccuguuccccggcaacgacguggacgaccagcugaagagaaucuucagacugcugggcacccccaccgaggagcaguggcccagcaugaccaagcugcccgacuacaagcccuaccccauguaccccgccaccaccagccuggugaacguggugcccaagcugaacgccaccggcagagaccugcugcagaaccugcugaagugcaaccccgugcagagaaucagcgccgaggaggcccugcagcaccccuacuucagcgacuucugcccccccuaa

SEQ ID NO: 14998 - RNA, 924 nt, Artificial Sequence
  CDK5R1__Homo_sapiens__XP_011523740
augggcaccgugcugagccugagccccagcuacagaaaggccacccuguucgaggacggcgccgccaccgugggccacuacaccgccgugcagaacagcaagaacgccaaggacaagaaccugaagagacacagcaucaucagcgugcugcccuggaagagaaucguggccgugagcgccaagaagaagaacagcaagaaggugcagcccaacagcagcuaccagaacaacaucacccaccugaacaacgagaaccugaagaagagccugagcugcgccaaccugagcaccuucgcccagcccccccccgcccagccccccgccccccccgccagccagcugagcggcagccagaccggcggcagcagcagcgugaagaaggccccccaccccgccgugaccagcgccggcacccccaagagagugaucgugcaggccagcaccagcgagcugcugagaugccugggcgaguuccugugcagaagaugcuacagacugaagcaccugagccccaccgaccccgugcuguggcugagaagcguggacagaagccugcugcugcagggcuggcaggaccagggcuucaucacccccgccaacgugguguuccuguacaugcugugcagagacgugaucagcagcgaggugggcagcgaccacgagcugcaggccgugcugcugaccugccuguaccugagcuacagcuacaugggcaacgagaucagcuacccccugaagcccuuccugguggagagcugcaaggaggccuucugggacagaugccugagcgugaucaaccugaugagcagcaagaugcugcagaucaacgccgacccccacuacuucacccagguguucagcgaccugaagaacgagagcggccaggaggacaagaagagacugcugcugggccuggacagauaa

SEQ ID NO: 14999 - RNA, 1104 nt, Artificial Sequence
  CDK5R2__Homo_sapiens__NP_003927
augggcaccgugcugagccugagccccgccagcagcgccaagggcagaagacccggcggccugcccgaggagaagaagaaggccccccccgccggcgacgaggcccugggcggcuacggcgccccccccgugggcaagggcggcaagggcgagagcagacugaagagacccagcgugcugaucagcgcccugaccuggaagagacugguggccgccagcgccaagaagaagaagggcagcaagaaggugacccccaagcccgccagcaccggccccgacccccuggugcagcagagaaacagagagaaccugcugagaaagggcagagacccccccgacggcggcggcaccgccaagccccuggccgugcccgugcccaccgugcccgccgccgccgccaccugcgagccccccagcggcggcagcgccgccgcccagccccccggcagcggcggcggcaagcccccccccccccccccccccgccccccagguggccccccccgugcccggcggcagccccagaagagugaucgugcaggccagcaccggcgagcugcugagaugccugggcgacuucgugugcagaagaugcuacagacugaaggagcugagccccggcgagcuggugggcugguucagaggcguggacagaagccugcugcugcagggcuggcaggaccaggccuucaucacccccgccaaccugguguucguguaccugcugugcagagagagccugagaggcgacgagcuggccagcgccgccgagcugcaggccgccuuccugaccugccuguaccuggccuacagcuacaugggcaacgagaucagcuacccccugaagcccuuccugguggagcccgacaaggagagauucuggcagagaugccugagacugauccagagacugagcccccagaugcugagacugaacgccgacccccacuucuucacccagguguuccaggaccugaagaacgagggcgaggccgccgccagcggcggcggcccccccagcggcggcgcccccgccgccagcagcgccgccagagacagcugcgccgccggcaccaagcacuggaccaugaaccuggacagauaa

SEQ ID NO: 15000 - RNA, 1761 nt, Artificial Sequence
  CDK5RAP1__Homo_sapiens__NP_001265096
augcacccccugcagugcgugcugcaggugcagagaagccugggcuggggcccccuggccagcgugagcuggcugagccugagaaugugcagagcccacagcagccugagcagcaccaugugccccagccccgagagacaggaggacggcgccagaaaggacuucagcagcagacuggccgccggccccaccuuccagcacuuccugaagagcgccagcgccccccaggagaagcugagcagcgagguggaggaccccccccccuaccugaugauggacgagcugcugggcagacagagaaagguguaccuggagaccuacggcugccagaugaacgugaacgacaccgagaucgccuggagcauccugcagaagagcggcuaccugagaaccagcaaccugcaggaggccgacgugauccugcuggugaccugcagcaucagagagaaggccgagcagaccaucuggaacagacugcaccagcugaaggcccugaagaccagaagacccagaagcagagugccccugagaaucggcauccugggcugcauggccgagagacugaaggaggagauccugaacagagagaagaugguggacauccuggccggccccgacgccuacagagaccugcccagacugcuggccguggccgagagcggccagcaggccgccaacgugcugcugagccuggacgagaccuacgccgacgugaugcccgugcagaccagcgccagcgccaccagcgccuucgugagcaucaugagaggcugcgacaacaugugcagcuacugcaucgugcccuucaccagaggcagagagagaagcagacccaucgccagcauccuggaggaggugaagaagcugagcgagcagggccugaaggaggugacccugcugggccagaacgugaacagcuucagagacaacagcgaggugcaguucaacagcgccgugcccaccaaccugagcagaggcuucaccaccaacuacaagaccaagcagggcggccugagauucgcccaccugcuggaccaggugagcagaguggaccccgagaugagaaucagauucaccagcccccaccccaaggacuuccccgacgaggugcugcagcugauccacgagagagacaacaucugcaagcagauccaccugcccgcccagagcggcagcagcagagugcuggaggccaugagaagaggcuacagcagagaggccuacguggagcuggugcaccacaucagagagagcauccccggcgugagccugagcagcgacuucaucgccggcuucugcggcgagaccgaggaggaccacgugcagaccgugagccugcugagagaggugcaguacaacaugggcuuccuguucgccuacagcaugagacagaccagagccuaccacagacugaaggacgacgugcccgaggaggugaagcugagaagacuggaggagcugaucaccaucuucagagaggaggccaccaaggccaaccagaccagcgugggcugcacccagcuggugcugguggagggccugagcaagagaagcgccaccgaccugugcggcagaaacgacggcaaccugaaggugaucuuccccgacgccgagauggaggacgugaacaaccccggccugagagugagagcccagcccggcgacuacgugcuggugaagaucaccagcgccagcagccagacccugagaggccacgugcugugcagaaccacccugagagacagcagcgccuacugcuaa

SEQ ID NO: 15001 - RNA, 5445 nt, Artificial Sequence
  CDK5RAP2__Homo_sapiens__NP_001011649
augauggaccuggugcuggaggaggacgugaccgugcccggcacccugagcggcugcagcggccuggugcccagcgugcccgacgaccuggacggcaucaaccccaacgccggccugggcaacggccugcugcccaacgugagcgaggagaccgugagccccaccagagccagaaacaugaaggacuucgagaaccagaucaccgagcugaagaaggagaacuucaaccugaagcugagaaucuacuuccuggaggagagaaugcagcaggaguuccacggccccaccgagcacaucuacaagaccaacaucgagcugaagguggagguggagagccugaagagagagcugcaggagagagagcagcugcugaucaaggccagcaaggccguggagagccuggccgaggccggcggcagcgagauccagagagugaaggaggacgccagaaagaaggugcagcagguggaggaccugcugaccaagagaauccugcugcuggagaaggacgugaccgccgcccaggccgagcuggagaaggccuucgccggcaccgagaccgagaaggcccugagacugagacuggagagcaagcugagcgagaugaagaagaugcacgagggcgaccuggccauggcccuggugcuggacgagaaggacagacugaucgaggagcugaagcugagccugaagagcaaggaggcccugauccagugccugaaggaggagaagagccagauggccugccccgacgagaacgugagcagcggcgagcugagaggccugugcgccgcccccagagaggagaaggagagagagaccgaggccgcccagauggagcaccagaaggagagaaacagcuucgaggagagaauccaggcccuggaggaggaccugagagagaaggagagagagaucgccaccgagaagaagaacagccugaagagagacaaggccauccagggccugaccauggcccugaagagcaaggagaagaagguggaggagcugaacagcgagaucgagaagcugagcgccgccuucgccaaggccagagaggcccugcagaaggcccagacccaggaguuccagggcagcgaggacuacgagaccgcccugagcggcaaggaggcccugagcgccgcccugagaagccagaaccugaccaagagcaccgagaaccacagacugagaagaagcaucaagaagaucacccaggagcugagcgaccugcagcaggagagagagagacuggagaaggaccuggaggaggcccacagagagaagagcaagggcgacugcaccaucagagaccugagaaacgagguggagaagcugagaaacgaggugaacgagagagagaaggccauggagaacagauacaagagccugcugagcgagagcaacaagaagcugcacaaccaggagcaggugaucaagcaccugaccgagagcaccaaccagaaggacgugcugcugcagaaguucaacgagaaggaccuggaggugauccagcagaacugcuaccugauggccgccgaggaccuggagcugagaagcgagggccugaucaccgagaagugcagcagccagcagccccccggcagcaagaccaucuucagcaaggagaagaagcagagcagcgacuacgaggagcugauccaggugcugaagaaggagcaggacaucuacacccaccuggugaagagccugcaggagagcgacagcaucaacaaccugcaggccgagcugaacaagaucuucgcccugagaaagcagcuggagcaggacgugcugagcuaccagaaccugagaaagacccuggaggagcagaucagcgagaucagaagaagagaggaggagagcuucagccuguacagcgaccagaccagcuaccugagcaucugccuggaggagaacaacagauuccagguggagcacuucagccaggaggagcugaagaagaaggugagcgaccugauccagcuggugaaggagcuguacaccgacaaccagcaccugaagaagaccaucuucgaccugagcugcaugggcuuccagggcaacggcuuccccgacagacuggccagcaccgagcagaccgagcugcuggccagcaaggaggacgaggacaccaucaagaucggcgaggacgacgagaucaacuuccugagcgaccagcaccugcagcagagcaacgagaucaugaaggaccugagcaagggcggcugcaagaacggcuaccugagacacaccgagagcaagaucagcgacugcgacggcgcccacgcccccggcugccuggaggagggcgccuucaucaaccugcuggccccccuguucaacgagaaggccacccugcugcuggagagcagacccgaccugcugaagguggugagagagcugcugcugggccagcuguuccugaccgagcaggaggugagcggcgagcaccuggacggcaagaccgagaagacccccaagcagaagggcgagcuggugcacuucgugcagaccaacagcuucagcaagccccacgacgagcugaagcugagcugcgaggcccagcuggugaaggccggcgaggugcccaaggugggccugaaggacgccagcgugcagaccguggccaccgagggcgaccugcugagauucaagcacgaggccaccagagaggccugggaggagaagcccaucaacaccgcccugagcgccgagcacagacccgagaaccugcacggcgugcccggcuggcaggccgcccugcugagccugcccggcaucaccaacagagaggccaagaagagcagacugcccauccugaucaagcccagcagaagccugggcaacauguacagacugcccgccacccaggagguggugacccagcugcagagccagauccuggagcugcagggcgagcugaaggaguucaagaccugcaacaagcagcugcaccagaagcugauccuggccgaggccgugauggagggcagacccacccccgacaagacccugcugaacgcccagccccccgugggcgccgccuaccaggacagccccggcgagcagaagggcaucaagaccaccagcagcguguggagagacaaggagauggacagcgaccagcagagaagcuacgagaucgacagcgagaucugcccccccgacgaccuggccagccugcccagcugcaaggagaaccccgaggacgugcugagccccaccagcguggccaccuaccugagcagcaagagccagcccagcgccaaggugagcgugaugggcaccgaccagagcgagagcaucaacaccagcaacgagaccgaguaccugaagcagaagauccacgaccuggagaccgagcuggagggcuaccagaacuucaucuuccagcugcagaagcacagccagugcagcgaggccaucaucaccgugcugugcggcaccgagggcgcccaggacggccugagcaagcccaagaacggcagcgacggcgaggagaugaccuucagcagccugcaccaggugagauacgugaagcacgugaagauccugggcccccuggcccccgagaugaucgacagcagagugcuggagaaccugaagcagcagcuggaggagcaggaguacaagcugcagaaggagcagaaccugaacaugcagcuguucagcgagauccacaaccugcagaacaaguucagagaccugagcccccccagauacgacagccuggugcagagccaggccagagagcugagccugcagagacagcagaucaaggacggccacggcaucugcgugaucagcagacagcacaugaacaccaugaucaaggccuucgaggagcugcugcaggccagcgacguggacuacugcguggccgagggcuuccaggagcagcugaaccagugcgccgagcugcuggagaagcuggagaagcuguuccugaacggcaagagcgugggcguggagaugaacacccagaacgagcugauggagagaaucgaggaggacaaccugaccuaccagcaccugcugcccgagagccccgagcccagcgccagccacgcccugagcgacuacgagaccagcgagaagagcuucuucagcagagaccagaagcaggacaacgagaccgagaagaccagcgugauggugaacagcuucagccaggaccugcugauggagcacauccaggagaucagaacccugagaaagagacuggaggagagcaucaagaccaacgagaagcugagaaagcagcuggagagacagggcagcgaguucgugcagggcagcaccagcaucuucgccagcggcagcgagcugcacagcagccugaccagcgagauccacuuccugagaaagcagaaccaggcccugaacgccaugcugaucaagggcagcagagacaagcagaaggagaacgacaagcugagagagagccugagcagaaagaccgugagccuggagcaccugcagagagaguacgccagcgugaaggaggagaacgagagacugcagaaggagggcagcgagaaggagagacacaaccagcagcugauccaggaggugagaugcagcggccaggagcugagcagagugcaggaggaggugaagcugagacagcagcugcugagccagaacgacaagcugcugcagagccugagaguggagcugaaggccuacgagaagcuggacgaggagcacagaagacugagagacggcgacaaguaccccauggagagcgacaacagcuucgaccuguucgacagcagccaggccgugacccccaagagcgugagcgagacccccccccugagcggcaacgacaccgacagccugagcugcgacagcggcagcagcgccaccagcacccccugcgugagcagacuggugaccggccaccaccugugggccagcaagaacggcagacacgugcugggccugaucgaggacuacgaggcccugcugaagcagaucagccagggccagagacugcuggccgagauggacauccagacccaggaggcccccagcagcaccagccaggagcugggcaccaagggcccccaccccgccccccugagcaaguucgugagcagcgugagcaccgccaagcugacccuggaggaggccuacagaagacugaagcugcuguggagagugagccugcccgaggacggccagugcccccugcacugcgagcagaucggcgagaugaaggccgaggugaccaagcugcacaagaagcuguucgagcaggagaagaagcugcagaacaccaugaagcugcugcagcugagcaagagacaggagaaggugaucuucgaccagcugguggugacccacaagauccugagaaaggccagaggcaaccuggagcugagacccggcggcgcccaccccggcaccugcagccccagcagacccggcagcuaa

SEQ ID NO: 15002 - RNA, 1521 nt, Artificial Sequence
  CDK5RAP3__Homo_sapiens__NP_788276
auggaggaccaccagcacgugcccaucgacauccagaccagcaagcugcuggacuggcugguggacagaagacacugcagccugaaguggcagagccuggugcugaccaucagagagaagaucaacgccgccauccaggacaugcccgagagcgaggagaucgcccagcugcugagcggcagcuacauccacuacuuccacugccugagaauccuggaccugcugaagggcaccgaggccagcaccaagaacaucuucggcagauacagcagccagagaaugaaggacuggcaggagaucaucgcccuguacgagaaggacaacaccuaccugguggagcugagcagccugcuggugagaaacgugaacuacgagauccccagccugaagaagcagaucgccaagugccagcagcugcagcaggaguacagcagaaaggaggaggagugccaggccggcgccgccgagaugagagagcaguucuaccacagcugcaagcaguacggcaucaccggcgagaacgugagaggcgagcugcuggcccuggugaaggaccugcccagccagcuggccgagaucggcgccgccgcccagcagagccugggcgaggccaucgacguguaccaggccagcgugggcuucgugugcgagagccccaccgagcaggugcugcccaugcugagauucgugcagaagagaggcaacagcaccguguacgaguggagaaccggcaccgagcccagcgugguggagagaccccaccuggaggagcugcccgagcagguggccgaggacgccaucgacuggggcgacuucggcguggaggccgugagcgagggcaccgacagcggcaucagcgccgaggccgccggcaucgacuggggcaucuuccccgagagcgacagcaaggaccccggcggcgacggcaucgacuggggcgacgacgccguggcccugcagaucaccgugcuggaggccggcacccaggcccccgagggcguggccagaggccccgacgcccugacccugcuggaguacaccgagaccagaaaccaguuccuggacgagcugauggagcuggagaucuuccuggcccagagagccguggagcugagcgaggaggccgacgugcugagcgugagccaguuccagcuggcccccgccauccugcagggccagaccaaggagaagauggugaccauggugagcgugcuggaggaccugaucggcaagcugaccagccugcagcugcagcaccuguucaugauccuggccagccccagauacguggacagagugaccgaguuccugcagcagaagcugaagcagagccagcugcuggcccugaagaaggagcugauggugcagaagcagcaggaggcccuggaggagcaggccgcccuggagcccaagcuggaccugcugcuggagaagaccaaggagcugcagaagcugaucgaggccgacaucagcaagagauacagcggcagacccgugaaccugaugggcaccagccuguaa

SEQ ID NO: 15003 - RNA, 981 nt, Artificial Sequence
  CDK6__Homo_sapiens__XP_006715898
auggagaaggacggccugugcagagccgaccagcaguacgagugcguggccgagaucggcgagggcgccuacggcaagguguucaaggccagagaccugaagaacggcggcagauucguggcccugaagagagugagagugcagaccggcgaggagggcaugccccugagcaccaucagagagguggccgugcugagacaccuggagaccuucgagcaccccaacguggugagacuguucgacgugugcaccgugagcagaaccgacagagagaccaagcugacccugguguucgagcacguggaccaggaccugaccaccuaccuggacaaggugcccgagcccggcgugcccaccgagaccaucaaggacaugauguuccagcugcugagaggccuggacuuccugcacagccacagaguggugcacagagaccugaagccccagaacauccuggugaccagcagcggccagaucaagcuggccgacuucggccuggccagaaucuacagcuuccagauggcccugaccagcgugguggugacccugugguacagagcccccgaggugcugcugcagagcagcuacgccacccccguggaccuguggagcgugggcugcaucuucgccgagauguucagaagaaagccccuguucagaggcagcagcgacguggaccagcugggcaagauccuggacgugaucggccugcccggcgaggaggacuggcccagagacguggcccugcccagacaggccuuccacagcaagagcgcccagcccaucgagaaguucgugaccgacaucgacgagcugggcaaggaccugcugcugaagugccugaccuucaaccccgccaagagaaucagcgccuacagcgcccugagccaccccuacuuccaggaccuggagagaugcaaggagaaccuggacagccaccugccccccagccagaacaccagcgagcugaacaccgccuaa

SEQ ID NO: 15004 - RNA, 1041 nt, Artificial Sequence
  CDK7__Homo_sapiens__NP_001790
auggcccuggacgugaagagcagagccaagagauacgagaagcuggacuuccugggcgagggccaguucgccaccguguacaaggccagagacaagaacaccaaccagaucguggccaucaagaagaucaagcugggccacagaagcgaggccaaggacggcaucaacagaaccgcccugagagagaucaagcugcugcaggagcugagccaccccaacaucaucggccugcuggacgccuucggccacaagagcaacaucagccugguguucgacuucauggagaccgaccuggaggugaucaucaaggacaacagccuggugcugacccccagccacaucaaggccuacaugcugaugacccugcagggccuggaguaccugcaccagcacuggauccugcacagagaccugaagcccaacaaccugcugcuggacgagaacggcgugcugaagcuggccgacuucggccuggccaagagcuucggcagccccaacagagccuacacccaccagguggugaccagaugguacagagcccccgagcugcuguucggcgccagaauguacggcgugggcguggacaugugggccgugggcugcauccuggccgagcugcugcugagagugcccuuccugcccggcgacagcgaccuggaccagcugaccagaaucuucgagacccugggcacccccaccgaggagcaguggcccgacaugugcagccugcccgacuacgugaccuucaagagcuuccccggcaucccccugcaccacaucuucagcgccgccggcgacgaccugcuggaccugauccagggccuguuccuguucaaccccugcgccagaaucaccgccacccaggcccugaagaugaaguacuucagcaacagacccggccccacccccggcugccagcugcccagacccaacugccccguggagacccugaaggagcagagcaaccccgcccuggccaucaagagaaagagaaccgaggcccuggagcagggcggccugcccaagaagcugaucuucuaa

SEQ ID NO: 15005 - RNA, 1395 nt, Artificial Sequence
  CDK8__Homo_sapiens__NP_001251
auggacuacgacuucaaggugaagcugagcagcgagagagagagaguggaggaccuguucgaguacgagggcugcaaggugggcagaggcaccuacggccacguguacaaggccaagagaaaggacggcaaggacgacaaggacuacgcccugaagcagaucgagggcaccggcaucagcaugagcgccugcagagagaucgcccugcugagagagcugaagcaccccaacgugaucagccugcagaagguguuccugagccacgccgacagaaagguguggcugcuguucgacuacgccgagcacgaccuguggcacaucaucaaguuccacagagccagcaaggccaacaagaagcccgugcagcugcccagaggcauggugaagagccugcuguaccagauccuggacggcauccacuaccugcacgccaacugggugcugcacagagaccugaagcccgccaacauccuggugaugggcgagggccccgagagaggcagagugaagaucgccgacaugggcuucgccagacuguucaacagcccccugaagccccuggccgaccuggaccccgugguggugaccuucugguacagagcccccgagcugcugcugggcgccagacacuacaccaaggccaucgacaucugggccaucggcugcaucuucgccgagcugcugaccagcgagcccaucuuccacugcagacaggaggacaucaagaccagcaaccccuaccaccacgaccagcuggacagaaucuucaacgugaugggcuuccccgccgacaaggacugggaggacaucaagaagaugcccgagcacagcacccugaugaaggacuucagaagaaacaccuacaccaacugcagccugaucaaguacauggagaagcacaaggugaagcccgacagcaaggccuuccaccugcugcagaagcugcugaccauggaccccaucaagagaaucaccagcgagcaggccaugcaggaccccuacuuccuggaggacccccugcccaccagcgacguguucgccggcugccagauccccuaccccaagagagaguuccugaccgaggaggagcccgacgacaagggcgacaagaagaaccagcagcagcagcagggcaacaaccacaccaacggcaccggccaccccggcaaccaggacagcagccacacccagggccccccccugaagaaggugagaguggugccccccaccaccaccagcggcggccugaucaugaccagcgacuaccagagaagcaacccccacgccgccuaccccaaccccggccccagcaccagccagccccagagcagcaugggcuacagcgccaccagccagcagcccccccaguacagccaccagacccacagauacuaa

SEQ ID NO: 15006 - RNA, 1119 nt, Artificial Sequence
  CDK9__Homo_sapiens__NP_001252
auggccaagcaguacgacagcguggagugccccuucugcgacgaggugagcaaguacgagaagcuggccaagaucggccagggcaccuucggcgagguguucaaggccagacacagaaagaccggccagaagguggcccugaagaaggugcugauggagaacgagaaggagggcuuccccaucaccgcccugagagagaucaagauccugcagcugcugaagcacgagaacguggugaaccugaucgagaucugcagaaccaaggccagccccuacaacagaugcaagggcagcaucuaccugguguucgacuucugcgagcacgaccuggccggccugcugagcaacgugcuggugaaguucacccugagcgagaucaagagagugaugcagaugcugcugaacggccuguacuacauccacagaaacaagauccugcacagagacaugaaggccgccaacgugcugaucaccagagacggcgugcugaagcuggccgacuucggccuggccagagccuucagccuggccaagaacagccagcccaacagauacaccaacagaguggugacccugugguacagaccccccgagcugcugcugggcgagagagacuacggcccccccaucgaccuguggggcgccggcugcaucauggccgagauguggaccagaagccccaucaugcagggcaacaccgagcagcaccagcuggcccugaucagccagcugugcggcagcaucacccccgagguguggcccaacguggacaacuacgagcuguacgagaagcuggagcuggugaagggccagaagagaaaggugaaggacagacugaaggccuacgugagagaccccuacgcccuggaccugaucgacaagcugcuggugcuggaccccgcccagagaaucgacagcgacgacgcccugaaccacgacuucuucuggagcgaccccaugcccagcgaccugaagggcaugcugagcacccaccugaccagcauguucgaguaccuggccccccccagaagaaagggcagccagaucacccagcagagcaccaaccagagcagaaaccccgccaccaccaaccagaccgaguucgagagaguguucuaa

SEQ ID NO: 15007 - RNA, 1740 nt, Artificial Sequence
  CDKAL1__Homo_sapiens__NP_060244
augcccagcgccagcugcgacacccugcuggacgacaucgaggacaucgugagccaggaggacagcaagccccaggacagacacuucgugagaaaggacguggugcccaaggugagaagaagaaacacccagaaguaccugcaggaggaggagaacagcccccccagcgacagcaccauccccggcauccagaagaucuggaucagaaccuggggcugcagccacaacaacagcgacggcgaguacauggccggccagcuggccgccuacggcuacaagaucaccgagaacgccagcgacgccgaccuguggcugcugaacagcugcaccgugaagaaccccgccgaggaccacuucagaaacagcaucaagaaggcccaggaggagaacaagaagaucgugcuggccggcugcgugccccaggcccagcccagacaggacuaccugaagggccugagcaucaucggcgugcagcagaucgacagagugguggaggugguggaggagaccaucaagggccacagcgugagacugcugggccagaagaaggacaacggcagaagacugggcggcgccagacuggaccugcccaagaucagaaagaacccccugaucgagaucaucagcaucaacaccggcugccugaacgccugcaccuacugcaagaccaagcacgccagaggcaaccuggccagcuaccccaucgacgagcugguggacagagccaagcagagcuuccaggagggcgugugcgagaucuggcugaccagcgaggacaccggcgccuacggcagagacaucggcaccaaccugcccacccugcuguggaagcugguggaggugauccccgagggcgccaugcugagacugggcaugaccaacccccccuacauccuggagcaccuggaggagauggccaagauccugaaccaccccagaguguacgccuuccugcacauccccgugcagagcgccagcgacagcgugcugauggagaugaagagagaguacugcguggccgacuucaagagagugguggacuuccugaaggagaaggugcccggcaucaccaucgccaccgacaucaucugcggcuuccccggcgagaccgaccaggacuuccaggagaccgugaagcugguggaggaguacaaguuccccagccuguucaucaaccaguucuaccccagacccggcacccccgccgccaagauggagcaggugcccgcccaggugaagaagcagagaaccaaggaccugagcagaguguuccacagcuacagccccuacgaccacaagaucggcgagagacagcaggugcuggugaccgaggagagcuucgacagcaaguucuacguggcccacaaccaguucuacgagcaggugcuggugcccaagaaccccgccuucaugggcaagaugguggagguggacaucuacgagagcggcaagcacuucaugaagggccagcccgugagcgacgccaagguguacacccccagcaucagcaagccccuggccaagggcgaggugagcggccugaccaaggacuucagaaacggccugggcaaccagcugagcagcggcagccacaccagcgccgccagccagugcgacagcgccagcagcagaauggugcugcccaugcccagacugcaccaggacugcgcccugagaaugagcgugggccuggcccugcugggccugcuguucgccuucuucgugaagguguacaacuaa

SEQ ID NO: 15008 - RNA, 1077 nt, Artificial Sequence
  CDKL1__Homo_sapiens__NP_004187
augauggagaaguacgagaagaucggcaagaucggcgagggcagcuacggcgugguguucaagugcagaaacagagacaccggccagaucguggccaucaagaaguuccuggagagcgaggacgaccccgugaucaagaagaucgcccugagagagaucagaaugcugaagcagcugaagcaccccaaccuggugaaccugcuggagguguucagaagaaagagaagacugcaccugguguucgaguacugcgaccacaccgugcugcacgagcuggacagauaccagagaggcgugcccgagcaccuggugaagagcaucaccuggcagacccugcaggccgugaacuucugccacaagcacaacugcauccacagagacgugaagcccgagaacauccugaucaccaagcacagcgugaucaagcugugcgacuucggcuucgccagacugcugaccggccccagcgacuacuacaccgacuacguggccaccagaugguacagaagccccgagcugcuggugggcgacacccaguacggcccccccguggacgugugggccaucggcugcguguucgccgagcugcugagcggcgugccccuguggcccggcaagagcgacguggaccagcuguaccugaucagaaagacccugggcgaccugauccccagacaccagcagguguucagcaccaaccaguacuucagcggcgugaagauccccgaccccgaggacauggagccccuggagcugaaguuccccaacaucagcuaccccgcccugggccugcugaagggcugccugcacauggaccccacccagagacugaccugcgagcagcugcugcaccaccccuacuucgagaacaucagagagaucgaggaccuggccaaggagcacaacaagcccaccagaaagacccugagaaagagcagaaagcaccacugcuucaccgagaccagcaagcugcaguaccugccccagcugaccggcagcagcauccugcccgcccuggacaacaagaaguacuacugcgacaccaagaagcugaacuacagauuccccaacaucuaa

SEQ ID NO: 15009 - RNA, 1482 nt, Artificial Sequence
  CDKL2__Homo_sapiens__NP_003939
auggagaaguacgagaaccugggccuggugggcgagggcagcuacggcauggugaugaagugcagaaacaaggacaccggcagaaucguggccaucaagaaguuccuggagagcgacgacgacaagauggugaagaagaucgccaugagagagaucaagcugcugaagcagcugagacacgagaaccuggugaaccugcuggaggugugcaagaagaagaagagaugguaccugguguucgaguucguggaccacaccauccuggacgaccuggagcuguuccccaacggccuggacuaccagguggugcagaaguaccuguuccagaucaucaacggcaucggcuucugccacagccacaacaucauccacagagacaucaagcccgagaacauccuggugagccagagcggcguggugaagcugugcgacuucggcuucgccagaacccuggccgcccccggcgagguguacaccgacuacguggccaccagaugguacagagcccccgagcugcuggugggcgacgugaaguacggcaaggccguggacgugugggccaucggcugccuggugaccgagauguucaugggcgagccccuguuccccggcgacagcgacaucgaccagcuguaccacaucaugaugugccugggcaaccugauccccagacaccaggagcuguucaacaagaaccccguguucgccggcgugagacugcccgagaucaaggagagagagccccuggagagaagauaccccaagcugagcgagguggugaucgaccuggccaagaagugccugcacaucgaccccgacaagagacccuucugcgccgagcugcugcaccacgacuucuuccagauggacggcuucgccgagagauucagccaggagcugcagcugaaggugcagaaggacgccagaaacgugagccugagcaagaagagccagaacagaaagaaggagaaggagaaggacgacagccugguggaggagagaaagacccugguggugcaggacaccaacgccgaccccaagaucaaggacuacaagcuguucaagaucaagggcagcaagaucgacggcgagaaggccgagaagggcaacagagccagcaacgccagcugccugcacgacagcagaaccagccacaacaagaucgugcccagcaccagccugaaggacugcagcaacgugagcguggaccacaccagaaaccccagcguggccauccccccccugacccacaaccugagcgccguggcccccagcaucaacagcggcaugggcaccgagaccauccccauccagggcuacagaguggacgagaagaccaagaagugcagcauccccuucgugaagcccaacagacacagccccagcggcaucuacaacaucaacgugaccacccuggugagcggccccccccugagcgacgacagcggcgccgaccugccccagauggagcaccagcacuaa

SEQ ID NO: 15010 - RNA, 1779 nt, Artificial Sequence
  CDKL3__Homo_sapiens__NP_001107047
auggagauguacgagacccugggcaaggugggcgagggcagcuacggcaccgugaugaagugcaagcacaagaacaccggccagaucguggccaucaagaucuucuacgagagacccgagcagagcgugaacaagaucgccaugagagagaucaaguuccugaagcaguuccaccacgagaaccuggugaaccugaucgagguguucagacagaagaagaagauccaccugguguucgaguucaucgaccacaccgugcuggacgagcugcagcacuacugccacggccuggagagcaagagacugagaaaguaccuguuccagauccugagagccaucgacuaccugcacagcaacaacaucauccacagagacaucaagcccgagaacauccuggugagccagagcggcaucaccaagcugugcgacuucggcuucgccagaacccuggccgcccccggcgacaucuacaccgacuacguggccaccagaugguacagagcccccgagcuggugcugaaggacaccagcuacggcaagcccguggacaucugggcccugggcugcaugaucaucgagauggccaccggcaaccccuaccugcccagcagcagcgaccuggaccugcugcacaagaucgugcugaaggugggcaaccugagcccccaccugcagaacaucuucagcaagagccccaucuucgccggcguggugcugccccaggugcagcaccccaagaacgccagaaagaaguaccccaagcugaacggccugcuggccgacaucgugcacgccugccugcagaucgaccccgccgacagaaucagcagcagcgaccugcugcaccacgaguacuucaccagagacggcuucaucgagaaguucaugcccgagcugaaggccaagcugcugcaggaggccaaggugaacagccugaucaagcccaaggagagcagcaaggagaacgagcugagaaaggacgagagaaagaccguguacaccaacacccugcugagcagcagcgugcugggcaaggagaucgagaaggagaagaagcccaaggagaucaaggugagagugaucaaggugaagggcggcagaggcgacaucagcgagcccaagaagaaggaguacgagggcggccugggccagcaggacgccaacgagaacgugcaccccaugagccccgacaccaagcuggugaccaucgagccccccaaccccaucaaccccagcaccaacugcaacggccugaaggagaacccccacugcggcggcagcgugaccaugccccccaucaaccugaccaacagcaaccugauggccgccaaccugagcagcaaccuguuccaccccagcgugagacugaccgagagagccaagaagagaagaaccagcagccagagcaucggccaggugaugcccaacagcagacaggaggaccccggccccauccagagccagauggagaagggcaucuucaacgagagaaccggccacagcgaccagauggccaacgagaacaagagaaagcugaacuucagcagaagcgacagaaaggaguuccacuuccccgagcugcccgugaccauccagagcaaggacaccaagggcauggaggugaagcagaucaagaugcugaagagagagagcaagaagaccgagagcagcaagauccccacccugcugaacguggaccagaaccaggagaagcaggagggcggcgacggccacugcgagggcaagaaccugaagagaaacagauucuucuucugguaa

SEQ ID NO: 15011 - RNA, 948 nt, Artificial Sequence
  CDKL4__Homo_sapiens__NP_001009565
auggagaaguacgagaagcuggccaagaccggcgagggcagcuacggcgugguguucaagugcagaaacaagaccagcggccaggugguggccgugaagaaguucguggagagcgaggacgaccccguggugaagaagaucgcccugagagagaucagaaugcugaagcagcugaagcaccccaaccuggugaaccugaucgagguguucagaagaaagagaaagaugcaccugguguucgaguacugcgaccacacccugcugaacgagcuggagagaaaccccaacggcguggccgacggcgugaucaagagcgugcuguggcagacccugcaggcccugaacuucugccacauccacaacugcauccacagagacaucaagcccgagaacauccugaucaccaagcagggcaucaucaagaucugcgacuucggcuucgcccagauccugauccccggcgacgccuacaccgacuacguggccaccagaugguacagagcccccgagcugcuggugggcgacacccaguacggcagcagcguggacaucugggccaucggcugcguguucgccgagcugcugaccggccagccccuguggcccggcaagagcgacguggaccagcuguaccugaucaucagaacccugggcaagcugauccccagacaccagagcaucuucaagagcaacggcuucuuccacggcaucagcauccccgagcccgaggacauggagacccuggaggagaaguucagcgacgugcaccccguggcccugaacuucaugaagggcugccugaagaugaaccccgacgacagacugaccugcagccagcugcuggagagcagcuacuucgacagcuuccaggaggcccagaucaagagaaaggccagaaacgagggcagaaacagaagaagacagcaggugcugccccugaagagcuaa

SEQ ID NO: 15012 - RNA, 3093 nt, Artificial Sequence
  CDKL5__Homo_sapiens__NP_001032420
augaagauccccaacaucggcaacgugaugaacaaguucgagauccugggcguggugggcgagggcgccuacggcguggugcugaagugcagacacaaggagacccacgagaucguggccaucaagaaguucaaggacagcgaggagaacgaggaggugaaggagaccacccugagagagcugaagaugcugagaacccugaagcaggagaacaucguggagcugaaggaggccuucagaagaagaggcaagcuguaccugguguucgaguacguggagaagaacaugcuggagcugcuggaggagaugcccaacggcgugccccccgagaaggugaagagcuacaucuaccagcugaucaaggccauccacuggugccacaagaacgacaucgugcacagagacaucaagcccgagaaccugcugaucagccacaacgacgugcugaagcugugcgacuucggcuucgccagaaaccugagcgagggcaacaacgccaacuacaccgaguacguggccaccagaugguacagaagccccgagcugcugcugggcgcccccuacggcaagagcguggacauguggagcgugggcugcauccugggcgagcugagcgacggccagccccuguuccccggcgagagcgagaucgaccagcuguucaccauccagaaggugcugggcccccugcccagcgagcagaugaagcuguucuacagcaaccccagauuccacggccugagauuccccgccgugaaccacccccagagccuggagagaagauaccugggcauccugaacagcgugcugcuggaccugaugaagaaccugcugaagcuggaccccgccgacagauaccugaccgagcagugccugaaccaccccaccuuccagacccagagacugcuggacagaagccccagcagaagcgccaagagaaagcccuaccacguggagagcagcacccugagcaacagaaaccaggccggcaagagcaccgcccugcagagccaccacagaagcaacagcaaggacauccagaaccugagcgugggccugcccagagccgacgagggccugcccgccaacgagagcuuccugaacggcaaccuggccggcgccagccugagcccccugcacaccaagaccuaccaggccagcagccagcccggcagcaccagcaaggaccugaccaacaacaacaucccccaccugcugagccccaaggaggccaagagcaagaccgaguucgacuucaacaucgaccccaagcccagcgagggccccggcaccaaguaccugaagagcaacagcagaagccagcagaacagacacagcuucauggagagcagccagagcaaggccggcacccugcagcccaacgagaagcagagcagacacagcuacaucgacaccaucccccagagcagcagaagccccagcuacagaaccaaggccaagagccacggcgcccugagcgacagcaagagcgugagcaaccugagcgaggccagagcccagaucgccgagcccagcaccagcagauacuuccccagcagcugccuggaccugaacagccccaccagccccacccccaccagacacagcgacaccagaacccugcugagccccagcggcagaaacaacagaaacgagggcacccuggacagcagaagaaccaccaccagacacagcaagaccauggaggagcugaagcugcccgagcacauggacagcagccacagccacagccugagcgccccccacgagagcuucagcuacggccugggcuacaccagccccuucagcagccagcagagaccccacagacacagcauguacgugaccagagacaaggugagagccaagggccuggacggcagccugagcaucggccagggcauggccgccagagccaacagccugcagcugcugagcccccagcccggcgagcagcugccccccgagaugaccguggccagaagcagcgugaaggagaccagcagagagggcaccagcagcuuccacaccagacagaagagcgagggcggcguguaccacgacccccacagcgacgacggcaccgcccccaaggagaacagacaccuguacaacgaccccgugcccagaagagugggcagcuucuacagagugcccagccccagacccgacaacagcuuccacgagaacaacgugagcaccagagugagcagccugcccagcgagagcagcagcggcaccaaccacagcaagagacagcccgccuucgaccccuggaagagccccgagaacaucagccacagcgagcagcugaaggagaaggagaagcagggcuucuucagaagcaugaagaagaagaagaagaagagccagaccgugcccaacagcgacagccccgaccugcugacccugcagaagagcauccacagcgccagcacccccagcagcagacccaaggaguggagacccgagaagaucagcgaccugcagacccagagccagccccugaagagccugagaaagcugcugcaccugagcagcgccagcaaccaccccgccagcagcgaccccagauuccagccccugaccgcccagcagaccaagaacagcuucagcgagaucagaauccacccccugagccaggccagcggcggcagcagcaacaucagacaggagcccgcccccaagggcagacccgcccugcagcugcccgacggcggcugcgacggcagaagacagagacaccacagcggcccccaggacagaagauucaugcugagaaccaccgagcagcagggcgaguacuucugcugcggcgaccccaagaagccccacacccccugcgugcccaacagagcccugcacagacccaucagcagccccgcccccuaccccgugcugcaggugagaggcaccagcaugugccccacccugcaggugagaggcaccgacgccuucagcugccccacccagcagagcggcuucagcuucuucgugagacacgugaugagagaggcccugauccacagagcccaggugaaccaggccgcccugcugaccuaccacgagaacgccgcccugaccggcaaguaa

SEQ ID NO: 15013 - RNA, 495 nt, Artificial Sequence
  CDKN1A__Homo_sapiens__NP_000380
augagcgagcccgccggcgacgugagacagaaccccugcggcagcaaggccugcagaagacuguucggccccguggacagcgagcagcugagcagagacugcgacgcccugauggccggcugcauccaggaggccagagagagauggaacuucgacuucgugaccgagaccccccuggagggcgacuucgccugggagagagugagaggccugggccugcccaagcuguaccugcccaccggccccagaagaggcagagacgagcugggcggcggcagaagacccggcaccagccccgcccugcugcagggcaccgccgaggaggaccacguggaccugagccugagcugcacccuggugcccagaagcggcgagcaggccgagggcagccccggcggccccggcgacagccagggcagaaagagaagacagaccagcaugaccgacuucuaccacagcaagagaagacugaucuucagcaagagaaagcccuaa

SEQ ID NO: 15014 - RNA, 597 nt, Artificial Sequence
  CDKN1B__Homo_sapiens__NP_004055
augagcaacgugagagugagcaacggcagccccagccuggagagaauggacgccagacaggccgagcaccccaagcccagcgccugcagaaaccuguucggccccguggaccacgaggagcugaccagagaccuggagaagcacugcagagacauggaggaggccagccagagaaaguggaacuucgacuuccagaaccacaagccccuggagggcaaguacgaguggcaggagguggagaagggcagccugcccgaguucuacuacagaccccccagaccccccaagggcgccugcaaggugcccgcccaggagagccaggacgugagcggcagcagacccgccgccccccugaucggcgcccccgccaacagcgaggacacccaccugguggaccccaagaccgaccccagcgacagccagaccggccuggccgagcagugcgccggcaucagaaagagacccgccaccgacgacagcagcacccagaacaagagagccaacagaaccgaggagaacgugagcgacggcagccccaacgccggcagcguggagcagacccccaagaagcccggccugagaagaagacagaccuaa

SEQ ID NO: 15015 - RNA, 951 nt, Artificial Sequence
  CDKN1C__Homo_sapiens__NP_000067
augagcgacgccagccugagaagcaccagcaccauggagagacugguggccagaggcaccuuccccgugcuggugagaaccagcgccugcagaagccuguucggccccguggaccacgaggagcugagcagagagcugcaggccagacuggccgagcugaacgccgaggaccagaacagaugggacuacgacuuccagcaggacaugccccugagaggccccggcagacugcaguggaccgagguggacagcgacagcgugcccgccuucuacagagagaccgugcaggugggcagaugcagacugcugcuggcccccagacccguggccguggccguggccgugagccccccccuggagcccgccgccgagagccuggacggccuggaggaggcccccgagcagcugcccagcgugcccgugcccgcccccgccagcacccccccccccgugcccgugcuggcccccgcccccgcccccgcccccgcccccguggccgcccccguggccgcccccguggccguggccgugcuggcccccgcccccgcccccgcccccgcccccgcccccgcccccgcccccguggccgcccccgcccccgcccccgcccccgcccccgcccccgcccccgcccccgcccccgcccccgacgccgccccccaggagagcgccgagcagggcgccaaccagggccagagaggccaggagccccuggccgaccagcugcacagcggcaucagcggcagacccgccgccggcaccgccgccgccagcgccaacggcgccgccaucaagaagcugagcggcccccugaucagcgacuucuucgccaagagaaagagaagcgcccccgagaagagcagcggcgacgugcccgcccccugccccagccccagcgccgcccccggcgugggcagcguggagcagacccccagaaagagacugagauaa

SEQ ID NO: 15016 - RNA, 471 nt, Artificial Sequence
  CDKN2A__Homo_sapiens__NP_000068
auggagcccgccgccggcagcagcauggagcccagcgccgacuggcuggccaccgccgccgccagaggcagaguggaggaggugagagcccugcuggaggccggcgcccugcccaacgcccccaacagcuacggcagaagacccauccaggugaugaugaugggcagcgccagaguggccgagcugcugcugcugcacggcgccgagcccaacugcgccgaccccgccacccugaccagacccgugcacgacgccgccagagagggcuuccuggacacccugguggugcugcacagagccggcgccagacuggacgugagagacgccuggggcagacugcccguggaccuggccgaggagcugggccacagagacguggccagauaccugagagccgccgccggcggcaccagaggcagcaaccacgccagaaucgacgccgccgagggccccagcgacauccccgacuaa

SEQ ID NO: 15017 - RNA, 1743 nt, Artificial Sequence
  CDKN2AIP__Homo_sapiens__NP_060102
auggcccaggaggugagcgaguaccugagccagaaccccagaguggccgccuggguggaggcccugagaugcgacggcgagaccgacaagcacuggagacacagaagagacuuccugcugagaaacgccggcgaccuggcccccgccggcggcgccgccagcgccagcaccgacgaggccgccgacgccgagagcggcaccagaaacagacagcugcagcagcugaucagcuucagcauggccugggccaaccacguguuccugggcugcagauacccccagaaggugauggacaagauccugagcauggccgagggcaucaaggugaccgacgcccccaccuacaccaccagagacgagcugguggccaaggugaagaagagaggcaucagcagcagcaacgagggcguggaggagcccagcaagaagagagugaucgagggcaagaacagcagcgccguggagcaggaccacgccaagaccagcgccaagaccgagagagccagcgcccagcaggagaacagcagcaccugcaucggcagcgccaucaagagcgagagcggcaacagcgccagaagcagcggcaucagcagccagaacagcagcaccagcgacggcgacagaagcgugagcagccagagcagcagcagcgugagcagccaggugaccaccgccggcagcggcaaggccagcgaggccgaggcccccgacaagcacggcagcgccagcuucgugagccugcugaagagcagcgugaacagccacaugacccagagcaccgacagcagacagcagagcggcagccccaagaagagcgcccuggagggcagcagcgccagcgccagccagagcagcagcgagaucgaggugccccugcugggcagcagcggcagcagcgagguggagcugccccugcugagcagcaagcccagcagcgagaccgccagcagcggccugaccagcaagaccagcagcgaggccagcgugagcagcagcguggccaagaacagcagcagcagcggcaccagccugcugacccccaagagcagcagcagcaccaacaccagccugcugaccagcaagagcaccagccagguggccgccagccugcuggccagcaagagcagcagccagaccagcggcagccuggugagcaagagcaccagccuggccagcgugagccagcuggccagcaagagcagcagccagaccagcaccagccagcugcccagcaagagcaccagccagagcagcgagagcagcgugaaguucagcugcaagcugaccaacgaggacgugaagcagaagcagcccuucuucaacagacuguacaagaccguggccuggaagcugguggccgugggcggcuucagccccaacgugaaccacggcgagcugcugaacgccgccaucgaggcccugaaggccacccuggacguguucuucgugccccugaaggagcuggccgaccugccccagaacaagagcagccaggagagcaucgugugcgagcugagaugcaagagcguguaccugggcaccggcugcggcaagagcaaggagaacgccaaggccguggccagcagagaggcccugaagcuguuccugaagaagaaggugguggugaagaucugcaagagaaaguacagaggcagcgagaucgaggaccuggugcugcuggacgaggagagcagacccgugaaccugccccccgcccugaagcacccccaggagcugcuguaa

SEQ ID NO: 15018 - RNA, 417 nt, Artificial Sequence
  CDKN2B__Homo_sapiens__NP_004927
augagagaggagaacaagggcaugcccagcggcggcggcagcgacgagggccuggccagcgccgccgccagaggccugguggagaaggugagacagcugcuggaggccggcgccgaccccaacggcgugaacagauucggcagaagagccauccaggugaugaugaugggcagcgccagaguggccgagcugcugcugcugcacggcgccgagcccaacugcgccgaccccgccacccugaccagacccgugcacgacgccgccagagagggcuuccuggacacccugguggugcugcacagagccggcgccagacuggacgugagagacgccuggggcagacugcccguggaccuggccgaggagagaggccacagagacguggccggcuaccugagaaccgccaccggcgacuaa

SEQ ID NO: 15019 - RNA, 507 nt, Artificial Sequence
  CDKN2C__Homo_sapiens__NP_001253
auggccgagcccuggggcaacgagcuggccagcgccgccgccagaggcgaccuggagcagcugaccagccugcugcagaacaacgugaacgugaacgcccagaacggcuucggcagaaccgcccugcaggugaugaagcugggcaaccccgagaucgccagaagacugcugcugagaggcgccaaccccgaccugaaggacagaaccggcuucgccgugauccacgacgccgccagagccggcuuccuggacacccugcagacccugcuggaguuccaggccgacgugaacaucgaggacaacgagggcaaccugccccugcaccuggccgccaaggagggccaccugagagugguggaguuccuggugaagcacaccgccagcaacgugggccacagaaaccacaagggcgacaccgccugcgaccuggccagacuguacggcagaaacgagguggugagccugaugcaggccaacggcgccggcggcgccaccaaccugcaguaa

SEQ ID NO: 15020 - RNA, 501 nt, Artificial Sequence
  CDKN2D__Homo_sapiens__NP_001791
augcugcuggaggaggugagagccggcgacagacugagcggcgccgccgccagaggcgacgugcaggaggugagaagacugcugcacagagagcuggugcaccccgacgcccugaacagauucggcaagaccgcccugcaggugaugauguucggcagcaccgccaucgcccuggagcugcugaagcagggcgccagccccaacgugcaggacaccagcggcaccagccccgugcacgacgccgccagaaccggcuuccuggacacccugaaggugcugguggagcacggcgccgacgugaacgugcccgacggcaccggcgcccugcccauccaccuggccgugcaggagggccacaccgccguggugagcuuccuggccgccgagagcgaccugcacagaagagacgccagaggccugaccccccuggagcuggcccugcagagaggcgcccaggaccugguggacauccugcagggccacaugguggccccccuguaa

SEQ ID NO: 15021 - RNA, 519 nt, Artificial Sequence
  CDKN3__Homo_sapiens__NP_001124323
augaagccccccagcagcauccagaccagcugcaaguucaaggacgugagaagaaacgugcagaaggacaccgaggagcugaagagcugcggcauccaggacaucuucguguucugcaccagaggcgagcugagcaaguacagagugcccaaccugcuggaccuguaccagcagugcggcaucaucacccaccaccaccccaucgccgacggcggcacccccgacaucgccagcugcugcgagaucauggaggagcugaccaccugccugaagaacuacagaaagacccugauccacugcuacggcggccugggcagaagcugccugguggccgccugccugcugcuguaccugagcgacaccaucagccccgagcaggccaucgacagccugagagaccugagaggcagcggcgccauccagaccaucaagcaguacaacuaccugcacgaguucagagacaagcuggccgcccaccugagcagcagagacagccagagcagaagcgugagcagauaa

SEQ ID NO: 15022 - RNA, 564 nt, Artificial Sequence
  CDNF__Homo_sapiens__NP_001025125
auguggugcgccagccccguggccgugguggccuucugcgccggccugcuggugagccaccccgugcugacccagggccaggaggccggcggcagacccggcgccgacugcgaggugugcaaggaguuccugaacagauucuacaagagccugaucgacagaggcgugaacuucagccuggacaccaucgagaaggagcugaucagcuucugccuggacaccaagggcaaggagaacagacugugcuacuaccugggcgccaccaaggacgccgccaccaagauccugagcgaggugaccagacccaugagcgugcacaugcccgccaugaagaucugcgagaagcugaagaagcuggacagccagaucugcgagcugaaguacgagaagacccuggaccuggccagcguggaccugagaaagaugagaguggccgagcugaagcagauccugcacagcuggggcgaggagugcagagccugcgccgagaagaccgacuacgugaaccugauccaggagcuggcccccaaguacgccgccacccaccccaagaccgagcuguaa

SEQ ID NO: 15023 - RNA, 603 nt, Artificial Sequence
  CDO1__Homo_sapiens__NP_001792
auggagcagaccgaggugcugaagcccagaacccuggccgaccugaucagaauccugcaccagcuguucgccggcgacgaggugaacguggaggaggugcaggccaucauggaggccuacgagagcgaccccaccgagugggccauguacgccaaguucgaccaguacagauacaccagaaaccugguggaccagggcaacggcaaguucaaccugaugauccugugcuggggcgagggccacggcagcagcauccacgaccacaccaacagccacugcuuccugaagaugcugcagggcaaccugaaggagacccuguucgccuggcccgacaagaagagcaacgagauggugaagaagagcgagagagugcugagagagaaccagugcgccuacaucaacgacagcaucggccugcacagaguggagaacaucagccacaccgagcccgccgugagccugcaccuguacagcccccccuucgacaccugccacgccuucgaccagagaaccggccacaagaacaaggugaccaugaccuuccacagcaaguucggcaucagaacccccaacgccaccagcggcagccuggagaacaacuaa

SEQ ID NO: 15024 - RNA, 3864 nt, Artificial Sequence
  CDON__Homo_sapiens__XP_011541167
augcaccccgaccugggcccccugugcacccugcuguacgugacccugaccauccugugcagcagcgugagcagcgaccuggcccccuacuucaccagcgagccccugagcgccgugcagaagcugggcggccccguggugcugcacugcagcgcccagcccgugaccaccagaaucagcuggcugcacaacggcaagacccuggacggcaaccuggagcacgugaagauccaccagggcacccugaccauccugagccugaacagcagccugcugggcuacuaccagugccuggccaacaacagcaucggcgccaucgugagcggccccgccaccgugagcguggccgugcugggcgacuucggcagcagcaccaagcacgugaucaccgccgaggagaagagcgccggcuucaucggcugcagagugcccgagagcaaccccaaggccgaggugagauacaagaucagaggcaaguggcuggagcacagcaccgagaacuaccugauccugcccagcggcaaccugcagauccugaacgugagccuggaggacaagggcagcuacaagugcgccgccuacaaccccgugacccaccagcugaagguggagcccaucggcagaaagcugcuggugagcagacccagcagcgacgacgugcacauccugcaccccacccacagccaggcccuggccgugcugagcagaagccccgugacccuggagugcguggugagcggcgugcccgccccccagguguacuggcugaaggacggccaggacaucgcccccggcagcaacuggagaagacuguacagccaccuggccaccgacagcguggaccccgccgacagcggcaacuacagcugcauggccggcaacaagagcggcgacgugaaguacgugaccuacauggugaacgugcuggagcacgccagcaucagcaagggccugcaggaccagaucgugagccugggcgccaccgugcacuucaccugcgacgugcacggcaaccccgcccccaacugcaccugguuccacaacgcccagcccauccaccccagcgccagacaccugaccgccggcaacggccugaagaucagcggcgugaccguggaggacgugggcauguaccagugcguggccgacaacggcaucggcuucaugcacagcaccggcagacuggagaucgagaacgacggcggcuucaagcccgugaucaucaccgcccccgugagcgccaagguggccgacggcgacuucgugacccugagcugcaacgccagcggccugcccgugcccgugaucagaugguacgacagccacggccugaucaccagccaccccagccaggugcugagaagcaagagcagaaagagccagcugagcagacccgagggccugaaccuggagcccguguacuucgugcugagccaggccggcgccagcagccugcacauccaggccgugacccaggagcacgccggcaaguacaucugcgaggccgccaacgagcacggcaccacccaggccgaggccagccugaugguggugcccuucgagaccaacaccaaggccgagaccgugacccugcccgacgccgcccagaacgacgacagaagcaagagagacggcagcgagaccggccugcugagcagcuuccccgugaaggugcaccccagcgccguggagagcgcccccgagaagaacgccagcggcaucagcgugcccgacgcccccaucauccugagccccccccagacccacacccccgacaccuacaaccugguguggagagccggcaaggacggcggccugcccaucaacgccuacuucgugaaguacagaaagcuggacgacggcgugggcaugcugggcagcuggcacaccgugagagugcccggcagcgagaacgagcugcaccuggccgagcuggagcccagcagccuguacgaggugcugaugguggccagaagcgccgccggcgagggccagcccgccaugcugaccuucagaaccagcaaggagaagaccgccagcagcaagaacacccaggccagcagcccccccgugggcauccccaaguaccccguggugagcgaggccgccaacaacaacuucggcguggugcugaccgacagcagcagacacagcggcgugcccgaggcccccgacagacccaccaucagcaccgccagcgagaccagcguguacgugaccuggauccccagagccaacggcggcagccccaucaccgccuucaagguggaguacaagagaaugagaaccagcaacuggcugguggccgccgaggacaucccccccagcaagcugagcguggaggugagaagccuggagcccggcagcaccuacaaguucagagugaucgccaucaaccacuacggcgagagcuucagaagcagcgccagcagacccuaccagguggugggcuuccccaacagauucagcagcagacccaucaccggcccccacaucgccuacaccgaggccgugagcgacacccagaucaugcugaaguggaccuacauccccagcagcaacaacaacacccccauccagggcuucuacaucuacuacagacccaccgacagcgacaacgacagcgacuacaagagagacgugguggagggcagcaagcaguggcacaugaucggccaccugcagcccgagaccagcuacgacaucaagaugcagugcuucaacgagggcggcgagagcgaguucagcaacgugaugaucugcgagaccaaggugaagagagugcccggcgccagcgaguaccccgugaaggaccugagcaccccccccaacagccugggcagcggcggcaacgugggccccgccaccagccccgccagaagcagcgacaugcuguaccugaucgugggcugcgugcugggcgugauggugcugauccugaugguguucaucgccaugugccuguggaagaacagacagcagaacaccauccagaaguacgacccccccggcuaccuguaccagggcagcgacaugaacggccagaugguggacuacaccacccugagcggcgccagccagaucaacggcaacgugcacggcggcuuccugaccaacggcggccugagcagcggcuacagccaccugcaccacaaggugcccaacgccgugaacggcaucgugaacggcagccugaacggcggccuguacagcggccacagcaacagccugaccagaacccacguggacuucgagcacccccaccaccuggugaacggcggcggcauguacaccgccgugccccagaucgacccccuggagugcgugaacugcagaaacugcagaaacaacaacagaugcuucaccaagaccaacagcaccuucagcagcagccccccccccguggugcccgugguggcccccuacccccaggacggccuggagaugaagccccugagccacgugaaggugcccgugugccugaccagcgccgugcccgacugcggccagcugcccgaggagagcgugaaggacaacguggagcccgugcccacccagagaaccugcugccaggacaucgugaacgacgugagcagcgacggcagcgaggaccccgccgaguucagcagaggccaggagggcaugaucaaccugagaauccccgaccaccugcagcuggccaagagcugcgugugggagggcgacagcugcgcccacagcgagaccgagaucaacaucgugagcuggaacgcccugauccugccccccgugcccgagggcugcgccgagaagaccauguggagcccccccggcaucccccuggacagccccaccgaggugcugcagcagcccagagagaccuaa

SEQ ID NO: 15025 - RNA, 789 nt, Artificial Sequence
  CDR1__Homo_sapiens__NP_004056
auggccuggcuggaggacguggacuuccuggaggacgugccccugcuggaggacaucccccugcuggaggacgugccccugcuggaggacgugccccugcuggaggacaccagcagacuggaggacaucaaccugauggaggacauggcccugcuggaggacguggaccugcuggaggacaccgacuuccuggaggaccuggacuucagcgaggccauggaccugagagaggacaaggacuuccuggaggacauggacagccuggaggacauggcccugcuggaggacguggaccugcuggaggacaccgacuuccuggaggaccccgacuuccuggaggccaucgaccugagagaggacaaggacuuccuggaggacauggacagccuggaggaccuggaggccaucggcagaugcggcuucagcggcagacacggcuucuucggcagaagaagauucagcggcagacccaagcugagcggcagacugggccugcugggcagaagaggcuucagcggcagacugggcggcuacuggaagaccuggaucuucuggaagaccuggaucuucuggaagaccuggaucuucagaaagaccuacaucggcuggaagaccuggaucuucagcggcagaugcggccugaccggcagacccggcuucggcggcagaagaagauucuucuggaagacccugaccgacuggaagaccuggaucagcuucuggaagacccugaucgacuggaagaccuggaucagcuucuggaagacccugaucgacuggaagaucuaa

SEQ ID NO: 15026 - RNA, 1365 nt, Artificial Sequence
  CDR2__Homo_sapiens__NP_001793
augcuggccgagaaccugguggaggaguucgagaugaaggaggacgagcccugguacgaccaccaggaccugcagcaggaccugcagcuggccgccgagcugggcaagacccugcuggacagaaacaccgagcuggaggacagcgugcagcagauguacaccaccaaccaggagcagcugcaggagaucgaguaccugaccaagcagguggagcugcugagacagaugaacgagcagcacgccaagguguacgagcagcuggacgugaccgccagagagcuggaggagaccaaccagaagcugguggccgacagcaaggccagccagcagaagauccugagccugaccgagaccaucgagugccugcagaccaacaucgaccaccugcagagccagguggaggagcugaagagcagcggccagggcagaagaagccccggcaagugcgaccaggagaagcccgcccccagcuucgccugccugaaggagcuguacgaccugagacagcacuucguguacgaccacguguucgccgagaagaucaccagccugcagggccagcccagccccgacgaggaggagaacgagcaccugaagaagaccgugaccaugcugcaggcccagcugagccuggagagacagaagagagugaccauggaggaggaguacggccuggugcugaaggagaacagcgagcuggagcagcagcugggcgccaccggcgccuacagagccagagcccuggagcuggaggccgagguggccgagaugagacagaugcugcagagcgagcaccccuucgugaacggcguggagaagcuggugcccgacagccuguacgugcccuucaaggagcccagccagagccugcuggaggagauguuccugaccgugcccgagagccacagaaagccccugaagagaagcagcagcgagaccauccugagcagccuggccggcagcgacaucgugaagggccacgaggagaccugcaucagaagagccaaggccgugaagcagagaggcaucagccugcugcacgagguggacacccaguacagcgcccugaaggugaaguacgaggagcugcugaagaagugccaggaggagcaggacagccugagccacaaggccgugcagaccagcagagccgccgccaaggaccugaccggcgugaacgcccagagcgagcccguggccagcggcugggagcuggccagcgugaaccccgagcccgugagcagccccaccaccccccccgaguacaaggcccuguucaaggagaucuucagcugcaucaagaagaccaagcaggagaucgacgagcagagaaccaaguacagaagccugagcagccacagcuaa

SEQ ID NO: 15027 - RNA, 1338 nt, Artificial Sequence
  CDS2__Homo_sapiens__NP_003809
augaccgagcugagacagagaguggcccacgagcccguggccccccccgaggacaaggagagcgagagcgaggccaagguggacggcgagaccgccagcgacagcgagagcagagccgagagcgccccccugcccgugagcgccgacgacacccccgaggugcugaacagagcccugagcaaccugagcagcagauggaagaacuggugggugagaggcauccugacccuggccaugaucgccuucuucuucaucaucaucuaccugggccccauggugcugaugaucaucgugaugugcgugcagaucaagugcuuccacgagaucaucaccaucggcuacaacguguaccacagcuacgaccugcccugguucagaacccugagcugguacuuccugcugugcgugaacuacuucuucuacggcgagaccgugaccgacuacuucuucacccuggugcagagagaggagccccugagaauccugagcaaguaccacagauucaucagcuucacccuguaccugaucggcuucugcauguucgugcugagccuggugaagaagcacuacagacugcaguucuacauguucggcuggacccacgugacccugcugaucguggugacccagagccaccuggugauccacaaccuguucgagggcaugaucugguucaucgugcccaucagcugcgugaucugcaacgacaucauggccuacauguucggcuucuucuucggcagaaccccccugaucaagcugagccccaagaagaccugggagggcuucaucggcggcuucuucgccaccgugguguucggccugcugcugagcuacgugaugagcggcuacagaugcuucgugugccccguggaguacaacaacgacaccaacagcuucaccguggacugcgagcccagcgaccuguucagacugcaggaguacaacauccccggcgugauccagagcgugaucggcuggaagaccgugagaauguaccccuuccagauccacagcaucgcccugagcaccuucgccagccugaucggccccuucggcggcuucuucgccagcggcuucaagagagccuucaagaucaaggacuucgccaacaccauccccggccacggcggcaucauggacagauucgacugccaguaccugauggccaccuucgugaacguguacaucgccagcuucaucagaggccccaaccccagcaagcugauccagcaguuccugacccugagacccgaccagcagcugcacaucuucaacacccugagaagccaccugaucgacaagggcaugcugaccagcaccaccgaggacgaguaa

SEQ ID NO: 15028 - RNA, 1641 nt, Artificial Sequence
  CDT1__Homo_sapiens__NP_112190
auggagcagagaagagugaccgacuucuucgccagaagaagacccggcccccccagaaucgccccccccaagcuggccugcagaacccccagccccgccagacccgcccugagagcccccgccagcgccaccagcggcagcagaaagagagccagaccccccgccgcccccggcagagaccaggccagaccccccgccagaagaagacugagacugagcguggacgaggugagcagccccagcacccccgaggcccccgacauccccgccugccccagccccggccagaagaucaagaagagcacccccgccgccggccagcccccccaccugaccagcgcccaggaccaggacaccaucagcgagcuggccagcugccugcagagagccagagagcugggcgccagagugagagcccugaaggccagcgcccaggacgccggcgagagcugcacccccgaggccgagggcagacccgaggagcccugcggcgagaaggcccccgccuaccagagauuccacgcccuggcccagcccggccugcccggccuggugcugcccuacaaguaccaggugcuggccgagauguucagaagcauggacaccaucgugggcaugcugcacaacagaagcgagacccccaccuucgccaaggugcagagaggcgugcaggacaugaugagaagaagauucgaggagugcaacgugggccagaucaagaccguguaccccgccagcuacagauucagacaggagagaagcgugcccaccuucaaggacggcaccagaagaagcgacuaccagcugaccaucgagccccugcuggagcaggaggccgacggcgccgccccccagcugaccgccagcagacugcugcagagaagacagaucuucagccagaagcugguggagcacgugaaggagcaccacaaggccuuccuggccagccugagccccgccaugguggugcccgaggaccagcugaccagauggcaccccagauucaacguggacgaggugcccgacaucgagcccgccgcccugccccagccccccgccaccgagaagcugaccaccgcccaggaggugcuggccagagccagaaaccugaucagccccagaauggagaaggcccugagccagcuggcccugagaagcgccgcccccagcagccccggcagccccagacccgcccugcccgccaccccccccgccaccccccccgccgccagccccagcgcccugaagggcgugagccaggaccugcuggagagaaucagagccaaggaggcccagaagcagcuggcccagaugaccagaugccccgagcaggagcagagacugcagagacuggagagacugcccgagcuggccagagugcugagaagcguguucgugagcgagagaaagcccgcccugagcauggagguggccugcgccagaauggugggcagcugcugcaccaucaugagccccggcgagauggagaagcaccugcugcugcugagcgagcugcugcccgacuggcugagccugcacagaaucagaaccgacaccuacgugaagcuggacaaggccgccgaccuggcccacaucaccgccagacuggcccaccagaccagagccgaggagggccuguaa

SEQ ID NO: 15029 - RNA, 642 nt, Artificial Sequence
  CDV3__Homo_sapiens__NP_001127894
auggccgagaccgaggagagaagccuggacaacuucuucgccaagagagacaagaagaagaagaaggagagaagcaacagagccgccagcgccgccggcgccgccggcagcgccggcggcagcagcggcgccgccggcgccgccggcggcggcgccggcgccggcaccagacccggcgacggcggcaccgccagcgccggcgccgccggccccggcgccgccaccaaggccgugaccaaggacgaggacgaguggaaggagcuggagcagaaggagguggacuacagcggccugagagugcaggccaugcagaucagcagcgagaaggaggaggacgacaacgagaagagacaggaccccggcgacaacugggaggagggcggcggcggcggcggcggcauggagaagagcagcggccccuggaacaagaccgcccccgugcaggccccccccgcccccgugaucgugaccgagacccccgagcccgccaugaccagcggcguguacagaccccccggcgccagacugaccaccaccagaaagaccccccagggcccccccgagaucuacagcgacacccaguuccccagccugcagagcaccgccaagcacguggagagcagaaacagauaccugaaguaa

SEQ ID NO: 15030 - RNA, 798 nt, Artificial Sequence
  CDX1__Homo_sapiens__NP_001795
auguacgugggcuacgugcuggacaaggacagccccguguaccccggccccgccagacccgccagccugggccugggcccccaggccuacggcccccccgcccccccccccgcccccccccaguaccccgacuucagcagcuacagccacguggagcccgcccccgccccccccaccgccuggggcgcccccuuccccgcccccaaggacgacugggccgccgccuacggccccggccccgccgcccccgccgccagccccgccagccuggccuucggccccccccccgacuucagccccgugcccgccccccccggccccggccccggccugcuggcccagccccugggcggccccggcacccccagcagccccggcgcccagagacccacccccuacgaguggaugagaagaagcguggccgccggcggcggcggcggcagcggcaagaccagaaccaaggacaaguacagagugguguacaccgaccaccagagacuggagcuggagaaggaguuccacuacagcagauacaucaccaucagaagaaagagcgagcuggccgccaaccugggccugaccgagagacaggugaagaucugguuccagaacagaagagccaaggagagaaaggugaacaagaagaagcagcagcagcagcagcccccccagccccccauggcccacgacaucaccgccacccccgccggccccagccugggcggccugugccccagcaacaccagccugcuggccaccagcagccccaugcccgugaaggaggaguuccugcccuaa

SEQ ID NO: 15031 - RNA, 942 nt, Artificial Sequence
  CDX2__Homo_sapiens__NP_001256
auguacgugagcuaccugcuggacaaggacgugagcauguaccccagcagcgugagacacagcggcggccugaaccuggccccccagaacuucgugagccccccccaguaccccgacuacggcggcuaccacguggccgccgccgccgccgccgccgccaaccuggacagcgcccagagccccggccccagcuggcccgccgccuacggcgccccccugagagaggacuggaacggcuacgcccccggcggcgccgccgccgccgccaacgccguggcccacggccugaacggcggcagccccgccgccgccaugggcuacagcagccccgccgacuaccacccccaccaccacccccaccaccacccccaccaccccgccgccgcccccagcugcgccagcggccugcugcagacccugaaccccggcccccccggccccgccgccaccgccgccgccgagcagcugagccccggcggccagagaagaaaccugugcgaguggaugagaaagcccgcccagcagagccugggcagccaggugaagaccagaaccaaggacaaguacagagugguguacaccgaccaccagagacuggagcuggagaaggaguuccacuacagcagauacaucaccaucagaagaaaggccgagcuggccgccacccugggccugagcgagagacaggugaagaucugguuccagaacagaagagccaaggagagaaagaucaacaagaagaagcugcagcagcagcagcagcagcagcccccccagcccccccccccccccccccagcccccccagccccagcccggcccccugagaagcgugcccgagccccugagccccgugagcagccugcaggccagcgugagcggcagcgugcccggcgugcugggccccaccggcggcgugcugaaccccaccgugacccaguaa

SEQ ID NO: 15032 - RNA, 855 nt, Artificial Sequence
  CDX4__Homo_sapiens__NP_005184
auguacggcagcugccugcuggagaaggaggccggcauguaccccggcacccugaugagccccggcggcgacggcaccgccggcaccggcggcaccggcggcggcggcagccccaugcccgccagcaacuucgccgccgcccccgccuucagccacuacaugggcuacccccacaugcccagcauggacccccacuggcccagccugggcguguggggcagccccuacagcccccccagagaggacuggagcguguaccccggccccagcagcaccaugggcaccgugcccgugaacgacgugaccagcagccccgccgccuucugcagcaccgacuacagcaaccugggccccgugggcggcggcaccagcggcagcagccugcccggccaggccggcggcagccuggugcccaccgacgccggcgccgccaaggccagcagccccagcagaagcagacacagccccuacgccuggaugagaaagaccgugcaggugaccggcaagaccagaaccaaggagaaguacagagugguguacaccgaccaccagagacuggagcuggagaaggaguuccacugcaacagauacaucaccauccagagaaagagcgagcuggccgugaaccugggccugagcgagagacaggugaagaucugguuccagaacagaagagccaaggagagaaagaugaucaagaagaagaucagccaguucgagaacagcggcggcagcgugcagagcgacagcgacagcaucagccccggcgagcugcccaacaccuucuucaccacccccagcgccgugagaggcuuccagcccaucgagauccagcaggugaucgugagcgaguaa

SEQ ID NO: 15033 - RNA, 1623 nt, Artificial Sequence
  CDY1B__Homo_sapiens__NP_001003894
auggccagccaggaguucgagguggaggccaucguggacaagagacaggacaagaacggcaacacccaguaccuggugagauggaagggcuacgacaagcaggacgacaccugggagcccgagcagcaccugaugaacugcgagaagugcgugcacgacuucaacagaagacagaccgagaagcagaagaagcugaccuggaccaccaccagcagaaucuucagcaacaacgccagaagaagaaccagcagaagcaccaaggccaacuacagcaagaacagccccaagacccccgugaccgacaagcaccacagaagcaagaacagaaagcuguucgccgccagcaagaacgugagaagaaaggccgccagcauccugagcgacaccaagaacauggagaucaucaacagcaccaucgagacccuggcccccgacagccccuucgaccacaagaccgugagcggcuuccagaagcuggagaagcuggaccccaucgccgccgaccagcaggacaccgugguguucaaggugaccgagggcaagcugcugagagacccccugagcagacccggcgccgagcagaccggcauccagaacaagacccagauccacccccugaugagccagaugagcggcagcgugaccgccagcauggccaccggcagcgccaccagaaagggcaucguggugcugaucgacccccuggccgccaacggcaccaccgacaugcacaccagcgugcccagagugaagggcggccagagaaacaucaccgacgacagcagagaccagcccuucaucaagaagaugcacuucaccaucagacugaccgagagcgccagcaccuacagagacaucguggugaagaaggaggacggcuucacccagaucgugcugagcaccagaagcaccgagaagaacgcccugaacaccgaggugaucaaggagaucgugaacgcccugaacagcgccgccgccgacgacagcaagcuggugcuguucagcgccgccggcagcguguucugcugcggccuggacuucggcuacuucgugaagcaccugagaaacaacagaaacaccgccagccuggagaugguggacaccaucaagaacuucgugaacaccuucauccaguucaagaagcccaucguggugagcgugaacggccccgccaucggccugggcgccagcauccugccccugugcgaccuggugugggccaacgagaaggccugguuccagacccccuacaccaccuucggccagagccccgacggcugcagcagcaucaccuuccccaagaugaugggcaaggccagcgccaacgagaugcugaucgccggcagaaagcugaccgccagagaggccugcgccaagggccuggugagccagguguuccugaccggcaccuucacccaggaggugaugauccagaucaaggagcuggccagcuacaaccccaucgugcuggaggagugcaaggcccuggugagaugcaacaucaagcuggagcuggagcaggccaacgagagagagugcgaggugcugagaaagaucuggagcagcgcccagggcaucgagagcaugcugaaguacguggagaacaagaucgacgaguucuaa

SEQ ID NO: 15034 - RNA, 1626 nt, Artificial Sequence
  CDY2B__Homo_sapiens__NP_001001722
auggccagccaggaguucgagguggaggccaucguggacaagagacaggacaagaacggcaacacccaguaccuggugagauggaagggcuacgacaagcaggacgacaccugggagcccgagcagcaccugaugaacugcgagaagugcgugcacgacuucaacagaagacagaccgagaagcagaagaagcugaccuggaccaccaccagcagaaucuucagcaacaacgccagaagaagaaccagcagaagcaccaaggccaacuacagcaagaacagccccaagacccccgugaccgacaagcaccacagaagcaagaacugcaagcuguucgccgccagcaagaacgugagaagaaaggccgccagcacccugagcgacaccaagaacauggagaucaucaacagcaccaucgagacccuggcccccgacagccccuucgaccacaagaagaccgugagcggcuuccagaagcuggagaagcuggaccccaucgccgccgaccagcaggacaccgugguguucaaggugaccgagggcaagcugcugagagacccccugagccaccccggcgccgagcagaccggcauccagaacaagacccagaugcacccccugaugagccagaugagcggcagcgugaccgccagcauggccaccggcagcgccaccagaaagggcaucguggugcugaucgacccccuggccgccaacggcaccaccgacaugcacaccagcgugcccagagugaagggcggccagagaaacaucaccgacgacagcagaggccagcccuucaucaagaagaugcacuucaccaucagacugaccgagagcgccaucaccuacagagacaucguggugaagaaggaggacggcuucacccagaucgugcugagcaccagaagcaccgagaagaacgcccugaacaccgaggugaucaaggagauggugaacgcccugaacagcgccgccgccgacgacagcaagcuggugcuguucagcgccgccggcagcguguucugcugcggccuggacuucggcuacuucgugagacaccugagaaacgacagaaacaccgccagccuggagaugguggacaccaucaagaacuucgugaacaccuucauccaguucaagaagcccaucguggugagcgugaacggccccgccaucggccugggcgccagcauccugccccugugcgaccuggugugggccaacgagaaggccugguuccagacccccuacaccaccuucggccagagccccgacggcugcagcagcaucaccuuccccaagaugaugggcaaggccagcgccaacgagaugcugaucgccggcagaaagcugaccgccagagaggccugcgccaagggccuggugagccagguguuccugaccggcaccuucacccaggaggugaugauccagaucaaggagcuggccagcuacaacgccaucgugcuggaggagugcaaggcccuggugagaugcaacaucaagcuggagcuggagcaggccaacgagagagagugcgaggugcugagaaagaucuggagcagcgcccagggcaucgagagcaugcugaaguacguggagaacaagaucgacgaguucuaa

SEQ ID NO: 15035 - RNA, 1521 nt, Artificial Sequence
  CDYL2__Homo_sapiens__NP_689555
auggccagcggcgaccuguacgagguggagagaaucguggacaagagaaagaacaagaagggcaagugggaguaccugaucagauggaagggcuacggcagcaccgaggacaccugggagcccgagcaccaccugcugcacugcgaggaguucaucgacgaguucaacggccugcacaugagcaaggacaagagaaucaagagcggcaagcagagcagcaccagcaagcugcugagagacagcagaggccccagcguggagaagcugagccacagacccagcgaccccggcaagagcaagggcaccagccacaagagaaagagaaucaaccccccccuggccaagcccaagaagggcuacagcggcaagcccagcagcggcggcgacagagccaccaagaccgugagcuacagaaccacccccagcggccugcagaucaugccccugaagaagagccagaacggcauggagaacggcgacgccggcagcgagaaggacgagagacacuucggcaacggcagccaccagcccggccuggaccugaacgaccacgugggcgagcaggacaugggcgagugcgacgugaaccacgccacccuggccgagaacggccugggcagcgcccugaccaacggcggccugaaccugcacagccccgugaagagaaagcuggaggccgagaaggacuacguguucgacaagagacugagauacagcgugagacagaacgagagcaacugcagauucagagacaucguggugagaaaggaggagggcuucacccacauccugcugagcagccagaccagcgacaacaacgcccugacccccgagaucaugaaggaggugagaagagcccugugcaacgccgccaccgacgacagcaagcugcugcugcugagcgccgugggcagcguguucugcagcggccuggacuacagcuaccugaucggcagacugagcagcgacagaagaaaggagagcaccagaaucgccgaggccaucagagacuucgugaaggccuucauccaguucaagaagcccaucgugguggccaucaacggccccgcccugggccugggcgccagcauccugccccugugcgacaucgugugggccagcgagaaggccugguuccagacccccuacgccaccaucagacugacccccgccggcugcagcagcuacaccuucccccagauccugggcguggcccuggccaacgagaugcuguucugcggcagaaagcugaccgcccaggaggccugcagcagaggccuggugagccagguguucuggcccaccaccuucagccaggaggugaugcugagagugaaggagauggccagcugcagcgccguggugcuggaggagagcaagugccuggugagaagcuuccugaagagcgugcuggaggacgugaacgagaaggagugccugaugcugaagcagcuguggagcagcagcaagggccuggacagccuguucagcuaccugcaggacaagaucuacgagguguaa

SEQ ID NO: 15036 - RNA, 1239 nt, Artificial Sequence
  CDYL__Homo_sapiens__NP_001137442
auggaccuggccaagagcggcaucaagauccuggugcccaagagccccgugaagagcagaaccgccguggacggcuuccagagcgagagccccgagaagcuggaccccguggagcagggccaggaggacaccguggcccccgagguggccgccgagaagcccgugggcgcccugcugggccccggcgccgagagagccagaaugggcagcagacccagaauccacccccuggugccccaggugcccggccccgugaccgccgccauggccaccggccuggccgugaacggcaagggcaccagccccuucauggacgcccugaccgccaacggcaccaccaacauccagaccagcgugaccggcgugaccgccagcaagagaaaguucaucgacgacagaagagaccagcccuucgacaagagacugagauucagcgugagacagaccgagagcgccuacagauacagagacaucguggugagaaagcaggacggcuucacccacauccugcugagcaccaagagcagcgagaacaacagccugaaccccgaggugaugagagaggugcagagcgcccugagcaccgccgccgccgacgacagcaagcuggugcugcugagcgccgugggcagcguguucugcugcggccuggacuucaucuacuucaucagaagacugaccgacgacagaaagagagagagcaccaagauggccgaggccaucagaaacuucgugaacaccuucauccaguucaagaagcccaucaucguggccgugaacggccccgccaucggccugggcgccagcauccugccccugugcgacguggugugggccaacgagaaggccugguuccagacccccuacaccaccuucggccagagccccgacggcugcagcaccgugauguuccccaagaucaugggcggcgccagcgccaacgagaugcugcugagcggcagaaagcugaccgcccaggaggccugcggcaagggccuggugagccagguguucuggcccggcaccuucacccaggaggugauggugagaaucaaggagcuggccagcugcaaccccguggugcuggaggagagcaaggcccuggugagaugcaacaugaagauggagcuggagcaggccaacgagagagagugcgaggugcugaagaagaucuggggcagcgcccagggcauggacagcaugcugaaguaccugcagagaaagaucgacgaguucuaa

SEQ ID NO: 15037 - RNA, 1278 nt, Artificial Sequence
  CEACAM16__Homo_sapiens__NP_001034302
auggcccugaccggcuacagcuggcugcugcugagcgccaccuuccugaacgugggcgccgagaucagcaucacccuggagcccgcccagcccagcgagggcgacaacgugacccugguggugcacggccugagcggcgagcugcuggccuacagcugguacgccggccccacccugagcgugagcuaccugguggccagcuacaucgugagcaccggcgacgagacccccggccccgcccacaccggcagagaggccgugagacccgacggcagccuggacauccagggcauccugcccagacacagcggcaccuacauccugcagaccuucaacagacagcugcagaccgaggugggcuacggccacgugcaggugcacgagauccuggcccagcccaccgugcuggccaacagcaccgcccugguggagagaagagacacccugagacugaugugcagcagccccagccccaccgccgaggugagaugguucuucaacggcggcgcccugcccguggcccugagacugggccugagccccgacggcagagugcuggccagacacggcaucagaagagaggaggccggcgccuaccagugcgagguguggaaccccgugagcgugagcagaagcgagcccaucaaccugaccguguacuucggccccgagagaguggccauccugcaggacagcaccaccagaaccggcugcaccaucaagguggacuucaacaccagccugacccuguggugcgugagcagaagcugccccgagcccgaguacguguggaccuucaacggccaggcccugaagaacggccaggaccaccugaacaucagcagcaugaccgccgcccaggagggcaccuacaccugcaucgccaagaacaccaagacccugcugagcggcagcgccagcgugguggugaagcugagcgccgccgccguggccaccaugaucgugcccgugcccaccaagcccaccgagggccaggacgugacccugaccgugcagggcuaccccaaggaccugcugguguacgccugguacagaggccccgccagcgagcccaacagacugcugagccagcugcccagcggcaccuggaucgccggccccgcccacaccggcagagaggugggcuuccccaacugcagccugcuggugcagaagcugaaccugaccgacaccggcagauacacccugaagaccgugaccgugcagggcaagaccgagacccuggagguggagcugcagguggccccccugggcuaa

SEQ ID NO: 15038 - RNA, 900 nt, Artificial Sequence
  CEACAM19__Homo_sapiens__NP_001121365
auggagauccccaugggcacccagggcugcuucagcaagagccugcugcugagcgccagcauccuggugcuguggaugcugcagggcagccaggccgcccuguacauccagaagauccccgagcagccccagaagaaccaggaccugcugcugagcgugcagggcgugcccgacaccuuccaggacuucaacugguaccugggcgaggagaccuacggcggcaccagacuguucaccuacauccccggcauccagagaccccagagagacggcagcgccaugggccagagagacaucgugggcuuccccaacggcagcaugcugcugagaagagcccagcccaccgacagcggcaccuaccagguggccaucaccaucaacagcgaguggaccaugaaggccaagaccgaggugcagguggccgagaagaacaaggagcugcccagcacccaccugcccaccaacgccggcauccuggccgccaccaucaucggcagccuggccgccggcgcccugcugaucagcugcaucgccuaccugcuggugaccagaaacuggagaggccagagccacagacugcccgcccccagaggccagggcagccugagcauccugugcagcgccgugagccccgugcccagcgugacccccagcaccuggauggccaccaccgagaagcccgagcugggccccgcccacgacgccggcgacaacaacaucuacgaggugaugcccagccccgugcugcuggugagccccaucagcgacaccagaagcaucaaccccgccagaccccugcccacccccccccaccugcaggccgagcccgagaaccaccaguaccaggaccugcugaaccccgaccccgcccccuacugccagcuggugcccaccagcuaa

SEQ ID NO: 15039 - RNA, 1395 nt, Artificial Sequence
  CEACAM1__Homo_sapiens__NP_001020083
augggccaccugagcgccccccugcacagagugagagugcccuggcagggccugcugcugaccgccagccugcugaccuucuggaacccccccaccaccgcccagcugaccaccgagagcaugcccuucaacguggccgagggcaaggaggugcugcugcuggugcacaaccugccccagcagcuguucggcuacagcugguacaagggcgagagaguggacggcaacagacagaucgugggcuacgccaucggcacccagcaggccacccccggccccgccaacagcggcagagagaccaucuaccccaacgccagccugcugauccagaacgugacccagaacgacaccggcuucuacacccugcaggugaucaagagcgaccuggugaacgaggaggccaccggccaguuccacguguaccccgagcugcccaagcccagcaucagcagcaacaacagcaaccccguggaggacaaggacgccguggccuucaccugcgagcccgagacccaggacaccaccuaccugugguggaucaacaaccagagccugcccgugagccccagacugcagcugagcaacggcaacagaacccugacccugcugagcgugaccagaaacgacaccggccccuacgagugcgagauccagaaccccgugagcgccaacagaagcgaccccgugacccugaacgugaccuacggccccgacacccccaccaucagccccagcgacaccuacuacagacccggcgccaaccugagccugagcugcuacgccgccagcaacccccccgcccaguacagcuggcugaucaacggcaccuuccagcagagcacccaggagcuguucauccccaacaucaccgugaacaacagcggcagcuacaccugccacgccaacaacagcgugaccggcugcaacagaaccaccgugaagaccaucaucgugaccgagcugagccccgugguggccaagccccagaucaaggccagcaagaccaccgugaccggcgacaaggacagcgugaaccugaccugcagcaccaacgacaccggcaucagcaucagaugguucuucaagaaccagagccugcccagcagcgagagaaugaagcugagccagggcaacaccacccugagcaucaaccccgugaagagagaggacgccggcaccuacuggugcgagguguucaaccccaucagcaagaaccagagcgaccccaucaugcugaacgugaacuacaacgcccugccccaggagaacggccugagccccggcgccaucgccggcaucgugaucggcgugguggcccugguggcccugaucgccguggcccuggccugcuuccugcacuucggcaagaccggcagcagcggcccccugcaguaa

SEQ ID NO: 15040 - RNA, 882 nt, Artificial Sequence
  CEACAM21__Homo_sapiens__XP_006725457
augggcccccccagcgccugcccccacagagagugcauccccuggcagggccugcugcugaccgccagccugcugaccuucuggaacgcccccaccaccgccuggcuguucaucgccagcgcccccuucgagguggccgagggcgagaacgugcaccugagcgugguguaccugcccgagaaccuguacagcuacggcugguacaagggcaagaccguggagcccaaccagcugaucgccgccuacgugaucgacacccacgugagaacccccggccccgccuacagcggcagagagaccaucagccccagcggcgaccugcacuuccagaacgugacccuggaggacaccggcuacuacaaccugcaggugaccuacagaaacagccagaucgagcaggccagccaccaccugagaguguacgagagcguggcccagcccagcauccaggccagcagcaccaccgugaccgagaagggcagcguggugcugaccugccacaccaacaacaccggcaccagcuuccaguggaucuucaacaaccagagacugcaggugaccaagagaaugaagcugagcugguucaaccacgugcugaccaucgaccccaucagacaggaggacgccggcgaguaccagugcgaggugagcaaccccgugagcagcaacagaagcgacccccugaagcugaccgugaagagcgacgacaacacccugggcauccugaucggcgugcuggugggcagccugcugguggccgcccuggugugcuuccugcugcugagaaagaccggcagagccagcgaccagagcgacuucagagagcagcagccccccgccagcacccccggccacggccccagcgacagcagcaucagcuaa

SEQ ID NO: 15041 - RNA, 639 nt, Artificial Sequence
  CEACAM3__Homo_sapiens__NP_001264092
augggcccccccagcgccagcccccacagagagugcauccccuggcagggccugcugcugaccgccagccugcugaacuucuggaacccccccaccaccgccaagcugaccaucgagagcaugccccugagcguggccgagggcaaggaggugcugcugcuggugcacaaccugccccagcaccuguucggcuacagcugguacaagggcgagagaguggacggcaacagccugaucgugggcuacgugaucggcacccagcaggccacccccggcgccgccuacagcggcagagagaccaucuacaccaacgccagccugcugauccagaacgugacccagaacgacaucggcuucuacacccugcaggugaucaagagcgaccuggugaacgaggaggccaccggccaguuccacguguaccaggagaacgcccccggccugcccgugggcgccguggccggcaucgugaccggcgugcuggugggcguggcccugguggccgcccuggugugcuuccugcugcuggccaagaccggcagacccuggagccugccccagcugugccugcuggacgugcccagccugcacugccccggcccccccacccagccccaggacagcagcuuccaccuguaa

SEQ ID NO: 15042 - RNA, 735 nt, Artificial Sequence
  CEACAM4__Homo_sapiens__NP_001808
augggcccccccagcgccgcccccagaggcggccacagacccuggcagggccugcugaucaccgccagccugcugaccuucuggcacccccccaccaccgugcaguucaccaucgaggcccugcccagcagcgccgccgagggcaaggacgugcugcugcuggccugcaacaucagcgagaccauccaggccuacuacuggcacaagggcaagaccgccgagggcagcccccugaucgccggcuacaucaccgacauccaggccaacauccccggcgccgccuacagcggcagagagaccguguaccccaacggcagccugcuguuccagaacaucacccuggaggacgccggcagcuacacccugagaaccaucaacgccagcuacgacagcgaccaggccaccggccagcugcacgugcaccagaacaacgugcccggccugcccgugggcgccguggccggcaucgugaccggcgugcuggugggcguggcccugguggccgcccuggugugcuuccugcugcugagcagaaccggcagagccagcauccagagagaccugagagagcagcccccccccgccagcacccccggccacggccccagccacagaagcaccuucagcgccccccugcccagccccagaaccgccacccccaucuacgaggagcugcuguacagcgacgccaacaucuacugccagaucgaccacaaggccgacguggugagcuaa

SEQ ID NO: 15043 - RNA, 2109 nt, Artificial Sequence
  CEACAM5__Homo_sapiens__NP_001278413
auggagagccccagcgcccccccccacagauggugcauccccuggcagagacugcugcugaccgccagccugcugaccuucuggaacccccccaccaccgccaagcugaccaucgagagcacccccuucaacguggccgagggcaaggaggugcugcugcuggugcacaaccugccccagcaccuguucggcuacagcugguacaagggcgagagaguggacggcaacagacagaucaucggcuacgugaucggcacccagcaggccacccccggccccgccuacagcggcagagagaucaucuaccccaacgccagccugcugauccagaacaucauccagaacgacaccggcuucuacacccugcacgugaucaagagcgaccuggugaacgaggaggccaccggccaguucagaguguaccccgagcugcccaagcccagcaucagcagcaacaacagcaagcccguggaggacaaggacgccguggccuucaccugcgagcccgagacccaggacgccaccuaccuguggugggugaacaaccagagccugcccgugagccccagacugcagcugagcaacggcaacagaacccugacccuguucaacgugaccagaaacgacaccgccagcuacaagugcgagacccagaaccccgugagcgccagaagaagcgacagcgugauccugaacgugcuguacggccccgacgcccccaccaucagcccccugaacaccagcuacagaagcggcgagaaccugaaccugagcugccacgccgccagcaacccccccgcccaguacagcugguucgugaacggcaccuuccagcagagcacccaggagcuguucauccccaacaucaccgugaacaacagcggcagcuacaccugccaggcccacaacagcgacaccggccugaacagaaccaccgugaccaccaucaccguguacgccgagccccccaagcccuucaucaccagcaacaacagcaaccccguggaggacgaggacgccguggcccugaccugcgagcccgagauccagaacaccaccuaccuguggugggugaacaaccagagccugcccgugagccccagacugcagcugagcaacgacaacagaacccugacccugcugagcgugaccagaaacgacgugggccccuacgagugcggcauccagaacgagcugagcguggaccacagcgaccccgugauccugaacgugcuguacggccccgacgaccccaccaucagccccagcuacaccuacuacagacccggcgugaaccugagccugagcugccacgccgccagcaacccccccgcccaguacagcuggcugaucgacggcaacauccagcagcacacccaggagcuguucaucagcaacaucaccgagaagaacagcggccuguacaccugccaggccaacaacagcgccagcggccacagcagaaccaccgugaagaccaucaccgugagcgccgagcugcccaagcccagcaucagcagcaacaacagcaagcccguggaggacaaggacgccguggccuucaccugcgagcccgaggcccagaacaccaccuaccuguggugggugaacggccagagccugcccgugagccccagacugcagcugagcaacggcaacagaacccugacccuguucaacgugaccagaaacgacgccagagccuacgugugcggcauccagaacagcgugagcgccaacagaagcgaccccgugacccuggacgugcuguacggccccgacacccccaucaucagcccccccgacagcagcuaccugagcggcgccaaccugaaccugagcugccacagcgccagcaaccccagcccccaguacagcuggagaaucaacggcaucccccagcagcacacccaggugcuguucaucgccaagaucacccccaacaacaacggcaccuacgccugcuucgugagcaaccuggccaccggcagaaacaacagcaucgugaagagcaucaccgugagcgccagcggcaccagccccggccugagcgccggcgccaccgugggcaucaugaucggcgugcuggugggcguggcccugaucuaa

SEQ ID NO: 15044 - RNA, 1035 nt, Artificial Sequence
  CEACAM6__Homo_sapiens__NP_002474
augggcccccccagcgccccccccugcagacugcacgugcccuggaaggaggugcugcugaccgccagccugcugaccuucuggaacccccccaccaccgccaagcugaccaucgagagcacccccuucaacguggccgagggcaaggaggugcugcugcuggcccacaaccugccccagaacagaaucggcuacagcugguacaagggcgagagaguggacggcaacagccugaucgugggcuacgugaucggcacccagcaggccacccccggccccgccuacagcggcagagagaccaucuaccccaacgccagccugcugauccagaacgugacccagaacgacaccggcuucuacacccugcaggugaucaagagcgaccuggugaacgaggaggccaccggccaguuccacguguaccccgagcugcccaagcccagcaucagcagcaacaacagcaaccccguggaggacaaggacgccguggccuucaccugcgagcccgaggugcagaacaccaccuaccuguggugggugaacggccagagccugcccgugagccccagacugcagcugagcaacggcaacaugacccugacccugcugagcgugaagagaaacgacgccggcagcuacgagugcgagauccagaaccccgccagcgccaacagaagcgaccccgugacccugaacgugcuguacggccccgacgugcccaccaucagccccagcaaggccaacuacagacccggcgagaaccugaaccugagcugccacgccgccagcaacccccccgcccaguacagcugguucaucaacggcaccuuccagcagagcacccaggagcuguucauccccaacaucaccgugaacaacagcggcagcuacaugugccaggcccacaacagcgccaccggccugaacagaaccaccgugaccaugaucaccgugagcggcagcgcccccgugcugagcgccguggccaccgugggcaucaccaucggcgugcuggccagaguggcccugaucuaa

SEQ ID NO: 15045 - RNA, 798 nt, Artificial Sequence
  CEACAM7__Homo_sapiens__NP_001278414
augggcagccccagcgccugccccuacagagugugcauccccuggcagggccugcugcugaccgccagccugcugaccuucuggaaccugcccaacagcgcccagaccaacaucgacguggugcccuucaacguggccgagggcaaggaggugcugcugguggugcacaacgagagccagaaccuguacggcuacaacugguacaagggcgagagagugcacgccaacuacagaaucaucggcuacgugaagaacaucagccaggagaacgcccccggccccgcccacaacggcagagagaccaucuaccccaacggcacccugcugauccagaacgugacccacaacgacgccggcaucuacacccugcacgugaucaaggagaaccuggugaacgaggaggugaccagacaguucuacguguucagcgagccccccaagcccagcaucaccagcaacaacuucaaccccguggagaacaaggacaucguggugcugaccugccagcccgagacccagaacaccaccuaccuguggugggugaacaaccagagccugcuggugagccccagacugcugcugagcaccgacaacagaacccuggugcugcugagcgccaccaagaacgacaucggccccuacgagugcgagauccagaaccccgugggcgccagcagaagcgaccccgugacccugaacgugagauacgagagcgugcaggccagcagccccgaccugagcgccggcaccgccgugagcaucaugaucggcgugcuggccggcauggcccugaucuaa

SEQ ID NO: 15046 - RNA, 1050 nt, Artificial Sequence
  CEACAM8__Homo_sapiens__NP_001807
augggccccaucagcgcccccagcugcagauggagaauccccuggcagggccugcugcugaccgccagccuguucaccuucuggaacccccccaccaccgcccagcugaccaucgaggccgugcccagcaacgccgccgagggcaaggaggugcugcugcuggugcacaaccugccccaggaccccagaggcuacaacugguacaagggcgagaccguggacgccaacagaagaaucaucggcuacgugaucagcaaccagcagaucacccccggccccgccuacagcaacagagagaccaucuaccccaacgccagccugcugaugagaaacgugaccagaaacgacaccggcagcuacacccugcaggugaucaagcugaaccugaugagcgaggaggugaccggccaguucagcgugcaccccgagacccccaagcccagcaucagcagcaacaacagcaaccccguggaggacaaggacgccguggccuucaccugcgagcccgagacccagaacaccaccuaccuguggugggugaacggccagagccugcccgugagccccagacugcagcugagcaacggcaacagaacccugacccugcugagcgugaccagaaacgacgugggccccuacgagugcgagauccagaaccccgccagcgccaacuucagcgaccccgugacccugaacgugcuguacggccccgacgcccccaccaucagccccagcgacaccuacuaccacgccggcgugaaccugaaccugagcugccacgccgccagcaacccccccagccaguacagcuggagcgugaacggcaccuuccagcaguacacccagaagcuguucauccccaacaucaccaccaagaacagcggcagcuacgccugccacaccaccaacagcgccaccggcagaaacagaaccaccgugagaaugaucaccgugagcgacgcccuggugcagggcagcagccccggccugagcgccagagccaccgugagcaucaugaucggcgugcuggccagaguggcccugaucuaa

SEQ ID NO: 15047 - RNA, 1182 nt, Artificial Sequence
  CEBPA__Homo_sapiens__NP_001274353
augagaggcagaggcagagccggcagccccggcggcagaagaagaagacccgcccaggccggcggcagaagaggcagccccugcagagagaacagcaacagccccauggagagcgccgacuucuacgaggccgagcccagaccccccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccuaa

SEQ ID NO: 15048 - RNA, 1038 nt, Artificial Sequence
  CEBPB__Homo_sapiens__NP_005185
augcagagacugguggccugggaccccgccugccugccccugcccccccccccccccgccuucaagagcauggagguggccaacuucuacuacgaggccgacugccuggccgccgccuacggcggcaaggccgcccccgccgccccccccgccgccagacccggccccagaccccccgccggcgagcugggcagcaucggcgaccacgagagagccaucgacuucagccccuaccuggagccccugggcgccccccaggcccccgcccccgccaccgccaccgacaccuucgaggccgccccccccgcccccgcccccgcccccgccagcagcggccagcaccacgacuuccugagcgaccuguucagcgacgacuacggcggcaagaacugcaagaagcccgccgaguacggcuacgugagccugggcagacugggcgccgccaagggcgcccugcaccccggcugcuucgccccccugcaccccccccccccccccccccccccccccgccgagcugaaggccgagcccggcuucgagcccgccgacugcaagagaaaggaggaggccggcgcccccggcggcggcgccggcauggccgccggcuuccccuacgcccugagagccuaccugggcuaccaggccgugcccagcggcagcagcggcagccugagcaccagcagcagcagcagcccccccggcacccccagccccgccgacgccaaggccccccccaccgccugcuacgccggcgccgcccccgcccccagccaggugaagagcaaggccaagaagaccguggacaagcacagcgacgaguacaagaucagaagagagagaaacaacaucgccgugagaaagagcagagacaaggccaagaugagaaaccuggagacccagcacaaggugcuggagcugaccgccgagaacgagagacugcagaagaagguggagcagcugagcagagagcugagcacccugagaaaccuguucaagcagcugcccgagccccugcuggccagcagcggccacugcuaa

SEQ ID NO: 15049 - RNA, 810 nt, Artificial Sequence
  CEBPD__Homo_sapiens__NP_005186
augagcgccgcccuguucagccuggacggccccgccagaggcgcccccuggcccgccgagcccgcccccuucuacgagcccggcagagccggcaagcccggcagaggcgccgagcccggcgcccugggcgagcccggcgccgccgcccccgccauguacgacgacgagagcgccaucgacuucagcgccuacaucgacagcauggccgccgugcccacccuggagcugugccacgacgagcuguucgccgaccuguucaacagcaaccacaaggccggcggcgccggcccccuggagcugcugcccggcggccccgccagaccccugggccccggccccgccgcccccagacugcugaagagagagcccgacuggggcgacggcgacgcccccggcagccugcugcccgcccagguggccgccugcgcccagaccguggugagccuggccgccgccggccagcccaccccccccaccagccccgagccccccagaagcagccccagacagacccccgcccccggccccgccagagagaagagcgccggcaagagaggccccgacagaggcagccccgaguacagacagagaagagagagaaacaacaucgccgugagaaagagcagagacaaggccaagagaagaaaccaggagaugcagcagaagcugguggagcugagcgccgagaacgagaagcugcaccagagaguggagcagcugaccagagaccuggccggccugagacaguucuucaagcagcugcccagcccccccuuccugcccgccgccggcaccgccgacugcagauaa

SEQ ID NO: 15050 - RNA, 846 nt, Artificial Sequence
  CEBPE__Homo_sapiens__NP_001796
augagccacggcaccuacuacgagugcgagcccagaggcggccagcagccccuggaguucagcggcggcagagccggccccggcgagcugggcgacaugugcgagcacgaggccagcaucgaccugagcgccuacaucgagagcggcgaggagcagcugcugagcgaccuguucgccgugaagcccgcccccgaggccagaggccugaagggccccggcacccccgccuucccccacuaccugccccccgaccccagacccuucgccuaccccccccacaccuucggccccgacagaaaggcccugggccccggcaucuacagcagccccggcagcuacgaccccagagccguggccgugaaggaggagcccagaggccccgagggcagcagagccgccagcagaggcagcuacaacccccugcaguaccagguggcccacugcggccagaccgccaugcaccugccccccacccuggccgcccccggccagccccugagagugcugaaggccccccuggccaccgccgccccccccugcagcccccugcugaaggcccccagccccgccggcccccugcacaagggcaagaaggccgugaacaaggacagccuggaguacagacugagaagagagagaaacaacaucgccgugagaaagagcagagacaaggccaagagaagaauccuggagacccagcagaaggugcuggaguacauggccgagaacgagagacugagaagcagaguggagcagcugacccaggagcuggacacccugagaaaccuguucagacagauccccgaggccgccaaccugaucaagggcgugggcggcugcagcuaa

SEQ ID NO: 15051 - RNA, 453 nt, Artificial Sequence
  CEBPG__Homo_sapiens__NP_001239225
augagcaagaucagccagcagaacagcacccccggcgugaacggcaucagcgugauccacacccaggcccacgccagcggccugcagcaggugccccagcuggugcccgccggccccggcggcggcggcaaggccguggcccccagcaagcagagcaagaagagcagccccauggacagaaacagcgacgaguacagacagagaagagagagaaacaacauggccgugaagaagagcagacugaagagcaagcagaaggcccaggacacccugcagagagugaaccagcugaaggaggagaacgagagacuggaggccaagaucaagcugcugaccaaggagcugagcgugcugaaggaccuguuccuggagcacgcccacaaccuggccgacaacgugcagagcaucagcaccgagaacaccaccgccgacggcgacaacgccggccaguaa

SEQ ID NO: 15052 - RNA, 3165 nt, Artificial Sequence
  CEBPZ__Homo_sapiens__NP_005751
auggccgccgugaaggagccccuggaguuccacgccaagagacccuggagacccgaggaggccguggaggaccccgacgaggaggacgaggacaacaccagcgaggccgagaacggcuucagccuggaggaggugcugagacugggcggcaccaagcaggacuaccugaugcuggccacccuggacgagaacgaggaggugaucgacggcggcaagaagggcgccaucgacgaccugcagcagggcgagcuggaggccuucauccagaaccugaaccuggccaaguacaccaaggccagccugguggaggaggacgagcccgccgagaaggagaacagcagcaagaaggaggugaagauccccaagaucaacaacaagaacaccgccgagagccagagaaccagcgugaacaaggugaagaacaagaacagacccgagccccacagcgacgagaacggcagcaccacccccaaggugaagaaggacaagcagaacaucuucgaguucuucgagagacagacccugcugcugagacccggcggcaagugguacgaccuggaguacagcaacgaguacagccugaagccccagccccaggacguggugagcaaguacaagacccuggcccagaagcuguaccagcacgagaucaaccuguucaagagcaagaccaacagccagaagggcgccagcagcaccuggaugaaggccaucgugagcagcggcacccugggcgacagaauggccgccaugauccugcugauccaggacgacgccgugcacacccugcaguucguggagacccuggugaaccuggugaagaagaagggcagcaagcagcagugccugauggcccuggacaccuucaaggagcugcugaucaccgaccugcugcccgacaacagaaagcugagaaucuucagccagagacccuucgacaagcuggagcagcugagcagcggcaacaaggacagcagagacagaagacugauccugugguacuucgagcaccagcugaagcaccugguggccgaguucgugcaggugcuggagacccugagccacgacacccuggugaccaccaagaccagagcccugaccguggcccacgagcugcugugcaacaagcccgaggaggagaaggcccugcuggugcagguggugaacaagcugggcgacccccagaacagaaucgccaccaaggccagccaccugcuggagacccugcugugcaagcaccccaacaugaagggcguggugagcggcgagguggagagacugcuguucagaagcaacaucagcagcaaggcccaguacuacgccaucugcuuccugaaccagauggcccugagccacgaggagagcgagcuggccaacaagcugaucaccguguacuucugcuucuucagaaccugcgugaagaagaaggacguggagagcaagaugcugagcgcccugcugaccggcgugaacagagccuaccccuacagccagaccggcgacgacaaggugagagagcagaucgacacccuguucaaggugcugcacaucgugaacuucaacaccagcgugcaggcccugaugcugcuguuccaggugaugaacagccagcagaccaucagcgacagauacuacaccgcccuguacagaaagaugcuggaccccggccugaugaccugcagcaagcaggccauguuccugaaccugguguacaagagccugaaggccgacaucgugcugagaagagugaaggccuucgugaagagacugcugcaggugaccugccagcagaugccccccuucaucugcggcgcccuguaccuggugagcgagauccugaaggccaagcccggccugagaagccagcuggacgaccaccccgagagcgacgacgaggagaacuucaucgacgccaacgacgacgaggacauggagaaguucaccgacgccgacaaggagaccgagaucgugaagaagcuggagaccgaggagaccgugcccgagaccgacguggagaccaagaagcccgagguggccagcugggugcacuucgacaaccugaagggcggcaagcagcugaacaaguacgaccccuucagcagaaacccccuguucugcggcgccgagaacaccagccugugggagcugaagaagcugagcgugcacuuccaccccagcguggcccuguucgccaagaccauccugcagggcaacuacauccaguacagcggcgacccccugcaggacuucacccugaugagauuccuggacagauucguguacagaaaccccaagccccacaagggcaaggagaacaccgacagcguggugaugcagcccaagagaaagcacuucaucaaggacaucagacaccugcccgugaacagcaaggaguuccuggccaaggaggagagccagauccccguggacgagguguucuuccacagauacuacaagaagguggccgugaaggagaagcagaagagagacgccgacgaggagagcaucgaggacguggacgacgaggaguucgaggagcugaucgacaccuucgaggacgacaacugcuucagcagcggcaaggacgacauggacuucgccggcaacgugaagaagagaaccaagggcgccaaggacaacacccuggacgaggacagcgagggcagcgacgacgagcugggcaaccuggacgacgacgaggugagccugggcagcauggacgacgaggaguucgccgagguggacgaggacggcggcaccuucauggacgugcuggacgacgagagcgagagcgugcccgagcuggaggugcacagcaaggugagcaccaagaagagcaagagaaagggcaccgacgacuucgacuucgccggcagcuuccagggccccagaaagaagaagagaaaccugaacgacagcagccuguucgugagcgccgaggaguucggccaccugcuggacgagaacaugggcagcaaguucgacaacaucggcaugaacgccauggccaacaaggacaacgccagccugaagcagcugagaugggaggccgagagagacgacuggcugcacaacagagacgccaagagcaucaucaagaagaagaagcacuucaagaagaagagaaucaagaccacccagaagaccaagaagcagagaaaguaa

SEQ ID NO: 15053 - RNA, 813 nt, Artificial Sequence
  CECR1__Homo_sapiens__NP_803124
auggacagccuggaguggaacugggcccugguguacgagcugagcggcgagcaccacgacgaggaguggagcgugaagaccuaccaggagguggcccagaaguucguggagacccaccccgaguucaucggcaucaagaucaucuacagcgaccacagaagcaaggacguggccgugaucgccgagagcaucagaauggccaugggccugagaaucaaguuccccaccgugguggccggcuucgaccuggugggccacgaggacaccggccacagccugcacgacuacaaggaggcccugaugauccccgccaaggacggcgugaagcugcccuacuucuuccacgccggcgagaccgacuggcagggcaccagcaucgacagaaacauccuggacgcccugaugcugaacaccaccagaaucggccacggcuucgcccugagcaagcaccccgccgugagaaccuacagcuggaagaaggacauccccaucgaggugugccccaucagcaaccaggugcugaagcuggugagcgaccugagaaaccaccccguggccacccugauggccaccggccaccccauggugaucagcagcgacgaccccgccauguucggcgccaagggccugagcuacgacuucuacgagguguucaugggcaucggcggcaugaaggccgaccugagaacccugaagcagcuggccaugaacagcaucaaguacagcacccugcuggagagcgagaagaacaccuucauggagaucuggaagaagagaugggacaaguucaucgccgacguggccaccaaguaa

SEQ ID NO: 15054 - RNA, 4395 nt, Artificial Sequence
  CECR2__Homo_sapiens__NP_001276976
augugccccgaggagggcggcgccgccggccugggcgagcugagaagcuggugggaggugcccgccaucgcccacuucugcagccuguucagaaccgccuucagacugcccgacuucgagaucgaggagcuggaggccgcccugcacagagacgacguggaguucaucagcgaccugaucgccugccugcugcagggcugcuaccagagaagagacaucaccccccagaccuuccacagcuaccuggaggacaucaucaacuacagaugggagcuggaggagggcaagcccaacccccugagagaggccagcuuccaggaccugccccugagaaccagaguggagauccugcacagacugugcgacuacagacuggacgccgacgacguguucgaccugcugaagggccuggacgccgacagccugagaguggagccccugggcgaggacaacagcggcgcccuguacugguacuucuacggcaccagaauguacaaggaggaccccgugcagggcaagagcaacggcgagcugagccugagcagagagagcgagggccagaagaacgugagcagcauccccggcaagaccggcaagagaagaggcagaccccccaagagaaagaagcugcaggaggagauccugcugagcgagaagcaggaggagaacagccuggccagcgagccccagaccagacacggcagccagggccccggccagggcaccugguggcugcugugccagaccgaggaggaguggagacaggugaccgagagcuucagagagagaaccagccugagagagagacagcuguacaagcugcugagcgaggacuuccugcccgagaucugcaacaugaucgcccagaagggcaagagaccccagagaaccaaggccgagcugcaccccagauggaugagcgaccaccugagcaucaagcccgugaagcaggaggagacccccgugcugaccagaaucgagaagcagaagagaaaggaggaggaggaggagagacagauccugcuggccgugcagaagaaggagcaggagcagaugcugaaggaggagagaaagagagagcuggaggagaaggugaaggccguggaggacagagccaagagaagaaagcugagagaggagagagccuggcugcuggcccagggcaaggagcugccccccgagcugagccaccuggaccccaacagccccaugagagaggagaagaagaccaaggaccuguucgagcuggacgacgacuucaccgccauguacaaggugcuggacguggugaaggcccacaaggacagcuggcccuuccuggagcccguggacgagagcuacgcccccaacuacuaccagaucaucaaggcccccauggacaucagcagcauggagaagaagcugaacggcggccuguacugcaccaaggaggaguucgugaacgacaugaagaccauguucagaaacugcagaaaguacaacggcgagagcagcgaguacaccaagaugagcgacaaccuggagagaugcuuccacagagccaugaugaagcacuuccccggcgaggacggcgacaccgacgaggaguucuggaucagagaggacgagaagagagagaagagaagaagcagagccggcagaagcggcggcagccacguguggaccagaagcagagaccccgagggcagcagcagaaagcagcagcccauggagaacggcggcaagagccugccccccaccagaagagcccccagcagcggcgacgaccagagcagcagcagcacccagccccccagagaggugggcaccagcaacggcagaggcuucagccacccccugcacugcggcggcacccccagccaggcccccuuccugaaccagaugagacccgccgugcccggcaccuucggcccccugagaggcagcgaccccgccacccuguacggcagcagcggcgugcccgagccccaccccggcgagcccgugcagcagagacagcccuucaccaugcagccccccgugggcaucaacagccugagaggccccagacugggcacccccgaggagaagcagaugugcggcggccugacccaccugagcaacaugggcccccaccccggcagccugcagcugggccagaucagcggccccagccaggacggcagcauguacgcccccgcccaguuccagcccggcuucaucccccccagacacggcggcgcccccgccagaccccccgacuuccccgagagcagcgagaucccccccagccacauguacagaagcuacaaguaccugaacagagugcacagcgccguguggaacggcaaccacggcgccaccaaccagggcccccugggccccgacgagaagccccaccugggccccggccccagccaccagcccagaacccugggccacgugauggacagcagagugaugagaccccccgugccccccaaccaguggaccgagcagagcggcuuccugccccacggcgugcccagcagcggcuacaugagaccccccugcaagagcgccggccacagacugcagcccccccccgugcccgcccccagcagccuguucggcgcccccgcccaggcccugagaggcgugcagggcggcgacagcaugauggacagccccgagaugaucgccaugcagcagcugagcagcagagugugcccccccggcgugcccuaccacccccaccagcccgcccaccccagacugcccggccccuucccccagguggcccaccccaugagcgugaccgugagcgcccccaagcccgcccugggcaaccccggcagagcccccgagaacagcgaggcccaggagcccgagaacgaccaggccgagccccugcccggccuggaggagaagccccccggcgugggcaccagcgagggcguguaccugacccagcugccccaccccacccccccccugcagaccgacugcaccagacagagcagcccccaggagagagagaccgugggccccgagcugaagagcagcagcagcgagagcgccgacaacugcaaggccaugaagggcaagaaccccuggcccagcgacagcagcuaccccggccccgccgcccagggcugcgugagagaccugagcaccguggccgacagaggcgcccugagcgagaacggcgugaucggcgaggccagccccugcggcagcgagggcaagggccugggcagcagcggcagcgagaagcugcugugccccagaggcagaacccugcaggagaccaugcccugcaccggccagaacgccgccaccccccccagcaccgaccccggccugaccggcggcaccgugagccaguuccccccccuguacaugcccggccuggaguaccccaacagcgccgcccacuaccacaucagccccggccugcagggcgugggccccgugaugggcggcaagagccccgccagccacccccagcacuucccccccagaggcuuccagagcaaccacccccacagcggcggcuuccccagauacagacccccccagggcaugagauacagcuaccacccccccccccagcccagcuaccaccacuaccagagaacccccuacuacgccugcccccagagcuucagcgacuggcagagaccccugcacccccagggcagccccagcggcccccccgccagccagccccccccccccagaagccuguucagcgacaagaacgccauggccagccugcagggcugcgagacccugaacgccgcccugaccagccccaccagaauggacgccguggccgccaaggugcccaacgacggccagaaccccggccccgaggaggagaagcuggacgagagcauggagagacccgagagccccaaggaguuccuggaccuggacaaccacaacgccgccaccaagagacagagcagccugagcgccagcgaguaccuguacggcaccccccccccccugagcagcggcaugggcuucggcagcagcgccuuccccccccacagcgugaugcugcagaccggcccccccuacaccccccagagacccgccagccacuuccagcccagagccuacagcagccccguggccgcccugcccccccaccaccccggcgccacccagcccaacggccugagccaggagggccccaucuacagaugccaggaggagggccugggccacuuccaggccgugaugauggagcagaucggcaccagaagcggcaucagaggccccuuccaggagauguacagacccagcggcaugcagaugcaccccgugcagagccaggccagcuuccccaagacccccaccgccgccaccagccaggaggaggugcccccccacaagccccccacccugccccuggaccagagcuaa

SEQ ID NO: 15055 - RNA, 777 nt, Artificial Sequence
  CELA1__Homo_sapiens__NP_001962
augcuggugcuguacggccacagcacccaggaccugcccgagaccaacgccagaguggugggcggcaccgaggccggcagaaacagcuggcccagccagaucagccugcaguacagaagcggcggcagcagauaccacaccugcggcggcacccugaucagacagaacugggugaugaccgccgcccacugcguggacuaccagaagaccuucagagugguggccggcgaccacaaccugagccagaacgacggcaccgagcaguacgugagcgugcagaagaucguggugcaccccuacuggaacagcgacaacguggccgccggcuacgacaucgcccugcugagacuggcccagagcgugacccugaacagcuacgugcagcugggcgugcugccccaggagggcgccauccuggccaacaacagccccugcuacaucaccggcuggggcaagaccaagaccaacggccagcuggcccagacccugcagcaggccuaccugcccagcguggacuacgccaucugcagcagcagcagcuacuggggcagcaccgugaagaacaccauggugugcgccggcggcgacggcgugagaagcggcugccagggcgacagcggcggcccccugcacugccuggugaacggcaaguacagcgugcacggcgugaccagcuucgugagcagcagaggcugcaacgugagcagaaagcccaccguguucacccaggugagcgccuacaucagcuggaucaacaacgugaucgccagcaacuaa

SEQ ID NO: 15056 - RNA, 882 nt, Artificial Sequence
  CELA3B__Homo_sapiens__XP_011539434
augaugcugagacugcugagcagccugcugcugguggccguggccagcggcuacggcccccccagcagcagacccagcagcagaguggugaacggcgaggacgccgugcccuacagcuggcccuggcaggugagccugcaguacgagaagagcggcagcuucuaccacaccugcggcggcagccugaucgcccccgacuggguggugaccgccggccacugcaucagcagcagcagaaccuaccagguggugcugggcgaguacgacagagccgugaaggagggccccgagcaggugauccccaucaacagcggcgaccuguucgugcacccccuguggaacagaagcugcguggccugcggcaacgacaucgcccugaucaagcugagcagaagcgcccagcugggcgacgccgugcagcuggccagccugccccccgccggcgacauccugcccaacgagacccccugcuacaucaccggcuggggcagacuguacaccaacggcccccugcccgacaagcugcaggaggcccugcugcccgugguggacuacgagcacugcagcagauggaacugguggggcagcagcgugaagaagaccauggugugcgccggcggcgacaucagaagcggcugcaacggcgacagcggcggcccccugaacugccccaccgaggacggcggcuggcaggugcacggcgugaccagcuucgugagcgccuucggcugcaacaccagaagaaagcccaccguguucaccagagugagcgccuucaucgacuggaucgaggagggccugugcagaauggagaccacccuggccugccugcccggcagccagaagcugcagggcaacaaggcccccgagagcagaaccuaa

SEQ ID NO: 15057 - RNA, 1539 nt, Artificial Sequence
  CELF1__Homo_sapiens__NP_001166110
auggccgccuucaagcuggacuuccugcccgagaugaugguggaccacugcagccugaacagcagccccgugagcaagaagaugaacggcacccuggaccaccccgaccagcccgaccuggacgccaucaagauguucgugggccaggugcccagaaccuggagcgagaaggaccugagagagcuguucgagcaguacggcgccguguacgagaucaacgugcugagagacagaagccagaaccccccccagagcaagggcugcugcuucgugaccuucuacaccagaaaggccgcccuggaggcccagaacgcccugcacaacaugaaggugcugcccggcaugcaccaccccauccagaugaagcccgccgacagcgagaagaacaacguggaggacagaaagcuguucaucggcaugaucagcaagaagugcaccgagaacgacaucagagugauguucagcagcuucggccagaucgaggagugcagaauccugagaggccccgacggccugagcagaggcugcgccuucgugaccuucaccaccagagccauggcccagaccgccaucaaggccaugcaccaggcccagaccauggagggcugcagcagccccaugguggugaaguucgccgacacccagaaggacaaggagcagaagagaauggcccagcagcugcagcagcagaugcagcagaucagcgccgccagcguguggggcaaccuggccggccugaacacccugggcccccaguaccuggcccuguaccugcagcugcugcagcagaccgccagcagcggcaaccugaacacccugagcagccugcaccccaugggcggccugaacgccaugcagcugcagaaccuggccgcccuggccgccgccgccagcgccgcccagaacacccccagcggcaccaacgcccugaccaccagcagcagcccccugagcgugcugaccagcagcggcagcagccccagcagcagcagcagcaacagcgugaaccccaucgccagccugggcgcccugcagacccuggccggcgccaccgccggccugaacgugggcagccuggccggcauggccgcccugaacggcggccugggcagcagcggccugagcaacggcaccggcagcaccauggaggcccugacccaggccuacagcggcauccagcaguacgccgccgccgcccugcccacccuguacaaccagaaccugcugacccagcagagcaucggcgccgccggcagccagaaggagggccccgagggcgccaaccuguucaucuaccaccugccccaggaguucggcgaccaggaccugcugcagauguucaugcccuucggcaacguggugagcgccaagguguucaucgacaagcagaccaaccugagcaagugcuucggcuucgugagcuacgacaaccccgugagcgcccaggccgccauccagagcaugaacggcuuccagaucggcaugaagagacugaaggugcagcugaagagaagcaagaacgacagcaagcccuacuaa

SEQ ID NO: 15058 - RNA, 1473 nt, Artificial Sequence
  CELF2__Homo_sapiens__NP_001020247
augaacggcgcccuggaccacagcgaccagcccgaccccgacgccaucaagauguucgugggccagauccccagaagcuggagcgagaaggagcugaaggagcuguucgagcccuacggcgccguguaccagaucaacgugcugagagacagaagccagaaccccccccagagcaagggcugcugcuucgugaccuucuacaccagaaaggccgcccuggaggcccagaacgcccugcacaacaucaagacccugcccggcaugcaccaccccauccagaugaagcccgccgacagcgagaagagcaacgccguggaggacagaaagcuguucaucggcauggugagcaagaagugcaacgagaacgacaucagagugauguucagccccuucggccagaucgaggagugcagaauccugagaggccccgacggccugagcagaggcugcgccuucgugaccuucagcaccagagccauggcccagaacgccaucaaggccaugcaccagagccagaccauggagggcugcagcagccccaucguggugaaguucgccgacacccagaaggacaaggagcagagaagacugcagcagcagcuggcccagcagaugcagcagcugaacaccgccaccuggggcaaccugaccggccugggcggccugaccccccaguaccuggcccugcugcagcaggccaccagcagcagcaaccugggcgccuucagcggcauccagcagauggccggcaugaacgcccugcagcugcagaaccuggccacccuggccgccgccgccgccgccgcccagaccagcgccaccagcaccaacgccaacccccugagcaccaccagcagcgcccugggcgcccugaccagccccguggccgccagcacccccaacagcaccgccggcgccgccaugaacagccugaccagccugggcacccugcagggccuggccggcgccaccgugggccugaacaacaucaacgcccuggccguggcccagaugcugagcggcauggccgcccugaacggcggccugggcgccaccggccugaccaacggcaccgccggcaccauggacgcccugacccaggccuacagcggcauccagcaguacgccgccgccgcccugcccacccuguacagccagagccugcugcagcagcagagcgccgccggcagccagaaggagggccccgagggcgccaaccuguucaucuaccaccugccccaggaguucggcgaccaggacauccugcagauguucaugcccuucggcaacgugaucagcgccaagguguucaucgacaagcagaccaaccugagcaagugcuucggcuucgugagcuacgacaaccccgugagcgcccaggccgccauccaggccaugaacggcuuccagaucggcaugaagagacugaaggugcagcugaagagaagcaagaacgacagcaagcccuacuaa

SEQ ID NO: 15059 - RNA, 1458 nt, Artificial Sequence
  CELF4__Homo_sapiens__NP_001020258
auguacaucaagauggccacccuggccaacggccaggccgacaacgccagccugagcaccaacggccugggcagcagccccggcagcgccggccacaugaacggccugagccacagccccggcaaccccagcaccauccccaugaaggaccacgacgccaucaagcuguucaucggccagauccccagaaaccuggacgagaaggaccugaagccccuguucgaggaguucggcaagaucuacgagcugaccgugcugaaggacagauucaccggcaugcacaagggcugcgccuuccugaccuacugcgagagagagagcgcccugaaggcccagagcgcccugcacgagcagaagacccugcccggcaugaacagacccauccaggugaagcccgccgacagcgagagcagaggcggcagcagcugccugagacagccccccagccaggacagaaagcuguucgugggcaugcugaacaagcagcagagcgaggacgacgugagaagacuguucgaggccuucggcaacaucgaggagugcaccauccugagaggccccgacggcaacagcaagggcugcgccuucgugaaguacagcagccacgccgaggcccaggccgccaucaacgcccugcacggcagccagaccaugcccggcgccagcagcagccugguggugaaguucgccgacaccgacaaggagagaaccaugagaagaaugcagcagauggccggccagaugggcauguucaaccccauggccauccccuucggcgccuacggcgccuacgcccaggccaugcagcagcaggccgcccugauggccagcguggcccagggcggcuaccugaaccccauggccgccuucgccgccgcccagaugcagcagauggccgcccugaacaugaacggccuggccgccgcccccaugacccccaccagcggcggcagcaccccccccggcaucaccgcccccgccgugcccagcauccccagccccaucggcgugaacggcuucaccggccugcccccccaggccaacggccagcccgccgccgaggccguguucgccaacggcauccaccccuaccccgcccagagccccaccgccgccgacccccugcagcaggccuacgccggcgugcagcaguacgccggccccgccgccuaccccgccgccuacggccagaucagccaggccuucccccagcccccccccaugaucccccagcagcagagagagggccccgagggcugcaaccuguucaucuaccaccugccccaggaguucggcgacgccgagcugaugcagauguuccugcccuucggcuucgugagcuucgacaaccccgccagcgcccagaccgccauccaggccaugaacggcuuccagaucggcaugaagagacugaaggugcagcugaagagacccaaggacgccaacagacccuacuaa

SEQ ID NO: 15060 - RNA, 1230 nt, Artificial Sequence
  CELF5__Homo_sapiens__NP_001166144
auggccagacugaccgagagcgaggccagaagacagcagcagcagcugcugcagcccagacccagccccgugggcagcagcggccccgagccccccggcggccagcccgacggcaugaaggaccuggacgccaucaagcuguucgugggccagauccccagacaccuggacgagaaggaccugaagccccuguucgagcaguucggcagaaucuacgagcugaccgugcugaaggaccccuacaccggcaugcacaagggcugcgccuuccugaccuacugcgccagagacagcgccaucaaggcccagaccgcccugcacgagcagaagacccugcccggcauggccagacccauccaggugaagcccgccgacagcgagagcagaggcggcagagacagaaagcuguucgugggcaugcugaacaagcagcagagcgaggaggacgugcugagacuguuccagcccuucggcgugaucgacgagugcaccgugcugagaggccccgacggcagcagcaagggcugcgccuucgugaaguucagcagccacaccgaggcccaggccgccauccacgcccugcacggcagccagaccaugcccggcgccagcagcagccugguggugaaguucgccgacaccgacaaggagagaacccugagaagaaugcagcagauggugggccagcugggcauccugacccccagccugacccugcccuucagccccuacagcgccuacgcccaggcccugaugcagcagcagaccaccgugcugagcaccagcggcagcuaccugagccccggcguggccuucagccccugccacauccagcagaucggcgccgugagccugaacggccugcccgccacccccaucgcccccgccagcggcguggugcccuuccccggcggccaccccgcccuggagaccguguacgccaacggccuggugcccuaccccgcccagagccccaccguggccgagacccugcaccccgccuucagcggcgugcagcaguacaccgccauguaccccaccgccgccaucacccccaucgcccacagcgugccccagccccccccccugcugcagcagcagcagagagagggcguguggagacacggcgccgacgccgacgugcccacccugagacaguaccacuuccugcagggcguguacggcagcagcuaccagcccgagcagguguucagacugagagagcuguaa

SEQ ID NO: 15061 - RNA, 1365 nt, Artificial Sequence
  CELF6__Homo_sapiens__NP_001166155
auggccgccgcccccggcggcagcgcccagcccgccggccccggccccagacugggcuucagcaccgccgacagcggcgugggcaugagcggccugaaccccggccccgccgugcccaugaaggaccacgacgccaucaagcuguucgugggccagauccccagaggccuggacgagcaggaccugaagccccuguucgaggaguucggcagaaucuacgagcugaccgugcugaaggacagacugaccggccugcacaagggcugcgccuuccugaccuacugcgccagagacagcgcccugaaggcccagagcgcccugcacgagcagaagacccugcccggcaugaacagacccauccaggugaagcccgccgccagcgagggcagaggcgaggacagaaagcuguucgugggcaugcugggcaagcagcagggcgaggaggacgugagaagacuguuccagcccuucggccacaucgaggagugcaccgugcugagaagccccgacggcaccagcaagggcugcgccuucgugaaguucggcagccagggcgaggcccaggccgccaucagaggccugcacggcagcagaaccauggccggcgccagcagcagccugguggugaagcuggccgacaccgacagagagagagcccugagaagaaugcagcagauggccggccaccugggcgccuuccaccccgccccccugccccugggcgccugcggcgccuacaccaccgccauccugcagcaccaggccgcccugcuggccgccgcccagggccccggccugggccccguggccgccguggccgcccagaugcagcacguggccgccuucagccugguggccgccccccugcugcccgccgccgccgccaacagcccccccggcagcggccccggcacccugcccggccugcccgcccccaucggcgugaacggcuucggcccccugaccccccagaccaacggccagcccggcagcgacacccuguacaacaacggccugagccccuaccccgcccagagccccggcguggccgacccccugcagcaggccuacgccggcaugcaccacuacgccggccccgagggcugcaaccuguucaucuaccaccugccccaggaguucggcgacgccgagcugauccagaccuuccugcccuucggcgccguggugagcgccaagguguucguggacagagccaccaaccagagcaagugcuucggcuucgugagcuucgacaaccccaccagcgcccagaccgccauccaggccaugaacggcuuccagaucggcaugaagagacugaaggugcagcugaagagacccaaggacgccaacagacccuacuaa

SEQ ID NO: 15062 - RNA, 2271 nt, Artificial Sequence
  CEL__Homo_sapiens__NP_001798
augcugaccaugggcagacugcagcugguggugcugggccugaccugcugcugggccguggccagcgccgccaagcugggcgccguguacaccgagggcggcuucguggagggcgugaacaagaagcugggccugcugggcgacagcguggacaucuucaagggcauccccuucgccgcccccaccaaggcccuggagaacccccagccccaccccggcuggcagggcacccugaaggccaagaacuucaagaagagaugccugcaggccaccaucacccaggacagcaccuacggcgacgaggacugccuguaccugaacaucugggugccccagggcagaaagcaggugagcagagaccugcccgugaugaucuggaucuacggcggcgccuuccugaugggcagcggccacggcgccaacuuccugaacaacuaccuguacgacggcgaggagaucgccaccagaggcaacgugaucguggugaccuucaacuacagagugggcccccugggcuuccugagcaccggcgacgccaaccugcccggcaacuacggccugagagaccagcacauggccaucgccugggugaagagaaacaucgccgccuucggcggcgaccccaacaacaucacccuguucggcgagagcgccggcggcgccagcgugagccugcagacccugagccccuacaacaagggccugaucagaagagccaucagccagagcggcguggcccugagccccugggugauccagaagaacccccuguucugggccaagaagguggccgagaaggugggcugccccgugggcgacgccgccagaauggcccagugccugaaggugaccgaccccagagcccugacccuggccuacaaggugccccuggccggccuggaguaccccaugcugcacuacgugggcuucgugcccgugaucgacggcgacuucauccccgccgaccccaucaaccuguacgccaacgccgccgacaucgacuacaucgccggcaccaacaacauggacggccacaucuucgccagcaucgacaugcccgccaucaacaagggcaacaagaaggugaccgaggaggacuucuacaagcuggugagcgaguucaccaucaccaagggccugagaggcgccaagaccaccuucgacguguacaccgagagcugggcccaggaccccagccaggagaacaagaagaagaccgugguggacuucgagaccgacgugcuguuccuggugcccaccgagaucgcccuggcccagcacagagccaacgccaagagcgccaagaccuacgccuaccuguucagccaccccagcagaaugcccguguaccccaagugggugggcgccgaccacgccgacgacauccaguacguguucggcaagcccuucgccacccccaccggcuacagaccccaggacagaaccgugagcaaggccaugaucgccuacuggaccaacuucgccaagaccggcgaccccaacaugggcgacagcgccgugcccacccacugggagcccuacaccaccgagaacagcggcuaccuggagaucaccaagaagaugggcagcagcagcaugaagagaagccugagaaccaacuuccugagauacuggacccugaccuaccuggcccugcccaccgugaccgaccaggaggccacccccgugccccccaccggcgacagcgaggccacccccgugccccccaccggcgacagcgagaccgcccccgugccccccaccggcgacagcggcgccccccccgugccccccaccggcgacagcggcgccccccccgugccccccaccggcgacagcggcgccccccccgugccccccaccggcgacagcggcgccccccccgugccccccaccggcgacagcggcgccccccccgugccccccaccggcgacagcggcgccccccccgugccccccaccggcgacagcggcgccccccccgugccccccaccggcgacagcggcgccccccccgugccccccaccggcgacgccggccccccccccgugccccccaccggcgacagcggcgccccccccgugccccccaccggcgacagcggcgccccccccgugacccccaccggcgacagcgagaccgcccccgugccccccaccggcgacagcggcgccccccccgugccccccaccggcgacagcgaggccgcccccgugccccccaccgacgacagcaaggaggcccagaugcccgccgugaucagauucuaa

SEQ ID NO: 15063 - RNA, 9045 nt, Artificial Sequence
  CELSR1__Homo_sapiens__NP_055061
auggcccccccccccccccccgugcugcccgugcugcugcugcuggccgccgccgccgcccugcccgccaugggccugagagccgccgccugggagcccagagugcccggcggcaccagagccuucgcccugagacccggcugcaccuacgccgugggcgccgccugcacccccagagcccccagagagcugcuggacgugggcagagacggcagacuggccggcagaagaagagugagcggcgccggcagaccccugccccugcaggugagacugguggccagaagcgcccccaccgcccugagcagaagacugagagccagaacccaccugcccggcugcggcgccagagccagacugugcggcaccggcgccagacugugcggcgcccugugcuuccccgugcccggcggcugcgccgccgcccagcacagcgcccuggccgcccccaccacccugcccgccugcagaugcccccccagacccagacccagaugccccggcagacccaucugccugccccccggcggcagcgugagacugagacugcugugcgcccugagaagagccgccggcgccgugagagugggccuggcccuggaggccgccaccgccggcacccccagcgccagccccagccccagccccccccugccccccaaccugcccgaggccagagccggccccgccagaagagccagaagaggcaccagcggcagaggcagccugaaguuccccaugcccaacuaccagguggcccuguucgagaacgagcccgccggcacccugauccugcagcugcacgcccacuacaccaucgagggcgaggaggagagagugagcuacuacauggagggccuguucgacgagagaagcagaggcuacuucagaaucgacagcgccaccggcgccgugagcaccgacagcgugcuggacagagagaccaaggagacccacgugcugagagugaaggccguggacuacagcaccccccccagaagcgccaccaccuacaucaccgugcuggugaaggacaccaacgaccacagccccguguucgagcagagcgaguacagagagagagugagagagaaccuggaggugggcuacgaggugcugaccaucagagccagcgacagagacagccccaucaacgccaaccugagauacagagugcugggcggcgccugggacguguuccagcugaacgagagcagcggcguggugagcaccagagccgugcuggacagagaggaggccgccgaguaccagcugcugguggaggccaacgaccagggcagaaaccccggcccccugagcgccaccgccaccguguacaucgagguggaggacgagaacgacaacuacccccaguucagcgagcagaacuacguggugcaggugcccgaggacgugggccugaacaccgccgugcugagagugcaggccaccgacagagaccagggccagaacgccgccauccacuacagcauccugagcggcaacguggccggccaguucuaccugcacagccugagcggcauccuggacgugaucaacccccuggacuucgaggacgugcagaaguacagccugagcaucaaggcccaggacggcggcagacccccccugaucaacagcagcggcguggugagcgugcaggugcuggacgugaacgacaacgagcccaucuucgugagcagccccuuccaggccaccgugcuggagaacgugccccugggcuaccccguggugcacauccaggccguggacgccgacagcggcgagaacgccagacugcacuacagacugguggacaccgccagcaccuuccugggcggcggcagcgccggccccaagaaccccgcccccacccccgacuuccccuuccagauccacaacagcagcggcuggaucaccgugugcgccgagcuggacagagaggagguggagcacuacagcuucggcguggaggccguggaccacggcagcccccccaugagcagcagcaccagcgugagcaucaccgugcuggacgugaacgacaacgaccccguguucacccagcccaccuacgagcugagacugaacgaggacgccgccgugggcagcagcgugcugacccugcaggccagagacagagacgccaacagcgugaucaccuaccagcugaccggcggcaacaccagaaacagauucgcccugagcagccagagaggcggcggccugaucacccuggcccugccccuggacuacaagcaggagcagcaguacgugcuggccgugaccgccagcgacggcaccagaagccacaccgcccacgugcugaucaacgugaccgacgccaacacccacagacccguguuccagagcagccacuacaccgugagcgugagcgaggacagacccgugggcaccagcaucgccacccugagcgccaacgacgaggacaccggcgagaacgccagaaucaccuacgugauccaggaccccgugccccaguucagaaucgaccccgacagcggcaccauguacaccaugauggagcuggacuacgagaaccagguggccuacacccugaccaucauggcccaggacaacggcaucccccagaagagcgacaccaccacccuggagauccugauccuggacgccaacgacaacgccccccaguuccugugggacuucuaccagggcagcaucuucgaggacgccccccccagcaccagcauccugcaggugagcgccaccgacagagacagcggccccaacggcagacugcuguacaccuuccagggcggcgacgacggcgacggcgacuucuacaucgagcccaccagcggcgugaucagaacccagagaagacuggacagagagaacguggccguguacaaccugugggcccuggccguggacagaggcagccccaccccccugagcgccagcguggagauccaggugaccauccuggacaucaacgacaacgcccccauguucgagaaggacgagcuggagcuguucguggaggagaacaaccccgugggcagcgugguggccaagaucagagccaacgaccccgacgagggccccaacgcccagaucauguaccagaucguggagggcgacaugagacacuucuuccagcuggaccugcugaacggcgaccugagagccaugguggagcuggacuucgaggugagaagagaguacgugcugguggugcaggccaccagcgccccccuggugagcagagccaccgugcacauccugcugguggaccagaacgacaacccccccgugcugcccgacuuccagauccuguucaacaacuacgugaccaacaagagcaacagcuuccccaccggcgugaucggcugcauccccgcccacgaccccgacgugagcgacagccugaacuacaccuucgugcagggcaacgagcugagacugcugcugcuggaccccgccaccggcgagcugcagcugagcagagaccuggacaacaacagaccccuggaggcccugauggaggugagcgugagcgacggcauccacagcgugaccgccuucugcacccugagagugaccaucaucaccgacgacaugcugaccaacagcaucaccgugagacuggagaacaugagccaggagaaguuccugagcccccugcuggcccuguucguggagggcguggccgccgugcugagcaccaccaaggacgacguguucguguucaacgugcagaacgacaccgacgugagcagcaacauccugaacgugaccuucagcgcccugcugcccggcggcgugagaggccaguucuuccccagcgaggaccugcaggagcagaucuaccugaacagaacccugcugaccaccaucagcacccagagagugcugcccuucgacgacaacaucugccugagagagcccugcgagaacuacaugaagugcgugagcgugcugagauucgacagcagcgcccccuuccugagcagcaccaccgugcuguucagacccauccaccccaucaacggccugagaugcagaugcccccccggcuucaccggcgacuacugcgagaccgagaucgaccugugcuacagcgaccccugcggcgccaacggcagaugcagaagcagagagggcggcuacaccugcgagugcuucgaggacuucaccggcgagcacugcgagguggacgccagaagcggcagaugcgccaacggcgugugcaagaacggcggcaccugcgugaaccugcugaucggcggcuuccacugcgugugcccccccggcgaguacgagagacccuacugcgaggugaccaccagaagcuuccccccccagagcuucgugaccuucagaggccugagacagagauuccacuucaccaucagccugaccuucgccacccaggagagaaacggccugcugcuguacaacggcagauucaacgagaagcacgacuucaucgcccuggagaucguggacgagcaggugcagcugaccuucagcgccggcgagaccaccaccaccguggcccccaaggugcccagcggcgugagcgacggcagauggcacagcgugcaggugcaguacuacaacaagcccaacaucggccaccugggccugccccacggccccagcggcgagaagauggccguggugaccguggacgacugcgacaccaccauggccgugagauucggcaaggacaucggcaacuacagcugcgccgcccagggcacccagaccggcagcaagaagagccuggaccugaccggcccccugcugcugggcggcgugcccaaccugcccgaggacuuccccgugcacaacagacaguucgugggcugcaugagaaaccugagcguggacggcaagaacguggacauggccggcuucaucgccaacaacggcaccagagagggcugcgccgccagaagaaacuucugcgacggcagaagaugccagaacggcggcaccugcgugaacagauggaacauguaccugugcgagugcccccugagauucggcggcaagaacugcgagcaggccaugccccacccccagcuguucagcggcgagagcguggugagcuggagcgaccugaacaucaucaucagcgugcccugguaccugggccugauguucagaaccagaaaggaggacagcgugcugauggaggccaccagcggcggccccaccagcuucagacugcagauccugaacaacuaccugcaguucgaggugagccacggccccagcgacguggagagcgugaugcugagcggccugagagugaccgacggcgaguggcaccaccugcugaucgagcugaagaacgugaaggaggacagcgagaugaagcaccuggugaccaugacccuggacuacggcauggaccagaacaaggccgacaucggcggcaugcugcccggccugaccgugagaagcgugguggugggcggcgccagcgaggacaaggugagcgugagaagaggcuucagaggcugcaugcagggcgugagaaugggcggcacccccaccaacguggccacccugaacaugaacaacgcccugaaggugagagugaaggacggcugcgacguggacgaccccugcaccagcagccccugcccccccaacagcagaugccacgacgccugggaggacuacagcugcgugugcgacaagggcuaccugggcaucaacugcguggacgccugccaccugaaccccugcgagaacaugggcgccugcgugagaagccccggcagcccccagggcuacgugugcgagugcggccccagccacuacggccccuacugcgagaacaagcuggaccugcccugccccagaggcugguggggcaaccccgugugcggccccugccacugcgccgugagcaagggcuucgaccccgacugcaacaagaccaacggccagugccagugcaaggagaacuacuacaagcugcuggcccaggacaccugccugcccugcgacugcuucccccacggcagccacagcagaaccugcgacauggccaccggccagugcgccugcaagcccggcgugaucggcagacagugcaacagaugcgacaaccccuucgccgaggugaccacccugggcugcgaggugaucuacaacggcugccccaaggccuucgaggccggcaucugguggccccagaccaaguucggccagcccgccgccgugcccugccccaagggcagcgugggcaacgccgugagacacugcagcggcgagaagggcuggcugccccccgagcuguucaacugcaccaccaucagcuucguggaccugagagccaugaacgagaagcugagcagaaacgagacccagguggacggcgccagagcccugcagcuggugagagcccugagaagcgccacccagcacaccggcacccuguucggcaacgacgugagaaccgccuaccagcugcugggccacgugcugcagcacgagagcuggcagcagggcuucgaccuggccgccacccaggacgccgacuuccacgaggacgugauccacagcggcagcgcccugcuggcccccgccaccagagccgccugggagcagauccagagaagcgagggcggcaccgcccagcugcugagaagacuggagggcuacuucagcaacguggccagaaacgugagaagaaccuaccugagacccuucgugaucgugaccgccaacaugauccuggccguggacaucuucgacaaguucaacuucaccggcgccagagugcccagauucgacaccauccacgaggaguuccccagagagcuggagagcagcgugagcuuccccgccgacuucuucagaccccccgaggagaaggagggcccccugcugagacccgccggcagaagaaccaccccccagaccaccagacccggccccggcaccgagagagaggcccccaucagcagaagaagaagacaccccgacgacgccggccaguucgccguggcccuggugaucaucuacagaacccugggccagcugcugcccgagagauacgaccccgacagaagaagccugagacugccccacagacccaucaucaacacccccauggugagcacccugguguacagcgagggcgccccccugcccagaccccuggagagacccgugcugguggaguucgcccugcuggagguggaggagagaaccaagcccgugugcguguucuggaaccacagccuggccgugggcggcaccggcggcuggagcgccagaggcugcgagcugcugagcagaaacagaacccacguggccugccagugcagccacaccgccagcuucgccgugcugauggacaucagcagaagagagaacggcgaggugcugccccugaagaucgugaccuacgccgccgugagccugagccuggccgcccugcugguggccuucgugcugcugagccuggugagaaugcugagaagcaaccugcacagcauccacaagcaccuggccguggcccuguuccugagccagcugguguucgugaucggcaucaaccagaccgagaaccccuuccugugcaccgugguggccauccugcugcacuacaucuacaugagcaccuucgccuggacccugguggagagccugcacguguacagaaugcugaccgaggugagaaacaucgacaccggccccaugagauucuacuacguggugggcuggggcauccccgccaucgugaccggccuggccgugggccuggacccccagggcuacggcaaccccgacuucugcuggcugagccugcaggacacccugaucuggagcuucgccggccccaucggcgccgugaucaucaucaacaccgugaccagcgugcugagcgccaaggugagcugccagagaaagcaccacuacuacggcaagaagggcaucgugagccugcugagaaccgccuuccugcugcugcugcugaucagcgccaccuggcugcugggccugcuggccgugaacagagacgcccugagcuuccacuaccuguucgccaucuucagcggccugcagggccccuucgugcugcuguuccacugcgugcugaaccaggaggugagaaagcaccugaagggcgugcugggcggcagaaagcugcaccuggaggacagcgccaccaccagagccacccugcugaccagaagccugaacugcaacaccaccuucggcgacggccccgacaugcugagaaccgaccugggcgagagcaccgccagccuggacagcaucgugagagacgagggcauccagaagcugggcgugagcagcggccuggugagaggcagccacggcgagcccgacgccagccugaugcccagaagcugcaaggacccccccggccacgacagcgacagcgacagcgagcugagccuggacgagcagagcagcagcuacgccagcagccacagcagcgacagcgaggacgacggcgugggcgccgaggagaagugggaccccgccagaggcgccgugcacagcacccccaagggcgacgccguggccaaccacgugcccgccggcuggcccgaccagagccuggccgagagcgacagcgaggaccccagcggcaagcccagacugaagguggagaccaaggugagcguggagcugcacagagaggagcagggcagccacagaggcgaguacccccccgaccaggagagcggcggcgccgccagacuggccagcagccagccccccgagcagagaaagggcauccugaagaacaaggugaccuacccccccccccugacccugaccgagcagacccugaagggcagacugagagagaagcuggccgacugcgagcagagccccaccagcagcagaaccagcagccugggcagcggcggccccgacugcgccaucaccgugaagagccccggcagagagcccggcagagaccaccugaacggcguggccaugaacgugagaaccggcagcgcccaggccgacggcagcgacagcgagaagcccuaa

SEQ ID NO: 15064 - RNA, 9939 nt, Artificial Sequence
  CELSR3__Homo_sapiens__NP_001398
augauggccagaagaccccccuggagaggccugggcggcagaagcacccccauccugcugcugcugcugcugagccuguucccccugagccaggaggagcugggcggcggcggccaccagggcugggaccccggccuggccgccaccaccggccccagagcccacaucggcggcggcgcccuggcccugugccccgagagcagcggcgugagagaggacggcggccccggccugggcgugagagagcccaucuucgugggccugagaggcagaagacagagcgccagaaacagcagaggcccccccgagcagcccaacgaggagcugggcaucgagcacggcgugcagccccugggcagcagagagagagagaccggccagggccccggcagcgugcuguacuggagacccgaggugagcagcugcggcagaaccggcccccugcagagaggcagccugagccccggcgcccugagcagcggcgugcccggcagcggcaacagcagcccccugcccagcgacuuccugaucagacaccacggccccaagcccgugagcagccagagaaacgccggcaccggcagcagaaagagagugggcaccgccagaugcugcggcgagcugugggccaccggcagcaagggccagggcgagagagccaccaccagcggcgccgagagaaccgcccccagaagaaacugccugcccggcgccagcggcagcggccccgagcuggacagcgcccccagaaccgccagaaccgcccccgccagcggcagcgcccccagagagagcagaaccgcccccgagcccgcccccaagagaaugagaagcagaggccuguucagaugcagauuccugccccagagacccggccccagaccccccggccugcccgccagacccgaggccagaaaggugaccagcgccaacagagccagauucagaagagccgccaacagacacccccaguucccccaguacaacuaccagacccuggugcccgagaacgaggccgccggcaccgccgugcugagagugguggcccaggaccccgacgccggcgaggccggcagacugguguacagccuggccgcccugaugaacagcagaagccuggagcuguucagcaucgacccccagagcggccugaucagaaccgccgccgcccuggacagagagagcauggagagacacuaccugagagugaccgcccaggaccacggcagccccagacugagcgccaccaccaugguggccgugaccguggccgacagaaacgaccacagccccguguucgagcaggcccaguacagagagacccugagagagaacguggaggagggcuaccccauccugcagcugagagccaccgacggcgacgccccccccaacgccaaccugagauacagauucgugggcccccccgccgccagagccgccgccgccgccgccuucgagaucgaccccagaagcggccugaucagcaccagcggcagaguggacagagagcacauggagagcuacgagcuggugguggaggccagcgaccagggccaggagcccggccccagaagcgccaccgugagagugcacaucaccgugcuggacgagaacgacaacgccccccaguucagcgagaagagauacguggcccaggugagagaggacgugagaccccacaccguggugcugagagugaccgccaccgacagagacaaggacgccaacggccuggugcacuacaacaucaucagcggcaacagcagaggccacuucgccaucgacagccugaccggcgagauccaggugguggccccccuggacuucgaggccgagagagaguacgcccugagaaucagagcccaggacgccggcagacccccccugagcaacaacaccggccuggccagcauccaggugguggacaucaacgaccacauccccaucuucgugagcacccccuuccaggugagcgugcuggagaacgccccccugggccacagcgugauccacauccaggccguggacgccgaccacggcgagaacgccagacuggaguacagccugaccggcguggcccccgacacccccuucgugaucaacagcgccaccggcugggugagcgugagcggcccccuggacagagagagcguggagcacuacuucuucggcguggaggccagagaccacggcagccccccccugagcgccagcgccagcgugaccgugaccgugcuggacgugaacgacaacagacccgaguucaccaugaaggaguaccaccugagacugaacgaggacgccgccgugggcaccagcguggugagcgugaccgccguggacagagacgccaacagcgccaucagcuaccagaucaccggcggcaacaccagaaacagauucgccaucagcacccagggcggcgugggccuggugacccuggcccugccccuggacuacaagcaggagagauacuucaagcuggugcugaccgccagcgacagagcccugcacgaccacugcuacgugcacaucaacaucaccgacgccaacacccacagacccguguuccagagcgcccacuacagcgugagcgugaacgaggacagacccaugggcagcaccaucguggugaucagcgccagcgacgacgacgugggcgagaacgccagaaucaccuaccugcuggaggacaaccugccccaguucagaaucgacgccgacagcggcgccaucacccugcaggccccccuggacuacgaggaccaggugaccuacacccuggccaucaccgccagagacaacggcaucccccagaaggccgacaccaccuacguggaggugauggugaacgacgugaacgacaacgccccccaguucguggccagccacuacaccggccuggugagcgaggacgccccccccuucaccagcgugcugcagaucagcgccaccgacagagacgcccacgccaacggcagagugcaguacaccuuccagaacggcgaggacggcgacggcgacuucaccaucgagcccaccagcggcaucgugagaaccgugagaagacuggacagagaggccgugagcguguacgagcugaccgccuacgccguggacagaggcgugcccccccugagaacccccgugagcauccaggugauggugcaggacgugaacgacaacgcccccguguuccccgccgaggaguucgaggugagagugaaggagaacagcaucgugggcagcgugguggcccagaucaccgccguggaccccgacgagggccccaacgcccacaucauguaccagaucguggagggcaacauccccgagcuguuccagauggacaucuucagcggcgagcugaccgcccugaucgaccuggacuacgaggccagacaggaguacgugaucguggugcaggccaccagcgccccccuggugagcagagccaccgugcacgugagacugguggaccagaacgacaacagccccgugcugaacaacuuccagauccuguucaacaacuacgugagcaacagaagcgacaccuuccccagcggcaucaucggcagaauccccgccuacgaccccgacgugagcgaccaccuguucuacagcuucgagagaggcaacgagcugcagcugcugguggugaaccagaccagcggcgagcugagacugagcagaaagcuggacaacaacagaccccugguggccagcaugcuggugaccgugaccgacggccugcacagcgugaccgcccagugcgugcugagaguggugaucaucaccgaggagcugcuggccaacagccugaccgugagacuggagaacauguggcaggagagauuccugagcccccugcugggcagauuccuggagggcguggccgccgugcuggccacccccgccgaggacguguucaucuucaacauccagaacgacaccgacgugggcggcaccgugcugaacgugagcuucagcgcccuggcccccagaggcgccggcgccggcgccgccggccccugguucagcagcgaggagcugcaggagcagcuguacgugagaagagccgcccuggccgccagaagccugcuggacgugcugcccuucgacgacaacgugugccugagagagcccugcgagaacuacaugaagugcgugagcgugcugagauucgacagcagcgcccccuuccuggccagcgccagcacccuguucagacccauccagcccaucgccggccugagaugcagaugcccccccggcuucaccggcgacuucugcgagaccgagcuggaccugugcuacagcaaccccugcagaaacggcggcgccugcgccagaagagagggcggcuacaccugcgugugcagacccagauucaccggcgaggacugcgagcuggacaccgaggccggcagaugcgugcccggcgugugcagaaacggcggcaccugcaccgacgcccccaacggcggcuucagaugccagugccccgccggcggcgccuucgagggccccagaugcgagguggccgccagaagcuucccccccagcagcuucgugauguucagaggccugagacagagauuccaccugacccugagccugagcuucgccaccgugcagcagagcggccugcuguucuacaacggcagacugaacgagaagcacgacuuccuggcccuggagcugguggccggccaggugagacugaccuacagcaccggcgagagcaacaccguggugagccccaccgugcccggcggccugagcgacggccaguggcacaccgugcaccugagauacuacaacaagcccagaaccgacgcccugggcggcgcccagggccccagcaaggacaagguggccgugcugagcguggacgacugcgacguggccguggcccugcaguucggcgccgagaucggcaacuacagcugcgccgccgccggcgugcagaccagcagcaagaagagccuggaccugaccggcccccugcugcugggcggcgugcccaaccugcccgagaacuuccccgugagccacaaggacuucaucggcugcaugagagaccugcacaucgacggcagaagaguggacauggccgccuucguggccaacaacggcaccauggccggcugccaggccaagcugcacuucugcgacagcggccccugcaagaacagcggcuucugcagcgagagauggggcagcuucagcugcgacugccccgugggcuucggcggcaaggacugccagcugaccauggcccacccccaccacuucagaggcaacggcacccugagcuggaacuucggcagcgacauggccgugagcgugcccugguaccugggccuggccuucagaaccagagccacccagggcgugcugaugcaggugcaggccggcccccacagcacccugcugugccagcuggacagaggccugcugagcgugaccgugaccagaggcagcggcagagccagccaccugcugcuggaccaggugaccgugagcgacggcagauggcacgaccugagacuggagcugcaggaggagcccggcggcagaagaggccaccacgugcugauggugagccuggacuucagccuguuccaggacaccauggccgugggcagcgagcugcagggccugaaggugaagcagcugcacgugggcggccugccccccggcagcgccgaggaggccccccagggccuggugggcugcauccagggcguguggcugggcagcacccccagcggcagccccgcccugcugccccccagccacagagugaacgccgagcccggcugcguggugaccaacgccugcgccagcggccccugccccccccacgccgacugcagagaccuguggcagaccuucagcugcaccugccagcccggcuacuacggccccggcugcguggacgccugccugcugaaccccugccagaaccagggcagcugcagacaccugcccggcgccccccacggcuacaccugcgacugcgugggcggcuacuucggccaccacugcgagcacagaauggaccagcagugccccagaggcugguggggcagccccaccugcggccccugcaacugcgacgugcacaagggcuucgaccccaacugcaacaagaccaacggccagugccacugcaaggaguuccacuacagacccagaggcagcgacagcugccugcccugcgacugcuaccccgugggcagcaccagcagaagcugcgccccccacagcggccagugccccugcagacccggcgcccugggcagacagugcaacagcugcgacagccccuucgccgaggugaccgccagcggcugcagagugcuguacgacgccugccccaagagccugagaagcggcgugugguggccccagaccaaguucggcgugcuggccaccgugcccugccccagaggcgcccugggcgccgccgugagacugugcgacgaggcccagggcuggcuggagcccgaccuguucaacugcaccagccccgccuucagagagcugagccugcugcuggacggccuggagcugaacaagaccgcccuggacaccauggaggccaagaagcuggcccagagacugagagaggugaccggccacaccgaccacuacuucagccaggacgugagagugaccgccagacugcuggcccaccugcuggccuucgagagccaccagcagggcuucggccugaccgccacccaggacgcccacuucaacgagaaccugcugugggccggcagcgcccugcuggcccccgagaccggcgaccugugggccgcccugggccagagagcccccggcggcagccccggcagcgccggccuggugagacaccuggaggaguacgccgccacccuggccagaaacauggagcugaccuaccugaaccccaugggccuggugacccccaacaucaugcugagcaucgacagaauggagcaccccagcagccccagaggcgccagaagauaccccagauaccacagcaaccuguucagaggccaggacgccugggacccccacacccacgugcugcugcccagccagagccccagacccagccccagcgaggugcugcccaccagcagcagcaucgagaacagcaccaccagcagcguggugcccccccccgccccccccgagcccgagcccggcaucagcaucaucauccugcugguguacagaacccugggcggccugcugcccgcccaguuccaggccgagagaagaggcgccagacugccccagaaccccgugaugaacagccccguggugagcguggccguguuccacggcagaaacuuccugagaggcauccuggagagccccaucagccuggaguucagacugcugcagaccgccaacagaagcaaggccaucugcgugcagugggacccccccggccuggccgagcagcacggcguguggaccgccagagacugcgagcuggugcacagaaacggcagccacgccagaugcagaugcagcagaaccggcaccuucggcgugcugauggacgccagccccagagagagacuggagggcgaccuggagcugcuggccguguucacccacguggugguggccgugagcguggccgcccuggugcugaccgccgccauccugcugagccugagaagccugaagagcaacgugagaggcauccacgccaacguggccgccgcccugggcguggccgagcugcuguuccugcugggcauccacagaacccacaaccagcuggugugcaccgccguggccauccugcugcacuacuucuuccugagcaccuucgccuggcuguucgugcagggccugcaccuguacagaaugcagguggagcccagaaacguggacagaggcgccaugagauucuaccacgcccugggcuggggcgugcccgccgugcugcugggccuggccgugggccuggaccccgagggcuacggcaaccccgacuucugcuggaucagcgugcacgagccccugaucuggagcuucgccggccccguggugcuggugaucgugaugaacggcaccauguuccugcuggccgccagaaccagcugcagcaccggccagagagaggccaagaagaccagcgcccugacccugagaagcagcuuccugcugcugcugcuggugagcgccagcuggcuguucggccugcuggccgugaaccacagcauccuggccuuccacuaccugcacgccggccugugcggccugcagggccuggccgugcugcugcuguucugcgugcugaacgccgacgccagagccgccuggaugcccgccugccugggcagaaaggccgcccccgaggaggccagacccgcccccggccugggccccggcgccuacaacaacaccgcccuguucgaggagagcggccugaucagaaucacccugggcgccagcaccgugagcagcgugagcagcgccagaagcggcagaacccaggaccaggacagccagagaggcagaagcuaccugagagacaacgugcuggugagacacggcagcgccgccgaccacaccgaccacagccugcaggcccacgccggccccaccgaccuggacguggccauguuccacagagacgccggcgccgacagcgacagcgacagcgaccugagccuggaggaggagagaagccugagcauccccagcagcgagagcgaggacaacggcagaaccagaggcagauuccagagaccccugugcagagccgcccagagcgagagacugcugacccaccccaaggacguggacggcaacgaccugcugagcuacuggcccgcccugggcgagugcgaggccgcccccugcgcccugcagaccuggggcagcgagagaagacugggccuggacaccagcaaggacgccgccaacaacaaccagcccgaccccgcccugaccagcggcgacgagaccagccugggcagagcccagagacagagaaagggcauccugaagaacagacugcaguacccccuggugccccagaccagaggcgcccccgagcugagcuggugcagagccgccacccugggccacagagccgugcccgccgccagcuacggcagaaucuacgccggcggcggcaccggcagccugagccagcccgccagcagauacagcagcagagagcagcuggaccugcugcugagaagacagcugagcagagagagacuggaggaggcccccgcccccgugcugagaccccugagcagacccggcagccaggagugcauggacgccgcccccggcagacuggagcccaaggacagaggcagcacccugcccagaagacagccccccagagacuaccccggcgccauggccggcagauucggcagcagagacgcccuggaccugggcgcccccagagaguggcugagcacccugcccccccccagaagaaccagagaccuggacccccagccccccccccugccccugagcccccagagacagcugagcagagacccccugcugcccagcagaccccuggacagccugagcagaagcagcaacagcagagagcagcuggaccaggugcccagcagacaccccagcagagaggcccugggcccccugccccagcugcugagagccagagaggacagcgugagcggccccagccacggccccagcaccgagcagcuggacauccugagcagcauccuggccagcuucaacagcagcgcccugagcagcgugcagagcagcagcaccccccugggcccccacaccaccgccacccccagcgccaccgccagcgugcugggccccagcacccccagaagcgccaccagccacagcaucagcgagcugagccccgacagcgaggugcccagaagcgagggccacagcuaa

SEQ ID NO: 15065 - RNA, 4086 nt, Artificial Sequence
  CEMIP__Homo_sapiens__NP_001280227
augggcgccgccggcagacaggacuuccuguucaaggccaugcugaccaucagcuggcugacccugaccugcuuccccggcgccaccagcaccguggccgccggcugccccgaccagagccccgagcugcagcccuggaaccccggccacgaccaggaccaccacgugcacaucggccagggcaagacccugcugcugaccagcagcgccaccguguacagcauccacaucagcgagggcggcaagcuggugaucaaggaccacgacgagcccaucgugcugagaaccagacacauccugaucgacaacggcggcgagcugcacgccggcagcgcccugugccccuuccagggcaacuucaccaucauccuguacggcagagccgacgagggcauccagcccgaccccuacuacggccugaaguacaucggcgugggcaagggcggcgcccuggagcugcacggccagaagaagcugagcuggaccuuccugaacaagacccugcaccccggcggcauggccgagggcggcuacuucuucgagagaagcuggggccacagaggcgugaucgugcacgugaucgaccccaagagcggcaccgugauccacagcgacagauucgacaccuacagaagcaagaaggagagcgagagacuggugcaguaccugaacgccgugcccgacggcagaauccugagcguggccgugaacgacgagggcagcagaaaccuggacgacauggccagaaaggccaugaccaagcugggcagcaagcacuuccugcaccugggcuucagacaccccuggagcuuccugaccgugaagggcaaccccagcagcagcguggaggaccacaucgaguaccacggccacagaggcagcgccgccgccagaguguucaagcuguuccagaccgagcacggcgaguacuucaacgugagccugagcagcgagugggugcaggacguggaguggaccgagugguucgaccacgacaaggugagccagaccaagggcggcgagaagaucagcgaccuguggaaggcccaccccggcaagaucugcaacagacccaucgacauccaggccaccaccauggacggcgugaaccugagcaccgaggugguguacaagaagggccaggacuacagauucgccugcuacgacagaggcagagccugcagaagcuacagagugagauuccugugcggcaagcccgugagacccaagcugaccgugaccaucgacaccaacgugaacagcaccauccugaaccuggaggacaacgugcagagcuggaagcccggcgacacccuggugaucgccagcaccgacuacagcauguaccaggccgaggaguuccaggugcugcccugcagaagcugcgcccccaaccaggugaagguggccggcaagcccauguaccugcacaucggcgaggagaucgacggcguggacaugagagccgaggugggccugcugagcagaaacaucaucgugaugggcgagauggaggacaagugcuaccccuacagaaaccacaucugcaacuucuucgacuucgacaccuucggcggccacaucaaguucgcccugggcuucaaggccgcccaccuggagggcaccgagcugaagcacaugggccagcagcuggugggccaguaccccauccacuuccaccuggccggcgacguggacgagagaggcggcuacgacccccccaccuacaucagagaccugagcauccaccacaccuucagcagaugcgugaccgugcacggcagcaacggccugcugaucaaggacguggugggcuacaacagccugggccacugcuucuucaccgaggacggccccgaggagagaaacaccuucgaccacugccugggccugcuggugaagagcggcacccugcugcccagcgacagagacagcaagaugugcaagaugaucaccgaggacagcuaccccggcuacauccccaagcccagacaggacugcaacgccgugagcaccuucuggauggccaaccccaacaacaaccugaucaacugcgccgccgccggcagcgaggagaccggcuucugguucaucuuccaccacgugcccaccggccccagcgugggcauguacagccccggcuacagcgagcacaucccccugggcaaguucuacaacaacagagcccacagcaacuacagagccggcaugaucaucgacaacggcgugaagaccaccgaggccagcgccaaggacaagagacccuuccugagcaucaucagcgccagauacagcccccaccaggacgccgacccccugaagcccagagagcccgccaucaucagacacuucaucgccuacaagaaccaggaccacggcgccuggcugagaggcggcgacguguggcuggacagcugcagauucgccgacaacggcaucggccugacccuggccagcggcggcaccuuccccuacgacgacggcagcaagcaggagaucaagaacagccuguucgugggcgagagcggcaacgugggcaccgagaugauggacaacagaaucuggggccccggcggccuggaccacagcggcagaacccugcccaucggccagaacuuccccaucagaggcauccagcuguacgacggccccaucaacauccagaacugcaccuucagaaaguucguggcccuggagggcagacacaccagcgcccuggccuucagacugaacaacgccuggcagagcugcccccacaacaacgugaccggcaucgccuucgaggacgugcccaucaccagcagaguguucuucggcgagcccggccccugguucaaccagcuggacauggacggcgacaagaccagcguguuccacgacguggacggcagcgugagcgaguaccccggcagcuaccugaccaagaacgacaacuggcuggugagacaccccgacugcaucaacgugcccgacuggagaggcgccaucugcagcggcugcuacgcccagauguacauccaggccuacaagaccagcaaccugagaaugaagaucaucaagaacgacuuccccagccacccccuguaccuggagggcgcccugaccagaagcacccacuaccagcaguaccagcccguggugacccugcagaagggcuacaccauccacugggaccagaccgcccccgccgagcuggccaucuggcugaucaacuucaacaagggcgacuggaucagagugggccugugcuaccccagaggcaccaccuucagcauccugagcgacgugcacaacagacugcugaagcagaccagcaagaccggcguguucgugagaacccugcagauggacaagguggagcagagcuaccccggcagaagccacuacuacugggacgaggacagcggccugcuguuccugaagcugaaggcccagaacgagagagagaaguucgccuucugcagcaugaagggcugcgagagaaucaagaucaaggcccugauccccaagaacgccggcgugagcgacugcaccgccaccgccuaccccaaguucaccgagagagccgugguggacgugcccaugcccaagaagcuguucggcagccagcugaagaccaaggaccacuuccuggaggugaagauggagagcagcaagcagcacuucuuccaccuguggaacgacuucgccuacaucgagguggacggcaagaaguaccccagcagcgaggacggcauccaggugguggugaucgacggcaaccagggcagaguggugagccacaccagcuucagaaacagcauccugcagggcauccccuggcagcuguucaacuacguggccaccauccccgacaacagcaucgugcugauggccagcaagggcagauacgugagcagaggccccuggaccagagugcuggagaagcugggcgccgacagaggccugaagcugaaggagcagauggccuucgugggcuucaagggcagcuucagacccaucugggugacccuggacaccgaggaccacaaggccaagaucuuccagguggugcccauccccguggugaagaagaagaagcuguaa

SEQ ID NO: 15066 - RNA, 744 nt, Artificial Sequence
  CEMP1__Homo_sapiens__NP_001041677
augggcaccagcagcaccgacagccagcaggccggccacagaagaugcagcaccagcaacaccagcgccgagaaccugaccugccugagccugcccggcagccccggcaagaccgccccccugcccggccccgcccaggccggcgccggccagccccugcccaagggcugcgccgccgugaaggccgaggugggcauccccgccccccacaccagccaggaggugagaauccacaucagaagacugcugagcugggccgcccccggcgccugcggccugagaagcacccccugcgcccugccccaggcccugccccaggccagacccugccccggcagaugguucuuccccggcugcagccugcccaccggcggcgcccagaccauccugagccuguggaccuggagacacuuccugaacugggcccugcagcagagagaggagaacagcggcagagccagaagagugccccccgugcccagaaccgcccccgugagcaagggcgagggcagccaccccccccagaacagcaacggcgagaaggugaagaccaucacccccgacgugggccugcaccagagccugaccagcgaccccaccguggccgugcugagagccaagagagcccccgaggcccacccccccagaagcugcagcggcagccugaccgccagagugugccacaugggcgugugccagggccagggcgacaccgaggacggcagaaugacccugaugggcuaa

SEQ ID NO: 15067 - RNA, 450 nt, Artificial Sequence
  CEND1__Homo_sapiens__NP_057648
auggagagcagaggcaagagcgccagcagccccaagcccgacaccaaggugccccaggugaccaccgaggccaaggugccccccgccgccgacggcaaggccccccugaccaagcccagcaagaaggaggcccccgccgagaagcagcagccccccgccgcccccaccaccgcccccgccaagaagaccagcgccaaggccgaccccgcccugcugaacaaccacagcaaccugaagcccgcccccaccgugcccagcagccccgacgccacccccgagcccaagggccccggcgacggcgccgaggaggacgaggccgccagcggcggccccggcggcagaggccccuggagcugcgagaacuucaacccccugcugguggccggcggcguggccguggccgccaucgcccugauccugggcguggccuuccuggugagaaagaaguaa

SEQ ID NO: 15068 - RNA, 345 nt, Artificial Sequence
  CENPA__Homo_sapiens__NP_001035891
augggccccagaagaagaagcagaaagcccgaggcccccagaagaagaagccccagccccacccccacccccggccccagcagaagaggccccagccugggcgccagcagccaccagcacagcagaagaagacagggcuggcugaaggagaucagaaagcugcagaagagcacccaccugcugaucagaaagcugcccuucagcagacuggccgccgaggccuuccuggugcaccuguucgaggacgccuaccugcugacccugcacgccggcagagugacccuguuccccaaggacgugcagcuggccagaagaaucagaggccuggaggagggccugggcuaa

SEQ ID NO: 15069 - RNA, 1800 nt, Artificial Sequence
  CENPB__Homo_sapiens__NP_001801
augggccccaagagaagacagcugaccuucagagagaagagcagaaucauccaggagguggaggagaaccccgaccugagaaagggcgagaucgccagaagauucaacaucccccccagcacccugagcaccauccugaagaacaagagagccauccuggccagcgagagaaaguacggcguggccagcaccugcagaaagaccaacaagcugagccccuacgacaagcuggagggccugcugaucgccugguuccagcagaucagagccgccggccugcccgugaagggcaucauccugaaggagaaggcccugagaaucgccgaggagcugggcauggacgacuucaccgccagcaacggcuggcuggacagauucagaagaagacacggcguggugagcugcagcggcguggccagagccagagccagaaacgccgcccccagaacccccgccgcccccgccagccccgccgccgugcccagcgagggcagcggcggcagcaccaccggcuggagagccagagaggagcagccccccagcguggccgagggcuacgccagccaggacguguucagcgccaccgagaccagccugugguacgacuuccugcccgaccaggccgccggccugugcggcggcgacggcagacccagacaggccacccagagacugagcgugcugcugugcgccaacgccgacggcagcgagaagcugcccccccugguggccggcaagagcgccaagcccagagccggccaggccggccugcccugcgacuacaccgccaacagcaagggcggcgugaccacccaggcccuggccaaguaccugaaggcccuggacaccagaauggccgccgagagcagaagagugcugcugcuggccggcagacuggccgcccagagccuggacaccagcggccugagacacgugcagcuggccuucuucccccccggcaccgugcacccccuggagagaggcguggugcagcaggugaagggccacuacagacaggccaugcugcugaaggccauggccgcccuggagggccaggaccccagcggccugcagcugggccugaccgaggcccugcacuucguggccgccgccuggcaggccguggagcccagcgacaucgccgccugcuucagagaggccggcuucggcggcggccccaacgccaccaucaccaccagccugaagagcgagggcgaggaggaggaggaggaggaggaggaggaggaggaggaggagggcgagggcgaggaggaggaggaggagggcgaggaggaggaggaggagggcggcgagggcgaggagcugggcgaggaggaggagguggaggaggagggcgacguggacagcgacgaggaggaggaggaggacgaggagagcagcagcgagggccuggaggccgaggacugggcccagggcgugguggaggccggcggcagcuucggcgccuacggcgcccaggaggaggcccagugccccacccugcacuuccuggagggcggcgaggacagcgacagcgacagcgaggaggaggacgacgaggaggaggacgacgaggacgaggacgacgacgacgacgaggaggacggcgacgaggugcccgugcccagcuucggcgaggccauggccuacuucgccauggugaagagauaccugaccagcuuccccaucgacgacagagugcagagccacauccugcaccuggagcacgaccuggugcacgugaccagaaagaaccacgccagacaggccggcgugagaggccugggccaccagagcuaa

SEQ ID NO: 15070 - RNA, 2832 nt, Artificial Sequence
  CENPC__Homo_sapiens__NP_001803
auggccgccagcggccuggaccaccugaagaacggcuacagaagaagauucugcagacccagcagagccagagacaucaacaccgagcagggccagaacgugcuggagauccugcaggacugcuucgaggagaagagccuggccaacgacuucagcaccaacagcaccaagagcgugcccaacagcaccagaaagaucaaggacaccugcauccagagccccagcaaggagugccagaagagccaccccaagagcgugcccgugagcagcaagaagaaggaggccagccugcaguucgugguggagcccagcgaggccaccaacagaagcgugcaggcccacgaggugcaccagaagauccuggccaccgacgugagcagcaagaacacccccgacagcaagaagaucagcagcagaaacaucaacgaccaccacagcgaggccgacgaggaguucuaccugagcgugggcagccccagcgugcugcuggacgccaagaccagcgugagccagaacgugauccccagcagcgcccagaagagagagaccuacaccuucgagaacagcgugaacaugcugcccagcagcaccgaggugagcgugaagaccaagaagagacugaacuucgacgacaaggugaugcugaagaagaucgagaucgacaacaaggugagcgacgaggaggacaagaccagcgagggccaggagagaaagcccagcggcagcagccagaacagaaucagagacagcgaguacgagauccagagacaggccaagaagagcuucagcacccuguuccuggagaccgugaagagaaagagcgagagcagccccaucgugagacacgccgccaccgcccccccccacagcugcccccccgacgacaccaagcugaucgaggacgaguucaucaucgacgagagcgaccagagcuucgccagcagaagcuggaucaccauccccagaaaggccggcagccugaagcagagaaccaucagccccgccgagagcaccgcccugcugcagggcagaaagagcagagagaagcaccacaacauccugcccaagacccuggccaacgacaagcacagccacaagccccaccccguggagaccagccagcccagcgacaagaccgugcuggacaccagcuacgcccugaucggcgagaccgugaacaacuacagaagcaccaaguacgagauguacagcaagaacgccgagaagcccagcagaagcaagagaaccaucaagcagaagcagagaagaaaguucauggccaagcccgccgaggagcagcuggacgugggccagagcaaggacgagaacauccacaccagccacaucacccaggacgaguuccagagaaacagcgacagaaacauggaggagcacgaggagaugggcaacgacugcgugagcaagaagcagaugccccccgugggcagcaagaagagcagcaccagaaaggacaaggaggagagcaagaagaagagauucagcagcgagagcaagaacaagcuggugcccgaggaggugaccagcaccgugaccaagagcagaagaaucagcagaagacccagcgacugguggguggugaagagcgaggagagccccguguacagcaacagcagcgugagaaacgagcugcccaugcaccacaacagcagcagaaagagcaccaagaagaccaaccagagcagcaagaacaucagaaagaagaccaucccccugaagagacagaagaccgccaccaagggcaaccagagagugcagaaguuccugaacgccgagggcagcggcggcaucgugggccacgacgagaucagcagaugcagccugagcgagccccuggagagcgacgaggccgaccuggccaagaagaagaaccuggacugcagcagaagcaccagaagcagcaagaacgaggacaacaucaugaccgcccagaacgugccccugaagccccagaccagcggcuacaccugcaacauccccaccgagagcaaccuggacagcggcgagcacaagaccagcgugcuggaggagagcggccccagcagacugaacaacaacuaccugaugagcggcaagaacgacguggacgacgaggaggugcacggcagcagcgacgacagcaagcagagcaaggugauccccaagaacagaauccaccacaagcuggugcugcccagcaacacccccaacgugagaagaaccaagagaaccagacugaagccccuggaguacuggagaggcgagagaaucgacuaccagggcagacccagcggcggcuucgugaucagcggcgugcugagccccgacaccaucagcagcaagagaaaggccaaggagaacaucggcaaggugaacaagaagagcaacaagaagagaaucugccuggacaacgacgagagaaagaccaaccugauggugaaccugggcaucccccugggcgacccccugcagcccaccagagugaaggaccccgagaccagagagaucauccugauggaccuggugagaccccaggacaccuaccaguucuucgugaagcacggcgagcugaagguguacaagacccuggacacccccuucuucagcaccggcaagcugauccugggcccccaggaggagaagggcaagcagcacgugggccaggacauccugguguucuacgugaacuucggcgaccugcugugcacccugcacgagacccccuacauccugagcaccggcgacagcuucuacgugcccagcggcaacuacuacaacaucaagaaccugagaaacgaggagagcgugcugcuguucacccagaucaagagauaa

SEQ ID NO: 15071 - RNA, 7743 nt, Artificial Sequence
  CENPE__Homo_sapiens__NP_001273663
auggccgaggagggcgccguggccgugugcgugagagugagaccccugaacagcagagaggagagccugggcgagaccgcccagguguacuggaagaccgacaacaacgugaucuaccagguggacggcagcaagagcuucaacuucgacagaguguuccacggcaacgagaccaccaagaacguguacgaggagaucgccgcccccaucaucgacagcgccauccagggcuacaacggcaccaucuucgccuacggccagaccgccagcggcaagaccuacaccaugaugggcagcgaggaccaccugggcgugauccccagagccauccacgacaucuuccagaagaucaagaaguuccccgacagagaguuccugcugagagugagcuacauggagaucuacaacgagaccaucaccgaccugcugugcggcacccagaagaugaagccccugaucaucagagaggacgugaacagaaacguguacguggccgaccugaccgaggaggugguguacaccagcgagauggcccugaaguggaucaccaagggcgagaagagcagacacuacggcgagaccaagaugaaccagagaagcagcagaagccacaccaucuucagaaugauccuggagagcagagagaagggcgagcccagcaacugcgagggcagcgugaaggugagccaccugaaccugguggaccuggccggcagcgagagagccgcccagaccggcgccgccggcgugagacugaaggagggcugcaacaucaacagaagccuguucauccugggccaggugaucaagaagcugagcgacggccaggugggcggcuucaucaacuacagagacagcaagcugaccagaauccugcagaacagccugggcggcaacgccaagaccagaaucaucugcaccaucacccccgugagcuucgacgagacccugaccgcccugcaguucgccagcaccgccaaguacaugaagaacacccccuacgugaacgaggugagcaccgacgaggcccugcugaagagauacagaaaggagaucauggaccugaagaagcagcuggaggaggugagccuggagaccagagcccaggccauggagaaggaccagcuggcccagcugcuggaggagaaggaccugcugcagaaggugcagaacgagaagaucgagaaccugaccagaaugcuggugaccagcagcagccugacccugcagcaggagcugaaggccaagagaaagagaagagugaccuggugccugggcaagaucaacaagaugaagaacagcaacuacgccgaccaguucaacauccccaccaacaucaccaccaagacccacaagcugagcaucaaccugcugagagagaucgacgagagcgugugcagcgagagcgacguguucagcaacacccuggacacccugagcgagaucgaguggaaccccgccaccaagcugcugaaccaggagaacaucgagagcgagcugaacagccugagagccgacuacgacaaccuggugcuggacuacgagcagcugagaaccgagaaggaggagauggagcugaagcugaaggagaagaacgaccuggacgaguucgaggcccuggagagaaagaccaagaaggaccaggagaacgagcugagcagcaagguggagcugcugagagagaaggaggaccagaucaagaagcugcaggaguacaucgacagccagaagcuggagaacaucaagauggaccugagcuacagccuggagagcaucgaggaccccaagcagaugaagcagacccuguucgacgccgagaccguggcccuggacgccaagagagagagcgccuuccugagaagcgagaaccuggagcugaaggagaagaugaaggagcuggccaccaccuacaagcagauggagaacgacauccagcuguaccagagccagcuggaggccaagaagaagaugcagguggaccuggagaaggagcugcagagcgccuucaacgagaucaccaagcugaccagccugaucgacggcaaggugcccaaggaccugcugugcaaccuggagcuggagggcaagaucaccgaccugcagaaggagcugaacaaggagguggaggagaacgaggcccugagagaggaggugauccugcugagcgagcugaagagccugcccagcgagguggagagacugagaaaggagauccaggacaagagcgaggagcugcacaucaucaccagcgagaaggacaagcuguucagcgagguggugcacaaggagagcagagugcagggccugcuggaggagaucggcaagaccaaggacgaccuggccaccacccagagcaacuacaagagcaccgaccaggaguuccagaacuucaagacccugcacauggacuucgagcagaaguacaagauggugcuggaggagaacgagagaaugaaccaggagaucgugaaccugagcaaggaggcccagaaguucgacagcagccugggcgcccugaagaccgagcugagcuacaagacccaggagcugcaggagaagaccagagaggugcaggagagacugaacgagauggagcagcugaaggagcagcuggagaacagagacagcacccugcagaccguggagagagagaagacccugaucaccgagaagcugcagcagacccuggaggaggugaagacccugacccaggagaaggacgaccugaagcagcugcaggagagccugcagaucgagagagaccagcugaagagcgacauccacgacaccgugaacaugaacaucgacacccaggagcagcugagaaacgcccuggagagccugaagcagcaccaggagaccaucaacacccugaagagcaagaucagcgaggaggugagcagaaaccugcacauggaggagaacaccggcgagaccaaggacgaguuccagcagaagauggugggcaucgacaagaagcaggaccuggaggccaagaacacccagacccugaccgccgacgugaaggacaacgagaucaucgagcagcagagaaagaucuucagccugauccaggagaagaacgagcugcagcagaugcuggagagcgugaucgccgagaaggagcagcugaagaccgaccugaaggagaacaucgagaugaccaucgagaaccaggaggagcugagacugcugggcgacgagcugaagaagcagcaggagaucguggcccaggagaagaaccacgccaucaagaaggagggcgagcugagcagaaccugcgacagacuggccgagguggaggagaagcugaaggagaagagccagcagcugcaggagaagcagcagcagcugcugaacgugcaggaggagaugagcgagaugcagaagaagaucaacgagaucgagaaccugaagaacgagcugaagaacaaggagcugacccuggagcacauggagaccgagagacuggagcuggcccagaagcugaacgagaacuacgaggaggugaagagcaucaccaaggagagaaaggugcugaaggagcugcagaagagcuucgagaccgagagagaccaccugagaggcuacaucagagagaucgaggccaccggccugcagaccaaggaggagcugaagaucgcccacauccaccugaaggagcaccaggagaccaucgacgagcugagaagaagcgugagcgagaagaccgcccagaucaucaacacccaggaccuggagaagagccacaccaagcugcaggaggagauccccgugcugcacgaggagcaggagcugcugcccaacgugaaggaggugagcgagacccaggagaccaugaacgagcuggagcugcugaccgagcagagcaccaccaaggacagcaccacccuggccagaaucgagauggagagacugagacugaacgagaaguuccaggagagccaggaggagaucaagagccugaccaaggagagagacaaccugaagaccaucaaggaggcccuggaggugaagcacgaccagcugaaggagcacaucagagagacccuggccaagauccaggagagccagagcaagcaggagcagagccugaacaugaaggagaaggacaacgagaccaccaagaucgugagcgagauggagcaguucaagcccaaggacagcgcccugcugagaaucgagaucgagaugcugggccugagcaagagacugcaggagagccacgacgagaugaagagcguggccaaggagaaggacgaccugcagagacugcaggaggugcugcagagcgagagcgaccagcugaaggagaacaucaaggagaucguggccaagcaccuggagaccgaggaggagcugaagguggcccacugcugccugaaggagcaggaggagaccaucaacgagcugagagugaaccugagcgagaaggagaccgagaucagcaccauccagaagcagcuggaggccaucaacgacaagcugcagaacaagauccaggagaucuacgagaaggaggagcaguucaacaucaagcagaucagcgaggugcaggagaaggugaacgagcugaagcaguucaaggagcacagaaaggccaaggacagcgcccugcagagcaucgagagcaagaugcuggagcugaccaacagacugcaggagagccaggaggagauccagaucaugaucaaggagaaggaggagaugaagagagugcaggaggcccugcagaucgagagagaccagcugaaggagaacaccaaggagaucguggccaagaugaaggagagccaggagaaggaguaccaguuccugaagaugaccgccgugaacgagacccaggagaagaugugcgagaucgagcaccugaaggagcaguucgagacccagaagcugaaccuggagaacaucgagaccgagaacaucagacugacccagauccugcacgagaaccuggaggagaugagaagcgugaccaaggagagagacgaccugagaagcguggaggagacccugaagguggagagagaccagcugaaggagaaccugagagagaccaucaccagagaccuggagaagcaggaggagcugaagaucgugcacaugcaccugaaggagcaccaggagaccaucgacaagcugagaggcaucgugagcgagaagaccaacgagaucagcaacaugcagaaggaccuggagcacagcaacgacgcccugaaggcccaggaccugaagauccaggaggagcugagaaucgcccacaugcaccugaaggagcagcaggagaccaucgacaagcugagaggcaucgugagcgagaagaccgacaagcugagcaacaugcagaaggaccuggagaacagcaacgccaagcugcaggagaagauccaggagcugaaggccaacgagcaccagcugaucacccugaagaaggacgugaacgagacccagaagaaggugagcgagauggagcagcugaagaagcagaucaaggaccagagccugacccugagcaagcuggagaucgagaaccugaaccuggcccagaagcugcacgagaaccuggaggagaugaagagcgugaugaaggagagagacaaccugagaagaguggaggagacccugaagcuggagagagaccagcugaaggagagccugcaggagaccaaggccagagaccuggagauccagcaggagcugaagaccgccagaaugcugagcaaggagcacaaggagaccguggacaagcugagagagaagaucagcgagaagaccauccagaucagcgacauccagaaggaccuggacaagagcaaggacgagcugcagaagaagcaggacagacagaaccaccaggugaagcccgagaagagacugcugagcgacggccagcagcaccugaccgagagccugagagagaagugcagcagaaucaaggagcugcugaagagauacagcgagauggacgaccacuacgagugccugaacagacugagccuggaccuggagaaggagaucgaguuccagaaggagcugagcaugagagugaaggccaaccugagccugcccuaccugcagaccaagcacaucgagaagcuguucaccgccaaccagagaugcagcauggaguuccacagaaucaugaagaagcugaaguacgugcugagcuacgugaccaagaucaaggaggagcagcacgagagcaucaacaaguucgagauggacuucaucgacgagguggagaagcagaaggagcugcugaucaagauccagcaccugcagcaggacugcgacgugcccagcagagagcugagagaccugaagcugaaccagaacauggaccugcacaucgaggagauccugaaggacuucagcgagagcgaguuccccagcaucaagaccgaguuccagcaggugcugagcaacagaaaggagaugacccaguuccuggaggaguggcugaacaccagauucgacaucgagaagcugaagaacggcauccagaaggagaacgacagaaucugccaggugaacaacuucuucaacaacagaaucaucgccaucaugaacgagagcaccgaguucgaggagagaagcgccaccaucagcaaggagugggagcaggaccugaagagccugaaggagaagaacgagaagcuguucaagaacuaccagacccugaagaccagccuggccagcggcgcccaggugaaccccaccacccaggacaacaagaacccccacgugaccagcagagccacccagcugaccaccgagaagaucagagagcuggagaacagccugcacgaggccaaggagagcgccaugcacaaggagagcaagaucaucaagaugcagaaggagcuggaggugaccaacgacaucaucgccaagcugcaggccaaggugcacgagagcaacaagugccuggagaagaccaaggagaccauccaggugcugcaggacaagguggcccugggcgccaagcccuacaaggaggagaucgaggaccugaagaugaagcuggugaagaucgaccuggagaagaugaagaacgccaaggaguucgagaaggagaucagcgccaccaaggccaccguggaguaccagaaggaggugaucagacugcugagagagaaccugagaagaagccagcaggcccaggacaccagcgugaucagcgagcacaccgacccccagcccagcaacaagccccugaccugcggcggcggcagcggcaucgugcagaacaccaaggcccugauccugaagagcgagcacaucagacuggagaaggagaucagcaagcugaagcagcagaacgagcagcugaucaagcagaagaacgagcugcugagcaacaaccagcaccugagcaacgaggugaagaccuggaaggagagaacccugaagagagaggcccacaagcaggugaccugcgagaacagccccaagagccccaaggugaccggcaccgccagcaagaagaagcagaucacccccagccagugcaaggagagaaaccugcaggaccccgugcccaaggagagccccaagagcugcuucuucgacagcagaagcaagagccugcccagcccccaccccgugagauacuucgacaacagcagccugggccugugccccgaggugcagaacgccggcgccgagagcguggacagccagcccggccccuggcacgccagcagcggcaaggacgugcccgagugcaagacccaguaa

SEQ ID NO: 15072 - RNA, 9345 nt, Artificial Sequence
  CENPF__Homo_sapiens__NP_057427
augagcugggcccuggaggaguggaaggagggccugcccaccagagcccugcagaagauccaggagcuggagggccagcuggacaagcugaagaaggagaagcagcagagacaguuccagcuggacagccuggaggccgcccugcagaagcagaagcagaagguggagaacgagaagaccgagggcaccaaccugaagagagagaaccagagacugauggagaucugcgagagccuggagaagaccaagcagaagaucagccacgagcugcaggugaaggagagccaggugaacuuccaggagggccagcugaacagcggcaagaagcagaucgagaagcuggagcaggagcugaagagaugcaagagcgagcuggagagaagccagcaggccgcccagagcgccgacgugagccugaaccccugcaacaccccccagaagaucuucaccaccccccugacccccagccaguacuacagcggcagcaaguacgaggaccugaaggagaaguacaacaaggagguggaggagagaaagagacuggaggccgaggugaaggcccugcaggccaagaaggccagccagacccugccccaggccaccaugaaccacagagacaucgccagacaccaggccagcagcagcguguucagcuggcagcaggagaagacccccagccaccugagcagcaacagccagagaacccccaucagaagagacuucagcgccagcuacuucagcggcgagcaggaggugacccccagcagaagcacccugcagaucggcaagagagacgccaacagcagcuucuucgacaacagcagcagcccccaccugcuggaccagcugaaggcccagaaccaggagcugagaaacaagaucaacgagcuggagcugagacugcagggccacgagaaggagaugaagggccaggugaacaaguuccaggagcugcagcugcagcuggagaaggccaagguggagcugaucgagaaggagaaggugcugaacaagugcagagacgagcuggugagaaccaccgcccaguacgaccaggccagcaccaaguacaccgcccuggagcagaagcugaagaagcugaccgaggaccugagcugccagagacagaacgccgagagcgccagaugcagccuggagcagaagaucaaggagaaggagaaggaguuccaggaggagcugagcagacagcagagaagcuuccagacccuggaccaggagugcauccagaugaaggccagacugacccaggagcugcagcaggccaagaacaugcacaacgugcugcaggccgagcuggacaagcugaccagcgugaagcagcagcuggagaacaaccuggaggaguucaagcagaagcugugcagagccgagcaggccuuccaggccagccagaucaaggagaacgagcugagaagaagcauggaggagaugaagaaggagaacaaccugcugaagagccacagcgagcagaaggccagagaggugugccaccuggaggccgagcugaagaacaucaagcagugccugaaccagagccagaacuucgccgaggagaugaaggccaagaacaccagccaggagaccaugcugagagaccugcaggagaagaucaaccagcaggagaacagccugacccuggagaagcugaagcuggccguggccgaccuggagaagcagagagacugcagccaggaccugcugaagaagagagagcaccacaucgagcagcugaacgacaagcugagcaagaccgagaaggagagcaaggcccugcugagcgcccuggagcugaagaagaaggaguacgaggagcugaaggaggagaagacccuguucagcugcuggaagagcgagaacgagaagcugcugacccagauggagagcgagaaggagaaccugcagagcaagaucaaccaccuggagaccugccugaagacccagcagaucaagagccacgaguacaacgagagagugagaacccuggagauggacagagagaaccugagcguggagaucagaaaccugcacaacgugcuggacagcaagagcguggagguggagacccagaagcuggccuacauggagcugcagcagaaggccgaguucagcgaccagaagcaccagaaggagaucgagaacaugugccugaagaccagccagcugaccggccagguggaggaccuggagcacaagcugcagcugcugagcaacgagaucauggacaaggacagaugcuaccaggaccugcacgccgaguacgagagccugagagaccugcugaagagcaaggacgccagccuggugaccaacgaggaccaccagagaagccugcuggccuucgaccagcagcccgccaugcaccacagcuucgccaacaucaucggcgagcagggcagcaugcccagcgagagaagcgagugcagacuggaggccgaccagagccccaagaacagcgccauccugcagaacagaguggacagccuggaguucagccuggagagccagaagcagaugaacagcgaccugcagaagcagugcgaggagcuggugcagaucaagggcgagaucgaggagaaccugaugaaggccgagcagaugcaccagagcuucguggccgagaccagccagagaaucagcaagcugcaggaggacaccagcgcccaccagaacgugguggccgagacccugagcgcccuggagaacaaggagaaggagcugcagcugcugaacgacaagguggagaccgagcaggccgagauccaggagcugaagaagagcaaccaccugcuggaggacagccugaaggagcugcagcugcugagcgagacccugagccuggagaagaaggagaugagcagcaucaucagccugaacaagagagagaucgaggagcugacccaggagaacggcacccugaaggagaucaacgccagccugaaccaggagaagaugaaccugauccagaagagcgagagcuucgccaacuacaucgacgagagagagaagagcaucagcgagcugagcgaccaguacaagcaggagaagcugauccugcugcagagaugcgaggagaccggcaacgccuacgaggaccugagccagaaguacaaggccgcccaggagaagaacagcaagcuggagugccugcugaacgagugcaccagccugugcgagaacagaaagaacgagcuggagcagcugaaggaggccuucgccaaggagcaccaggaguuccugaccaagcuggccuucgccgaggagagaaaccagaaccugaugcuggagcuggagaccgugcagcaggcccugagaagcgagaugaccgacaaccagaacaacagcaagagcgaggccggcggccugaagcaggagaucaugacccugaaggaggagcagaacaagaugcagaaggaggugaacgaccugcugcaggagaacgagcagcugaugaaggugaugaagaccaagcacgagugccagaaccuggagagcgagcccaucagaaacagcgugaaggagagagagagcgagagaaaccagugcaacuucaagccccagauggaccuggaggugaaggagaucagccuggacagcuacaacgcccagcuggugcagcuggaggccaugcugagaaacaaggagcugaagcugcaggagagcgagaaggagaaggagugccugcagcacgagcugcagaccaucagaggcgaccuggagaccagcaaccugcaggacaugcagagccaggagaucagcggccugaaggacugcgagaucgacgccgaggagaaguacaucagcggcccccacgagcugagcaccagccagaacgacaacgcccaccugcagugcagccugcagaccaccaugaacaagcugaacgagcuggagaagaucugcgagauccugcaggccgagaaguacgagcuggugaccgagcugaacgacagcagaagcgagugcaucaccgccaccagaaagauggccgaggaggugggcaagcugcugaacgaggugaagauccugaacgacgacagcggccugcugcacggcgagcugguggaggacauccccggcggcgaguucggcgagcagcccaacgagcagcaccccgugagccuggccccccuggacgagagcaacagcuacgagcaccugacccugagcgacaaggaggugcagaugcacuucgccgagcugcaggagaaguuccugagccugcagagcgagcacaagauccugcacgaccagcacugccagaugagcagcaagaugagcgagcugcagaccuacguggacagccugaaggccgagaaccuggugcugagcaccaaccugagaaacuuccagggcgaccuggugaaggagaugcagcugggccuggaggagggccuggugcccagccugagcagcagcugcgugcccgacagcagcagccugagcagccugggcgacagcagcuucuacagagcccugcuggagcagaccggcgacaugagccugcugagcaaccuggagggcgccgugagcgccaaccagugcagcguggacgagguguucugcagcagccugcaggaggagaaccugaccagaaaggagacccccagcgcccccgccaagggcguggaggagcuggagagccugugcgagguguacagacagagccuggagaagcuggaggagaagauggagagccagggcaucaugaagaacaaggagauccaggagcuggagcagcugcugagcagcgagagacaggagcuggacugccugagaaagcaguaccugagcgagaacgagcaguggcagcagaagcugaccagcgugacccuggagauggagagcaagcuggccgccgagaagaagcagaccgagcagcugagccuggagcuggagguggccagacugcagcugcagggccuggaccugagcagcagaagccugcugggcaucgacaccgaggacgccauccagggcagaaacgagagcugcgacaucagcaaggagcacaccagcgagaccaccgagagaacccccaagcacgacgugcaccagaucugcgacaaggacgcccagcaggaccugaaccuggacaucgagaagaucaccgagaccggcgccgugaagcccaccggcgagugcagcggcgagcagagccccgacaccaacuacgagccccccggcgaggacaagacccagggcagcagcgagugcaucagcgagcugagcuucagcggccccaacgcccuggugcccauggacuuccugggcaaccaggaggacauccacaaccugcagcugagagugaaggagaccagcaacgagaaccugagacugcugcacgugaucgaggacagagacagaaagguggagagccugcugaacgagaugaaggagcuggacagcaagcugcaccugcaggaggugcagcugaugaccaagaucgaggccugcaucgagcuggagaagaucgugggcgagcugaagaaggagaacagcgaccugagcgagaagcuggaguacuucagcugcgaccaccaggagcugcugcagagaguggagaccagcgagggccugaacagcgaccuggagaugcacgccgacaagagcagcagagaggacaucggcgacaacguggccaaggugaacgacagcuggaaggagagauuccuggacguggagaacgagcugagcagaaucagaagcgagaaggccagcaucgagcacgaggcccuguaccuggaggccgaccuggagguggugcagaccgagaagcugugccuggagaaggacaacgagaacaagcagaaggugaucgugugccuggaggaggagcugagcguggugaccagcgagagaaaccagcugagaggcgagcuggacaccaugagcaagaagaccaccgcccuggaccagcugagcgagaagaugaaggagaagacccaggagcuggagagccaccagagcgagugccugcacugcauccagguggccgaggccgaggugaaggagaagaccgagcugcugcagacccugagcagcgacgugagcgagcugcugaaggacaagacccaccugcaggagaagcugcagagccuggagaaggacagccaggcccugagccugaccaagugcgagcuggagaaccagaucgcccagcugaacaaggagaaggagcugcuggugaaggagagcgagagccugcaggccagacugagcgagagcgacuacgagaagcugaacgugagcaaggcccuggaggccgcccugguggagaagggcgaguucgcccugagacugagcagcacccaggaggaggugcaccagcugagaagaggcaucgagaagcugagagugagaaucgaggccgacgagaagaagcagcugcacaucgccgagaagcugaaggagagagagagagagaacgacagccugaaggacaagguggagaaccuggagagagagcugcagaugagcgaggagaaccaggagcuggugauccuggacgccgagaacagcaaggccgagguggagacccugaagacccagaucgaggagauggccagaagccugaagguguucgagcuggaccuggugacccugagaagcgagaaggagaaccugaccaagcagauccaggagaagcagggccagcugagcgagcuggacaagcugcugagcagcuucaagagccugcuggaggagaaggagcaggccgagauccagaucaaggaggagagcaagaccgccguggagaugcugcagaaccagcugaaggagcugaacgaggccguggccgcccugugcggcgaccaggagaucaugaaggccaccgagcagagccuggacccccccaucgaggaggagcaccagcugagaaacagcaucgagaagcugagagccagacuggaggccgacgagaagaagcagcugugcgugcugcagcagcugaaggagagcgagcaccacgccgaccugcugaagggcagaguggagaaccuggagagagagcuggagaucgccagaaccaaccaggagcacgccgcccuggaggccgagaacagcaagggcgagguggagacccugaaggccaagaucgagggcaugacccagagccugagaggccuggagcuggacguggugaccaucagaagcgagaaggagaaccugaccaacgagcugcagaaggagcaggagagaaucagcgagcuggagaucaucaacagcagcuucgagaacauccugcaggagaaggagcaggagaaggugcagaugaaggagaagagcagcaccgccauggagaugcugcagacccagcugaaggagcugaacgagagaguggccgcccugcacaacgaccaggaggccugcaaggccaaggagcagaaccugagcagccagguggagugccuggagcuggagaaggcccagcugcugcagggccuggacgaggccaagaacaacuacaucgugcugcagagcagcgugaacggccugauccaggagguggaggacggcaagcagaagcuggagaagaaggacgaggagaucagcagacugaagaaccagauccaggaccaggagcagcuggugagcaagcugagccagguggagggcgagcaccagcuguggaaggagcagaaccuggagcugagaaaccugaccguggagcuggagcagaagauccaggugcugcagagcaagaacgccagccugcaggacacccuggaggugcugcagagcagcuacaagaaccuggagaacgagcuggagcugaccaagauggacaagaugagcuucguggagaaggugaacaagaugaccgccaaggagaccgagcugcagagagagaugcacgagauggcccagaagaccgccgagcugcaggaggagcugagcggcgagaagaacagacuggccggcgagcugcagcugcugcuggaggagaucaagagcagcaaggaccagcugaaggagcugacccuggagaacagcgagcugaagaagagccuggacugcaugcacaaggaccagguggagaaggagggcaaggugagagaggagaucgccgaguaccagcugagacugcacgaggccgagaagaagcaccaggcccugcugcuggacaccaacaagcaguacgagguggagauccagaccuacagagagaagcugaccagcaaggaggagugccugagcagccagaagcuggagaucgaccugcugaagagcagcaaggaggagcugaacaacagccugaaggccaccacccagauccuggaggagcugaagaagaccaagauggacaaccugaaguacgugaaccagcugaagaaggagaacgagagagcccagggcaagaugaagcugcugaucaagagcugcaagcagcuggaggaggagaaggagauccugcagaaggagcugagccagcugcaggccgcccaggagaagcagaagaccggcaccgugauggacaccaagguggacgagcugaccaccgagaucaaggagcugaaggagacccuggaggagaagaccaaggaggccgacgaguaccuggacaaguacugcagccugcugaucagccacgagaagcuggagaaggccaaggagaugcuggagacccagguggcccaccugugcagccagcagagcaagcaggacagcagaggcagcccccugcugggccccguggugcccggccccagccccauccccagcgugaccgagaagagacugagcagcggccagaacaaggccagcggcaagagacagagaagcagcggcaucugggagaacggcagaggccccacccccgccacccccgagagcuucagcaagaagagcaagaaggccgugaugagcggcauccaccccgccgaggacaccgagggcaccgaguucgagcccgagggccugcccgagguggugaagaagggcuucgccgacauccccaccggcaagaccagccccuacauccugagaagaaccaccauggccaccagaaccagccccagacuggccgcccagaagcuggcccugagcccccugagccugggcaaggagaaccuggccgagagcagcaagcccaccgccggcggcagcagaagccagaaggugaagguggcccagagaagccccguggacagcggcaccauccugagagagcccaccaccaagagcgugcccgugaacaaccugcccgagagaagccccaccgacagccccagagagggccugagagugaagagaggcagacuggugcccagccccaaggccggccuggagagcaacggcagcgagaacugcaaggugcaguaa

SEQ ID NO: 15073 - RNA, 744 nt, Artificial Sequence
  CENPH__Homo_sapiens__NP_075060
auggaggagcagccccagaugcaggacgccgacgagcccgccgacagcggcggcgagggcagagccggcggccccccccagguggccggcgcccaggccgccugcagcgaggacagaaugacccugcugcugagacugagagcccagaccaagcagcagcugcuggaguacaagagcaugguggacgccagcgaggagaagacccccgagcagaucaugcaggagaagcagaucgaggccaagaucgaggaccuggagaacgagaucgaggaggugaagguggccuucgagaucaagaagcuggcccuggacagaaugagacugagcaccgcccugaagaagaaccuggagaagaucagcagacagagcagcgugcugauggacaacaugaagcaccugcuggagcugaacaagcugaucaugaagagccagcaggagagcugggaccuggaggagaagcugcuggacaucagaaagaagagacugcagcugaagcaggccagcgagagcaagcugcuggagauccagaccgagaagaacaagcagaagaucgaccuggacagcauggagaacagcgagagaaucaagaucaucagacagaaccugcagauggagaucaagaucaccaccgugauccagcacguguuccagaaccugauccugggcagcaaggugaacugggccgaggaccccgcccugaaggagaucgugcugcagcuggagaagaacguggacaugauguaa

SEQ ID NO: 15074 - RNA, 4017 nt, Artificial Sequence
  CENPJ__Homo_sapiens__NP_060921
auguuccugaugcccaccagcagcgagcugaacagcggccagaacuuccugacccaguggaugaccaaccccagcagagccggcgugauccugaacagaggcuuccccauccuggaggccgacaaggagaagagagccgccguggacaucagcaccagcuuccccaucaagggcacccacuucagcgacagcuucagcuucaucaacgaggaggacagccugcuggaggagcagaagcuggagagcaacaaccccuacaagccccagagcgacaagagcgagacccacaccgccuuccccugcaucaagaagggcccccagguggccgccugccacagcgcccccggccaccaggaggagaacaagaacgacuucauccccgaccuggccagcgaguucaaggagggcgccuacaaggacccccuguucaagaagcuggagcagcugaaggaggugcagcagaagaagcaggagcagcugaagagacagcagcuggagcagcugcagagacugauggaggagcaggagaagcugcugaccauggugagcggccagugcacccugcccggccugagccugcugcccgacgaccagagccagaagcacagaagccccggcaacaccaccaccggcgagagagccaccugcugcuuccccagcuacguguaccccgaccccacccaggaggagaccuaccccagcaacauccugagccacgagcagagcaacuucugcagaaccgcccacggcgacuucgugcugaccagcaagagagccagccccaaccuguucagcgaggcccaguaccaggaggcccccguggagaagaacaaccugaaggaggagaacagaaaccaccccaccggcgagagcauccugugcugggagaaggugaccgagcagauccaggaggccaacgacaagaaccugcagaagcacgacgacagcagcgagguggccaacaucgaggagagacccaucaaggccgccaucggcgagagaaagcagaccuucgaggacuaccuggaggagcagauccagcuggaggagcaggagcugaagcagaagcagcugaaggaggccgagggcccccugcccaucaaggccaagcccaagcagcccuuccugaagagaggcgagggccuggccagauucaccaacgccaagagcaaguuccagaagggcaaggagagcaagcuggugaccaaccagagcaccagcgaggaccagccccuguucaagauggacagacagcagcugcagagaaagaccgcccugaagaacaaggagcugugcgccgacaaccccauccugaagaaggacagcaaggccagaaccaagagcggcagcgugacccugagccagaagcccaagaugcugaagugcagcaacagaaagagccugagccccagcggccugaagauccagaccggcaagaagugcgacggccaguucagagaccagaucaaguucgagaacaaggugaccagcaacaacaaggagaacgugaccgagugccccaagcccugcgacaccggcugcaccggcuggaacaagacccagggcaaggacagacugccccugagcaccggccccgccagcagacuggccgccaagagccccaucagagagaccaugaaggagagcgagagcagccuggacgugagccugcagaagaagcuggagaccugggagagagagaaggagaaggagaaccuggagcuggacgaguuccuguuccuggagcaggccgccgacgagaucagcuucagcagcaacagcagcuucgugcugaagauccuggagagagaccagcagaucugcaagggccacagaaugagcagcacccccgugaaggccgugccccagaagaccaaccccgccgaccccaucagccacugcaacagaagcgaggaccuggaccacaccgccagagagaaggagagcgagugcgagguggcccccaagcagcugcacagccugagcagcgccgacgagcugagagagcagcccugcaagaucagaaaggccgugcagaagagcaccagcgagaaccagaccgaguggaacgccagagacgacgagggcgugcccaacagcgacagcagcaccgacagcgaggagcagcuggacgugaccaucaagcccagcaccgaggacagagagagaggcaucagcagcagagaggacagcccccaggugugcgacgacaagggccccuucaaggacaccagaacccaggaggacaagagaagagacguggaccuggaccugagcgacaaggacuacagcagcgacgagagcaucauggagagcaucaagcacaaggugagcgagcccagcagaagcagcagccugagccugagcaagauggacuucgacgacgagagaaccuggaccgaccuggaggagaaccugugcaaccacgacguggugcugggcaacgagagcaccuacggcaccccccagaccugcuaccccaacaacgagaucggcauccuggacaagaccaucaagagaaagaucgcccccgugaagagaggcgaggaccugagcaagagcagaagaagcagaagcccccccaccagcgagcugaugaugaaguucuuccccagccugaagcccaagcccaagagcgacagccaccugggcaacgagcugaagcugaacaucagccaggaccagccccccggcgacaacgccagaagccaggugcugagagagaagaucaucgagcuggagaccgagaucgagaaguucaaggccgagaacgccagccuggccaagcugagaaucgagagagagagcgcccuggagaagcugagaaaggagaucgccgacuucgagcagcagaaggccaaggagcuggccagaaucgaggaguucaagaaggaggagaugagaaagcugcagaaggagagaaagguguucgagaaguacaccaccgccgccagaaccuuccccgacaagaaggagagagaggagauccagacccugaagcagcagaucgccgaccugagagaggaccugaagagaaaggagaccaaguggagcagcacccacagcagacugagaagccagauccagaugcuggugagagagaacaccgaccugagagaggagaucaaggugauggagagauucagacuggacgccuggaagagagccgaggccaucgagagcagccuggagguggagaagaaggacaagcuggccaacaccagcgugagauuccagaacagccagaucagcagcggcacccagguggagaaguacaagaagaacuaccugcccaugcagggcaacccccccagaagaagcaagagcgccccccccagagaccugggcaaccuggacaagggccaggccgccagccccagagagccccuggagccccugaacuuccccgaccccgaguacaaggaggaggaggaggaccaggacauccagggcgagaucagccaccccgacggcaagguggagaagguguacaagaacggcugcagagugauccuguuccccaacggcaccagaaaggaggugagcgccgacggcaagaccaucaccgugaccuucuucaacggcgacgugaagcaggugaugcccgaccagagagugaucuacuacuacgccgccgcccagaccacccacaccaccuaccccgagggccuggaggugcugcacuucagcagcggccagaucgagaagcacuaccccgacggcagaaaggagaucaccuuccccgaccagaccgugaagaaccuguuccccgacggccaggaggagagcaucuuccccgacggcaccaucgugagagugcagagagacggcaacaagcugaucgaguucaacaacggccagagagagcugcacaccgcccaguucaagagaagagaguaccccgacggcaccgugaagaccguguacgccaacggccaccaggagaccaaguacagaagcggcagaaucagagugaaggacaaggagggcaacgugcugauggacaccgagcuguaa

SEQ ID NO: 15075 - RNA, 810 nt, Artificial Sequence
  CENPK__Homo_sapiens__NP_001253967
augaaccaggaggaccuggaccccgacagcaccaccgacgugggcgacgugaccaacaccgaggaggagcugaucagagagugcgaggagauguggaaggacauggaggagugccagaacaagcugagccugaucggcaccgagacccugaccgacagcaacgcccagcugagccugcugaucaugcaggugaagugccugaccgccgagcugagccaguggcagaagaagacccccgagaccaucccccugaccgaggacgugcugaucacccugggcaaggaggaguuccagaagcugagacaggaccuggagauggugcugagcaccaaggagagcaagaacgagaagcugaaggaggaccuggagagagagcagagauggcuggacgagcagcagcagaucauggagagccugaacgugcugcacagcgagcugaagaacaagguggagaccuucagcgagagcagaaucuucaacgagcugaagaccaagaugcugaacaucaaggaguacaaggagaagcugcugagcacccugggcgaguuccuggaggaccacuucccccugcccgacagaagcgugaagaagaagaagaagaacauccaggagagcagcgugaaccugaucacccugcacgagaugcuggagauccugaucaacagacuguucgacgugccccacgaccccuacgugaagaucagcgacagcuucuggccccccuacguggagcugcugcugagaaacggcaucgcccugagacaccccgaggaccccaccagaaucagacuggaggccuuccaccaguaa

SEQ ID NO: 15076 - RNA, 1062 nt, Artificial Sequence
  CENPN__Homo_sapiens__NP_001094095
auggacgagaccguggccgaguucaucaagagaaccauccugaagauccccaugaacgagcugaccaccauccugaaggccugggacuuccugagcgagaaccagcugcagaccgugaacuucagacagagaaaggagagcguggugcagcaccugauccaccugugcgaggagaagagagccagcaucagcgacgccgcccugcuggacaucaucuacaugcaguuccaccagcaccagaaggugugggagguguuccagaugagcaagggccccggcgaggacguggaccuguucgacaugaagcaguucaagaacagcuucaagaagauccugcagagagcccugaagaacgugaccgugagcuucagagagaccgaggagaacgccguguggaucagaaucgccuggggcacccaguacaccaagcccaaccaguacaagcccaccuacgugguguacuacagccagacccccuacgccuucaccagcagcagcaugcugagaagaaacaccccccugcugggccaggcccugaccaucgccagcaagcaccaccagaucgugaagauggaccugagaagcagauaccuggacagccugaaggccaucguguucaagcaguacaaccagaccuucgagacccacaacagcaccaccccccugcaggagagaagccugggccuggacaucaacauggacagcagaaucauccacgagaacaucguggagaaggagagagugcagagaaucacccaggagaccuucggcgacuacccccagccccagcuggaguucgcccaguacaagcuggagaccaaguucaagagcggccugaacggcagcauccuggccgagagagaggagccccugagaugccugaucaaguucagcagcccccaccugcuggaggcccugaagagccuggcccccgccgcccuggugugcagaauccagaagcugcugugcuacagcggcagccacagccagggcacccaggaccccagcagcuggcagaaggaccuguaccugcuguucgugccccuguaccccagaugcuaa

SEQ ID NO: 15077 - RNA, 885 nt, Artificial Sequence
  CENPO__Homo_sapiens__NP_001186732
auggccggcauccuggccagcggccugggcgugcuggcccaccuggagagacuggagacccaggugagcagaagcagaaagcagagcgaggagcugcagagcgugcaggcccaggagggcgcccugggcaccaagauccacaagcugagaagacugagagacgagcugagagccguggugagacacagaagagccagcgugaaggccugcaucgccaacguggagcccaaccagaccguggagaucaacgagcaggaggcccuggaggagaagcuggagaacgugaaggccauccugcaggccuaccacuucaccggccugagcggcaagcugaccagcagaggcgugugcgugugcaucagcaccgccuucgagggcaaccugcuggacagcuacuucguggaccuggugauccagaagccccugagaauccaccaccacagcgugcccguguucaucccccuggaggagaucgccgccaaguaccugcagaccaacauccagcacuuccuguucagccugugcgaguaccugaacgccuacagcggcagaaaguaccaggccgacagacugcagagcgacuucgccgcccugcugaccggcccccugcagagaaacccccugugcaaccugcugagcuucaccuacaagcuggaccccggcggccagagcuuccccuucugcgccagacugcuguacaaggaccugaccgccacccugcccaccgacgugaccgugaccugccagggcguggaggugcugagcaccagcugggaggagcagagagccagccacgagacccuguucugcaccaagccccugcaccagguguucgccagcuucaccagaaagggcgagaagcuggacaugagccuggugagcuaa

SEQ ID NO: 15078 - RNA, 807 nt, Artificial Sequence
  CENPQ__Homo_sapiens__NP_060602
augagcggcaaggccaacgccagcaagaagaacgcccagcagcugaagagaaaccccaagagaaagaaggacaacgaggagguggugcugagcgagaacaaggugagaaacaccgugaagaagaacaagaaccaccugaaggaccugagcagcgagggccagaccaagcacaccaaccugaagcacggcaagaccgccgccagcaagagaaagaccuggcagccccugagcaagagcaccagagaccaccugcagaccaugauggagagcgugaucaugaccauccugagcaacagcaucaaggagaaggaggagauccaguaccaccugaacuuccugaagaagagacugcugcagcagugcgagacccugaaggugccccccaagaagauggaggaccugaccaacgugagcagccugcugaacauggagagagccagagacaaggccaacgaggagggccuggcccugcugcaggaggagaucgacaagaugguggagaccaccgagcugaugaccggcaacauccagagccugaagaacaagauccagauccuggccagcgagguggaggaggaggaggagagagugaagcagaugcaccagaucaacagcagcggcgugcugagccugcccgagcugagccagaagacccugaaggcccccacccugcagaaggagauccuggcccugauccccaaccagaacgcccugcugaaggaccuggacauccugcacaacagcagccagaugaagagcaugagcaccuucaucgaggaggccuacaagaagcuggacgccagcuaa

SEQ ID NO: 15079 - RNA, 1257 nt, Artificial Sequence
  CENPU__Homo_sapiens__NP_078905
auggcccccagaggcagaagaagacccagaccccacagaagcgagggcgccagaagaagcaagaacacccuggagagaacccacagcaugaaggacaaggccggccagaagugcaagcccaucgacguguucgacuuccccgacaacagcgacgugagcagcaucggcagacugggcgagaacgagaaggacgaggagaccuacgagaccuucgaccccccccugcacagcaccgccaucuacgccgacgaggaggaguucagcaagcacugcggccugagccugagcagcaccccccccggcaaggaggccaagagaagcagcgacaccagcggcaacgaggccagcgagaucgagagcgugaagaucagcgccaagaagcccggcagaaagcugagacccaucagcgacgacagcgagagcaucgaggagagcgacaccagaagaaaggugaagagcgccgagaagaucagcacccagagacacgaggugaucagaaccaccgccagcagcgagcugagcgagaagcccgccgagagcgugaccagcaagaagaccggcccccugagcgcccagcccagcguggagaaggagaaccuggccaucgagagccagagcaagacccagaagaagggcaagaucagccacgacaagagaaagaagagcagaagcaaggccaucggcagcgacaccagcgacaucgugcacaucuggugccccgagggcaugaagaccagcgacaucaaggagcugaacaucgugcugcccgaguucgagaagacccaccuggagcaccagcagagaaucgagagcaaggugugcaaggccgccaucgccaccuucuacgugaacgugaaggagcaguucaucaagaugcugaaggagagccagaugcugaccaaccugaagagaaagaacgccaagaugaucagcgacaucgagaagaagagacagagaaugaucgaggugcaggacgagcugcugagacuggagccccagcugaagcagcugcagaccaaguacgacgagcugaaggagagaaagagcagccugagaaacgccgccuacuuccugagcaaccugaagcagcuguaccaggacuacagcgacgugcaggcccaggagcccaacgugaaggagaccuacgacagcagcagccugcccgcccugcuguucaaggccagaacccugcugggcgccgagagccaccugagaaacaucaaccaccagcuggagaagcugcuggaccagggcuaa

SEQ ID NO: 15080 - RNA, 819 nt, Artificial Sequence
  CENPV__Homo_sapiens__NP_859067
augagaagaagcagaagcagcgccgccgccaagcugagaggccagaagagaagcggcgccagcgccgcccccgccgccagcgccgccgccgcccuggcccccagcgccaccagaaccagaagaagcgccagccaggccggcagcaagagccaggccguggagaagccccccagcgagaagcccagacugagaagaagcagccccagagcccaggaggagggccccggcgagccccccccccccgagcuggcccugcugccccccccccccccccccccccccacccccgccacccccaccagcagcgccagcaaccuggaccugggcgagcagagagagagaugggagaccuuccagaagagacagaagcugaccagcgagggcgccgccaagcugcugcuggacaccuucgaguaccagggccuggugaagcacaccggcggcugccacugcggcgccgugagauucgaggugugggccagcgccgaccugcacaucuucgacugcaacugcagcaucugcaagaagaagcagaacagacacuucaucgugcccgccagcagauucaagcugcugaagggcgccgagcacaucaccaccuacaccuucaacacccacaaggcccagcacaccuucugcaagagaugcggcgugcagagcuucuacacccccagaagcaaccccggcggcuucggcaucgccccccacugccuggacgagggcaccgugagaagcauggugaccgaggaguucaacggcagcgacugggagaaggccaugaaggagcacaagaccaucaagaacaugagcaaggaguaa

SEQ ID NO: 15081 - RNA, 267 nt, Artificial Sequence
  CENPW__Homo_sapiens__NP_001012525
auggcccugagcaccaucgugagccagagaaagcagaucaagagaaaggcccccagaggcuuccugaagagaguguucaagagaaagaagccccagcugagacuggagaagagcggcgaccugcuggugcaccugaacugccugcuguucgugcacagacuggccgaggagagcagaaccaacgccugcgccagcaagugcagagugaucaacaaggagcacgugcuggccgccgccaaggugauccugaagaagagcagaggcuaa

SEQ ID NO: 15082 - RNA, 636 nt, Artificial Sequence
  CEP112__Homo_sapiens__NP_001032402
augugggccagccugagccuggaccaccccagcgccaaggagaaccaggcccugagacugaucgagaugagagaggagaacggcaacgugcccaagaccgagcaggccggcagccugaagccccugagagacaccggcaagagcaaccugaaggagaagaaggccaacagcaagcugaagcagaucgagaaggaguacacccagaagcuggccaagagcagccagaucaucgccgagcugcagaccaccaucagcagccugaaggaggagaacagccagcagcagcuggccgccgagagaagacugcaggacgugagacagaaguucgaggacgagaagaagcagcugaucagagacaacgaccaggccaucaaggugcugcaggacgagcuggagaacagaagcaaccaggugagaugcgccgagaagaagcugcagcacaaggagcuggagagccaggagcagaucaccuacaucagacaggaguacgagaccaagcugaagggccugaugcccgccagccugagacaggagcuggaggacaccaucagcagccugaagagccaggugaacuuccugcagaagagagccagcauccugcaggaggagcugaccaccuaccagggcagaagauaa

SEQ ID NO: 15083 - RNA, 2883 nt, Artificial Sequence
  CEP120__Homo_sapiens__NP_001159698
augcuggugguggaggccaaguucgacggcgagcagcuggccaccgaccccguggaccacaccgaccagcccgaguucgccaccgagcuggccugggagaucgacagaaaggcccugcaccagcacagacugcagagaacccccaucaagcugcagugcuucgcccuggaccccgugaccagcgccaaggagaccaucggcuacaucgugcuggaccugagaaccgcccaggagaccaagcaggcccccaagugguaccagcugcugagcaacaaguacaccaaguucaagagcgagauccagaucagcaucgcccuggagaccgacaccaagccccccguggacagcuucaaggccaagggcgccccccccagagacggcaaggugcccgccauccuggccggccuggaccccagagacaucguggccgugcugaacgaggagggcggcuaccaccagaucggccccgccgaguacugcaccgacagcuucaucaugagcgugaccaucgccuucgccacccagcuggagcagcugauccccugcaccaugaagcugcccgagagacagcccgaguucuucuucuacuacagccugcugggcaacgacgugaccaacgagcccuucaacgaccugaucaaccccaacuucgagcccgagagagccagcgugagaaucagaagcagcguggagauccugagaguguaccuggcccugcagagcaagcugcagauccaccugugcugcggcgaccagagccugggcagcaccgagaucccccugaccggccugcugaagaagggcagcaccgagaucaaccagcaccccgugaccguggagggcgccuucacccuggacccccccaacagagccaagcagaagcuggcccccauccccguggagcuggcccccaccgugggcgugagcguggcccugcagagagagggcaucgacagccagagccugaucgagcugaagacccagaacgagcacgagcccgagcacagcaagaagaaggugcugacccccaucaaggagaagacccugaccggccccaagagccccaccgugagccccgugcccagccacaaccagagcccccccaccaaggacgacgccaccgagagcgagguggagagccugcaguacgacaaggacaccaagcccaaccccaaggccagcagcagcgugcccgccagccuggcccagcuggugaccaccagcaacgccagcgagguggccagcggccagaagaucgccgugcccgccaccagccaccacuucugcuucagcaucgaccugagaagcauccacgcccuggagaucggcuuccccaucaacugcauccugagauacagcuaccccuucuucggcagcgccgcccccaucaugaccaacccccccguggaggugagaaagaacauggagguguuccugccccagagcuacugcgccuucgacuucgccaccaugccccaccagcugcaggacaccuuccugagaaucccccugcugguggagcuguggcacaaggacaagaugagcaaggaccugcugcugggcaucgccagaauccagcugagcaacauccugagcagcgagaagaccagauuccugggcagcaacggcgagcagugcuggagacagaccuacagcgagagcgugcccgugaucgccgcccagggcagcaacaacagaaucgccgaccugagcuacaccgugacccuggaggacuacggccuggugaagaugagagagaucuucaucagcgacagcagccagggcgugagcgccgugcagcagaagcccagcagccugccccccgcccccugccccagcgagauccagaccgagcccagagagacccuggaguacaaggccgcccuggagcuggagauguggaaggagaugcaggaggacaucuucgagaaccagcugaagcagaaggagcuggcccacaugcaggcccuggccgaggaguggaagaagagagacagagagagagagagccuggugaagaagaagguggccgaguacaccauccuggagggcaagcugcagaagacccugaucgaccuggagaagagagagcagcagcuggccagcguggagagcgagcugcagagagagaagaaggagcugcagagcgagagacagagaaaccugcaggagcugcaggacagcaucagaagagccaaggaggacugcauccaccagguggagcuggagagacugaagaucaagcagcuggaggaggacaagcacagacugcagcagcagcugaacgacgccgagaacaaguacaagauccuggagaaggaguuccagcaguucaaggaccagcagaacaacaagcccgagaucagacugcagagcgagaucaaccugcugacccuggagaagguggagcuggagagaaagcuggagagcgccaccaagagcaagcugcacuacaagcagcaguggggcagagcccugaaggagcuggccagacugaagcagagagagcaggagagccagauggccagacugaagaagcagcaggaggagcuggagcagaugagacugagauaccuggccgccgaggagaaggacaccgugaagaccgagagacaggagcugcuggacaucagaaacgagcugaacagacugagacagcaggagcagaagcaguaccaggacagcaccgagaucgccagcggcaagaaggacggcccccacggcagcgugcuggaggagggccuggacgacuaccugaccagacugaucgaggagagagacacccugaugagaaccggcguguacaaccacgaggacagaaucaucagcgagcuggacagacagaucagagagauccuggccaagagcaacgccagcaacuaa

SEQ ID NO: 15084 - RNA, 3285 nt, Artificial Sequence
  CEP128__Homo_sapiens__XP_006720119
auggccgagagcagcagcgagagcgaccacuucagaugcagagacagacugagccccugggccgccagaagcacccacagaggcaccagaagccugcccaccguggaggugaccgagaaggugaacaccaucaccagcacccugcaggacaccagcagaaaccugagacagguggaccagaugcugggcagauacagagaguacagcaacggccaggccggcgccaucgagcaccugaaggagagccuggagcagagcaucgaccagcugagaagccagagacugcugagaaacagcggcggcagaagcaucagcgugaccagccugagcgccagcgaccuggacggcggcaccggcagcgagcugcaccacuucccccccaccagcccccugaaggacuacggcgacccccagggcaucaagagaaugagaagcagaaccggcgugagauucgugcaggagaccgacgacaugacccagcugcacggcuuccaccagagccugagagaccugagcagcgagcagaucagacugggcgacgacuucaacagagagcugagcagaagaagcagaagcgacgccgagaccaagagagcccuggaggagcugaccgagaagcugaacgaggcccagaagcaggagguggugagcgacagaguggagagaagacugcaggagcuggagagagagaugagaaccgagagagagcugguggagagaagacaggaccagcugggccugaugagccugcagcugcaggaggcccugaagaagcaggaggccaaggccgacgagcacgagggcgccaucaagaacaagcugagacagaccgagaccgagaagaaccagcuggagcaggagcuggagcugagcagaagacugcugaaccagagcgagggcagcagagagacccugcugcaccagguggaggagcugagaacccagcugaccaaggccgagggcgacagaaagggccugcagcaccaggugagccagaucagcaagcagcagagcaacuaccaggacgagcagggcgaggacuggagauucagaagaggcguggagagagagaagcaggaccuggagaagcagaugagcgaccugagagugcagcugaacuucagcgccauggccagcgagcuggaggaggugaagagaugcauggagagaaaggacaaggagaaggcccaccuggccagccagguggagaaccugaccagagagcuggagaacggcgagaagcagcagcugcagaugcuggacagacugaaggagauccagaaccacuucgacaccugcgaggccgagagaaagcacgccgaccugcagaucagcgagcugaccagacacgccgaggacgccaccaagcaggccgagagauaccugagcgagcugcagcagagcgaggcccugaaggaggaggccgagaagagaagagaggaccugaagcugaaggcccaggagagcaucagacaguggaagcugaagcacaagaagcuggagagagcccuggagaagcagagcgagaccguggacgagcugaccggcaagaacaaccagauccugaaggagaaggacgagcugaagacccagcuguacgccgcccugcagcagaucgagaaccugagaaaggagcugaacgacgugcugaccaagagagcccugcaggaggaggagcugcacagcaaggaggagaagcugagagacaucaagagccaccaggccgaccuggagcuggaggugaagaacagccuggacaccauccacagacuggagagcgagcugaagaagcagagcaagauccagagccagaugaagguggagaaggcccaccuggaggaggagaucgccgagcugaagaagagccaggcccaggacaaggccaagcugcuggagaugcaggagagcaucaaggaccugagcgccaucagagccgaccuggccaacaagcuggccgaggaggagagagccaagaaggccgugcugaaggaccugagcgaccugaccgcccaggccaagagcagagacgaggagaccgccaccaucaucacccagcugaagcuggagagagacgugcaccagagagagcugaaggaccugaccagcagccugcagagcgugaagaccaagcacgagcagaacauccaggagcugaugaagcacuucaagaaggagaagagcgaggccgagaaccacaucagaacccugaaggccgagagccuggaggagaagaacauggccaagauccacagaggccagcuggagaagcugaagagccagugcgacagacugaccgaggagcugacccagaacgagaacgagaacaagaagcugaagcugaaguaccagugccugaaggaccagcuggaggagagagagaagcacaucagcaucgaggaggagcaccugagaagaauggaggaggccagacugcagcugaaggaccagcugcugugccuggagaccgagcaggagagcauccugggcgugaucggcaaggagaucgacgccgccugcaagaccuucagcaaggacagcguggagaagcugaagguguucagcagcggccccgacauccacuacgacccccacagauggcuggccgagagcaagaccaagcugcaguggcugugcgaggagcugaaggagagagagaacagagagaagaaccugagacaccagcugaugcugugcagacagcagcugagaaaccugaccgagaacaaggagagcgagcugcagugccuguuccagcagaucgagagacaggagcagcugcuggacgagauccacagagagaagagagaccugcuggaggagacccagagaaaggacgaggagaugggcagccugcaggacagagugaucgcccuggagaccagcacccagguggcccuggaccaccuggagagcgugcccgagaagcugagccugcuggaggacuucaaggacuucagagacagcugcagcagcagcgagagaaccgacggcagauacagcaaguacagagugagaagaaacagccugcagcaccaccaggacgacaccaaguacagaaccaagagcuucaagggcgacagaaccuuccuggagggcagccacaccagaggccuggaccacagcagcagcuggcaggaccacagcagauuccugagcagccccagauucagcuacgugaacagcuucaccaagagaaccguggcccccgacagcgccagcaacaaggaggacgccaccaugaacggcaccagcagccagcccaagaaggaggaguacggcagcuaa

SEQ ID NO: 15085 - RNA, 3135 nt, Artificial Sequence
  CEP131__Homo_sapiens__NP_001009811
augaagggcaccagagccaucggcagcgugcccgagagaagccccgccggcguggaccugagccugaccggccugcccccccccgugagcagaagacccggcagcgccgccaccaccaagcccaucgugagaagcgugagcguggugaccggcagcgagcagaagagaaaggugcuggaggccaccggccccggcggcagccaggccaucaacaaccugagaagaagcaacagcaccacccaggugagccagcccagaagcggcagccccagacccaccgagcccaccgacuuccugaugcuguucgagggcagccccagcggcaagaagagacccgccagccugagcaccgcccccagcgagaagggcgccaccuggaacgugcuggacgaccagcccagaggcuucacccugcccagcaacgccagaagcagcagcgcccuggacagccccgccggccccagaagaaaggagugcaccguggcccuggcccccaacuucaccgccaacaacagaagcaacaagggcgccgugggcaacugcgugaccaccauggugcacaacagauacacccccagcgagagagcccccccccugaagagcagcaaccagaccgcccccagccugaacaacaucaucaaggccgccaccugcgagggcagcgagagcagcggcuucggcaagcugcccaagaacgugagcagcgccacccacagcgccagaaacaacaccggcggcagcaccggccugcccagaagaaaggaggugaccgaggaggaggccgagagauucauccaccaggugaaccaggccaccgugaccauccagagaugguacagacaccaggugcagagaagaggcgccggcgccgccagacuggagcaccugcugcaggccaagagagaggagcagagacagagaagcggcgagggcacccugcuggaccugcaccagcagaaggaggccgccagaagaaaggccagagaggagaaggccagacaggccagaagagccgccauccaggagcugcagcagaagagagcccugagagcccagaaggccagcaccgccgagagaggcccccccgagaaccccagagagaccagagugcccggcaugagacagcccgcccaggagcugagccccacccccggcggcaccgcccaccaggcccugaaggccaacaacaccggcggcggccugcccgccgccggccccggcgacagaugccugcccaccagcgacagcagccccgagccccagcagccccccgaggacagaacccaggacgugcuggcccaggacgccgccggcgacaaccuggagaugauggcccccagcagaggcagcgccaagagcagaggcccccuggaggagcugcugcacacccugcagcugcuggagaaggagcccgacgugcugcccagacccagaacccaccacagaggcagauacgccugggccagcgaggaggacgacgccagcagccugaccgccgacaaccuggagaaguucggcaagcugagcgccuuccccgagccccccgaggacggcacccugcugagcgaggccaagcugcagagcaucaugagcuuccuggacgagauggagaagagcggccaggaccagcuggacagccagcaggagggcugggugcccgaggccggccccggcccccuggagcugggcagcgaggugagcaccagcgugaugagacugaagcuggagguggaggagaagaagcaggccaugcugcugcugcagagagcccuggcccagcagagagaccugaccgccagaagagugaaggagaccgagaaggcccugagcagacagcugcagagacagagagagcacuacgaggccaccauccagagacaccuggccuucaucgaccagcugaucgaggacaagaaggugcugagcgagaagugcgaggccgugguggccgagcugaagcaggaggaccagagaugcaccgagagaguggcccaggcccaggcccagcacgagcuggagaucaagaagcugaaggagcugaugagcgccaccgagaaggccagaagagagaaguggaucagcgagaagaccaagaagaucaaggaggugaccgugagaggccuggagcccgagauccagaagcugaucgccagacacaagcaggaggugagaagacugaagagccugcacgaggccgagcugcugcagagcgacgagagagccagccagagaugccugagacaggccgaggagcugagagagcagcuggagagagagaaggaggcccugggccagcaggagagagagagagccagacagagacagagagccgagcuggaggagcugagacagcagcuggaggagagcagcagcgcccugaccagagcccugagagccgaguucgagaagggcagagaggagcaggagagaagacaccagauggagcugaacacccugaagcagcagcuggagcuggagagacaggccugggaggccggcagaaccagaaaggaggaggccuggcugcugaacagagagcaggagcugagagaggagaucagaaagggcagagacaaggagaucgagcuggugauccacagacuggaggccgacauggcccuggccaaggaggagagcgagaaggccgccgagagcagaaucaagagacugagagacaaguacgaggccgagcugagcgagcuggagcagagcgagagaaagcugcaggagagaugcagcgagcugaagggccagcugggcgaggccgagggcgagaaccugagacugcagggccuggugagacagaaggagagagcccuggaggacgcccaggccgugaacgagcagcugagcagcgagagaagcaaccuggcccaggugaucagacaggaguucgaggacagacuggccgccagcgaggaggagaccagacaggccaaggccgagcuggccacccugcaggccagacagcagcuggagcuggaggaggugcacagaagagugaagaccgcccuggccagaaaggaggaggccgugagcagccugagaacccagcacgaggccgccgugaagagagccgaccaccuggaggagcugcuggagcagcacagaagacccacccccagcaccaaguaa

SEQ ID NO: 15086 - RNA, 3423 nt, Artificial Sequence
  CEP135__Homo_sapiens__NP_079285
augaccaccgccguggagagaaaguacaucaacaucagaaagagacuggaccagcugggcuacagacagacccugaccguggagugccugccccugguggagaagcuguucagcgaccuggugcacaccaccgagagccugagacagagcaagcugagcgccgugaaggccgagaaggagagcgccaacuucgacuucgugcuggagcccuacaagcuggagaacgccagacugagcagagagaacaacgagcuguaccuggagcugaugaagcugagagagcacagcgaccagcacgugaaggagcugaagaccagccugaagaagugcgccagagagaccgccgaccugaaguuccugaacaaccaguacgcccacaagcugaagcugcuggagaaggagagcaaggccaagaacgagagaauccagcagcugcaggagaagaaccugcacgccguggugcagacccccggcggcaagaagagaagcaucgccuucagaagacagagaaugcagaucgacgagcccgugccccccagcgaggugagcagcuaccccgugccccagcccgacgaccccuacaucgccgaccugcugcagguggccgacaacagaauccaggagcugcagcaggaggugcaccagcugcaggagaagcuggccaugauggagagcggcgugagagacuacagcaagcagaucgagcugagagagagagagaucgagagacugagcguggcccuggacggcggcagaagccccgacgugcugagccuggagagcagaaacaagaccaacgagaagcugaucgcccaccugaacauccagguggacuuccugcagcaggccaacaaggaccuggagaagagaaucagagagcugauggagaccaaggagaccgugaccagcgagguggugaaccugagcaacaagaacgagaagcugugccaggagcugaccgagaucgaccagcuggcccagcagcuggagagacacaaggaggaggugcuggagaccgccgacaaggagcugggcgaggccaagaaggagaucaagagaaagcugagcgagaugcaggaccuggaggagaccauggccaagcugcagcuggagcugaaccugugccagaaggagaaggagagacugagcgacgagcugcuggugaagagcgaccuggagaccguggugcaccagcuggagcaggagaagcagagacugagcaagaagguggagagcuucgccgugaccgagagacagcugacccuggagguggagagaaugagacuggagcacggcaucaagagaagagacagaagccccagcagacuggacaccuuccugaagggcaucgaggaggagagagacuacuacaagaaggagcuggagagacugcagcacaucauccagagaagaagcugcagcaccagcuacagcgccagagagaagagcagcaucuucagaacccccgagaagggcgacuacaacagcgagauccaccagaucaccagagagagagacgagcugcagagaaugcuggagagauucgagaaguacauggaggacauccagagcaacgugaagcugcugaccgccgagagagacaagcugagcgugcuguacaacgaggcccaggaggagcugagcgcccugagaaaggagagcacccagaccaccgccccccacaacaucgugagccugauggagaaggagaaggagcuggcccugagcgaccugagaagaaucauggccgagaaggaggcccugagagagaagcuggagcacaucgaggaggugagccuguucggcaagagcgagcuggagaagaccaucgagcaccugaccugcgugaaccaccagcuggagagcgagaaguacgagcugaagagcaaggugcugaucaugaaggagaccaucgagagccuggagaacaagcugaaggugcaggcccagaaguucagccacguggccggcgacagcagccaccagaagaccgaggugaacagccugagaaucgugaacgagcagcugcagagaagcguggacgacuaccagcacagacugagcaucaagagaggcgagcuggagagcgcccaggcccagaucaagauccuggaggagaagaucgacgagcugaaccugaagaugaccagccaggacgaggaggcccacgugaugaagaagaccaucggcgugaucgacaaggagaaggacuuccugcaggagaccguggacgagaagaccgagaagaucgccaaccugcaggagaaccuggccaacaaggagaaggccguggcccagaugaagaucaugaucagcgagugcgagagcagcgugaaccagcugaaggagacccuggugaacagagacagagagaucaacagccugagaagacagcuggacgccgcccacaaggagcuggacgaggugggcagaagcagagagaucgccuucaaggagaacagaagacugcaggacgaccuggccaccauggccagagagaaccaggagaucagccuggagcuggaggccgccgugcaggagaaggaggagaugaagagcagagugcacaaguacaucaccgaggugagcagaugggagagccugauggccgccaaggagaaggagaaccaggaccugcuggacagauuccagaugcugcacaacagagccgaggacugggaggugaaggcccaccaggccgagggcgagagcagcagcgugagacuggagcugcugagcaucgacaccgagagaagacaccugagagagagaguggagcugcuggagaaggagauccaggagcacaucaacgcccaccacgccuacgagagccagaucagcagcauggccaaggccaugagcagacuggaggaggagcugagacaccaggaggacgagaaggccaccgugcugaacgaccugagcagccugagagagcugugcaucaagcuggacagcggcaaggacaucaugacccagcagcugaacagcaagaaccuggaguucgagagaguggugguggagcuggagaacgugaagagcgagagcgaccugcugaagaagcagcugagcaacgagagacacaccgugaagaaccuggagagccugcuggccaccaacagagacaaggaguuccacagccaccugaccagccacgagaaggacaccgagauccagcugcugaaggagaagcugacccugagcgagagcaagcugaccagccagagcagagagaacaccaugcugagagccaagguggcccagcugcagaccgacuacgacgcccugaagagacagaucagcaccgagagauacgagagagagagagccauccaggagaugagaagacacggccuggccacccccccccugagcagcacccugagaagccccagccacagccccgagcacagaaacguguaa

SEQ ID NO: 15087 - RNA, 4965 nt, Artificial Sequence
  CEP152__Homo_sapiens__NP_055800
augagccuggacuucggcagcguggcccugcccgugcagaacgaggacgaggaguacgacgaggaggacuacgagagagagaaggagcugcagcagcugcugaccgaccugccccacgacaugcuggacgacgaccugagcagccccgagcugcaguacagcgacugcagcgaggacggcaccgacggccagccccaccaccccgagcagcuggagaugagcuggaacgagcagaugcugcccaagagccagagcgugaacggcuacaacgagauccagagccuguacgccggcgagaagugcggcaacgugugggaggagaacagaagcaagaccgaggacagacaccccguguaccaccccgaggagggcggcgacgagggcggcagcggcuacagcccccccagcaagugcgagcagaccgaccuguaccaccugcccgagaacuucagacccuacaccaacggccagaagcaggaguucaacaaccaggccaccaacgugaucaaguucagcgacccccaguggaaccacuuccagggccccagcugccagggccuggagcccuacaacaaggugaccuacaagcccuaccagagcagcgcccagaacaacggcagccccgcccaggagaucaccggcagcgacaccuucgagggccugcagcagcaguuccugggcgccaacgagaacagcgccgagaacaugcagaucauccagcugcaggugcugaacaaggccaaggagagacagcuggagaaccugaucgagaagcugaacgagagcgagagacagaucagauaccugaaccaccagcuggugaucaucaaggacgagaaggacggccugacccugagccugagagagagccagaagcuguuccagaacggcaaggagagagagauccagcuggaggcccagaucaaggcccuggagacccagauccaggcccugaaggugaacgaggagcagaugaucaagaagagcagaaccaccgagauggcccuggagagccugaagcagcagcugguggaccugcaccacagcgagagccugcagagagccagagagcagcacgagagcaucgugaugggccugaccaagaaguacgaggagcaggugcugagccugcagaagaaccuggacgccaccgugaccgcccugaaggagcaggaggacaucugcagcagacugaaggaccacgugaagcagcuggagagaaaccaggaggccaucaagcuggagaagaccgagaucaucaacaagcugaccagaagccuggaggagagccagaagcagugcgcccaccugcugcagagcggcagcgugcaggagguggcccagcugcaguuccagcugcagcaggcccagaaggcccacgccaugagcgccaacaugaacaaggcccugcaggaggagcugaccgagcugaaggacgagaucagccuguacgagagcgccgccaagcugggcauccaccccagcgacagcgagggcgagcugaacaucgagcugaccgagagcuacguggaccugggcaucaagaaggugaacuggaagaagagcaaggugaccagcaucgugcaggaggaggaccccaacgaggagcugagcaaggacgaguucauccugaagcugaaggccgaggugcagagacugcugggcagcaacagcaugaagagacaccuggugagccagcugcagaacgaccugaaggacugccacaagaagaucgaggaccugcaccaggugaagaaggacgagaagagcaucgagguggagaccaagaccgacaccagcgagaagcccaagaaccagcuguggcccgagagcagcaccagcgacguggugagagacgacauccugcugcugaagaacgagauccaggugcugcagcagcagaaccaggagcugaaggagaccgagggcaagcugagaaacaccaaccaggaccugugcaaccagaugagacagauggugcaggacuucgaccacgacaagcaggaggccguggacagaugcgagagaaccuaccagcagcaccacgaggccaugaagacccagaucagagagagccugcuggccaagcacgcccuggagaagcagcagcuguucgaggccuacgagagaacccaccugcagcugagaagcgagcuggacaagcugaacaaggaggugaccgccgugcaggagugcuaccuggaggugugcagagagaaggacaaccuggagcugacccugagaaagaccaccgagaaggagcagcagacccaggagaagaucaaggagaagcugauccagcagcuggagaaggaguggcagagcaagcuggaccagaccaucaaggccaugaagaagaagacccuggacugcggcagccagaccgaccaggugaccaccagcgacgugaucagcaagaaggagauggccaucaugaucgaggagcagaagugcaccauccagcagaaccuggagcaggagaaggacaucgccaucaagggcgccaugaagaagcuggagaucgagcuggagcugaagcacugcgagaacaucaccaagcagguggagaucgccgugcagaacgcccaccagagauggcugggcgagcugcccgagcuggccgaguaccaggcccuggugaaggccgagcagaagaagugggaggagcagcacgaggugagcgugaacaagagaaucagcuucgccgugagcgaggccaaggagaaguggaagagcgagcuggagaacaugagaaagaacauccugcccggcaaggagcuggaggagaagauccacagccugcagaaggagcuggagcugaagaacgaggaggugcccguggugaucagagccgagcuggccaaggccagaagcgaguggaacaaggagaagcaggaggagauccacagaauccaggagcagaacgagcaggacuacagacaguuccuggacgaccacagaaacaagaucaacgaggugcuggccgccgccaaggaggacuucaugaagcagaagaccgagcugcugcugcagaaggagaccgagcugcagaccugccuggaccagagcagaagagaguggaccaugcaggaggccaagagaauccagcuggagaucuaccaguacgaggaggacauccugaccgugcugggcgugcugcugagcgacacccagaaggagcacaucagcgacagcgaggacaagcagcugcuggagaucaugagcaccugcagcagcaaguggaugagcgugcaguacuucgagaagcugaagggcugcauccagaaggccuuccaggacacccugccccugcugguggagaacgccgaccccgaguggaagaagagaaacauggccgagcugagcaaggacagcgccagccagggcaccggccagggcgaccccggccccgccgccggccaccacgcccagccccuggcccugcaggccaccgaggccgaggccgaggagaacaacaaggugguggaggagcugaucgaggagaacaacgacaugaagaacaagcuggaggagcugcagacccugugcaagaccccccccagaagccugagcgccggcgccaucgagaacgccugccugcccugcagcggcggcgcccuggaggagcugagaggccaguacaucaaggccgugaagaagaucaagugcgacaugcugagauacauccaggagagcaaggagagagccgccgagauggugaaggccgaggugcugagagagagacaggagaccgccagaaagaugagaaaguacuaccugaucugccugcagcagauccugcaggacgacggcaaggagggcgccgagaagaagaucaugaacgccgccagcaagcuggccaccauggccaagcugcuggagacccccaucagcagcaagagccagagcaagaccacccagagcgcccugccccugaccagcgagaugcugaucgccgugaagaagagcaagagaaacgacgugaaccagaagauccccugcugcaucgagagcaagagcaacagcgugaacaccaucaccagaacccugugcgagcaggcccccaagagaagagccgccugcaaccugcagagacugcuggagaacagcgagcaccagagcaucaagcacgugggcagcaaggagacccaccuggaguuccaguucggcgacggcagcugcaagcaccugaacagccugcccagaaacgugagccccgaguucgugcccugcgagggcgagggcggcuucggccugcacaagaagaaggaccugcugagcgacaacggcagcgagagccugccccacagcgccgccuaccccuuccugggcacccugggcaacaagcccagccccagaugcacccccggccccagcgagagcggcugcaugcacaucaccuucagagacagcaacgagagacugggccugaagguguacaagugcaacccccugauggagagcgagaacgccgccagcgagaagagccagggccuggacgugcaggagccccccgugaaggacggcggcgaccugagcgacugccugggcuggcccagcagcagcgccacccugagcuucgacagcagagaggccagcuucgugcacggcagaccccagggcacccuggagauccccagcgagagcgugaagagcaagcaguucagccccagcggcuaccugagcgacaccgaggagagcaacaugaucugccagaccaugaagugccagagauaccagacccccuaccugagcgaggagaccaccuaccuggagcccggcaagaucagcgugaacugcggccaccccagcagacacaaggccgacagacugaagagcgacuucaagaagcugagcagcacccugcccagcagcgugugccagcagcccagcagaaagcugaucgugccccugagcagccagcaggacagcggcuucgacagccccuucgugaaccuggacuaa

SEQ ID NO: 15088 - RNA, 4212 nt, Artificial Sequence
  CEP162__Homo_sapiens__NP_055710
auggccaacugcagccaggaggagcuggacgaggaguucgagcaguucaugaaggagcugagcgacgacagcuucgagaacagcgacaagaccgccagacagagcaagaaggagaugaagaagaaggacaccgugcccugguggaucaccgaggacgacuucaaggacgacggccugcugggcaccaacgugagcuaccugaagaccaagaagaccagccagcccgugauggagaucgaggaggagagcgccgagaagauccaguuccugaagagcagcggcaccagccugcugagcaccgacagccuggagaccaacgagcugguggugagcgagcugaaccacagcagccugggcgugggccuggacacccuggaggagcaggaggagaaggagcaguucuucgccagacuggagaagggccugaccagcagcaucgacuacagcagacugaacaaggagcuggacagcaacgacagcacccacuucaaggcccugcacagcaaccaggccaacgccgagcugaccgacgacgagcacgagaacgagagcaagcacgaggagcuggccgagaacuacagcgacgacuucgaggacgaguacgugggcgccccccugaccaccaaggacgaggagaugcccagcaaggagaacagcaagagcgagaagaucagcgugcccaagcaggaggaggagaagaccggcaugcuggccaacguggugcugcuggacagccuggacagcguggccgaggugaaccuggacgagcaggacaagaucacccccaagcccagaugccugcccgagaugaccgagaacgagaugaccggcaccggcgugagcuacggccagagcagcagcgacguggaggcccugcaccaggccuacugccacaucgcccacagccugggcgacgaggacaagcagaagaucgagagcaacaccguggaggacaucaagagcagcgugaagggccacccccaggagaacgaggagaacagcaagaacaucagcaccauggagagcgaccugcccaccguggaggagcugaugaagcccaucagaaucgacagcuucggcaucagcggcuucgaccugcagcccgugagcagcgagaagguggccgagagaaaggagaccgaguucuucagcagccugccccugaagaugaaccccaacauccugagccaggacagccagcacgugaaccuguucuucgacaagaacgacgagaacgugauccugcagaagaccaccaacgagagcauggagaacagcugcccccaggugaccgaggugaccgccaccgaggagcacguggacaagauguaccugaacauccugagaaagaagaucaccgugaacagcagcagccugagccaggacgacaagaucaacaagaccuacagaagccagcugagcagcgaggaggagggcgccgugaugggcaagcaggugcccuacaagaaggccagaagcgcccccccccugcugaagagaaagccccagagcggccuguacgccagcgugagaagcagcggcuacggcaagcccagcagcccccugaagauguucagcacccuggagaagaagaccagcgaggacaucaucaagagcaagaaccugagaagcaucagcaccagcaaccagcccagaaagaaggagauccugagcggcaccaagcugaucaagcccgccgcccuggacaagcccgcccacaagaccgagagcugccugagcaccagaaagaagagcgagaaccccaccgagaccgacagcugcauccaguuccagaccgacagccugggcuacugcggcgagaacaaggagaagaagcugcugauguucaagagagugcaggaggccgaggacaaguggagaggcgcccaggcccugaucgagcagaucaaggccaccuucagcgagaaggagaaggagcuggagaacaagcuggaggagcugaagaagcagcaggagaaggagcuguucaagcugaaccaggacaacuacauccugcaggccaagcugagcagcuucgaggagaccaacaagaagcagagauggcugcacuucggcgaggccgccgaccccgugaccggcgagaagcugaagcagauccagaaggagauccaggagcaggagacccugcugcagggcuaccagcaggagaacgagagacuguacaaccaggugaaggaccugcaggagcagaacaagaagaacgaggagagaauguucaaggagaaccagagccuguucagcgagguggccagccugaaggagcagaugcacaagagcagauuccugagccaggugguggaggacagcgagcccaccagaaaccagaacuucaccgaccugcuggccgagcugagaauggcccagaaggagaaggacagccugcuggaggacaucaagagacugaagcaggacaagcaggcccuggagguggacuucgagaagaugaagaaggagagagaccaggccaaggaccagaucgccuacgugaccggcgagaagcuguacgagaucaagauccuggaggagacccacaagcaggagaucagcagacugcagaagagacugcagugguacgccgagaaccaggagcugcuggacaaggacgcccugagacugagagaggccaacgaggagaucgagaagcugaagcuggagaucgagaagcugaaggccgagagcggcaaccccagcaucagacagaagaucagacugaaggacaaggccgccgacgccaagaagauccaggaccuggagagacaggugaaggagauggagggcauccugaagagaagauaccccaacagccugcccgcccugauccuggccgccagcgccgccggcgacaccguggacaagaacaccguggaguucauggagaagagaaucaagaagcuggaggccgaccuggagggcaaggacgaggacgccaagaagagccugagaaccauggagcagcaguuccagaagaugaagauccaguacgagcagagacuggagcagcaggagcagcugcuggccugcaagcugaaccagcacgacagccccagaaucaaggcccuggagaaggagcuggacgacaucaaggaggcccaccagaucaccgugagaaaccuggaggccgagaucgacgugcugaagcaccagaacgccgagcuggacgugaagaagaacgacaaggacgacgaggacuuccagagcaucgaguuccagguggagcaggcccacgccaaggccaagcuggugagacugaacgaggagcuggccgccaagaagagagagauccaggaccugagcaagaccguggagagacugcagaaggacagaagaaugaugcugagcaaccagaacagcaagggcagagaggagaugagcgccaagagagccaagaaggacgugcugcacagcagcaagggcaacgccaacagcuuccccggcacccuggacagcaagcuguaccagccccacaccuucaccgacagccacgugagcgaggugcugcaggagaacuacagacugaagaacgagcuggagggccugaucagcgagaagaacgagcugaagaugaagagcgaggccgugaugaaccaguucgagaacagcaugagaagagugaaggaggacaccgccgcccacaucgccagccugaaggccagccaccagagagagaucgagaagcugcugugccagaacgccguggagaacagcagcagcaagguggccgagcugaacagaaagaucgccacccaggaggugcugaucagacacuuccagagccaggugaacgagcugcagagcaagcaggagagccugguggugagcgaggugagagaggagauccugcagaaggagaucaccaagcugcuggaggagcugagagaggccaaggagaaccacacccccgagaugaagcacuucgugggccuggagaagaagaucaagcagauggagaugagacacgcccagagagagcaggagcugcagcagaucauccagcagacccaccaggugguggagaccgagcagaacaaggagguggagaaguggaagagacuggcccagcugaagaacagagagcuggagaaguucagaaccgagcuggacagcauccuggacgugcugagagagcugcacagacagggcgugguggugcccguggccuucgccgacgagaugaacgcccccgaguacuaa

SEQ ID NO: 15089 - RNA, 4368 nt, Artificial Sequence
  CEP164__Homo_sapiens__NP_001258862
auggccggcagaccccugagaaucggcgaccagcuggugcuggaggaggacuacgacgagaccuacauccccagcgagcaggagauccuggaguucgccagagagaucggcaucgaccccaucaaggagcccgagcugauguggcuggccagagagggcaucguggccccccugcccggcgaguggaagcccugccaggacaucaccggcgacaucuacuacuucaacuucgccaacggccagagcaugugggaccaccccugcgacgagcacuacagaagccuggugauccaggagagagccaagcugagcaccagcggcgccaucaagaagaagaagaagaagaaggagaagaaggacaagaaggacagagacccccccaagagcagccuggcccugggcagcagccuggcccccgugcacgugccccugggcggccuggccccccugagaggccugguggacaccccccccagcgcccugagaggcagccagagcgugagccugggcagcagcguggagagcggcagacagcugggcgagcugaugcugcccagccagggccugaagaccagcgccuacaccaagggccugcugggcagcaucuacgaggacaagaccgcccugagccugcugggccugggcgaggagaccaacgaggaggacgaggaggagagcgacaaccagagcgugcacagcagcagcgagccccugagaaaccugcaccuggacaucggcgcccugggcggcgacuucgaguacgaggagagccugagaaccagccagcccgaggagaagaaggacgugagccuggacagcgacgccgccggcccccccacccccugcaagcccagcagccccggcgccgacagcagccugagcagcgccgugggcaagggcagacagggcagcggcgccagacccggccugcccgagaaggaggagaacgagaagagcgagcccaagaucugcagaaaccuggugacccccaaggccgaccccaccggcagcgagcccgccaaggccagcgagaaggaggcccccgaggacaccguggacgccggcgaggagggcagcagaagagaggaggccgccaaggagcccaagaagaaggccagcgcccuggaggagggcagcagcgacgccagccaggagcuggagaucagcgagcacaugaaggagccccagcugagcgacagcaucgccagcgaccccaagagcuuccacggccuggacuucggcuucagaagcagaaucagcgagcaccugcuggacguggacgugcugagccccgugcugggcggcgccugcagacaggcccagcagccccugggcaucgaggacaaggacgacagccagagcagccaggacgagcugcagagcaagcagagcaagggccuggaggagagauaccacagacugagccccccccugccccacgaggagagagcccagagcccccccagaagccuggccaccgaggaggagcccccccagggccccgagggccagcccgaguggaaggaggccgaggagcugggcgaggacagcgccgccagccugagccugcagcugagccugcagagagagcaggcccccagcccccccgccgccugcgagaagggcaaggagcagcacagccaggccgaggagcugggccccggccaggaggaggccgaggaccccgaggagaagguggccgugagccccaccccccccgugagccccgaggugagaagcaccgagcccguggccccccccgagcagcugagcgaggccgcccugaaggccauggaggaggccguggcccaggugcuggagcaggaccagagacaccugcuggagagcaagcaggagaagaugcagcagcugagagagaagcugugccaggaggaggaggaggagauccugagacugcaccagcagaaggagcagagccugagcagccugagagagagacugcagaaggccaucgaggaggaggaggccagaaugagagaggaggagagccagagacugagcuggcugagagcccaggugcagagcagcacccaggccgacgaggaccagaucagagccgagcaggaggccagccugcagaagcugagagaggagcuggagagccagcagaaggccgagagagccagccuggagcagaagaacagacagaugcuggagcagcugaaggaggagaucgaggccagcgagaagagcgagcaggccgcccugaacgccgccaaggagaaggcccugcagcagcugagagagcagcuggagggcgagagaaaggaggccguggccacccuggagaaggagcacagcgccgagcuggagagacugugcagcagccuggaggccaagcacagagagguggugagcagccugcagaagaagauccaggaggcccagcagaaggaggaggcccagcugcagaagugccugggccagguggagcacagagugcaccagaagagcuaccacguggccggcuacgagcacgagcugagcagccugcugagagagaagagacaggagguggagggcgagcacgagagaagacuggacaagaugaaggaggagcaccagcaggugauggccaaggccagagagcaguacgaggccgaggagagaaagcagagagccgagcugcugggccaccugaccggcgagcuggagagacugcagagagcccacgagagagagcuggagaccgugagacaggagcagcacaagagacuggaggaccugagaagaagacacagagagcaggagagaaagcugcaggaccuggagcuggaccuggagaccagagccaaggacgugaaggccagacuggcccugcuggaggugcaggaggagaccgccagaagagagaagcagcagcugcuggacgugcagagacagguggcccugaagagcgaggaggccaccgccacccaccagcagcuggaggaggcccagaaggagcacacccaccugcugcagagcaaccagcagcugagagagauccuggacgagcugcaggccagaaagcugaagcuggagagccagguggaccugcugcaggcccagagccagcagcugcagaagcacuucagcagccuggaggccgaggcccagaagaagcagcaccugcugagagaggugaccguggaggagaacaacgccagcccccacuucgagcccgaccugcacaucgaggaccugagaaagagccugggcaccaaccagaccaaggaggugagcagcagccugagccagagcaaggaggaccuguaccuggacagccugagcagccacaacguguggcaccugcugagcgccgagggcguggcccugagaagcgccaaggaguuccuggugcagcagaccagaagcaugagaagaagacagaccgcccugaaggccgcccagcagcacuggagacacgagcuggccagcgcccaggagguggccaaggacccccccggcaucaaggcccuggaggacaugagaaagaaccuggagaaggagaccagacaccuggacgagaugaagagcgccaugagaaagggccacaaccugcugaagaagaaggaggagaagcugaaccagcuggagagcagccugugggaggaggccagcgacgagggcacccugggcggcagccccaccaagaaggccgugaccuucgaccugagcgacauggacagccugagcagcgagagcagcgagagcuucagccccccccaccuggacagcacccccagccugaccagcagaaagauccacggccugagccacagccugagacagaucagcagccagcugagcagcgugcugagcauccuggacagccugaacccccagagcccccccccccugcuggccagcaugcccgcccagcugccccccagagaccccaagagcacccccacccccaccuacuacggcagccuggccagauucagcgcccugagcagcgccacccccaccagcacccagugggccugggacagcggccagggccccagacugcccagcagcguggcccagaccguggacgacuuccugcuggagaaguggagaaaguacuuccccagcggcaucccccugcugagcaacagccccaccccccuggagagcagacugggcuacaugagcgccagcgagcagcugagacugcugcagcacagccacagccaggugcccgaggccggcagcaccaccuuccagggcaucaucgaggccaacagaagauggcuggagagagugaagaacgaccccagacugccccuguucagcagcacccccaagcccaaggccacccugagccugcugcagcugggccuggacgagcacaacagagugaagguguacagauucuaa

SEQ ID NO: 15090 - RNA, 4461 nt, Artificial Sequence
  CEP170__Homo_sapiens__NP_001035863
augagccugaccagcugguuccuggugagcagcggcggcaccagacacagacugcccagagagaugaucuucgugggcagagacgacugcgagcugaugcugcagagcagaagcguggacaagcagcacgccgugaucaacuacgacgccagcaccgacgagcaccuggugaaggaccugggcagccugaacggcaccuucgugaacgacgugagaauccccgagcagaccuacaucacccugaagcuggaggacaagcugagauucggcuacgacaccaaccuguucaccguggugcagggcgagaugagagugcccgaggaggcccugaagcacgagaaguucaccauccagcugcagcugagccagaagagcagcgagagcgagcugagcaagagcgccagcgccaagagcaucgacagcaagguggccgacgccgccaccgaggugcagcacaagaccaccgaggcccugaagagcgaggagaaggccauggacaucagcgccaugcccagaggcaccccccuguacggccagcccagcugguggggcgacgacgagguggacgagaagagagccuucaagaccaacggcaagcccgaggagaagaaccacgaggccggcaccagcggcugcggcaucgacgccaagcagguggaggagcagagcgccgccgccaacgaggaggugcuguuccccuucugcagagagcccagcuacuucgagauccccaccaaggaguuccagcagcccagccagaucaccgagagcaccauccacgagauccccaccaaggacacccccagcagccacaucaccggcgccggccacgccagcuucaccaucgaguucgacgacagcacccccggcaaggugaccaucagagaccacgugaccaaguucaccagcgaccagagacacaagagcaagaagagcagccccggcacccaggaccugcugggcauccagaccggcaugauggcccccgagaacaagguggccgacuggcuggcccagaacaaccccccccagaugcugugggagagaaccgaggaggacagcaagagcaucaagagcgacgugcccguguaccugaagagacugaagggcaacaagcacgacgacggcacccagagcgacagcgagaacgccggcgcccacagaagaugcagcaagagagccacccuggaggagcaccugagaagacaccacagcgagcacaagaagcugcagaaggugcaggccaccgagaagcaccaggaccaggccgugguguucggcguggacgacaaccaggacuacaacagacccgugaucaacgagaagcacaaggaccugaucaaggacugggcccugagcagcgccgccgccgugauggaggagagaaagccccugaccaccagcggcuuccaccacagcgaggagggcaccagcagcagcggcagcaagagaugggugagccagugggccagccuggccgccaaccacaccagacacgaccaggaggagagaaucauggaguucagcgccccccugccccuggagaacgagaccgagaucagcgagagcggcaugaccgugagaagcaccggcagcgccaccagccuggccagccagggcgagagaagaagaagaacccugccccagcugcccaacgaggagaagagccuggagagccacagagccaagguggugacccagagaagcgagaucggcgagaagcaggacaccgagcugcaggagaaggagacccccacccagguguaccagaaggacaagcaggacgccgacagaccccugagcaagaugaacagagccgugaacggcgagacccugaagaccggcggcgacaacaagacccugcugcaccugggcagcagcgcccccggcaaggagaagagcgagaccgacaaggagaccagccuggugaagcagacccuggccaagcugcagcagcaggagcagagagaggaggcccaguggacccccaccaagcugagcagcaagaacgugagcggccagaccgacaagugcagagaggagaccuucaagcaggagagccagccccccgagaagaacagcggccacagcaccagcaagggcgacagaguggcccagagcgagagcaagagaagaaaggccgaggagauccugaagagccagacccccaagggcggcgacaagaaggagagcagcaagagccuggugagacagggcagcuucaccaucgagaagcccagccccaacauccccaucgagcugaucccccacaucaacaagcagaccagcagcacccccagcagccuggcccugaccagcgccagcagaaucagagagagaagcgagagccuggaccccgacagcagcauggacaccacccugauccugaaggacaccgaggccgugauggccuuccuggaggccaagcugagagaggacaacaagaccgacgagggccccgacacccccagcuacaacagagacaacagcaucagccccgagagcgacguggacaccgccagcaccaucagccuggugaccggcgagaccgagagaaagagcacccagaagagaaagagcuucaccagccuguacaaggacagaugcagcaccggcagccccagcaaggacgugaccaagagcagcagcagcggcgccagagagaagauggagaagaagaccaagagcagaagcaccgacgugggcagcagagccgacggcagaaaguucgugcagagcagcggcagaaucagacagcccagcguggaccugaccgacgacgaccagaccagcagcgugccccacagcgccaucagcgacaucaugagcagcgaccaggagaccuacagcugcaagccccacggcagaaccccccugaccagcgccgacgagcacgugcacagcaagcuggagggcagcaaggugaccaagagcaagaccagccccguggugagcggcagcagcagcaagagcaccacccugcccagacccagacccaccagaaccagccugcugagaagagccagacugggcgaggccagcgacagcgagcuggccgacgccgacaaggccagcguggccagcgaggugagcaccaccagcagcaccagcaagccccccaccggcagaagaaacaucagcagaaucgaccugcuggcccagcccagaagaaccagacugggcagccugagcgccagaagcgacagcgaggccaccaucagcagaagcagcgccagcagcagaaccgccgaggccaucaucagaagcggcgccagacuggugcccagcgacaaguucagccccagaaucagagccaacagcaucagcagacugagcgacagcaaggugaagagcaugaccagcgcccacggcagcgccagcgugaacagcagauggagaagauuccccaccgacuacgccagcaccagcgaggacgaguucggcagcaacagaaacagccccaagcacaccagacugagaaccagccccgcccugaagaccaccagacugcagagcgccggcagcgccaugcccaccagcagcagcuucaagcacagaaucaaggagcaggaggacuacaucagagacuggaccgcccacagagaggagaucgccagaaucagccaggaccuggcccugaucgccagagagaucaacgacguggccggcgagaucgacagcgugaccagcagcggcaccgcccccagcaccaccgugagcaccgccgccaccacccccggcagcgccaucgacaccagagaggagcugguggacagaguguucgacgagagccugaacuucagaaagauccccccccuggugcacagcaagacccccgagggcaacaacggcagaagcggcgaccccagaccccaggccgccgagccccccgaccaccugaccaucaccagaagaagaaccuggagcagagacgaggugaugggcgacaaccugcugcugagcagcguguuccaguucagcaagaagaucagacagagcaucgacaagaccgccggcaagaucagaauccuguucaaggacaaggacagaaacugggacgacaucgagagcaagcugagagccgagagcgaggugcccaucgugaagaccagcagcauggagaucagcagcauccugcaggagcugaagagaguggagaagcagcugcaggccaucaacgccaugaucgaccccgacggcacccuggaggcccugaacaacaugggcuuccccagcgccaugcugcccagcccccccaagcagaagagcagccccgugaacaaccaccacagccccggccagacccccacccugggccagcccgaggccagagcccugcaccccgccgccgugagcgccgccgccgaguucgagaacgccgagagcgaggccgacuucagcauccacuucaacagauucaaccccgacggcgaggaggaggacgugaccgugcaggaguaa

SEQ ID NO: 15091 - RNA, 7614 nt, Artificial Sequence
  CEP192__Homo_sapiens__NP_115518
auggaggacuucagaggcaucgccgaggagagcuuccccagcuuccugaccaacagccuguucggcaacagcggcauccuggagaacgugacccugagcagcaaccugggccugcccguggccgugagcacccuggccagagacagaagcagcaccgacaacagauaccccgacauccaggccagcuaccugguggagggcagauucagcgugcccagcggcagcagccccggcagccagagcgacgccgagcccagagagagacugcagcugagcuuccaggacgacgacagcaucagcagaaagaagagcuacguggagagccagagacugagcaacgcccugagcaagcagagcgcccugcagauggagaccgccggccccgaggaggagcccgccggcgccaccgagagccugcagggccaggaccuguucaacagagccagcccccuggagcaggcccaggacagccccaucgacuuccaccugcagagcuggaugaacaacaaggagcccaagaucguggugcuggacgccggcaagcacuucgaggacaagacccugaagagcgaccugagccacaccagccugcuggagaacgagaagcugauccugcccaccagccuggaggacagcagcgacgacgacaucgacgacgagauguucuacgacgaccaccuggaggccuacuucgagcagcuggccauccccggcaugaucuacgaggaccuggagggccccgagccccccgagaagggcuucaagcugcccaccaacggccugagacaggccaacgagaacggcagccugaacugcaaguuccagagcgagaacaacagcagccugaucagccuggacagccacagcagcgagaccacccacaaggagagcgaggagagccaggugaucugccugcccggcaccagcaacagcaucggcaccggcgacagcagaagauacaccgacggcaugcugcccuucagcagcggcaccuggggcaccgagaaggagaucgagaaccugaagggcaucgugcccgaccugaacagcgagugcgccagcaaggacgugcuggugaagacccugagagccaucgacgugaagcugaacagcgacaacuuccacgacgccaacgccaacagaggcggcuucgaccugaccgaccccgugaagcagggcgccgagugcccccaccagaacaagaccgugcugcacauggacggcugccuggacaccgagacccccaccgugagcauccaggagaacguggacguggccagccugaagcccaucagcgacagcggcaucaacuucaccgacgccaucuggagccccaccugcgagagaagaaccugcgagugccacgagagcaucgagaagaacaaggacaagaccgaccugccccagagcgugguguaccagaacgaggagggcagaugggugaccgaccuggccuacuacaccagcuucaacagcaagcagaaccugaacgugagccugagcgacgagaugaacgaggacuucagaagcggcagcgaggccuucgaccugaucgcccaggacgaggaggaguucaacaaggagcaccaguucauccaggaggagaacaucgacgcccacaacaccagcguggcccugggcgacaccagcuggggcgccaccaucaacuacagccugcugagaaagagcagaagcaccagcgaccuggacaaggacgacgccagcuaccugagacugagccugggcgaguucuucgcccagagaagcgaggcccugggcugccugggcggcggcaacaacgugaagagacccagcuucggcuacuucaucagaagccccgagaagagagagcccaucgcccugaucagaaagagcgacgugagcagaggcaaccuggagaaggagauggcccaccugaaccacgaccuguacagcggcgaccugaacgagcagagccaggcccagcugagcgagggcagcaucacccugcagguggaggccguggagagcaccagccagguggacgagaacgacgugacccugaccgccgacaagggcaagaccgaggacaccuucuucaugagcaacaagccccagagauacaaggacaagcugcccgacagcggcgacagcaugcugagaaucagcaccaucgccagcgccaucgccgaggccagcgugaacaccgaccccagccagcuggccgccaugaucaaggcccugagcaacaagaccagagacaagaccuuccaggaggacgagaagcagaaggacuacagccacgugagacacuuccugcccaacgaccuggagaagagcaacggcagcaacgcccuggacauggagaaguaccugaagaagaccgaggugagcagauacgagagcgcccuggagaacuucagcagagccagcaugagcgacaccugggaccugagccugcccaaggagcagaccacccaggacauccaccccguggaccugagcgccaccagcgugagcgugagagcccccgaggagaacaccgccgccaucguguacguggagaacggcgagagcgagaaccaggagagcuucagaaccaucaacagcagcaacagcgugaccaacagagagaacaacagcgccgugguggacgugaagaccugcagcaucgacaacaagcugcaggacgugggcaacgacgagaaggccaccagcaucagcacccccagcgacagcuacagcagcgugagaaaccccagaaucaccagccugugccugcugaaggacugcgaggagaucagagacaacagagagaaccagagacagaacgagugcgugagcgagaucagcaacagcgagaagcacgugaccuucgagaaccacagaaucgugagccccaagaacagcgaccugaagaacaccagccccgagcacggcggcagaggcagcgaggacgagcaggagagcuucagacccagcaccagcccccugagccacagcagccccagcgagaucagcggcaccagcagcagcggcugcgcccuggagagcuucggcagcgccgcccagcagcagcagccccccugcgagcaggagcugagcccccuggugugcagccccgccggcgugagcagacugaccuacgugagcgagcccgagagcagcuaccccaccaccgccaccgacgacgcccuggaggacagaaagagcgacaucaccagcgagcugagcaccaccaucauccagggcagccccgccgcccuggaggagagagccauggagaagcugagagagaaggugcccuuccagaacagaggcaagggcacccugagcagcaucauccagaacaacagcgacaccagaaaggccaccgagaccaccagccugagcagcaagcccgaguacgugaagcccgacuucagauggagcaaggaccccagcagcaagagcggcaaccugcuggagaccagcgaggugggcuggaccagcaaccccgaggagcuggaccccaucagacuggcccugcugggcaagagcggccugagcugccaggugggcagcgccaccagccaccccgugagcugccaggagcccaucgacgaggaccagagaaucagccccaaggacaagagcaccgccggcagagaguucagcggccaggugagccaccagaccaccagcgagaaccagugcacccccauccccagcagcaccgugcacagcagcguggccgacaugcagaacaugcccgccgccgugcacgcccugcugacccagcccagccugagcgccgcccccuucgcccagagauaccugggcacccugcccagcaccggcagcaccacccugccccagugccacgccggcaacgccaccgugugcggcuucagcggcggccugcccuaccccgccguggccggcgagcccgugcagaacagcguggccgugggcaucugccugggcagcaacaucggcagcggcuggaugggcaccagcagccugugcaaccccuacagcaacacccugaaccagaaccugcugagcaccaccaagcccuuccccgugcccagcgugggcaccaacugcggcaucgagcccugggacagcggcgugaccagcggccugggcagcgugagagugcccgaggagcugaagcugccccacgccugcugcgugggcaucgccagccagacccugcugagcgugcugaaccccaccgacagauggcugcaggugagcaucggcgugcugagcaucagcgugaacggcgagaagguggaccugagcaccuacagaugccugguguucaagaacaaggccaucaucagaccccacgccaccgaggagaucaaggugcuguucauccccagcagccccggcguguucagaugcaccuucagcguggccagcuggcccugcagcaccgacgccgagaccaucgugcaggccgaggcccuggccagcaccgugacccugaccgccaucgccgagagccccgugaucgagguggagaccgagaagaaggacgugcuggacuucggcgaccugaccuacggcggcuggaaggcccugccccugaagcugaucaacagaacccacgccaccgugcccaucagacugaucaucaacgccaacgccguggccuggagaugcuucaccuucagcaaggagagcgugagagcccccguggagguggcccccugcgccgacguggugaccagacuggccggccccagcguggugaaccacaugaugcccgccagcuacgacggccaggaccccgaguuccugaugaucugggugcuguuccacagccccaagaagcagaucagcagcagcgacauccuggacagcgccgaggaguucagcgccaagguggacaucgagguggacagccccaaccccacccccgugcugagaagcgugagccugagagccagagccggcaucgccagaauccacgcccccagagaccugcagaccaugcacuuccuggccaagguggccagcagcagaaagcagcaccugccccugaagaacgccggcaacaucgagguguaccuggacaucaaggugcccgagcagggcagccacuucagcguggaccccaagaaccugcugcugaagcccggcgaggagcacgaggugaucgugagcuucacccccaaggaccccgaggccugcgaggagagaauccugaagaucuucgugcagcccuucggcccccaguacgagguggugcugaagggcgaggugaucagcagcggcagcaagccccugagccccggccccugccuggacauccccagcauccugagcaacaagcaguuccuggccuggggcggcgugccccugggcagaacccagcugcagaagcuggcccugagaaacaacagcgccagcaccacccagcaccugagacugcugaucagaggccaggaccaggacugcuuccagcugcagaacaccuucggcagcgagcagagacugaccagcaacugcgagaucagaauccaccccaaggaggacaucuucaucagcgugcuguucgcccccaccagacugagcugcaugcuggccagacuggagaucaagcagcugggcaacagaagccagcccggcaucaaguucaccaucccccugagcggcuacggcggcaccagcaaccugauccuggagggcgugaagaagcugagcgacagcuacauggugaccgugaacggccuggugcccggcaaggagagcaagaucguguucagcgugagaaacaccggcagcagagccgccuucgugaaggccgugggcuucaaggacagccagaagaaggugcugcuggaccccaaggugcugagaaucuuccccgacaaguucgugcugaaggagagaacccaggagaacgugacccugaucuacaaccccagcgacagaggcaucaacaacaagaccgccaccgagcugagcaccguguaccuguucggcggcgacgagaucagcagacagcaguacagaagagcccugcugcacaagcccgagaugaucaagcagauccugcccgagcacagcgugcugcagaacaucaacuucguggaggccuuccaggacgagcugcuggugaccgagguguacgaccugccccagagacccaacgacgugcagcuguucuacggcagcaugugcaagaucauccugagcgugaucggcgaguucagagacugcaucagcagcagagaguuccugcagcccagcagcaaggccagccuggagagcaccagcgaccugggcgccagcggcaagcacggcggcaacgugagccuggacgugcugcccgugaagggcccccagggcagcccccugcugagcagagccgccagacccccccuggaccagcuggccagcgaggagcccuggaccgugcugcccgagcaccugauccugguggcccccagccccugcgacauggccaagaccggcagauuccagaucgugaacaacagcgugagacugcugagauucgagcugugcuggcccgcccacugccugaccgugaccccccagcacggcugcguggcccccgagagcaagcugcagauccuggugagccccaacagcagccugagcaccaagcagagcauguuccccuggagcggccugaucuacauccacugcgacgacggccagaagaagaucgugaaggugcagaucagagaggaccugacccagguggagcugcugaccagacugaccagcaagcccuucggcauccugagccccgugagcgagcccagcgugagccaccuggugaagcccaugaccaagccccccagcaccaagguggagaucagaaacaagagcaucaccuuccccaccaccgagcccggcgagaccagcgagagcugccuggagcuggagaaccacggcaccaccgacgugaaguggcaccugagcagccuggccccccccuacgugaagggcguggacgagagcggcgacguguucagagccaccuacgccgccuucagaugcagccccaucagcggccugcuggagagccacggcauccagaaggugagcaucaccuuccugcccagaggcagaggcgacuacgcccaguucugggacguggagugccacccccugaaggagccccacaugaagcacacccugagauuccagcugagcggccagagcaucgaggccgagaacgagcccgagaacgccugccugagcaccgacagccugaucaagaucgaccaccuggugaagcccagaagacaggccgugagcgaggccagcgccagaauccccgagcagcuggacgugaccgccagaggcguguacgcccccgaggacguguacagauucagacccaccagcgugggcgagagcagaacccugaaggugaaccugagaaacaacagcuucaucacccacagccugaaguuccugagccccagagagcccuucuacgugaagcacagcaaguacagccugagagcccagcacuacaucaacaugcccgugcaguucaagcccaagagcgccggcaaguucgaggcccugcuggugauccagaccgacgagggcaagagcaucgccaucagacugaucggcgaggcccugggcaagaacuaa

SEQ ID NO: 15092 - RNA, 504 nt, Artificial Sequence
  CEP19__Homo_sapiens__NP_116287
auguacaugggcaugaugugcaccgccaagaagugcggcaucagauuccagccccccgccaucauccugaucuacgagagcgagaucaagggcaagaucagacagagaaucaugcccgugagaaacuucagcaaguucagcgacugcaccagagccgccgagcagcugaagaacaaccccagacacaagagcuaccuggagcaggugagccugagacagcuggagaagcuguucagcuuccugagaggcuaccugagcggccagagccuggccgagaccauggagcagauccagagagagaccaccaucgaccccgaggaggaccugaacaagcuggacgacaaggagcuggccaagagaaagagcaucauggacgagcuguucgagaagaaccagaagaagaaggacgaccccaacuucguguacgacaucgagguggaguucccccaggacgaccagcugcagagcugcggcugggacaccgagagcgccgacgaguucuaa

SEQ ID NO: 15093 - RNA, 7329 nt, Artificial Sequence
  CEP250__Homo_sapiens__NP_009117
auggagaccagaagccccggccugaacaacaugaagccccagagccugcagcuggugcuggaggagcaggugcuggcccugcagcagcagauggccgagaaccaggccgccagcuggagaaagcugaagaacagccaggaggcccagcagagacaggccacccuggugagaaagcugcaggccaaggugcugcaguacagaagcuggugccaggagcuggagaagagacuggaggccaccggcggccccaucccccagagaugggagaacguggaggagcccaaccuggacgagcugcuggugagacuggaggaggagcagcagagaugcgagagccuggccgaggugaacacccagcugagacugcacauggagaaggccgacguggugaacaaggcccugagagaggacguggagaagcugaccguggacuggagcagagccagagacgagcugaugagaaaggagagccaguggcagauggagcaggaguucuucaagggcuaccugaagggcgagcacggcagacugcugagccuguggagagagguggugaccuucagaagacacuuccuggagaugaagagcgccaccgacagagaccugauggagcugaaggccgagcacgugagacugagcggcagccugcugaccugcugccugagacugaccgugggcgcccagagcagagagcccaacggcagcggcagaauggacggcagagagcccgcccagcugcugcugcugcuggccaagacccaggagcuggagaaggaggcccacgagagaagccaggagcugauccagcugaagagccagggcgaccuggagaaggccgagcugcaggacagagugaccgagcugagcgcccugcugacccagagccagaagcagaacgaggacuacgagaagaugaucaaggcccugagagagaccguggagauccuggagaccaaccacaccgagcugauggagcacgaggccagccugagcagaaacgcccaggaggagaagcugagccugcagcaggugaucaaggacaucacccaggugaugguggaggagggcgacaacaucgcccagggcagcggccacgagaacagccuggagcuggacagcagcaucuucagccaguucgacuaccaggacgccgacaaggcccugacccuggugagaagcgugcugaccagaagaagacaggccgugcaggaccugagacagcagcuggccggcugccaggaggccgugaaccugcugcagcagcagcacgaccagugggaggaggagggcaaggcccugagacagagacugcagaagcugaccggcgagagagacacccuggccggccagaccguggaccugcagggcgagguggacagccugagcaaggagagagagcugcugcagaaggccagagaggagcugagacagcagcuggaggugcuggagcaggaggccuggagacugagaagagugaacguggagcugcagcugcagggcgacagcgcccagggccagaaggaggagcagcaggaggagcugcaccuggccgugagagagagagagagacugcaggagaugcugaugggccuggaggccaagcagagcgagagccugagcgagcugaucacccugagagaggcccuggagagcagccaccuggagggcgagcugcugagacaggagcagaccgaggugaccgccgcccuggccagagccgagcagagcaucgccgagcugagcagcagcgagaacacccugaagaccgagguggccgaccugagagccgccgccgugaagcugagcgcccugaacgaggcccuggcccuggacaaggugggccugaaccagcagcugcugcagcuggaggaggagaaccagagcgugugcagcagaauggaggccgccgagcaggccagaaacgcccugcagguggaccuggccgaggccgagaagagaagagaggcccugugggagaagaacacccaccuggaggcccagcugcagaaggccgaggaggccggcgccgagcugcaggccgaccugagagacauccaggaggagaaggaggagauccagaagaagcugagcgagagcagacaccagcaggaggccgccaccacccagcuggagcagcugcaccaggaggccaagagacaggaggaggugcuggccagagccgugcaggagaaggaggcccuggugagagagaaggccgcccuggaggugagacugcaggccguggagagagacagacaggaccuggccgagcagcugcagggccugagcagcgccaaggagcugcuggagagcagccuguucgaggcccagcagcagaacagcgugaucgaggugaccaagggccagcuggaggugcagauccagaccgugacccaggccaaggaggugauccagggcgaggugagaugccugaagcuggagcuggacaccgagagaagccaggccgagcaggagagagacgccgccgccagacagcuggcccaggccgagcaggagggcaagaccgcccuggagcagcagaaggccgcccacgagaaggaggugaaccagcugagagagaagugggagaaggagagaagcuggcaccagcaggagcuggccaaggcccuggagagccuggagagagagaagauggagcuggagaugagacugaaggagcagcagaccgagauggaggccauccaggcccagagagaggaggagagaacccaggccgagagcgcccugugccagaugcagcuggagaccgagaaggagagagugagccugcuggagacccugcugcagacccagaaggagcuggccgacgccagccagcagcuggagagacugagacaggacaugaaggugcagaagcugaaggagcaggagaccaccggcauccugcagacccagcugcaggaggcccagagagagcugaaggaggccgccagacagcacagagacgaccuggccgcccugcaggaggagagcagcagccugcugcaggacaagauggaccugcagaagcagguggaggaccugaagagccagcugguggcccaggacgacagccagagacugguggagcaggaggugcaggagaagcugagagagacccaggaguacaacagaauccagaaggagcuggagagagagaaggccagccugacccugagccugauggagaaggagcagagacugcuggugcugcaggaggccgacagcaucagacagcaggagcugagcgcccugagacaggacaugcaggaggcccagggcgagcagaaggagcugagcgcccagauggagcugcugagacaggaggugaaggagaaggaggccgacuuccuggcccaggaggcccagcugcuggaggagcuggaggccagccacaucaccgagcagcagcugagagccagccugugggcccaggaggccaaggccgcccagcugcagcugagacugagaagcaccgagagccagcuggaggcccuggccgccgagcagcagcccggcaaccaggcccaggcccaggcccagcuggccagccuguacagcgcccugcagcaggcccugggcagcgugugcgagagcagacccgagcugagcggcggcggcgacagcgcccccagcguguggggccuggagcccgaccagaacggcgccagaagccuguucaagagaggcccccugcugaccgcccugagcgccgaggccguggccagcgcccugcacaagcugcaccaggaccuguggaagacccagcagaccagagacgugcugagagaccaggugcagaagcuggaggagagacugaccgacaccgaggccgagaagagccaggugcacaccgagcugcaggaccugcagagacagcugagccagaaccaggaggagaagagcaagugggagggcaagcagaacagccuggagagcgagcugauggagcugcacgagaccauggccagccugcagagcagacugagaagagccgagcugcagagaauggaggcccagggcgagagagagcugcugcaggccgccaaggagaaccugaccgcccagguggagcaccugcaggccgccgugguggaggccagagcccaggccagcgccgccggcauccuggaggaggaccugagaaccgccagaagcgcccugaagcugaagaacgaggagguggagagcgagagagagagagcccaggcccugcaggagcagggcgagcugaagguggcccagggcaaggcccugcaggagaaccuggcccugcugacccagacccuggccgagagagaggaggagguggagacccugagaggccagauccaggagcuggagaagcagagagagaugcagaaggccgcccuggagcugcugagccuggaccugaagaagagaaaccaggagguggaccugcagcaggagcagauccaggagcuggagaagugcagaagcgugcuggagcaccugcccauggccgugcaggagagagagcagaagcugaccgugcagagagagcagaucagagagcuggagaaggacagagagacccagagaaacgugcuggagcaccagcugcuggagcuggagaagaaggaccagaugaucgagagccagagaggccaggugcaggaccugaagaagcagcuggugacccuggagugccuggcccuggagcuggaggagaaccaccacaagauggagugccagcagaagcugaucaaggagcuggagggccagagagagacccagagaguggcccugacccaccugacccuggaccuggaggagagaagccaggagcugcaggcccagagcagccagauccacgaccuggagagccacagcaccgugcuggccagagagcugcaggagagagaccaggaggugaagagccagagagagcagaucgaggagcugcagagacagaaggagcaccugacccaggaccuggagagaagagaccaggagcugaugcugcagaaggagagaauccaggugcuggaggaccagagaaccagacagaccaagauccuggaggaggaccuggagcagaucaagcugagccugagagagagaggcagagagcugaccacccagagacagcugaugcaggagagagccgaggagggcaagggccccagcaaggcccagagaggcagccuggagcacaugaagcugauccugagagacaaggagaaggagguggagugccagcaggagcacauccacgagcugcaggagcugaaggaccagcuggagcagcagcugcagggccugcacagaaaggugggcgagaccagccugcugcugagccagagagagcaggagaucguggugcugcagcagcagcugcaggaggccagagagcagggcgagcugaaggagcagagccugcagagccagcuggacgaggcccagagagcccuggcccagagagaccaggagcuggaggcccugcagcaggagcagcagcaggcccagggccaggaggagagagugaaggagaaggccgacgcccugcagggcgcccuggagcaggcccacaugacccugaaggagagacacggcgagcugcaggaccacaaggagcaggccagaagacuggaggaggagcuggccguggagggcagaagagugcaggcccuggaggaggugcugggcgaccugagagccgagagcagagagcaggagaaggcccugcuggcccugcagcagcagugcgccgagcaggcccaggagcacgagguggagaccagagcccugcaggacagcuggcugcaggcccaggccgugcugaaggagagagaccaggagcuggaggcccugagagccgagagccagagcagcagacaccaggaggaggccgccagagccagagccgaggcccugcaggaggcccugggcaaggcccacgccgcccugcagggcaaggagcagcaccugcuggagcaggccgagcugagcagaagccuggaggccagcaccgccacccugcaggccagccuggacgccugccaggcccacagcagacagcuggaggaggcccugagaauccaggagggcgagauccaggaccaggaccugagauaccaggaggacgugcagcagcugcagcaggcccuggcccagagagacgaggagcugagacaccagcaggagagagagcagcugcuggagaagagccuggcccagagagugcaggagaacaugauccaggagaagcagaaccugggccaggagagagaggaggaggagaucagaggccugcaccagagcgugagagagcugcagcugacccuggcccagaaggagcaggagauccuggagcugagagagacccagcagagaaacaaccuggaggcccugccccacagccacaagaccagccccauggaggagcagagccugaagcuggacagccuggagcccagacugcagagagagcuggagagacugcaggccgcccugagacagaccgaggccagagagaucgaguggagagagaaggcccaggaccuggcccugagccuggcccagaccaaggccagcgugagcagccugcaggagguggccauguuccugcaggccagcgugcuggagagagacagcgagcagcagagacugcaggacgagcuggagcugaccagaagagcccuggagaaggagagacugcacagccccggcgccaccagcaccgccgagcugggcagcagaggcgagcagggcgugcagcugggcgaggugagcggcguggaggccgagcccagccccgacggcauggagaagcagagcuggagacagagacuggagcaccugcagcaggccguggccagacuggagaucgacagaagcagacugcagagacacaacgugcagcugagaagcacccuggagcagguggagagagagagaagaaagcugaagagagaggccaugagagccgcccaggccggcagccuggagaucagcaaggccaccgccagcagccccacccagcaggacggcagaggccagaagaacagcgacgccaagugcguggccgagcugcagaaggagguggugcugcugcaggcccagcugacccuggagagaaagcagaagcaggacuacaucaccagaagcgcccagaccagcagagagcuggccggccugcaccacagccugagccacagccugcuggccguggcccaggcccccgaggccaccgugcuggaggccgagaccagaagacuggacgagagccugacccagagccugaccagccccggccccgugcugcugcaccccagccccagcaccacccaggccgccagcagauaa

SEQ ID NO: 15094 - RNA, 7440 nt, Artificial Sequence
  CEP290__Homo_sapiens__NP_079390
augccccccaacaucaacuggaaggagaucaugaagguggaccccgacgaccugcccagacaggaggagcuggccgacaaccugcugaucagccugagcaagguggaggugaacgagcugaagagcgagaagcaggagaacgugauccaccuguucagaaucacccagagccugaugaagaugaaggcccaggagguggagcuggcccuggaggagguggagaaggccggcgaggagcaggccaaguucgagaaccagcugaagaccaaggugaugaagcuggagaacgagcuggagauggcccagcagagcgccggcggcagagacaccagauuccugagaaacgagaucugccagcuggagaagcagcuggagcagaaggacagagagcuggaggacauggagaaggagcuggagaaggagaagaaggugaacgagcagcuggcccugagaaacgaggaggccgagaacgagaacagcaagcugagaagagagaacaagagacugaagaagaagaacgagcagcugugccaggacaucaucgacuaccagaagcagaucgacagccagaaggagacccugcugagcagaagaggcgaggacagcgacuacagaagccagcugagcaagaagaacuacgagcugauccaguaccuggacgagauccagacccugaccgaggccaacgagaagaucgaggugcagaaccaggagaugagaaagaaccuggaggagagcgugcaggagauggagaagaugaccgacgaguacaacagaaugaaggccaucgugcaccagaccgacaacgugaucgaccagcugaagaaggagaacgaccacuaccagcugcaggugcaggagcugaccgaccugcugaagagcaagaacgaggaggacgaccccaucaugguggccgugaacgccaagguggaggaguggaagcugauccugagcagcaaggacgacgagaucaucgaguaccagcagaugcugcacaaccugagagagaagcugaagaacgcccagcuggacgccgacaagagcaacgugauggcccugcagcagggcauccaggagagagacagccagaucaagaugcugaccgagcagguggagcaguacaccaaggagauggagaagaacaccugcaucaucgaggaccugaagaacgagcugcagagaaacaagggcgccagcacccugagccagcagacccacaugaagauccagagcacccuggacauccugaaggagaagaccaaggaggccgagagaaccgccgagcuggccgaggccgacgccagagagaaggacaaggagcugguggaggcccugaagagacugaaggacuacgagagcggcguguacggccuggaggacgccgugguggagaucaagaacugcaagaaccagaucaagaucagagacagagagaucgagauccugaccaaggagaucaacaagcuggagcugaagaucagcgacuuccuggacgagaacgaggcccugagagagagagugggccuggagcccaagaccaugaucgaccugaccgaguucagaaacagcaagcaccugaagcagcagcaguacagagccgagaaccagauccugcugaaggagaucgagagccuggaggaggagagacuggaccugaagaagaagaucagacagauggcccaggagagaggcaagagaagcgccaccagcggccugaccaccgaggaccugaaccugaccgagaacaucagccagggcgacagaaucagcgagagaaagcuggaccugcugagccugaagaacaugagcgaggcccagagcaagaacgaguuccugagcagagagcugaucgagaaggagagagaccuggagagaagcagaaccgugaucgccaaguuccagaacaagcugaaggagcugguggaggagaacaagcagcuggaggagggcaugaaggagauccugcaggccaucaaggagaugcagaaggaccccgacgugaagggcggcgagaccagccugaucauccccagccuggagagacuggugaacgccaucgagagcaagaacgccgagggcaucuucgacgccagccugcaccugaaggcccagguggaccagcugaccggcagaaacgaggagcugagacaggagcugagagagagcagaaaggaggccaucaacuacagccagcagcuggccaaggccaaccugaagaucgaccaccuggagaaggagaccagccugcugagacagagcgagggcagcaacgugguguucaagggcaucgaccugcccgacggcaucgcccccagcagcgccagcaucaucaacagccagaacgaguaccugauccaccugcugcaggagcuggagaacaaggagaagaagcugaagaaccuggaggacagccuggaggacuacaacagaaaguucgccgugaucagacaccagcagagccugcuguacaaggaguaccugagcgagaaggagaccuggaagaccgagagcaagaccaucaaggaggagaagagaaagcuggaggaccaggugcagcaggacgccaucaaggugaaggaguacaacaaccugcugaacgcccugcagauggacagcgacgagaugaagaagauccuggccgagaacagcagaaagaucaccgugcugcaggugaacgagaagagccugaucagacaguacaccacccugguggagcuggagagacagcugagaaaggagaacgagaagcagaagaacgagcugcugagcauggaggccgaggugugcgagaagaucggcugccugcagagauucaaggagauggccaucuucaagaucgccgcccugcagaaggugguggacaacagcgugagccugagcgagcuggagcuggccaacaagcaguacaacgagcugaccgccaaguacagagacauccugcagaaggacaacaugcuggugcagagaaccagcaaccuggagcaccuggagugcgagaacaucagccugaaggagcagguggagagcaucaacaaggagcuggagaucaccaaggagaagcugcacaccaucgagcaggccugggagcaggagaccaagcugggcaacgagagcagcauggacaaggccaagaagagcaucaccaacagcgacaucgugagcaucagcaagaagaucaccaugcuggagaugaaggagcugaacgagagacagagagccgagcacugccagaagauguacgagcaccugagaaccagccugaagcagauggaggagagaaacuucgagcuggagaccaaguucgccgagcugaccaagaucaaccuggacgcccagaagguggagcagaugcugagagacgagcuggccgacagcgugagcaaggccgugagcgacgccgacagacagagaauccuggagcuggagaagaacgagauggagcugaagguggaggugagcaagcugagagagaucagcgacaucgccagaagacagguggagauccugaacgcccagcagcagagcagagacaaggagguggagagccugagaaugcagcugcuggacuaccaggcccagagcgacgagaagagccugaucgccaagcugcaccagcacaacgugagccugcagcugagcgaggccaccgcccugggcaagcuggagagcaucaccagcaagcugcagaagauggaggccuacaaccugagacuggagcagaagcuggacgagaaggagcaggcccuguacuacgccagacuggagggcagaaacagagccaagcaccugagacagaccauccagagccugagaagacaguucagcggcgcccugccccuggcccagcaggagaaguucagcaagaccaugauccagcugcagaacgacaagcugaagaucaugcaggagaugaagaacagccagcaggagcacagaaacauggagaacaagacccuggagauggagcugaagcugaagggccuggaggagcugaucagcacccugaaggacaccaagggcgcccagaaggugaucaacuggcacaugaagaucgaggagcugagacugcaggagcugaagcugaacagagagcuggugaaggacaaggaggagaucaaguaccugaacaacaucaucagcgaguacgagagaaccaucagcagccuggaggaggagaucgugcagcagaacaaguuccacgaggagagacagauggccugggaccagagagagguggaccuggagagacagcuggacaucuucgacagacagcagaacgagauccugaacgccgcccagaaguucgaggaggccaccggcagcauccccgaccccagccugccccugcccaaccagcuggagaucgcccugagaaagaucaaggagaacaucagaaucauccuggagaccagagccaccugcaagagccuggaggagaagcugaaggagaaggagagcgcccugagacuggccgagcagaacauccugagcagagacaaggugaucaacgagcugagacugagacugcccgccaccgccgagagagagaagcugaucgccgagcugggcagaaaggagauggagcccaagagccaccacacccugaagaucgcccaccagaccaucgccaacaugcaggccagacugaaccagaaggaggaggugcugaagaaguaccagagacugcuggagaaggccagagaggagcagagagagaucgugaagaagcacgaggaggaccugcacauccugcaccacagacuggagcugcaggccgacagcagccugaacaaguucaagcagaccgccugggaccugaugaagcagagccccacccccgugcccaccaacaagcacuucaucagacuggccgagauggagcagaccguggccgagcaggacgacagccugagcagccugcuggugaagcugaagaaggugagccaggaccuggagagacagagagagaucaccgagcugaaggugaaggaguucgagaacaucaagcugcagcugcaggagaaccacgaggacgaggugaagaaggugaaggccgagguggaggaccugaaguaccugcuggaccagagccagaaggagagccagugccugaagagcgagcugcaggcccagaaggaggccaacagcagagcccccaccaccaccaugagaaaccugguggagagacugaagagccagcuggcccugaaggagaagcagcagaaggcccugagcagagcccugcuggagcugagagccgagaugaccgccgccgccgaggagagaaucaucagcgccaccagccagaaggaggcccaccugaacgugcagcagaucguggacagacacaccagagagcugaagacccagguggaggaccugaacgagaaccugcugaagcugaaggaggcccugaagaccagcaagaacagagagaacagccugaccgacaaccugaacgaccugaacaacgagcugcagaagaagcagaaggccuacaacaagauccugagagagaaggaggagaucgaccaggagaacgacgagcugaagagacagaucaagagacugaccagcggccugcagggcaagccccugaccgacaacaagcagagccugaucgaggagcugcagagaaaggugaagaagcuggagaaccagcuggagggcaagguggaggagguggaccugaagcccaugaaggagaagaacgccaaggaggagcugaucagaugggaggagggcaagaaguggcaggccaagaucgagggcaucagaaacaagcugaaggagaaggagggcgagguguucacccugaccaagcagcugaacacccugaaggaccuguucgccaaggccgacaaggagaagcugacccugcagagaaagcugaagaccaccggcaugaccguggaccaggugcugggcaucagagcccuggagagcgagaaggagcuggaggagcugaagaagagaaaccuggaccuggagaacgacauccuguacaugagagcccaccaggcccugcccagagacagcgugguggaggaccugcaccugcagaacagauaccugcaggagaagcugcacgcccuggagaagcaguucagcaaggacaccuacagcaagcccagcaucagcggcaucgagagcgacgaccacugccagagagagcaggagcugcagaaggagaaccugaagcugagcagcgagaacaucgagcugaaguuccagcuggagcaggccaacaaggaccugcccagacugaagaaccaggugagagaccugaaggagaugugcgaguuccugaagaaggagaaggccgaggugcagagaaagcugggccacgugagaggcagcggcagaagcggcaagaccauccccgagcuggagaagaccaucggccugaugaagaaggugguggagaaggugcagagagagaacgagcagcugaagaaggccagcggcauccugaccagcgagaagauggccaacaucgagcaggagaacgagaagcugaaggccgagcuggagaagcugaaggcccaccugggccaccagcugagcaugcacuacgagagcaagaccaagggcaccgagaagaucaucgccgagaacgagagacugagaaaggagcugaagaaggagaccgacgccgccgagaagcugagaaucgccaagaacaaccuggagauccugaacgagaagaugaccgugcagcuggaggagaccggcaagagacugcaguucgccgagagcagaggcccccagcuggagggcgccgacagcaagagcuggaagagcaucguggugaccagaauguacgagaccaagcugaaggagcuggagaccgacaucgccaagaagaaccagagcaucaccgaccugaagcagcuggugaaggaggccaccgagagagagcagaaggugaacaaguacaacgaggaccuggagcagcagaucaagauccugaagcacgugcccgagggcgccgagaccgagcagggccugaagagagagcugcaggugcugagacuggccaaccaccagcuggacaaggagaaggccgagcugauccaccagaucgaggccaacaaggaccagagcggcgccgagagcaccauccccgacgccgaccagcugaaggagaagaucaaggaccuggagacccagcugaagaugagcgaccuggagaagcagcaccugaaggaggagaucaagaagcugaagaaggagcuggagaacuucgaccccagcuucuucgaggagaucgaggaccugaaguacaacuacaaggaggaggugaagaagaacauccugcuggaggagaaggugaagaagcugagcgagcagcugggcguggagcugaccagccccguggccgccagcgaggaguucgaggacgaggaggagagccccgugaacuuccccaucuacuaa

SEQ ID NO: 15095 - RNA, 906 nt, Artificial Sequence
  CEP41__Homo_sapiens__NP_001244087
augagccugagaagacacaucggcaaccccgaguaccugaugaagagaaucccccagaaccccagauaccagcacaucaagagcagacuggacaccggcaacagcaugaccaaguacaccgagaagcuggaggagaucaagaagaacuacagauacaagaaggacgagcuguucaagagacugaaggugaccaccuucgcccagcugaucauccagguggccagccugagcgaccagacccuggaggugaccgccgaggagauccagagacuggaggacaacgacagcgccgccagcgaccccgacgccgagaccaccgccagaaccaacggcaagggcaaccccggcgagcagagccccagccccgagcaguucaucaacaacgccggcgccggcgacagcagcagaagcacccugcagagcgugaucagcggcgugggcgagcuggaccuggacaagggccccgugaagaaggccgagccccacaccaaggacaagcccuaccccgacugccccuuccugcugcuggacgugagagacagagacagcuaccagcagugccacaucgugggcgccuacagcuaccccaucgccacccugagcagaaccaugaaccccuacagcaacgacauccuggaguacaagaacgcccacggcaagaucaucauccuguacgacgacgacgagagacuggccagccaggccgccaccaccaugugcgagagaggcuucgagaaccuguucaugcugagcggcggcagacugaaccaggccaacagcagcggcagagagagcaaggugcccggcgccagaagcgcccagaaccugcccggcggcggccccgccagccacagcaaccccagaagccugagcagcggccaccugcagggcaagcccuggaaguaa

SEQ ID NO: 15096 - RNA, 1395 nt, Artificial Sequence
  CEP55__Homo_sapiens__NP_001120654
augagcagcagaagcaccaaggaccugaucaagagcaaguggggcagcaagcccagcaacagcaagagcgagaccacccuggagaagcugaagggcgagaucgcccaccugaagaccagcguggacgagaucaccagcggcaagggcaagcugaccgacaaggagagacacagacugcuggagaagaucagagugcuggaggccgagaaggagaagaacgccuaccagcugaccgagaaggacaaggagauccagagacugagagaccagcugaaggccagauacagcaccaccgcccugcuggagcagcuggaggagaccaccagagagggcgagagaagagagcaggugcugaaggcccugagcgaggagaaggacgugcugaagcagcagcugagcgccgccaccagcagaaucgccgagcuggagagcaagaccaacacccugagacugagccagaccguggcccccaacugcuucaacagcagcaucaacaacauccacgagauggagauccagcugaaggacgcccuggagaagaaccagcaguggcugguguacgaccagcagagagagguguacgugaagggccugcuggccaagaucuucgagcuggagaagaagaccgagaccgccgcccacagccugccccagcagaccaagaagcccgagagcgagggcuaccugcaggaggagaagcagaagugcuacaacgaccugcuggccagcgccaagaaggaccuggagguggagagacagaccaucacccagcugagcuucgagcugagcgaguucagaagaaaguacgaggagacccagaaggaggugcacaaccugaaccagcugcuguacagccagagaagagccgacgugcagcaccuggaggacgacagacacaagaccgagaagauccagaagcugagagaggagaacgacaucgccagaggcaagcuggaggaggagaagaagagaagcgaggagcugcugagccaggugcaguuccuguacaccagccugcugaagcagcaggaggagcagaccagaguggcccugcuggagcagcagaugcaggccugcacccuggacuucgagaacgagaagcuggacagacagcacgugcagcaccagcugcacgugauccugaaggagcugagaaaggccagaaaccagaucacccagcuggagagccugaagcagcugcacgaguucgccaucaccgagccccuggugaccuuccagggcgagaccgagaacagagagaagguggccgccagccccaagagccccaccgccgcccugaacgagagccugguggagugccccaagugcaacauccaguaccccgccaccgagcacagagaccugcuggugcacguggaguacugcagcaaguaa

SEQ ID NO: 15097 - RNA, 1476 nt, Artificial Sequence
  CEP57__Homo_sapiens__NP_001230705
augcugaccagaaucgacaacagcuucgccgagcccagcagaagcaacggcagcauggugagacacagcagcagccccuacgugguguaccccagcgacaagcccuuccugaacagcgaccugagaagaagccccagcaagcccacccuggccuaccccgagagcaacagcagagccaucuucagcgcccugaagaaccugcaggacaagaucagaagacuggagcuggagagaauccaggccgaggagagcgugaagacccugagcagagagaccaucgaguacaagaaggugcuggacgagcagauccaggagagagagaacagcaagaacgaggagagcaagcacaaccaggagcugaccagccagcugcuggccgccgagaacaagugcaaccugcuggagaagcagcuggaguacaugagaaacaugaucaagcacgccgagauggagagaaccagcgugcuggagaagcaggugagccuggagagagagagacagcacgaccagacccacgugcagagccagcuggagaagcuggaccugcuggagcaggaguacaacaagcugaccaccaugcaggcccuggccgagaagaagaugcaggagcuggaggccaagcugcacgaggaggagcaggagagaaagagaaugcaggccaaggccgccgagcugcagaccggccuggagaccaacagacugaucuucgaggacaaggccacccccugcgugcccaacgccagaagaaucaagaagaagaagagcaagccccccgagaagaagagcagcagaaacuacuucggcgcccagccccacuacagacugugccugggcgacaugcccuucguggccggcaagagcaccagccccagccacgccgugguggccaacgugcagcuggugcugcaccugaugaagcagcacagcaaggcccugugcaacgacagagugaucaacagcaucccccuggccaagcaggugagcagcagaggcggcaagagcaagaagcugagcgugaccccccccagcagcaacggcaucaacgaggagcugagcgaggugcugcagacccugcaggacgaguucggccagaugagcuucgaccaccagcagcuggccaagcugauccaggagagccccaccguggagcugaaggacaagcuggagugcgagcuggaggcccuggugggcagaauggaggccaaggccaaccagaucaccaaggugagaaaguaccaggcccagcuggagaagcagaagcuggagaagcagaagaaggagcugaaggccaccaagaagacccuggacgaggagagaaacagcagcagcagaagcggcaucaccggcaccaccaacaagaaggacuucaugaagcugagacccggcgagaagagaagaaagaaccugcagcugcugaaggacaugcagagcauccagaacagccugcagagcagcagccugugcugggacuacuaa

SEQ ID NO: 15098 - RNA, 1488 nt, Artificial Sequence
  CEP63__Homo_sapiens__NP_001035842
auggaggcccugcuggagggcauccagaacagaggccacggcggcggcuuccugaccagcugcgaggccgagcugcaggagcugaugaagcagaucgacaucaugguggcccacaagaagagcgagugggagggcagaacccacgcccuggagaccugccugaagaucagagagcaggagcugaagagccugagaagccagcuggacgugacccacaaggaggugggcaugcugcaccagcagguggaggagcacgagaagaucaagcaggagaugaccauggaguacaagcaggagcugaagaagcugcacgaggagcugugcauccugaagagaagcuacgagaagcugcagaagaagcagaugagagaguucagaggcaacaccaagaaccacagagaggacagaagcgagaucgagagacugaccgccaagaucgaggaguucagacagaagagccuggacugggagaagcagagacugaucuaccagcagcaggugagcagccuggaggcccagagaaaggcccuggccgagcagagcgagaucauccaggcccagcuggugaacagaaagcagaagcuggagagcguggagcugagcagccagagcgagauccagcaccugagcagcaagcuggagagagccaacgacaccaucugcgccaacgagcuggagaucgagagacugaccaugagagugaacgaccuggugggcaccagcaugaccgugcugcaggagcagcagcagaaggaggagaagcugagagagagcgagaagcugcuggaggcccugcaggaggagaagagagagcugaaggccgcccugcagagccaggagaaccugauccacgaggccagaauccagaaggagaagcugcaggagaaggugaaggccaccaacacccagcacgccguggaggccaucagccuggagagcgugagcgccaccugcaagcagcugagccaggagcugauggagaaguacgaggagcugaagagaauggaggcccacaacaacgaguacaaggccgagaucaagaagcugaaggagcagauccugcagggcgagcagagcuacagcagcgcccuggagggcaugaagauggagaucagccaccugacccaggagcugcaccagagagacaucaccaucgccagcaccaagggcagcagcagcgacauggagaagagacugagagccgagaugcagaaggccgaggacaaggccguggagcacaaggagauccuggaccagcuggagagccugaagcuggagaacagacaccugagcgagauggugaugaagcuggagcugggccugcacgagugcagccugcccgugagcccccugggcagcaucgccaccagauuccuggaggaggaggagcugagaagccaccacauccuggagagacuggacgcccacaucgaggagcugaagagagagagcgagaagaccgugagacaguucaccgcccugaaguaa

SEQ ID NO: 15099 - RNA, 2274 nt, Artificial Sequence
  CEP68__Homo_sapiens__NP_055962
auggcccugggcgaggagaaggccgaggccgaggccagcgaggacaccaaggcccagagcuacggcagaggcagcugcagagagagagagcuggacauccccggccccaugagcggcgagcagccccccagacuggaggccgagggcggccugaucagccccguguggggcgccgagggcauccccgcccccaccugcuggaucggcaccgaccccggcggccccagcagagcccaccagccccaggccagcgacgccaacagagagcccguggccgagagaagcgagcccgcccugagcggccugccccccgccaccaugggcagcggcgaccugcugcugagcggcgagagccagguggagaagaccaagcugagcagcagcgaggaguucccccagacccugagccugcccagaaccaccaccaucugcagcggccacgacgccgacaccgaggacgaccccagccuggccgaccugccccaggcccuggaccugagccagcagccccacagcagcggccugagcugccugagccaguggaagagcgugcugagccccggcagcgccgcccagcccagcagcugcagcaucagcgccagcagcaccggcagcagccugcagggccaccaggagagagccgagcccagaggcggcagccuggccaaggugagcagcagccuggagcccguggugccccaggagcccagcagcguggugggccugggccccagaccccaguggagcccccagcccguguucagcggcggcgacgccagcggccugggcagaagaagacugagcuuccaggccgaguacugggccugcgugcugcccgacagccugccccccagccccgacagacacagcccccuguggaaccccaacaaggaguacgaggaccugcuggacuacaccuacccccugagacccggcccccagcugcccaagcaccuggacagcagagugcccgccgaccccgugcugcaggacagcggcguggaccuggacagcuucagcgugagccccgccagcacccugaagagccccaccaacgugagccccaacugcccccccgccgaggccaccgcccugcccuucagcggccccagagagcccagccugaagcaguggcccagcagagugccccagaagcagggcggcaugggccuggccagcuggagccagcuggccagcacccccagagcccccggcagcagagacgccagaugggagagaagagagcccgcccugagaggcgccaaggacagacugaccaucggcaagcaccuggacaugggcagcccccagcugagaaccagagacagaggcuggcccagccccagacccgagagagagaagagaaccagccagagcgccagaagacccaccugcaccgagagcagauggaagagcgaggaggagguggagagcgacgacgaguaccuggcccugcccgccagacugacccaggugagcagccuggugagcuaccugggcagcaucagcacccuggugacccugcccaccggcgacaucaagggccagagcccccuggaggugagcgacagcgacggccccgccagcuuccccagcagcagcagccagagccagcugccccccggcgccgcccugcagggcagcggcgaccccgagggccagaaccccugcuuccugagaagcuucgugagagcccacgacagcgccggcgagggcagccugggcagcagccaggcccugggcgugagcagcggccugcugaagaccagacccagccugcccgccagacuggacagauggcccuucagcgaccccgacguggagggccagcugcccagaaagggcggcgagcagggcaaggagagccuggugcagugcgugaagaccuucugcugccagcuggaggagcugaucugcuggcuguacaacguggccgacgugaccgaccacggcaccgccgccagaagcaaccugaccagccugaagagcagccugcagcuguacagacaguucaagaaggacaucgacgagcaccagagccugaccgagagcgugcugcagaagggcgagauccugcugcagugccugcuggagaacacccccgugcuggaggacgugcugggcagaaucgccaagcagagcggcgagcuggagagccacgccgacagacuguacgacagcauccuggccagccuggacaugcuggccggcugcacccugauccccgacaagaagcccauggccgccauggagcaccccugcgagggcguguaa

SEQ ID NO: 15100 - RNA, 1944 nt, Artificial Sequence
  CEP72__Homo_sapiens__NP_060610
auggccagagccggccccagacuggugcugagcgaggaggccgugagagccaagagcggccugggcccccacagagaccuggccgagcugcagagccugagcauccccggcaccuaccaggagaagaucacccaccugggccacagccugaugagccugaccggccugaagagccuggaccugagcagaaacagccuggugagccuggagggcauccaguaccugaccgcccuggagagccugaaccuguacuacaacugcaucagcagccuggccgagguguucagacugcacgcccugaccgagcugguggacguggacuucagacugaaccccguggugaagguggagcccgacuacagacuguucguggugcaccugcugcccaagcugcagcagcuggacgacagacccgugagagccagcgagagaaaggccagcagacugcacuucgccagcgaggacagccuggacagcaaggagagcgugcccgccagccugaaggagggcagaccccaccaccccagagccaagugcaccgaggcccuggccaagcagagccuggugauggacgccgacgacgaggccgugcugaaccugaucgccgagugcgagugggaccugggcagaccccccggcagcaccagcuucagccagaagggcagagaggccgacagcagaggcagccaggagagcagacaccugcugagcccccagcuggugcaguaccagugcggcgacagcggcaagcagggcagagagaccagaagaagcagcugcagaggcugcugccuggagaagaugcccuggagccagcugugcggcgagcugcccccccuguacggcgccgagcccgaggccagcagagcccccagaccccacaccuacuucaccccccaccccgacagcauggacaccgaggacagcgccagcagccagaagcuggaccugagcggcgagauggugcccggcccccugcccgcccccggcaagugcagaaagagaagaaugcccgugggcagauuccagaccuucagcgaccaggagggccugggcugccccgagagaacccacggcagcagcgugcccaaggagagccugagcagacaggacagcagcgagagcagaaacggcagaacccugagccagcccgaggccagcgagaccgaggagcagagaagcagaggcgugaccgacaccagagagcccagccccggcagccacagcgcccugcccggcaagaagaccgcccugcaggccgcccugcuggagacccugcuggaccugguggacagaagcuggggcggcugcagaagccugcacagcaacgaggccuuccuggcccaggccagacacauccugagcagcguggaggaguucaccgccgcccaggacagcagcgccauggugggcgaggacgugggcagccuggcccuggagagcaagagccugcagagcagacuggccgagcagcagcagcagcacgccagagagaugagcgaggugaccgccgagcugcaccacacccacaaggagcuggacgaccugagacagcaccuggacaagagccuggaggagaacagcagacugaagagccugcugcugagcaugaagaaggaggugaagagcgccgacaccgccgccacccugaaccugcagaucgccggccugcagaccagcgugaagagacugugcggcgagaucguggagcugaagcagcaccuggagcacuacgacaagauccaggagcugacccagaugcugcaggagagccacagcagccuggugagcaccaacgagcaccugcugcaggagcugagccaggugagagcccagcacagagccgagguggagcagaugcacuggagcuaccaggagcugaagaagaccauggcccuguucccccacagcagcgccagccacggcggcugccaggccugcuaa

SEQ ID NO: 15101 - RNA, 1755 nt, Artificial Sequence
  CEP76__Homo_sapiens__NP_001258918
augagccugccccccgagaaggccagcgagcugaagcagcugauccaccagcagcugagcaagauggacgugcacggcagaaucagagagauccuggccgagaccaucagagaggagcuggcccccgaccagcagcaccugagcaccgaggaccugaucaaggcccugagaagaagaggcaucaucgacgacgugaugaaggagcugaacuucgugaccgacagcguggagcaggagcugcccagcagccccaagcagcccaucugcuucgacagacagagcacccugaagaagagcgacggcaccagaauggccgacagcaccaccaugcugagcaucagcgaccccauccacauggugcugaucaagaccgacaucuucggcgagaccacccugguggccagcuacuuccuggaguggagaagcgugcugggcagcgagaacggcgugaccagccugaccguggagcugaugggcgugggcaccgagagcaaggugagcgugggcauccugaacaucaagcuggagauguaccccccccugaaccagacccugagccaggagguggugaacacccagcuggcccuggagagacagaagaccgccgagaaggagagacuguuccugguguacgccaagcagugguggagagaguaccugcagaucagacccagccacaacagcagacuggugaagaucuucgcccaggacgagaacggcaucaacagacccgugugcagcuacgugaagccccugagagccggcagacugcuggacacccccagacaggccgccagauucgugaacgugcugggcuacgagagagcccccgugaucggcggcggcggcaagcaggagcaguggugcacccugcuggccuuccugugcagaaacaagggcgacugcgaggaccacgccaaccugcugugcagccugcugcugggcuacggccuggaggccuucgugugcgugggcaccaaggccaagggcgugccccacgccugggugaugaccugcggcaccgacggcgccaucaccuucugggagagccugaccggccacagauacauccacaagcccaccaaccccgacgagccccccguggccgagcagcccaagccccuguaccccuacagaaccaucggcugcguguucaaccaccagauguuccugggcaacugccagcccagcgacgccguggagaccugcguguucgaccugaacgacgagagcaaguggaagcccaugagcgaggaggccaucaagagcgugugcgcccccggcgccaccaccagccugccccccuuccccccccugugcgccagcaccaucgacgccagcgugaccagcaacgagaucgagaugcagcugagacugcuggugagcgagcacagaaaggaccugggccugaccaccgugugggaggaccagcugagcuaccugcugagccccgcccuggccagcuacgaguucgagagaaccaccagcaucagcgccggcaacgaggaguuccaggacgccaucagaagagccgugcccgacggccacaccuucaagggcuuccccauccacuucguguacagaaacgccagaagagccuucgccaccugccugagaagccccuucugcgaggagaucaucugcugcagaggcgaccaggugagacuggccgugagagugagaguguucaccuaccccgagagcgccugcgccguguggaucauguucgccugcaaguacagaagcgugcuguaa

SEQ ID NO: 15102 - RNA, 2106 nt, Artificial Sequence
  CEP83__Homo_sapiens__NP_057206
augguggugagcaccuucaccgacauggacaccuuccccaacaacuucccccccggcggcgacagcggccugaccggcagccagagcgaguuccagaagaugcugaucgacgagagacugagaugcgagcaccacaaggccaacuaccagacccugaaggccgagcacaccagacugcagaacgagcacgugaagcugcagaacgagcugaagcaccuguucaacgagaagcagacccagcaggagaagcugcagcugcugcuggaggagcugagaggcgagcugguggagaagaccaaggaccuggaggagaugaagcugcagauccugaccccccagaagcuggagcugcugagagcccagauccagcaggagcuggagacccccaugagagagagauucagaaaccuggacgaggagguggagaaguacagagccguguacaacaagcugagauacgagcacaccuuccugaagagcgaguucgagcaccagaaggaggaguacgccagaauccuggacgagggcaagaucaaguacgagagcgagaucgccagacuggaggaggacaaggaggagcugagaaaccagcugcugaacguggaccugaccaaggacagcaagagaguggagcagcuggccagagagaagguguaccugugccagaagcugaagggccuggaggccgagguggccgagcugaaggccgagaaggagaacagcgaggcccagguggagaacgcccagagaauccaggugagacagcuggccgagaugcaggccaccgugagaagccuggaggccgagaagcagagcgccaaccugagagccgagagacuggagaaggagcugcagagcagcagcgagcagaacaccuuccugaucaacaagcugcacaaggccgagagagagaucaacacccugagcagcaaggugaaggagcugaagcacagcaacaagcuggagaucaccgacaucaagcuggagaccgccagagccaagagcgagcuggagagagagagaaacaagauccagagcgagcuggacggccugcagagcgacaacgagauccugaaggccgccguggagcaccacaaggugcugcugguggagaaggacagagagcugaucagaaaggugcaggccgccaaggaggagggcuaccagaagcugguggugcugcaggacgagaagcuggagcuggagaacagacuggccgaccuggagaagaugaagguggagcacgacguguggagacagagcgagaaggaccaguacgaggagaagcugagagccagccagauggccgaggagaucaccagaaaggagcugcagagcgugagacugaagcugcagcagcagaucgugaccaucgagaacgccgagaaggagaagaacgagaacagcgaccugaagcagcagaucagcagccugcagauccaggugaccagccuggcccagagcgagaacgaccugcugaacagcaaccagaugcugaaggagaugguggagagacugaagcaggagugcagaaacuucagaagccaggccgagaaggcccagcuggaggccgagaagacccuggaggagaagcagauccaguggcuggaggagaagcacaagcugcacgagagaaucaccgacagagaggagaaguacaaccaggccaaggagaagcugcagagagccgccaucgcccagaagaagagaaagagccugcacgagaacaagcugaagagacugcaggagaagguggaggugcuggaggccaagaaggaggagcuggagaccgagaaccaggugcugaacagacagaacgugcccuucgaggacuacaccagacugcagaagagacugaaggacauccagagaagacacaacgaguucagaagccugauccuggugcccaacaugccccccaccgccagcaucaaccccgugagcuuccagagcagcgccauggugcccagcauggagcugcccuuccccccccacaugcaggaggagcagcaccagagagagcugagccugcugagaaagagacuggaggagcuggagaccacccagagaaagcagcuggaggagcugggcagcagcggcgaguaa

SEQ ID NO: 15103 - RNA, 2418 nt, Artificial Sequence
  CEP85L__Homo_sapiens__NP_001035940
auguggggcagauuccuggcccccgaggccagcggcagagacagccccggcggcgccagaagcuuccccgccggccccgacuacagcagcgccuggcugcccgccaacgagagccuguggcaggccaccaccgugcccagcaaccacagaaacaaccacaucagaagacacagcaucgccagcgacagcggcgacaccggcaucggcaccagcugcagcgacagcguggaggaccacagcaccagcagcggcacccugagcuucaagcccagccagagccugaucacccugcccaccgcccacgugaugcccagcaacagcagcgccagcaucagcaagcugagagagagccugacccccgacggcagcaaguggagcaccagccugaugcagacccugggcaaccacagcagaggcgagcaggacagcagccuggacaugaaggacuucagaccccugagaaaguggagcagccugagcaagcugaccgcccccgacaacugcggccagggcggcaccgugugcagagaggagagcagaaacggccuggagaagaucggcaaggccaaggcccugaccagccagcugagaaccaucggccccagcugccugcacgacagcauggagaugcugagacuggaggacaaggagaucaacaagaagagaagcagcacccuggacugcaaguacaaguucgagagcugcagcaaggaggacuucagagccagcagcagcacccugagaagacagcccguggacaugaccuacagcgcccugcccgagagcaagcccaucaugaccagcagcgaggccuucgagccccccaaguaccugaugcugggccagcaggccgugggcggcgugcccauccagcccagcgugagaacccagauguggcugaccgagcagcugagaaccaacccccuggagggcagaaacaccgaggacagcuacagccuggcccccuggcagcagcagcagaucgaggacuucagacagggcagcgagacccccaugcaggugcugaccggcagcagcagacagagcuacagccccggcuaccaggacuucagcaagugggagagcaugcugaagaucaaggagggccugcugagacagaaggagaucgugaucgacagacagaagcagcagaucacccaccugcacgagagaaucagagacaacgagcugagagcccagcacgccaugcugggccacuacgugaacugcgaggacagcuacguggccagccugcagccccaguacgagaacaccagccugcagacccccuucagcgaggagagcgugagccacagccagcagggcgaguucgagcagaagcuggccagcaccgagaaggaggugcugcagcugaacgaguuccugaagcagagacugagccuguucagcgaggagaagaagaagcuggaggagaagcugaagaccagagacagauacaucagcagccugaagaagaagugccagaaggagagcgagcagaacaaggagaagcagagaagaaucgagacccuggagaaguaccuggccgaccugcccacccuggacgacgugcagagccagagccugcagcugcagauccuggaggagaagaacaagaaccugcaggaggcccugaucgacaccgagaagaagcuggaggagaucaagaagcagugccaggacaaggagacccagcugaucugccagaagaagaaggagaaggagcuggugaccaccgugcagagccugcagcagaagguggagagaugccuggaggacggcaucagacugcccaugcuggacgccaagcagcugcagaacgagaacgacaaccugagacagcagaacgagaccgccagcaagaucaucgacagccagcaggacgagaucgacagaaugauccuggagauccagagcaugcagggcaagcugagcaaggagaagcugaccacccagaagaugauggaggagcuggagaagaaggagagaaacgugcagagacugaccaaggcccugcuggagaaccagagacagaccgacgagaccugcagccugcuggaccagggccaggagcccgaccagagcagacagcagaccgugcugagcaagagaccccuguucgaccugaccgugaucgaccagcuguucaaggagaugagcugcugccuguucgaccugaaggcccugugcagcauccugaaccagagagcccagggcaaggagcccaaccugagccugcugcugggcaucagaagcaugaacugcagcgccgaggagaccgagaacgaccacagcaccgagacccugaccaagaagcugagcgacgugugccagcugagaagagacaucgacgagcugagaaccaccaucagcgacagauacgcccaggacaugggcgacaacugcaucacccaguaa

SEQ ID NO: 15104 - RNA, 2352 nt, Artificial Sequence
  CEP89__Homo_sapiens__NP_116205
augcugcugggcuucagaagaggcagaagaagccacuucaagcacaucauccacggccugcugcccgccgccagcguggcccccaaggccgccgugcccagaacccccccccccagaagccccaaccccagccccgagagacccagaagcgcccuggccgccgccauccuggccaccacccugaccggcagaaccguggccaucccccagcccagacagagaagcagaagcgagagcgacgugagcagcguggagcaggacagcuucaucgagcccuacgccaccaccagccagcugagacccagacccaacuggcagagcgagaugggcagaagaagcagccugcccagcuucgagacccuggacuacggcgacgaggaggacaucgagacccagcugagcagcagcggcaaggagcugggcgacgugagcgccagagaggacagaggcggccacagcgacgaccuguacgccgugccccacagaaaccaggugccccugcugcacgaggugaacagcgaggacgacgagaacaucagccaccaggacggcuuccccggcagcccccccgccccccagagaacccagcagaaggacggcaagcaccccgugcugaaccugaaggacgagaagcccccccugugcgagaagcccccccccagccccgacaucaccggcagagccagacagagauacaccgagaucaccagagagaaguucgaggcccugaaggaggagaacauggaccugaacaacaugaaccagagccugacccuggagcugaacaccaugaagcaggccaugaaggagcugcagcugaagcugaagggcauggagaaggagaagagaaagcugaaggaggccgagaaggccagcagccaggagguggccgcccccgagcugcuguaccugagaaagcaggcccaggagcugguggacgagaacgacggccugaagaugaccgugcacagacugaacguggagcugagcagauaccagaccaaguucagacaccugagcaaggaggagagccugaacaucgagggccugcccagcaagggccccaucccccccuggcugcuggacaucaaguaccugagcccccugcugcuggccuacgaggacaugaugaaggagaaggacgagcugaacgccacccugaaggaggagaugagaauguucagaaugagagugcaggagguggugaaggagaacgaggagcugcaccaggagcugaacaagagcagcgccgugaccagcgaggaguggagacagcugcagacccaggccaagcuggugcuggaggagaacaagcugcugcuggagcagcuggagauccagcagagaaaggccaaggacagccaccaggagagacugcaggaggugagcaagcugaccaagcagcugaugcugcuggaggccaagacccacggccaggagaaggagcuggccgagaacagagagcagcuggagauccugagagccaagugccaggagcugaagacccacagcgacggcaagaucgccguggaggugcacaagagcaucgugaacgagcugaagagccagcugcagaaggaggaggagaaggagagagccgagauggaggagcugauggagaagcugaccgugcugcaggcccagaagaagagccugcugcuggagaagaacagccugaccgagcagaacaaggcccuggaggccgagcuggagagagcccagaagaucaacagaaagagccagaagaagaucgaggugcugaagaagcagguggagaaggccaugggcaacgagaugagcgcccaccaguaccuggccaaccuggugggccuggccgagaacaucacccaggagagagacagccugaugugccuggccaagugccuggagagcgagaaggacggcgugcugaacaaggugaucaagagcaacaucagacugggcaagcuggaggagaaggugaagggcuacaagaagcaggccgcccugaagcugggcgacaucagccacagacugcuggagcagcaggaggacuucgccggcaagaccgcccaguacagacaggagaugagacaccugcaccaggugcugaaggacaagcaggaggugcuggaccaggcccugcagcagaacagagagauggagggcgagcuggaggugaucugggagagcaccuucagagagaacagaagaaucagagagcugcugcaggacacccugaccagaaccggcgugcaggacaaccccagagcccugguggcccccagccugaacggcgugagccaggccgaccugcuggacggcugcgacgugugcagcuacgaccugaagagccacgcccccaccugcuaa

SEQ ID NO: 15105 - RNA, 804 nt, Artificial Sequence
  CER1__Homo_sapiens__NP_005445
augcaccugcugcuguuccagcugcuggugcugcugccccugggcaagaccaccagacaccaggacggcagacagaaccagagcagccugagccccgugcugcugcccagaaaccagagagagcugcccaccggcaaccacgaggaggccgaggagaagcccgaccuguucguggccgugccccaccugguggccaccagccccgccggcgagggccagagacagagagagaagaugcugagcagauucggcagauucuggaagaagcccgagagagagaugcaccccagcagagacagcgacagcgagcccuucccccccggcacccagagccugauccagcccaucgacggcaugaagauggagaagagcccccugagagaggaggccaagaaguucuggcaccacuucauguucagaaagacccccgccagccagggcgugauccugcccaucaagagccacgaggugcacugggagaccugcagaaccgugcccuucagccagaccaucacccacgagggcugcgagaaggugguggugcagaacaaccugugcuucggcaagugcggcagcgugcacuuccccggcgccgcccagcacagccacaccagcugcagccacugccugcccgccaaguucaccaccaugcaccugccccugaacugcaccgagcugagcagcgugaucaagguggugaugcugguggaggagugccagugcaaggugaagaccgagcacgaggacggccacauccugcacgccggcagccaggacagcuucauccccggcgugagcgccuaa

SEQ ID NO: 15106 - RNA, 1614 nt, Artificial Sequence
  CERK__Homo_sapiens__NP_073603
augggcgccaccggcgccgccgagccccugcagagcgugcugugggugaagcagcagagaugcgccgugagccuggagcccgccagagcccugcugagaugguggagaagccccggccccggcgccggcgcccccggcgccgacgccugcagcgugcccgugagcgagaucaucgccguggaggagaccgacgugcacggcaagcaccagggcagcggcaaguggcagaagauggagaagcccuacgccuucaccgugcacugcgugaagagagccagaagacacagauggaagugggcccaggugaccuucuggugccccgaggagcagcugugccaccuguggcugcagacccugagagagaugcuggagaagcugaccagcagacccaagcaccugcugguguucaucaaccccuucggcggcaagggccagggcaagagaaucuacgagagaaagguggccccccuguucacccuggccagcaucaccaccgacaucaucgugaccgagcacgccaaccaggccaaggagacccuguacgagaucaacaucgacaaguacgacggcaucgugugcgugggcggcgacggcauguucagcgaggugcugcacggccugaucggcagaacccagagaagcgccggcguggaccagaaccaccccagagccgugcuggugcccagcagccugagaaucggcaucauccccgccggcagcaccgacugcgugugcuacagcaccgugggcaccagcgacgccgagaccagcgcccugcacaucguggugggcgacagccuggccauggacgugagcagcgugcaccacaacagcacccugcugagauacagcgugagccugcugggcuacggcuucuacggcgacaucaucaaggacagcgagaagaagagauggcugggccuggccagauacgacuucagcggccugaagaccuuccugagccaccacugcuacgagggcaccgugagcuuccugcccgcccagcacaccgugggcagccccagagacagaaagcccugcagagccggcugcuucgugugcagacagagcaagcagcagcuggaggaggagcagaagaaggcccuguacggccuggaggccgccgaggacguggaggaguggcagguggugugcggcaaguuccuggccaucaacgccaccaacaugagcugcgccugcagaagaagccccagaggccugagccccgccgcccaccugggcgacggcagcagcgaccugauccugaucagaaagugcagcagauucaacuuccugagauuccugaucagacacaccaaccagcaggaccaguucgacuucaccuucguggagguguacagagugaagaaguuccaguucaccagcaagcacauggaggacgaggacagcgaccugaaggagggcggcaagaagagauucggccacaucugcagcagccaccccagcugcugcugcaccgugagcaacagcagcuggaacugcgacggcgaggugcugcacagccccgccaucgaggugagagugcacugccagcuggugagacuguucgccagaggcaucgaggagaaccccaagcccgacagccacagcuaa

SEQ ID NO: 15107 - RNA, 1677 nt, Artificial Sequence
  CERKL__Homo_sapiens__NP_001025482
augcccuggagaagaagaagaaacagagugagcgcccuggagggcggcagagaggaggaggccccccccgaggccgccgccgugccccccgcccugcugaccagcccccagcagaccgaggccgccgccgagagaauccugcugagaggcaucuucgagaucggcagagacagcugcgacguggugcugagcgagagagcccugagauggagacccauccagcccgagagacccgccggcgacagcaaguacgaccugcugugcaaggaggaguucaucgagcugaaggacaucuucagcgugaagcugaagagaagaugcagcgugaagcagcagagaagcggcacccugcugggcaucacccuguucaucugccugaagaaggagcagaacaagcugaagaacagcacccuggaccugaucaaccugagcgaggaccacugcgacaucugguucagacaguucaagaagauccuggccggcuuccccaacagacccaagagccugaagauccugcugaacccccagagccacaagaaggaggccacccagguguacuacgagaagguggagccccugcugaagcuggccggcaucaagaccgacgugaccaucauggaguacgagggccacgcccugagccugcugaaggagugcgagcugcagggcuucgacggcggccacagaaagccccuguucgccauccacuggagcgugcagagacuguucaccggcaugcagacccuggagcccagcguggugugcgugggcggcgacggcagcgccagcgagguggcccacgcccugcugcugagagcccagaagaacgccggcauggagaccgacagaauccugacccccgugagagcccagcugccccugggccugauccccgccggcagcaccaacgugcuggcccacagccugcacggcgugccccacgugaucaccgccacccugcacaucaucaugggccacgugcagcugguggacgugugcaccuucagcaccgccggcaagcugcugagauucggcuucagcgccauguucggcuucggcggcagaacccuggcccuggccgagaaguacagauggaugagccccaaccagagaagagacuucgccguggugaaggcccuggccaagcugaaggccgaggacugcgagaucagcuuccugcccuucaacagcagcgacgacgugcaggagagaagagcccagggcagccccaagagcgacugcaacgaccaguggcagaugauccagggccaguuccugaacgugagcaucauggccauccccugccugugcagcguggcccccagaggccuggcccccaacaccagacugaacaacggcagcauggcccugaucaucgccagaaacaccagcagacccgaguucaucaagcaccugaagagauacgccagcgugaagaaccaguucaacuuccccuucguggagaccuacaccguggaggaggugaaggugcaccccagaaacaacaccggcggcuacaaccccgaggaggaggaggacgagaccgccagcgagaacugcuuccccuggaacguggacggcgaccugauggagguggccagcgaggugcacaucagacugcaccccagacugaucagccuguacggcggcagcauggaggagaugauccccaaguaa

SEQ ID NO: 15108 - RNA, 720 nt, Artificial Sequence
  CERS1__Homo_sapiens__NP_001277194
augcccgagagcgccuggaaguuccuguucuaccugggcagcuggagcuacagcgccuaccugcuguucggcaccgacuaccccuucuuccacgacccccccagcguguucuacgacuggacccccggcauggccgugcccagagacaucgccgccgccuaccugcugcagggcagcuucuacggccacagcaucuacgccacccuguacauggacaccuggagaaaggacagcguggugaugcugcugcaccacguggugacccugauccugaucgugagcagcuacgccuucagauaccacaacgugggcauccuggugcuguuccugcacgacaucagcgacgugcagcuggaguucaccaagcugaacaucuacuucaagagcagaggcggcagcuaccacagacugcacgcccuggccgccgaccugggcugccugagcuucggcuucagcugguucugguucagacuguacugguucccccugaaggugcuguacgccaccagccacugcagccugagaaccgugcccgacauccccuucuacuucuucuucaacgcccugcugcugcugcugacccugaugaaccuguacugguuccuguacaucguggccuucgccgccaaggugcugaccggccaggugcacgagcugaaggaccugagagaguacgacaccgccgaggcccagagccugaagcccagcaaggccgaguaa

SEQ ID NO: 15109 - RNA, 1203 nt, Artificial Sequence
  CERS2__Homo_sapiens__XP_011507753
auggugccccuggcccugcacuuccccggcgaggugggccugcaggagaccgccgugagaaugcugcagacccuguacgacuacuucuggugggagagacuguggcugcccgugaaccugaccugggccgaccuggaggacagagacggcagaguguacgccaaggccagcgaccuguacaucacccugccccuggcccugcuguuccugaucgugagauacuucuucgagcuguacguggccaccccccuggccgcccugcugaacaucaaggagaagaccagacugagagccccccccaacgccacccuggagcacuucuaccugaccagcggcaagcagcccaagcagguggagguggagcugcugagcagacagagcggccugagcggcagacagguggagagaugguucagaagaagaagaaaccaggacagacccagccugcugaagaaguucagagaggccagcuggagauucaccuucuaccugaucgccuucaucgccggcauggccgugaucguggacaagcccugguucuacgacaugaagaaggugugggagggcuaccccauccagagcaccauccccagccaguacugguacuacaugaucgagcugagcuucuacuggagccugcuguucagcaucgccagcgacgugaagagaaaggacuucaaggagcagaucauccaccacguggccaccaucauccugaucagcuucagcugguucgccaacuacaucagagccggcacccugaucauggcccugcacgacagcagcgacuaccugcuggagagcgccaagauguucaacuacgccggcuggaagaacaccugcaacaacaucuucaucguguucgccaucguguucaucaucaccagacuggugauccugcccuucuggauccugcacugcacccugguguacccccuggagcuguaccccgccuucuucggcuacuacuucuucaacagcaugaugggcgugcugcagcugcugcacaucuucugggccuaccugauccugagaauggcccacaaguucaucaccggcaagcugguggaggacgagagaagcgacagagaggagaccgagagcagcgagggcgaggaggccgccgccggcggcggcgccaagagcagaccccuggccaacggccaccccauccugaacaacaaccacagaaagaacgacuaa

SEQ ID NO: 15110 - RNA, 1185 nt, Artificial Sequence
  CERS3__Homo_sapiens__NP_001277270
augcugcacaccaccgccagaagagccgccagaauguucuggaccuucaaggagugguucuggcuggagagauucuggcugccccccaccaucaaguggagcgaccuggaggaccacgacggccugguguucgugaagcccagccaccuguacgugaccauccccuacgccuuccugcugcugaucaucagaagaguguucgagaaguucguggccagcccccuggccaagagcuucggcaucaaggagaccgugagaaaggugacccccaacaccgugcuggagaacuucuucaagcacagcaccagacagccccugcagaccgacaucuacggccuggccaagaagugcaaccugaccgagagacagguggagagaugguucagaagcagaagaaaccaggagagacccagcagacugaagaaguuccaggaggccugcuggagauucgccuucuaccugaugaucaccguggccggcaucgccuuccuguacgacaagcccuggcuguacgaccugugggagguguggaacggcuaccccaagcagccccugcugcccagccaguacugguacuacauccuggagaugagcuucuacuggagccugcuguucagacugggcuucgacgugaagagaaaggacuuccuggcccacaucauccaccaccuggccgccaucagccugaugagcuucagcuggugcgccaacuacaucagaagcggcacccuggugaugaucgugcacgacguggccgacaucuggcuggagagcgccaagauguucagcuacgccggcuggacccagaccugcaacacccuguucuucaucuucagcaccaucuucuucaucagcagacugaucguguuccccuucuggauccuguacugcacccugauccugcccauguaccaccuggagcccuucuucagcuacaucuuccugaaccugcagcugaugauccugcaggugcugcaccuguacuggggcuacuacauccugaagaugcugaacagaugcaucuucaugaagagcauccaggacgugagaagcgacgacgaggacuacgaggaggaggaggaggaggaggaggaggaggccaccaagggcaaggagauggacugccugaagaacggccugagagccgagagacaccugauccccaacggccagcacggccacuaa

SEQ ID NO: 15111 - RNA, 1185 nt, Artificial Sequence
  CERS4__Homo_sapiens__NP_078828
augcugagcagcuucaacgagugguucuggcaggacagauucuggcugccccccaacgugaccuggaccgagcuggaggacagagacggcagaguguacccccacccccaggaccugcuggccgcccugccccuggcccuggugcugcuggccaugagacuggccuucgagagauucaucggccugccccugagcagauggcugggcgugagagaccagaccagaagacaggugaagcccaacgccacccuggagaagcacuuccugaccgagggccacagacccaaggagccccagcugagccugcuggccgcccagugcggccugacccugcagcagacccagagaugguucagaagaagaagaaaccaggacagaccccagcugaccaagaaguucugcgaggccagcuggagauuccuguucuaccugagcagcuucgugggcggccugagcgugcuguaccacgagagcuggcugugggcccccgugaugugcugggacagauaccccaaccagacccugaagcccagccuguacuggugguaccugcuggagcugggcuucuaccugagccugcugaucagacugcccuucgacgugaagagaaaggacuucaaggagcaggugauccaccacuucguggccgugauccugaugaccuucagcuacagcgccaaccugcugagaaucggcagccuggugcugcugcugcacgacagcagcgacuaccugcuggaggccugcaagauggugaacuacaugcaguaccagcaggugugcgacgcccuguuccugaucuucagcuucguguucuucuacaccagacuggugcuguuccccacccagauccuguacaccaccuacuacgagagcaucagcaacagaggccccuucuucggcuacuacuucuucaacggccugcugaugcugcugcagcugcugcacguguucuggagcugccugauccugagaaugcuguacagcuucaugaagaagggccagauggagaaggacaucagaagcgacguggaggagagcgacagcagcgaggaggccgccgccgcccaggagccccugcagcugaagaacggcgccgccggcggccccagacccgcccccaccgacggccccagaagcagaguggccggcagacugaccaacagacacaccaccgccaccuaa

SEQ ID NO: 15112 - RNA, 1179 nt, Artificial Sequence
  CERS6__Homo_sapiens__NP_001243055
auggccggcauccuggccugguucuggaacgagagauucuggcugccccacaacgugaccugggccgaccugaagaacaccgaggaggccaccuucccccaggccgaggaccuguaccuggccuucccccuggccuucugcaucuucauggugagacugaucuucgagagauucguggccaagcccugcgccaucgcccugaacauccaggccaacggcccccagaucgccccccccaacgccauccuggagaagguguucaccgccaucaccaagcaccccgacgagaagagacuggagggccugagcaagcagcuggacugggacgugagaagcauccagagaugguucagacagagaagaaaccaggagaagcccagcacccugaccagauucugcgagagcauguggagauucagcuucuaccuguacguguucaccuacggcgugagauuccugaagaagacccccuggcuguggaacaccagacacugcugguacaacuaccccuaccagccccugaccaccgaccugcacuacuacuacauccuggagcugagcuucuacuggagccugauguucagccaguucaccgacaucaagagaaaggacuucggcaucauguuccugcaccaccuggugagcaucuuccugaucaccuucagcuacgugaacaacauggccagagugggcacccuggugcugugccugcacgacagcgccgacgcccugcuggaggccgccaagauggccaacuacgccaaguuccagaagaugugcgaccugcuguucgugauguucgccgugguguucaucaccaccagacugggcaucuucccccugugggugcugaacaccacccuguucgagagcugggagaucgugggccccuaccccagcugguggguguucaaccugcugcugcugcuggugcagggccugaacugcuucuggagcuaccugaucgugaagaucgccugcaaggccgugagcagaggcaaggccggcaaguggaacccccugcacgugagcaaggacgacagaagcgacaucgagagcagcagcgacgaggaggacagcgagccccccggcaagaacccccacaccgccaccaccaccaacggcaccagcggcaccaacggcuaccugcugaccggcagcugcagcauggacgacuaa

SEQ ID NO: 15113 - RNA, 1704 nt, Artificial Sequence
  CES1__Homo_sapiens__NP_001020365
auguggcugagagccuucauccuggccacccugagcgccagcgccgccuggggccaccccagcagcccccccgugguggacaccgugcacggcaaggugcugggcaaguucgugagccuggagggcuucgcccagcccguggccaucuuccugggcauccccuucgccaagcccccccugggcccccugagauucacccccccccagcccgccgagcccuggagcuucgugaagaacgccaccagcuacccccccaugugcacccaggaccccaaggccggccagcugcugagcgagcuguucaccaacagaaaggagaacaucccccugaagcugagcgaggacugccuguaccugaacaucuacacccccgccgaccugaccaagaagaacagacugcccgugaugguguggauccacggcggcggccugauggugggcgccgccagcaccuacgacggccuggcccuggccgcccacgagaacguggugguggugaccauccaguacagacugggcaucuggggcuucuucagcaccggcgacgagcacagcagaggcaacuggggccaccuggaccagguggccgcccugagaugggugcaggacaacaucgccagcuucggcggcaaccccggcagcgugaccaucuucggcgagagcgccggcggcgagagcgugagcgugcuggugcugagcccccuggccaagaaccuguuccacagagccaucagcgagagcggcguggcccugaccagcgugcuggugaagaagggcgacgugaagccccuggccgagcagaucgccaucaccgccggcugcaagaccaccaccagcgccgugauggugcacugccugagacagaagaccgaggaggagcugcuggagaccacccugaagaugaaguuccugagccuggaccugcagggcgaccccagagagagccagccccugcugggcaccgugaucgacggcaugcugcugcugaagacccccgaggagcugcaggccgagagaaacuuccacaccgugcccuacauggugggcaucaacaagcaggaguucggcuggcugauccccaugcagcugaugagcuacccccugagcgagggccagcuggaccagaagaccgccaugagccugcuguggaagagcuacccccuggugugcaucgccaaggagcugauccccgaggccaccgagaaguaccugggcggcaccgacgacaccgugaagaagaaggaccuguuccuggaccugaucgccgacgugauguucggcgugcccagcgugaucguggccagaaaccacagagacgccggcgcccccaccuacauguacgaguuccaguacagacccagcuucagcagcgacaugaagcccaagaccgugaucggcgaccacggcgacgagcuguucagcguguucggcgcccccuuccugaaggagggcgccagcgaggaggagaucagacugagcaagauggugaugaaguucugggccaacuucgccagaaacggcaaccccaacggcgagggccugccccacuggcccgaguacaaccagaaggagggcuaccugcagaucggcgccaacacccaggccgcccagaagcugaaggacaaggagguggccuucuggaccaaccuguucgccaagaaggccguggagaagcccccccagaccgagcacaucgagcuguaa

SEQ ID NO: 15114 - RNA, 1872 nt, Artificial Sequence
  CES2__Homo_sapiens__NP_003860
augaccgcccagagcagaagccccaccacccccaccuuccccggccccagccagagaaccccccugacccccugccccgugcagacccccagacugggcaaggcccugauccacugcuggaccgaccccggccagccccugggcgagcagcagagagugagaagacagagaaccgagaccagcgagcccaccaugagacugcacagacugagagccagacugagcgccguggccugcggccugcugcugcugcuggugagaggccagggccaggacagcgccagccccaucagaaccacccacaccggccaggugcugggcagccuggugcacgugaagggcgccaacgccggcgugcagaccuuccugggcauccccuucgccaagcccccccugggcccccugagauucgccccccccgagccccccgagagcuggagcggcgugagagacggcaccacccaccccgccaugugccugcaggaccugaccgccguggagagcgaguuccugagccaguucaacaugaccuuccccagcgacagcaugagcgaggacugccuguaccugagcaucuacacccccgcccacagccacgagggcagcaaccugcccgugaugguguggauccacggcggcgcccugguguucggcauggccagccuguacgacggcagcaugcuggccgcccuggagaacguggugguggugaucauccaguacagacugggcgugcugggcuucuucagcaccggcgacaagcacgccaccggcaacuggggcuaccuggaccagguggccgcccugagaugggugcagcagaacaucgcccacuucggcggcaaccccgacagagugaccaucuucggcgagagcgccggcggcaccagcgugagcagccugguggugagccccaucagccagggccuguuccacggcgccaucauggagagcggcguggcccugcugcccggccugaucgccagcagcgccgacgugaucagcaccgugguggccaaccugagcgccugcgaccagguggacagcgaggcccuggugggcugccugagaggcaagagcaaggaggagauccuggccaucaacaagcccuucaagaugauccccggcgugguggacggcguguuccugcccagacacccccaggagcugcuggccagcgccgacuuccagcccgugcccagcaucgugggcgugaacaacaacgaguucggcuggcugauccccaaggugaugagaaucuacgacacccagaaggagauggacagagaggccagccaggccgcccugcagaagaugcugacccugcugaugcugccccccaccuucggcgaccugcugagagaggaguacaucggcgacaacggcgacccccagacccugcaggcccaguuccaggagaugauggccgacagcauguucgugauccccgcccugcagguggcccacuuccagugcagcagagcccccguguacuucuacgaguuccagcaccagcccagcuggcugaagaacaucagacccccccacaugaaggccgaccacggcgacgagcugcccuucguguucagaagcuucuucggcggcaacuacaucaaguucaccgaggaggaggagcagcugagcagaaagaugaugaaguacugggccaacuucgccagaaacggcaaccccaacggcgagggccugccccacuggccccuguucgaccaggaggagcaguaccugcagcugaaccugcagcccgccgugggcagagcccugaaggcccacagacugcaguucuggaagaaggcccugccccagaagauccaggagcuggaggagcccgaggagagacacaccgagcuguaa

SEQ ID NO: 15115 - RNA, 633 nt, Artificial Sequence
  CES3__Homo_sapiens__NP_001172105
auggagcagaugagcagagaggacaugcuggccaucagcacccccgugcugaccagccuggacgugccccccgagaugaugcccaccgugaucgacgaguaccugggcagcaacagcgacgcccaggccaagugccaggccuuccaggaguucaugggcgacguguucaucaacgugcccaccgugagcuucagcagauaccugagagacagcggcagccccguguucuucuacgaguuccagcacagacccagcagcuucgccaagaucaagcccgccugggugaaggccgaccacggcgccgagggcgccuucguguucggcggccccuuccugauggacgagagcagcagacuggccuuccccgaggccaccgaggaggagaagcagcugagccugaccaugauggcccaguggacccacuucgccagaaccggcgaccccaacagcaaggcccugccccccuggccccaguucaaccaggccgagcaguaccuggagaucaaccccgugcccagagccggccagaaguucagagaggccuggaugcaguucuggagcgagacccugcccagcaagauccagcaguggcaccagaagcagaagaacagaaaggcccaggaggaccuguaa

SEQ ID NO: 15116 - RNA, 519 nt, Artificial Sequence
  CETN1__Homo_sapiens__NP_004057
auggccagcggcuucaagaagcccagcgccgccagcaccggccagaagagaaagguggcccccaagcccgagcugaccgaggaccagaagcaggaggugagagaggccuucgaccuguucgacguggacggcagcggcaccaucgacgccaaggagcugaagguggccaugagagcccugggcuucgagcccagaaaggaggagaugaagaagaugaucagcgagguggacagagagggcaccggcaagaucagcuucaacgacuuccuggccgugaugacccagaagaugagcgagaaggacaccaaggaggagauccugaaggccuucagacuguucgacgacgacgagaccggcaagaucagcuucaagaaccugaagagaguggccaacgagcugggcgagaaccugaccgacgaggagcugcaggagaugaucgacgaggccgacagagacggcgacggcgaggugaacgaggaggaguuccugagaaucaugaagaagaccagccuguacuaa

SEQ ID NO: 15117 - RNA, 519 nt, Artificial Sequence
  CETN2__Homo_sapiens__NP_004335
auggccagcaacuucaagaaggccaacauggccagcagcagccagagaaagagaaugagccccaagcccgagcugaccgaggagcagaagcaggagaucagagaggccuucgaccuguucgacgccgacggcaccggcaccaucgacgugaaggagcugaagguggccaugagagcccugggcuucgagcccaagaaggaggagaucaagaagaugaucagcgagaucgacaaggagggcaccggcaagaugaacuucggcgacuuccugaccgugaugacccagaagaugagcgagaaggacaccaaggaggagauccugaaggccuucaagcuguucgacgacgacgagaccggcaagaucagcuucaagaaccugaagagaguggccaaggagcugggcgagaaccugaccgacgaggagcugcaggagaugaucgacgaggccgacagagacggcgacggcgaggugagcgagcaggaguuccugagaaucaugaagaagaccagccuguacuaa

SEQ ID NO: 15118 - RNA, 504 nt, Artificial Sequence
  CETN3__Homo_sapiens__NP_004356
augagccuggcccugagaagcgagcuggugguggacaagaccaagagaaagaagagaagagagcugagcgaggagcagaagcaggagaucaaggacgccuucgagcuguucgacaccgacaaggacgaggccaucgacuaccacgagcugaagguggccaugagagcccugggcuucgacgugaagaaggccgacgugcugaagauccugaaggacuacgacagagaggccaccggcaagaucaccuucgaggacuucaacgagguggugaccgacuggauccuggagagagacccccacgaggagauccugaaggccuucaagcuguucgacgacgacgacagcggcaagaucagccugagaaaccugagaagaguggccagagagcugggcgagaacaugagcgacgaggagcugagagccaugaucgaggaguucgacaaggacggcgacggcgagaucaaccaggaggaguucaucgccaucaugaccggcgacaucuaa

SEQ ID NO: 15119 - RNA, 1482 nt, Artificial Sequence
  CETP__Homo_sapiens__NP_000069
augcuggccgccaccgugcugacccuggcccugcugggcaacgcccacgccugcagcaagggcaccagccacgaggccggcaucgugugcagaaucaccaagcccgcccugcuggugcugaaccacgagaccgccaaggugauccagaccgccuuccagagagccagcuaccccgacaucaccggcgagaaggccaugaugcugcugggccaggugaaguacggccugcacaacauccagaucagccaccugagcaucgccagcagccagguggagcugguggaggccaagagcaucgacgugagcauccagaacgugagcgugguguucaagggcacccugaaguacggcuacaccaccgccugguggcugggcaucgaccagagcaucgacuucgagaucgacagcgccaucgaccugcagaucaacacccagcugaccugcgacagcggcagagugagaaccgacgcccccgacugcuaccugagcuuccacaagcugcugcugcaccugcagggcgagagagagcccggcuggaucaagcagcuguucaccaacuucaucagcuucacccugaagcuggugcugaagggccagaucugcaaggagaucaacgugaucagcaacaucauggccgacuucgugcagaccagagccgccagcauccugagcgacggcgacaucggcguggacaucagccugaccggcgaccccgugaucaccgccagcuaccuggagagccaccacaagggccacuucaucuacaagaacgugagcgaggaccugccccugcccaccuucagccccacccugcugggcgacagcagaaugcuguacuucugguucagcgagagaguguuccacagccuggccaagguggccuuccaggacggcagacugaugcugagccugaugggcgacgaguucaaggccgugcuggagaccuggggcuucaacaccaaccaggagaucuuccaggagguggugggcggcuuccccagccaggcccaggugaccgugcacugccugaagaugcccaagaucagcugccagaacaagggcgugguggugaacagcagcgugauggugaaguuccuguuccccagacccgaccagcagcacagcguggccuacaccuucgaggaggacaucgugaccaccgugcaggccagcuacagcaagaagaagcuguuccugagccugcuggacuuccagaucacccccaagaccgugagcaaccugaccgagagcagcagcgagagcgugcagagcuuccugcagagcaugaucaccgccgugggcauccccgaggugaugagcagacuggaggugguguucaccgcccugaugaacagcaagggcgugagccuguucgacaucaucaaccccgagaucaucaccagagacggcuuccugcugcugcagauggacuucggcuuccccgagcaccugcugguggacuuccugcagagccugagcuaa

SEQ ID NO: 15120 - RNA, 534 nt, Artificial Sequence
  CFAP126__Homo_sapiens__NP_001013647
auggccaccaacuacagcgccaaccaguacgagaaggccuucagcagcaaguaccugcagaacuggagccccaccaagcccaccaaggagagcaucagcagccacgagggcuacacccagaucaucgccaacgacagaggccaccugcugcccagcgugcccagaagcaaggccaaccccuggggcagcuucaugggcaccuggcagaugccccugaagaucccccccgccagagugacccugaccagcagaaccaccgccggcgccgccagccugaccaaguggauccagaagaaccccgaccugcugaaggccagcaacggccugugccccgagauccugggcaagccccacgaccccgacagccagaagaagcugagaaagaagagcaucaccaagaccgugcagcaggccagaagccccaccaucauccccagcagccccgccgccaaccugaacagccccgacgagcugcagagcagccaccccagcgccggccacacccccggcccccagagacccgccaagagcuaa

SEQ ID NO: 15121 - RNA, 1104 nt, Artificial Sequence
  CFAP36__Homo_sapiens__NP_001269690
auggccgccgaggaggaggacgagguggagugggugguggagagcaucgccggcuuccugagaggccccgacuggagcauccccauccuggacuucguggagcagaagugcgaggugaacugcaagggcggccacgugaucacccccggcagccccgagcccgugauccugguggccugcgugccccugguguucgacgacgaggaggagagcaagcugaccuacaccgagauccaccaggaguacaaggagcugguggagaagcugcuggagggcuaccugaaggagaucggcaucaacgaggaccaguuccaggaggccugcaccagcccccuggccaagacccacaccagccaggccauccugcagcccgugcuggccgccgaggacuucaccaucuucaaggccaugauggugcagaagaacaucgagaugcagcugcaggccaucagaaucauccaggagagaaacggcgugcugcccgacugccugaccgacggcagcgacguggugagcgaccuggagcacgaggagaugaagauccugagagaggugcugagaaagagcaaggaggaguacgaccaggaggaggagagaaagagaaagaagcagcugagcgaggccaagaccgaggagcccaccgugcacagcagcgaggccgccaucaugaacaacagccagggcgacggcgagcacuucgcccacccccccagcgaggugaagaugcacuucgccaaccagagcaucgagccccugggcagaaagguggagagaagcgagaccagcagccugccccagaaggaccugaagauccccggccuggagcacgccagcaucgagggccccaucgccaaccugagcgugcugggcaccgaggagcugagacagagagagcacuaccugaagcagaagagagacaagcugaugagcaugagaaaggacaugagaaccaagcagauccagaacauggagcagaagggcaagcccaccggcgagguggaggagaugaccgagaagcccgagaugaccgccgaggagaagcagacccugcugaagagaagacugcuggccgagaagcugaaggaggaggugaucaacaaguaa

SEQ ID NO: 15122 - RNA, 2949 nt, Artificial Sequence
  CFAP44__Homo_sapiens__NP_060808
augaaggagcccgacgaccaggacaccgacggcgagaagagcgugaccagcaagagcgacggcaagaagagccugagaagcagcaagagcgagagcagaagccccgugcaggaggacaacaccuuccuggaggacgacaccgacgagaccuucaccaagggcgagggcagcuaccuggaggaggacagcgacgaggagagacuggagggcagccugagcagcuuccaguacggcgaccugcagagcaccaccgugccccagcagacccccgcccccgccguggaggaggccgaggaggaggugaagaagaagaucagcgagagcuucuucuacgacuacauggagcuggccagcaugcccuucgugacccuggacagcaacaucccccuggaccugcugacccuggugcacagcuucggcuacgacugcagaaagagagccaaccugcagcugcuggacgacagcaucgccaucuacaucgccggcaaccagcugaucuuccugaaccugaagaccaaggagcagaucuaccugagaagcagcagcggcgagggcaucggcgugaucggcgugcacccccacaagaccuacuucaccguggccgagaagggcagcuuccccgacaucaucaucuacgaguaccccagccugagacccuacagagugcugagagacggcaccgagaagggcuacgccuacguggacuucaacuacagcggcaaccugcuggccagcgugggcagcaaccccgacuacacccugaccaucuggaacuggaaggaggagcagcccauccugagaaccaaggccuucagccaggagguguucaaggugaccuucaaccccgacaaggaggagcagcugaccaccagcggcagcggccacaucaaguucugggagauggccuucaccuucaccggccugaagcugcagggcagccugggcagauucggcaagaccaucaccaccgacaucgagggcuacauggagcugcccgacggcaaggugcugagcggcagcgaguggggcaacaugcugcugugggagggcggccugaucaagguggagcugugcagaggcaccagcaagagcugccacaacggccccaucaaccagaucaugcuguacgagggcgaggugaucaccgugggcagcgacggcuacgugagaaucugggacuucgagaccaucgacaccgccgacgugaucgacgagaccggccugcuggagaucgagcccaucaacgagcugcagguggacaagaacgugaaccuguucagcaugaucaagaugaacgagaccggcaacaacuucuggcuggcccaggacgccaacggcgccaucuggaagcuggaccugagcuucagcaacaucacccaggaccccgagugccuguucagcuuccacagcggcgccaucgaggccguggccgugagcccccugaccuaccugauggccaccaccgcccuggacugcagcgugagaaucuacgacuucgccagcaagaccccccuggcccagaugaaguucaagcagggcggcaccgcccuggugugggugcccagaauggugaacuucaccggcgcccagaucaucgugggcuucgaggacggcguggugagaauccuggagcuguacgaccccaagggccugaccaucuucgccggcagaaagaagauccuggacgccgacauccagcugaagcagguguucaagccccacaccgccugcgugaccgcccuggccuacgagagagacggcgagauccuggccaccggcagcaaggaccagaccguguucuucuucgagguggagagagacuacaagcccaucggcuacaucaacacccccggccccgugugccagcugauguggagccccaugagccaccccgagagcacccugcugaucaucugcgagaacggcuacauccuggaggccccccugcccaccaucaagcaggaggaggacgaccacgacguggugagcuacgagaucaaggacaugugcaucaagugcuuccacuucagcagcgugaagagcaagauccugagacugaucgagaucgagaagagagagagacagagagagcugaaggagaagaucagagaggagagaagaaacaagcuggccgccgagaugggcgaggacggcgagaaggaguuccaggaggaggaggaggagaaggaggaggaggaggaggaggaggagccccugcccgagaucuucauccccagcacccccagccccauccugugcggcuucuacagcgagcccggcaaguucugggugagccugggcggcuacgacagcggcuuccuguaccacugcgaguucccccccugcgacgagagcagcgacuucaaggagcagaaggacgagcccaucgacgugagauaccuggccgacaccgaggacaaccccauccagaccaucaccuucaacaucaacaaggugaugauguucugcggcaugaagaacggcgccaucagaguguacgugcugaaccagaacgaccccagccugaccagccugguggacuacuggcacuucaacaugcacgacaacaacuacggcugcaucaagagcaucgccaacagcuucgacgacagauuccuggugaccgccggcgccgacggcaacaucuucguguucaacaucuucagcgaguucaugcugagaaaggacaugaaggccaaggugcccagccccagauucggcaucgagaccgagcccauccccgaggacaucgaggaccccaaggccuacagcaucgagaacgccagaagaaagagagagcacgacaagcugaugaaggaggugggcgagaucaaggccagaaagagagagcagaucaaggcccugagaagcgaguucugcaaccugcuggagaugaacgagaagcugcccaagcacaugcaguucaagagaaccgugagccugaucuaa

SEQ ID NO: 15123 - RNA, 1659 nt, Artificial Sequence
  CFAP52__Homo_sapiens__NP_001074025
auggacaacaagaucagccccgaggcccagguggccgagcuggagcuggacgccgugaucggcuucaacgacaucauccugugggacuacaagaacagagagcugcuggccagacugagccugcacaagggcaagaucgaggcccuggccuucagccccaacgaccuguaccuggugagccugggcggccccgacgacggcagcguggugguguggagcaucgccaagagagacgccaucugcggcagccccgccgccggccugaacgugggcaacgccaccaacgugaucuucagcagaugcagagacgagauguucaugaccgccggcaacggcaccaucagagugugggagcuggaccugcccaacagaaagaucuggcccaccgagugccagaccggccagcugaagagaaucgugaugagcaucggcguggacgacgacgacagcuucuucuaccugggcaccaccaccggcgacauccugaagaugaaccccagaaccaagcugcugaccgacgugggccccgccaaggacaaguucagccugggcgugagcgccaucagaugccugaagaugggcggccugcuggugggcagcggcgccggccugcugguguucugcaagagccccggcuacaagcccaucaagaagauccagcugcagggcggcaucaccagcaucacccugagaggcgagggccaccaguuccuggugggcaccgaggagagccacaucuacagagugagcuucaccgacuucaaggagacccugaucgccaccugccacuucgacgccguggaggacaucguguuccccuucggcaccgccgagcuguucgccaccugcgccaagaaggacaucagaguguggcacaccagcagcaacagagagcugcugagaaucaccgugcccaacaugaccugccacggcaucgacuucaugagagacggcaagagcaucaucagcgccuggaacgacggcaagaucagagccuucgcccccgagaccggcagacugauguacgugaucaacaacgcccacagaaucggcgugaccgccaucgccaccaccagcgacugcaagagagugaucagcggcggcggcgagggcgaggugagaguguggcagaucggcugccagacccagaagcuggaggaggcccugaaggagcacaagagcagcgugagcugcaucagagugaagagaaacaacgaggagugcgugaccgccagcaccgacggcaccugcaucaucugggaccuggugagacugagaagaaaccagaugauccuggccaacacccuguuccagugcgugugcuaccaccccgaggaguuccagaucaucaccagcggcaccgacagaaagaucgccuacugggagguguucgacggcaccgugaucagagagcuggagggcagccugagcggcagcaucaacggcauggacaucacccaggagggcgugcacuucgugaccggcggcaacgaccaccuggugaaggugugggacuacaacgagggcgaggugacccacgugggcgugggccacagcggcaacaucaccagaaucagaaucagccccggcaaccaguacaucgugagcgugagcgccgacggcgccauccugagauggaaguaccccuacaccagcuaa

SEQ ID NO: 15124 - RNA, 1545 nt, Artificial Sequence
  CFAP53__Homo_sapiens__NP_659457
auguacagccagagauucggcaccgugcagagagaggugaagggccccacccccaagguggugaucgugagaagcaagccccccaagggccagggcgccgagcaccaccuggagagaaucagaagaagccaccagaagcacaacgccauccuggccagcaucaagagcagcgagagagacagacugaaggccgagugggaccagcacaacgacugcaagauccuggacagccuggugagagccagaaucaaggacgccgugcagggcuucaucaucaacaucgaggagagaagaaacaagcugagagagcugcuggcccuggaggagaacgaguacuucaccgagaugcagcugaagaaggagaccaucgaggagaagaaggacagaaugagagagaagaccaagcugcugaaggagaagaacgagaaggagagacaggacuucguggccgagaagcuggaccagcaguucagagagagaugcgaggagcugagaguggagcugcugagcauccaccagaagaaggugugcgaggagagaaaggcccagaucgccuucaacgaggagcugagcagacagaagcugguggaggagcagauguucagcaagcugugggaggaggacagacuggccaaggagaagagagaggcccaggaggccagaagacagaaggagcugauggagaacaccagacugggccugaacgcccagaucaccagcaucaaggcccagagacaggccacccagcugcugaaggaggaggaggccagacugguggagagcaacaacgcccagaucaagcacgagaacgagcaggacaugcugaagaagcagaaggccaagcaggagaccagaaccauccugcagaaggcccugcaggagagaaucgagcacauccagcaggaguacagagacgagcaggaccugaacaugaagcuggugcagagagcccugcaggaccugcaggaggaggccgacaagaagaagcagaagagagaggacaugaucagagagcagaagaucuaccacaaguaccuggcccagagaagagaggaggagaaggcccaggagaaggaguucgacagaauccuggaggaggacaaggccaagaagcuggccgagaaggacaaggagcugagacuggagaaggaggccagaagacagcugguggacgaggugaugugcaccagaaagcugcaggugcaggagaagcugcagagagaggccaaggagcaggaggagagagccauggagcagaagcacaucaacgagagccugaaggagcugaacugcgaggagaaggagaacuucgccagaagacagagacuggcccaggaguacagaaagcagcugcagaugcagaucgccuaccagcagcagagccaggaggccgagaaggaggagaagagaagagaguucgaggccggcguggccgccaacaagaugugccuggacaaggugcaggaggugcugagcacccaccaggugcugccccagaacauccaccccaugagaaaggccugccccagcaagcugccccccuaa

SEQ ID NO: 15125 - RNA, 3366 nt, Artificial Sequence
  CFAP57__Homo_sapiens__XP_011539101
augagcgccgugguggcccagacccugcacguguucggccugagaagccacguggccaacaacaucuucuacuucgacgagcagaucaucaucuuccccagcggcaaccacugcgugaaguacaacguggaccagaaguggcagaaguucauccccggcagcgagaagagccagggcaugcuggcccugagcaucagccccaacagaagauaccuggccaucagcgagaccgugcaggagaagcccgccaucaccaucuacgagcugagcagcauccccugcagaaagagaaaggugcugaacaacuucgacuuccaggugcagaaguucaucagcauggccuucagccccgacagcaaguaccugcuggcccagaccagcccccccgagagcaaccugguguacuggcugugggagaagcagaaggugauggccaucgugagaaucgacacccagaacaaccccguguaccaggugagcuucagcccccaggacaacacccaggugugcgugaccggcaacggcauguucaagcugcugagauucgccgagggcacccugaagcagaccagcuuccagagaggcgagccccagaacuaccuggcccacaccuggguggccgacgacaagaucguggugggcaccgacaccggcaagcuguuccuguucgagagcggcgaccagagaugggagaccagcaucauggugaaggagcccaccaacggcagcaagagccuggacgugauccaggagagcgagagccugaucgaguucccccccgugagcagcccccugcccagcuacgagcagaugguggccgccagcagccacagccagaugagcaugccccagguguucgccaucgccgccuacagcaagggcuucgccugcagcgccggccccggcagagugcugcuguucgagaagauggaggagaaggacuucuacagagagagcagagagaucagaauccccguggacccccagagcaacgaccccagccagagcgacaagcaggacgugcugugccugugcuucagccccagcgaggagacccugguggccagcaccagcaagaaccagcuguacagcaucaccaugagccugaccgagaucagcaagggcgagcccgcccacuucgaguaccugauguacccccugcacagcgcccccaucaccggccuggccaccugcaucagaaagccccugaucgccaccugcagccuggacagaagcaucagacuguggaacuacgagaccaacacccuggagcuguucaaggaguaccaggaggaggccuacagcaucagccugcaccccagcggccacuucaucguggugggcuucgccgacaagcugagacugaugaaccugcugaucgacgacaucagaagcuucaaggaguacagcgugagaggcugcggcgagugcagcuucagcaacggcggccaccuguucgccgccgugaacggcaacgugauccacguguacaccaccaccagccuggagaacaucagcagccugaagggccacaccggcaagaugcugcugaccuucgacgaccaguuccugcugaccgccgccgaggacggcugccuguucaccuggaagguguucgacaaggacggcagaggcaucaagagagagagagaggugggcuucgccgaggaggugcuggugaccaagaccgacauggaggagaaggcccaggugaugcuggagcugaagaccagaguggaggagcugaagauggagaacgaguaccagcugagacugaaggacaugaacuacagcgagaagaucaaggagcugaccgacaaguucauccaggagauggagagccugaagaccaagaaccaggugcugagaaccgagaaggagaagcaggacguguaccaccacgagcacaucgaggaccugcuggacaagcagagcagagagcugcaggacauggagugcugcaacaaccagaagcugcugcuggaguacgagaaguaccaggagcugcagcugaagagccagagaaugcaggaggaguacgagaagcagcugagagacaacgacgagaccaagagccaggcccuggaggagcugaccgaguucuacgaggccaagcugcaggagaagaccacccugcuggaggaggcccaggaggacgugagacagcagcugagagaguucgaggagaccaagaagcagaucgaggaggacgaggacagagagauccaggacaucaagaccaaguacgagaagaagcugagagacgagaaggagagcaaccugagacugaagggcgagaccggcaucaugagaaagaaguucagcagccugcagaaggagaucgaggagagaaccaacgacaucgagacccugaagggcgagcagaugaagcugcagggcgugaucaagagccuggagaaggacauccagggccugaagagagagauccaggagagagacgagaccauccaggacaaggagaagagaaucuacgaccugaagaagaagaaccaggagcugggcaaguucaaguucgugcuggacuacaagaucaaggagcugaagaagcagaucgagcccagagagaacgagaucagagugaugaaggagcagauccaggagauggaggccgagcuggagaacuuccacaagcagaacacccagcuggagcugaacaucaccgagcuguggcagaagcugagagccaccgaccaggagaugagaagagagagacagaaggagagagaccuggaggcccuggugaagagauucaagaccgaccugcacaacugcguggccuacauccaggagcccagacugcugaaggagaaggugagaggccuguucgagaaguacgugcagagagccgacaugguggagaucgccggccugaacaccgaccugcagcaggaguacaccagacagagagagcaccuggagagaaaccuggccacccugaagaagaagguggugaaggagggcgagcugcacagaaccgacuacgugagaaucaugcaggagaacgugagccugaucaaggagaucaacgagcugagaagagagcugaaguucaccagaagccagguguacgaccuggaggccgcccugaagcugaccaagaaggugagaccccaggaggugagcgagaccgagcccagcagagacaugcugagcaccgcccccaccgccagacugaacgagcaggaggagaccggcagaaucaucgagaugcagagacuggagauccagagacugagagaccagauccaggagcaggagcaggugaccggcuuccacacccuggccggcgugagacugcccagccugagcaacagcgagguggaccuggaggugaagaccaacuaa

SEQ ID NO: 15126 - RNA, 2619 nt, Artificial Sequence
  CFAP58__Homo_sapiens__NP_001008723
auggccgaggagaagggcggcaagcaggugcuggaggagagcgccuucgaggagauggagagagacuuccagggcgugcugcacgagcugagcggcgacaagagccuggagaaguucagaaucgaguacgagagacugcacgccgugaugaagaagagcuacgacaacgagaagagacugauggccaagugcagagagcugaacgccgagaucguggugaacagcgccaagguggccaccgcccugaagcugagccaggacgaccagaccaccaucgccagccugaagaaggagaucgagaaggccuggaagaugguggacagcgccuacgacaaggagcagaaggccaaggagaccauccuggcccugaaggaggagaucgugaaccugaccaagcugguggagcagggcagcggccugagcauggaccagcacagcaacaucagagaccugcugagauucaaggaggaggugaccaaggagagagaccagcugcugagcgagguggugaagcugagagagagccuggcccagaccaccgagcagcagcaggagaccgagagaagcaaggaggaggccgagcacgccaucagccaguuccagcaggagauccagcagagacagaacgaggccagcagagaguucagaaagaaggagaagcuggagaaggagcugaagcagauccaggccgacauggacagcagacagaccgagaucaaggcccugcagcaguacgugcagaagagcaaggaggagcugcagaagcuggagcagcagcugaaggagcagaagauccugaacgagagagccgccaaggagcuggagcaguuccagaugagaaacgccaagcugcagcaggagaacgagcagcacagccuggugugcgagcagcugagccaggagaaccagcagaaggcccuggagcugaaggccaaggaggaggaggugcaccagaugagacuggacaucggcaagcugaacaagaucagagagcagauccacaagaagcugcaccacaccgaggaccagaaggccgagguggagcagcacaaggagacccugaagaaccagaucgugggccuggagagagagguggaggccagcaagaagcaggccgagcuggacagaaaggccauggacgagcugcugagagagagagacauccugaacaagaacaugcugaaggccgugaacgccacccagaagcagaccgaccuggugaagcugcacgagcaggccaagagaaaccuggagggcgagauccagaacuacaaggacgaggcccagaagcagagaaagaucaucuuccaccuggagaaggagagagacagauacaucaaccaggccagcgaccugacccagaaggugcugaugaacauggaggacaucaaggugagagagacccagaucuucgacuacagaaagaagaucgccgagagcgagaucaagcugaagcagcagcagaaccuguacgaggccgugagaagcgacagaaaccuguacagcaagaaccugguggaggcccaggacgagaucaccgacaugaagagaaagcugaagaucaugauccaccagguggacgagcugaaggaggacaucagcgccaaggagagcgcccuggugaagcugcaccuggagcagcagagaaucgagaaggagaaggagacccugaaggccgagcugcagaagcugagacagcaggcccuggagaccaagcacuucaucgagaagcaggaggccgaggagagaaagcugcugagaaucaucgccgaggccgacggcgagagacugagacagaagaaggagcuggaccaggugaucagcgagagagacauccugggcagccagcuggugagaagaaacgacgagcuggcccugcuguacgagaagaucaagauccagcagagcgugcugaacaagggcgagagccaguacaaccagagacuggaggacaugagaauccugagacuggagaucaagaagcugagaagagagaagggcauccuggccagaagcauggccaacguggaggagcugagacaggaguucuuccacaugcagagagagcugcugaaggagagaaccagaugcagagcccuggaggaggagcuggagaacccccugaacgugcacagauggagaaagcuggaggccagcgaccccaacgccuacgagcugauccagaagauccacacccugcagaagagacugaucagcaagaccgaggaggugguggagaaggagcugcugcugcaggagaaggagaagcuguacauggagcugaagcacgugcuggccagacagcccggccccgaggccgccgagcagcugaagcuguacagaagaacccugcacgacaagaagcagcagcugaaggugcugagcagcgagcugaacauguacgaggugcagagcaaggaguacaaguacgagguggagaagcugaccaacgagcugcagaaccugaagaagaaguaccuggcccagaagagaaaggagcagcugcagaagaacaaggacaccgcccccauggacaacaccuuccugauggugaagcccaacggccccggcuucaccggcggcggcuucccccugagaagcaccaagaugaccuucuaa

SEQ ID NO: 15127 - RNA, 3714 nt, Artificial Sequence
  CFAP61__Homo_sapiens__NP_056400
augagcgugcugaccagccccagaggcaagguggagguggugcacugcagaagaaccgagagccaggacguguacugcaucaagagccugaucagaaaguucaccugcaagcuguucggcaagcugaacaucaucuaccugcuggagaaggccaaccuggccgugacccugugcaacgacaaggaggagaucauggcccaggccaccuuccuggacuaccccaacuggaacguggccaagcaggacgacugggugagcguguucagagagcuggacagcgacauccccugcaccccccugaacacccuguucaugcaccuguucguggccguggacgaguacagcgugggcugcugcaaggagauccugagaaccguguacaaggccgugcccgagcugcacuucaucuuccugaucgugcccagcuacaugagccugggcagcacccugaucaccguguucgaccaggugggcaacauccccugccugaccuacgaggaggacuucgccgugcacaucugccacagacacagccacuacccccagcugcacgugagaaaggccagaguggaggaccacgacgaccugaugcccaucuucaugagauacgacaccauccugaaggagaccuacggcgaguacuuccuggccgagcugaucgaggcccaggacgaggagaaccacgccguggugugcgagguggagggcaccgccgugggcuucaugagcgugugcagcagagugaacaugcagcugcugcacgagugcuucgaccugggccccuuccacggccugugcuucccccaccccgacgacgugcuggagagcccccaggaccugagcgugagaagaagccaggacgccgagcugagaagcagcagccagggcagccagaagaucguggaggagcugcaggagcccgugagccccgacaccauggagaacauccagggcaacaucgccagagaggccgccagcgaggaggcccugaccgccgugcagagcggcaacgugagcgagcccgaggacaucgagaagcugagcgacaucagcaccggcuacgcccaguaccaccacgugagcagcagaagccuggccagccuggugcugcccgaggagcccgugcacuucagacccaucuacagaggcgccagcgccgccuucugcauccagcuguucugcaucgacgagaaguacgaggccagaagccuggacuucaugaacuucguguucagccuguucagcgacaagaacuucugcgugaucagccugccccaccugacccccgaguucuuccugauccagaacuucgugaagauggugcccuucaacaccugcacccuggagcaggaccuguacguguuccacagagccggccugcugaagagcaucaacaucagauucgccacccugcuggacacccccggcguggagaaccuggugagcacccugaugcugaacaagagcauccuggaggaccuggacagauacaacaaggccagaaaggaccccgacggcacccugcugcaggccuucguggccgagguggccgagcagaucgugggcaucgccgugaucagaaacgagauggacaucgaguacaucagaagccacuacaacaucgaggacuucaucuacuucagccaccaccagagagaggagcacggccacaugcaccacuucgcccugaaccccaucuucagacacuacaccaaguucuuccugaaggagauccugagacugggcuucaagagcugccuguacuacagaguguaccccaagagcagagagggcaaguuccagaaccccuacgcccacagccugaccagcgcccugcacuaccuggugcccgugagacccagaagacagaucguguacccccuggagaagcugggcaucaacgcccccagcaaggccgugagcaaggaccccaugagcuacgcccugaaccacaccaacagaaagcugacccuggagcccaagaucaccgugaacgccaagaucaucguggugggcgccagcagcgugggcaucagcuuccuggagacccugguguucugcagccacaugaaguucaacaaccugacccugaucagcacccacggccugcccggcaagaagcugcuggacaccgagcagagaaaguuccuggccagcgaccacugcuucaacgacaaggacuacgcccugaugagccugugcagcugggugaacgugguggugggcagaaugaccggcaucgacagagccgccaagcacguggugcugagcaccgacgagaucgugcccuacgaccaccugauccugugcaccggccagcaguaccaggugcccugccccaccgaggccgacaucagccagcaccugaccaacagagaggugcccaacagcagccagagaagauacaccggcaaggugcccugcaaccacuucacccugaacgaggaggaggacugcuucaaggcccugaucuggaucagaaacaacagcaucaccaccgagggcaacaucaucguguacggcaacaccaucgacaccuacaccaccguggagacccugcugaaccugggcgugagcggcagcagaauccaccuggugcagcccccccccgccagcaccaucaccugcaucaacaacuacagcguggagagcgccguggccgacgcccugggcgccgccggcgugaccauguacagagacgccauccuggcccaguggaacgacggccugcaccccgaccccaucuacagcgccagcuucaccacccccaccaagcccuucagacugcagugcagcauguucuucagcuucugcgagaagaacguggacuacgagaccuucaaggcccugaacgacgccugccugguguacgacagcagacuggugaucgacaccaacuuccacaccaacgacaucgccaucagagccgccggcagccugaccaaguucagcaacagauacuacagcaacgaguggacccacagcaacuucagcagcaaggagaucggcuuccagcuggccgccgccaugcugcaccuguucgaccccacccuggagcccgugaccgagccccccgccaaccuggacagacugauccccauguacaagggcgccaagauccagggcggcauccugcccggcagcuaccacuaccugcacaucgccaagcccgccauccccaccccccuggaggugcagauggcccagcccaacuacggccuggagcuggugaccggcagcgccaagaacggcaccuacuucagaauccacaucaacaaguacaagaugguggagaccaucaccugccugagcagagagcccuuccccgccagcaacuacaucagacuguucggccagcacgagcagcugcugaacaaccugugcgccagauacgacgagaaccugaucaccgaccuguacagcuacuucaccgagcccuggugccuggcccuguuccacgacagauucaucgaccugagaaaggagcugagacagauccuggccagcaaggaggaggaggaccugcccagcaucgagcagcuggcccaccagaucgaggacgaggagaucaaccccaccgagaagcccagacaguaccugaagagaguguucgaggagagcaucuacaagacccugguggagagaagcacccuggacuaccugcacuacaacagauaccaccugcccauguacgccuggcccggcaucguguaa

SEQ ID NO: 15128 - RNA, 2826 nt, Artificial Sequence
  CFAP69__Homo_sapiens__NP_001034795
auguggaccgaggaggccggcgccaccgccgaggcccaggagagcggcaucagaaacaagagcagcagcagcagccagauccccguggugggcguggugaccgaggacgacgaggcccaggacguguucaagcccauggaccugaacagagugaucaagcugcuggaggagaccgacaaggacggccuggaggagaagcagcugaaguucgugaagaagcuggugcagugcuaccagaacggccugccccugagagaccuggcccagaucuucaagauccugaaccugugcagcggcaagaucaagaaccagcccagauucaucgagagcgccuacgacaucaucaagcugugcggccugcccuuccugaagaagaaggugagcgacgagaucaccuacgccgaggacaccgccaacagcaucgcccugcugggcgaccugaugaagauccccagcagcgagcugagaauccagaucugcaagugcaucguggacuucuaccacgccgagccccccaagaagcacauccccggcuaccagcaggccagcagcagcuacaagauccagauggccgaggugggcggccuggccaagaccauggugcagagcaugacccugcuggagaaccagcugguggagaagcugugggugcugaaggugcugcagcaccugagcaccagcgaggugaacugcaccaucaugaugaaggcccaggccgccagcggcaucugcacccaccugaacgaccccgaccccagcggccagcugcuguucagaagcagcgagauccuguggaaccugcuggagaagagcagcaaggaggaggugauccagcagcugagcaaccuggagugccugcuggcccugaaggagguguucaagaaccuguucaugagaggcuucagccacuacgacagacagcugagaaacgacauccuggugaucaccaccaucaucgcccagaaccccgaggcccccaugaucgagugcggcuucaccaaggaccugauccuguucgccaccuucaacgaggugaagagccagaaccugcuggugaagggccugaagcugagcaacagcuacgaggacuucgagcugaagaagcugcuguucaacgugaucgugauccugugcaaggaccugcccaccgugcagcugcugaucgacggcaaggugauccuggcccuguucaccuacgugaagaagcccgagaagcagaagaucaucgacuggagcgccgcccagcacgaggagcugcagcugcacgccaucgccacccugagcagcguggccccccugcugaucgaggaguacaugagcugccagggcaacgccagagugcuggccuuccuggaguggugcgagagcgaggaccccuucuucagccacggcaacagcuuccacggcaccggcggcagaggcaacaaguucgcccagaugagauacagccugagacugcugagagccgugguguaccuggaggacgagaccgugaacaaggaccugugcgagaagggcaccauccagcagaugaucggcaucuucaagaacaucaucagcaagcccaacgagaaggaggaggccaucgugcuggagauccagagcgacauccugcugauccugagcggccugugcgagaaccacauccagagaaaggagaucuucggcaccgagggcguggacaucgugcugcacgugaugaagaccgaccccagaaagcugcagagcggccugggcuacaacgugcugcuguucagcacccuggacagcaucuggugcugcauccugggcugcuaccccagcgaggacuacuuccuggagaaggagggcaucuuccugcugcuggaccugcuggcccugaaccagaagaaguucugcaaccugauccugggcaucaugguggaguucugcgacaaccccaagaccgccgcccacgugaacgccuggcagggcaagaaggaccagaccgccgccagccugcugaucaagcuguggagaaaggaggagaaggagcugggcgugaagagagacaagaacggcaagaucaucgacaccaagaagccccuguucaccagcuuccaggaggagcagaagaucaucccccugcccgccaacugccccagcaucgccgugauggacgugagcgagaacaucagagccaagaucuacgccauccugggcaagcuggacuucgagaaccugcccggccugagcgccgaggacuucgugacccugugcaucauccacagauaccuggacuucaagaucggcgagaucuggaacgagaucuacgaggagaucaagcuggagaagcugagacccgugaccaccgacaagaaggcccuggaggccaucaccaccgccagcgagaacaucggcaagaugguggccagccugcagagcgacaucaucgagagccaggccugccaggacaugcagaacgagcagaagguguacgccaagauccaggccacccacaagcagagagagcuggccaacaagagcugggaggacuuccuggccagaaccagcaacgccaagacccugaagaaggccaagagccugcaggagaaggccaucgaggccagcagauaccacaagagaccccagaacgccaucuuccaccagacccacaucaagggccugaacaccaccgugcccagcggcggcguggugaccguggagagcacccccgccagacuggugggcggcccccugguggacaccgacaucgcccugaagaagcugcccaucagaggcggcgcccugcagagagugaaggccgugaagaucguggacgcccccaagaagagcauccccaccuaa

SEQ ID NO: 15129 - RNA, 1362 nt, Artificial Sequence
  CFAP97__Homo_sapiens__NP_001278962
auggaccaguucggcgacauccuggagggcgagguggaccacagcuucuucgacagcgacuucgaggagggcaagaagugcgagaccaacagcguguucgacaagcagaacgacgaccccaaggagagaaucgacaaggacaccaagaacgugaacagcaacaccggcaugcagaccaccgagaacuaccugaccgagaagggcaacgagagaaacgugaaguucccccccgagcaccccguggagaacgacgugacccagaccgugagcagcuucagccugcccgccagcagcagaagcaagaagcugugcgacgugaccaccggccugaagauccacgugagcauccccaacagaauccccaagaucgugaaggagggcgaggacgacuacuacaccgacggcgaggagagcagcgacgacggcaagaaguaccacgugaagagcaagagcgccaagcccagcaccaacgugaagaagagcaucagaaagaaguacugcaaggugagcagcagcagcagcagcagccugagcagcagcagcagcggcagcggcaccgacugccuggacgccggcagcgacagccaccugagcgacagcagccccagcagcaagagcagcaagaagcacgugagcggcaucacccugcugagccccaagcacaaguacaagagcggcaucaagagcaccgagacccagcccagcagcaccacccccaagugcggccacuaccccgaggagagcgaggacaccgugaccgacgugagcccccugagcacccccgacaucagcccccugcagagcuucgagcugggcaucgccaacgaccagaaggugaagaucaagaagcaggagaacgugagccaggagaucuacgaggacguggaggaccugaagaacaacagcaaguaccugaaggccgccaagaagggcaaggagaagcacgagcccgacgugagcagcaagagcagcagcgugcuggacagcagccuggaccacagacacaagcagaaggugcugcacgacaccauggaccugaaccaccugcugaaggccuuccugcagcuggacaagaagggcccccagaagcaccacuucgaccagcccagcguggcccccggcaagaacuacagcuucaccagagaggaggugagacagaucgacagagagaaccagagacugcugaaggagcugagcagacaggccgagaagcccggcagcaagagcaccauccccagaagcgccgaccacccccccaagcuguaccacagcgcccugaacagacagaaggagcagcagagaaucgagagagagaaccugaccaucagccugugccaccccggcuggagcgccgugaccuaa

SEQ ID NO: 15130 - RNA, 2295 nt, Artificial Sequence
  CFB__Homo_sapiens__NP_001701
augggcagcaaccugagcccccagcugugccugaugcccuucauccugggccugcugagcggcggcgugaccaccacccccuggagccuggccagaccccagggcagcugcagccuggagggcguggagaucaagggcggcagcuucagacugcugcaggagggccaggcccuggaguacgugugccccagcggcuucuaccccuaccccgugcagaccagaaccugcagaagcaccggcagcuggagcacccugaagacccaggaccagaagaccgugagaaaggccgagugcagagccauccacugccccagaccccacgacuucgagaacggcgaguacuggcccagaagccccuacuacaacgugagcgacgagaucagcuuccacugcuacgacggcuacacccugagaggcagcgccaacagaaccugccaggugaacggcagauggagcggccagaccgccaucugcgacaacggcgccggcuacugcagcaaccccggcauccccaucggcaccagaaaggugggcagccaguacagacuggaggacagcgugaccuaccacugcagcagaggccugacccugagaggcagccagagaagaaccugccaggagggcggcagcuggagcggcaccgagcccagcugccaggacagcuucauguacgacaccccccaggagguggccgaggccuuccugagcagccugaccgagaccaucgagggcguggacgccgaggacggccacggccccggcgagcagcagaagagaaagaucgugcuggaccccagcggcagcaugaacaucuaccuggugcuggacggcagcgacagcaucggcgccagcaacuucaccggcgccaagaagugccuggugaaccugaucgagaagguggccagcuacggcgugaagcccagauacggccuggugaccuacgccaccuaccccaagaucugggugaaggugagcgaggccgacagcagcaacgccgacugggugaccaagcagcugaacgagaucaacuacgaggaccacaagcugaagagcggcaccaacaccaagaaggcccugcaggccguguacagcaugaugagcuggcccgacgacgugccccccgagggcuggaacagaaccagacacgugaucauccugaugaccgacggccugcacaacaugggcggcgaccccaucaccgugaucgacgagaucagagaccugcuguacaucggcaaggacagaaagaaccccagagaggacuaccuggacguguacguguucggcgugggcccccuggugaaccaggugaacaucaacgcccuggccagcaagaaggacaacgagcagcacguguucaaggugaaggacauggagaaccuggaggacguguucuaccagaugaucgacgagagccagagccugagccugugcggcauggugugggagcacagaaagggcaccgacuaccacaagcagcccuggcaggccaagaucagcgugaucagacccagcaagggccacgagagcugcaugggcgccguggugagcgaguacuucgugcugaccgccgcccacugcuucaccguggacgacaaggagcacagcaucaaggugagcgugggcggcgagaagagagaccuggagaucgagguggugcuguuccaccccaacuacaacaucaacggcaagaaggaggccggcauccccgaguucuacgacuacgacguggcccugaucaagcugaagaacaagcugaaguacggccagaccaucagacccaucugccugcccugcaccgagggcaccaccagagcccugagacugccccccaccaccaccugccagcagcagaaggaggagcugcugcccgcccaggacaucaaggcccuguucgugagcgaggaggagaagaagcugaccagaaaggagguguacaucaagaacggcgacaagaagggcagcugcgagagagacgcccaguacgcccccggcuacgacaaggugaaggacaucagcgagguggugacccccagauuccugugcaccggcggcgugagccccuacgccgaccccaacaccugcagaggcgacagcggcggcccccugaucgugcacaagagaagcagauucauccaggugggcgugaucagcuggggcgugguggacgugugcaagaaccagaagagacagaagcaggugcccgcccacgccagagacuuccacaucaaccuguuccaggugcugcccuggcugaaggagaagcugcaggacgaggaccugggcuuccuguaa

SEQ ID NO: 15131 - RNA, 672 nt, Artificial Sequence
  CFC1B__Homo_sapiens__NP_001072998
augaccuggagacaccacgugagacugcuguucaccgugagccuggcccugcagaucaucaaccugggcaacagcuaccagagagagaagcacaacggcggcagagaggaggugaccaagguggccacccagaagcacagacagagcccccugaacuggaccagcagccacuucggcgaggugaccggcagcgccgagggcuggggccccgaggagccccugcccuacagcugggccuucggcgagggcgccagcgccagacccagaugcugcagaaacggcggcaccugcgugcugggcagcuucugcgugugccccgcccacuucaccggcagauacugcgagcacgaccagagaagaagcgagugcggcgcccuggagcacggcgccuggacccugagagccugccaccugugcagaugcaucuucggcgcccugcacugccugccccugcagacccccgacagaugcgaccccaaggacuuccuggccagccacgcccacggccccagcgccggcggcgcccccagccugcugcugcugcugcccugcgcccugcugcacagacugcugagacccgacgcccccgcccaccccagaagccuggugcccagcgugcugcagagagagagaagacccugcggcagacccggccugggccacagacuguaa

SEQ ID NO: 15132 - RNA, 672 nt, Artificial Sequence
  CFC1__Homo_sapiens__NP_115934
augaccuggagacaccacgugagacugcuguucaccgugagccuggcccugcagaucaucaaccugggcaacagcuaccagagagagaagcacaacggcggcagagaggaggugaccaagguggccacccagaagcacagacagagcccccugaacuggaccagcagccacuucggcgaggugaccggcagcgccgagggcuggggccccgaggagccccugcccuacagcagagccuucggcgagggcgccagcgccagacccagaugcugcagaaacggcggcaccugcgugcugggcagcuucugcgugugccccgcccacuucaccggcagauacugcgagcacgaccagagaagaagcgagugcggcgcccuggagcacggcgccuggacccugagagccugccaccugugcagaugcaucuucggcgcccugcacugccugccccugcagacccccgacagaugcgaccccaaggacuuccuggccagccacgcccacggccccagcgccggcggcgcccccagccugcugcugcugcugcccugcgcccugcugcacagacugcugagacccgacgcccccgcccaccccagaagccuggugcccagcgugcugcagagagagagaagacccugcggcagacccggccugggccacagacuguaa

SEQ ID NO: 15133 - RNA, 762 nt, Artificial Sequence
  CFD__Homo_sapiens__NP_001919
augcacagcugggagagacuggccgugcuggugcugcugggcgccgccgccugcgccgccccccccagaggcagaauccugggcggcagagaggccgaggcccacgccagacccuacauggccagcgugcagcugaacggcgcccaccugugcggcggcgugcugguggccgagcagugggugcugagcgccgcccacugccuggaggacgccgccgacggcaaggugcaggugcugcugggcgcccacagccugagccagcccgagcccagcaagagacuguacgacgugcugagagccgugccccaccccgacagccagcccgacaccaucgaccacgaccugcugcugcugcagcugagcgagaaggccacccugggccccgccgugagaccccugcccuggcagagaguggacagagacguggcccccggcacccugugcgacguggccggcuggggcaucgugaaccacgccggcagaagacccgacagccugcagcacgugcugcugcccgugcuggacagagccaccugcaacagaagaacccaccacgacggcgccaucaccgagagacugaugugcgccgagagcaacagaagagacagcugcaagggcgacagcggcggcccccuggugugcggcggcgugcuggagggcguggugaccagcggcagcagagugugcggcaacagaaagaagcccggcaucuacaccagaguggccagcuacgccgccuggaucgacagcgugcuggccuaa

SEQ ID NO: 15134 - RNA, 900 nt, Artificial Sequence
  CFDP1__Homo_sapiens__NP_006315
auggaggaguucgacagcgaggacuucagcaccagcgaggaggacgaggacuacgugcccagcggcggcgaguacagcgaggacgacgugaacgagcuggugaaggaggacgagguggacggcgaggagcagacccagaagacccagggcaagaagagaaaggcccagagcauccccgccagaaagagaagacagggcggccugagccuggaggaggaggaggaggaggacgccaacagcgagagcgagggcagcagcagcgaggaggaggacgacgccgccgagcaggagaagggcaucggcagcgaggacgccagaaagaagaaggaggacgagcugugggccagcuuccugaacgacgugggccccaagagcaaggugccccccagcacccaggugaagaagggcgaggagaccgaggagaccagcagcagcaagcugcuggugaaggccgaggagcuggagaagcccaaggagaccgagaaggugaagaucaccaagguguucgacuucgccggcgaggaggugagagugaccaaggagguggacgccaccagcaaggaggccaagagcuucuucaagcagaacgagaaggagaagccccaggccaacgugcccagcgcccugcccagccugcccgccggcagcggccugaagagaagcagcggcaugagcagccugcugggcaagaucggcgccaagaagcagaagaugagcacccuggagaagagcaagcuggacugggagagcuucaaggaggaggagggcaucggcgaggagcuggccauccacaacagaggcaaggagggcuacaucgagagaaaggccuuccuggacagaguggaccacagacaguucgagaucgagagagaccugagacugagcaagaugaagcccuaa

SEQ ID NO: 15135 - RNA, 3696 nt, Artificial Sequence
  CFH__Homo_sapiens__NP_000177
augagacugcuggccaagaucaucugccugaugcugugggccaucugcguggccgaggacugcaacgagcugccccccagaagaaacaccgagauccugaccggcagcuggagcgaccagaccuaccccgagggcacccaggccaucuacaagugcagacccggcuacagaagccugggcaacgugaucauggugugcagaaagggcgaguggguggcccugaacccccugagaaagugccagaagagacccugcggccaccccggcgacacccccuucggcaccuucacccugaccggcggcaacguguucgaguacggcgugaaggccguguacaccugcaacgagggcuaccagcugcugggcgagaucaacuacagagagugcgacaccgacggcuggaccaacgacauccccaucugcgagguggugaagugccugcccgugaccgcccccgagaacggcaagaucgugagcagcgccauggagcccgacagagaguaccacuucggccaggccgugagauucgugugcaacagcggcuacaagaucgagggcgacgaggagaugcacugcagcgacgacggcuucuggagcaaggagaagcccaagugcguggagaucagcugcaagagccccgacgugaucaacggcagccccaucagccagaagaucaucuacaaggagaacgagagauuccaguacaagugcaacaugggcuacgaguacagcgagagaggcgacgccgugugcaccgagagcggcuggagaccccugcccagcugcgaggagaagagcugcgacaaccccuacauccccaacggcgacuacagcccccugagaaucaagcacagaaccggcgacgagaucaccuaccagugcagaaacggcuucuaccccgccaccagaggcaacaccgccaagugcaccagcaccggcuggauccccgcccccagaugcacccugaagcccugcgacuaccccgacaucaagcacggcggccuguaccacgagaacaugagaagacccuacuuccccguggccgugggcaaguacuacagcuacuacugcgacgagcacuucgagacccccagcggcagcuacugggaccacauccacugcacccaggacggcuggagccccgccgugcccugccugagaaagugcuacuuccccuaccuggagaacggcuacaaccagaaccacggcagaaaguucgugcagggcaagagcaucgacguggccugccaccccggcuacgcccugcccaaggcccagaccaccgugaccugcauggagaacggcuggagccccacccccagaugcaucagagugaagaccugcagcaagagcagcaucgacaucgagaacggcuucaucagcgagagccaguacaccuacgcccugaaggagaaggccaaguaccagugcaagcugggcuacgugaccgccgacggcgagaccagcggcagcaucaccugcggcaaggacggcuggagcgcccagcccaccugcaucaagagcugcgacauccccguguucaugaacgccagaaccaagaacgacuucaccugguucaagcugaacgacacccuggacuacgagugccacgacggcuacgagagcaacaccggcagcaccaccggcagcaucgugugcggcuacaacggcuggagcgaccugcccaucugcuacgagagagagugcgagcugcccaagaucgacgugcaccuggugcccgacagaaagaaggaccaguacaaggugggcgaggugcugaaguucagcugcaagcccggcuucaccaucgugggccccaacagcgugcagugcuaccacuucggccugagccccgaccugcccaucugcaaggagcaggugcagagcugcggccccccccccgagcugcugaacggcaacgugaaggagaagaccaaggaggaguacggccacagcgaggugguggaguacuacugcaaccccagauuccugaugaagggccccaacaagauccagugcguggacggcgaguggaccacccugcccgugugcaucguggaggagagcaccugcggcgacauccccgagcuggagcacggcugggcccagcugagcagcccccccuacuacuacggcgacagcguggaguucaacugcagcgagagcuucaccaugaucggccacagaagcaucaccugcauccacggcguguggacccagcugccccagugcguggccaucgacaagcugaagaagugcaagagcagcaaccugaucauccuggaggagcaccugaagaacaagaaggaguucgaccacaacagcaacaucagauacagaugcagaggcaaggagggcuggauccacaccgugugcaucaacggcagaugggaccccgaggugaacugcagcauggcccagauccagcugugccccccccccccccagauccccaacagccacaacaugaccaccacccugaacuacagagacggcgagaaggugagcgugcugugccaggagaacuaccugauccaggagggcgaggagaucaccugcaaggacggcagauggcagagcaucccccugugcguggagaagauccccugcagccagcccccccagaucgagcacggcaccaucaacagcagcagaagcagccaggagagcuacgcccacggcaccaagcugagcuacaccugcgagggcggcuucagaaucagcgaggagaacgagaccaccugcuacaugggcaaguggagcagccccccccagugcgagggccugcccugcaagagcccccccgagaucagccacggcgugguggcccacaugagcgacagcuaccaguacggcgaggaggugaccuacaagugcuucgagggcuucggcaucgacggccccgccaucgccaagugccugggcgagaaguggagccacccccccagcugcaucaagaccgacugccugagccugcccagcuucgagaacgccauccccaugggcgagaagaaggacguguacaaggccggcgagcaggugaccuacaccugcgccaccuacuacaagauggacggcgccagcaacgugaccugcaucaacagcagauggaccggcagacccaccugcagagacaccagcugcgugaacccccccaccgugcagaacgccuacaucgugagcagacagaugagcaaguaccccagcggcgagagagugagauaccagugcagaagccccuacgagauguucggcgacgaggaggugaugugccugaacggcaacuggaccgagcccccccagugcaaggacagcaccggcaagugcggcccccccccccccaucgacaacggcgacaucaccagcuucccccugagcguguacgcccccgccagcagcguggaguaccagugccagaaccuguaccagcuggagggcaacaagagaaucaccugcagaaacggccaguggagcgagccccccaagugccugcaccccugcgugaucagcagagagaucauggagaacuacaacaucgcccugagauggaccgccaagcagaagcuguacagcagaaccggcgagagcguggaguucgugugcaagagaggcuacagacugagcagcagaagccacacccugagaaccaccugcugggacggcaagcuggaguaccccaccugcgccaagagauaa

SEQ ID NO: 15136 - RNA, 993 nt, Artificial Sequence
  CFHR1__Homo_sapiens__NP_002104
auguggcugcuggugagcgugauccugaucagcagaaucagcagcgugggcggcgaggccaccuucugcgacuuccccaagaucaaccacggcauccuguacgacgaggagaaguacaagcccuucagccaggugcccaccggcgagguguucuacuacagcugcgaguacaacuucgugagccccagcaagagcuucuggaccagaaucaccugcaccgaggagggcuggagccccacccccaagugccugagacugugcuucuuccccuucguggagaacggccacagcgagagcagcggccagacccaccuggagggcgacaccgugcagaucaucugcaacaccggcuacagacugcagaacaacgagaacaacaucagcugcguggagagaggcuggagcaccccccccaagugcagaagcaccgacaccagcugcgugaacccccccaccgugcagaacgcccacauccugagcagacagaugagcaaguaccccagcggcgagagagugagauacgagugcagaagccccuacgagauguucggcgacgaggaggugaugugccugaacggcaacuggaccgagcccccccagugcaaggacagcaccggcaagugcggcccccccccccccaucgacaacggcgacaucaccagcuucccccugagcguguacgcccccgccagcagcguggaguaccagugccagaaccuguaccagcuggagggcaacaagagaaucaccugcagaaacggccaguggagcgagccccccaagugccugcaccccugcgugaucagcagagagaucauggagaacuacaacaucgcccugagauggaccgccaagcagaagcuguaccugagaaccggcgagagcgccgaguucgugugcaagagaggcuacagacugagcagcagaagccacacccugagaaccaccugcugggacggcaagcuggaguaccccaccugcgccaagagauaa

SEQ ID NO: 15137 - RNA, 813 nt, Artificial Sequence
  CFHR2__Homo_sapiens__NP_005657
auguggcugcuggugagcgugauccugaucagcagaaucagcagcgugggcggcgaggccauguucugcgacuuccccaagaucaaccacggcauccuguacgacgaggagaaguacaagcccuucagccaggugcccaccggcgagguguucuacuacagcugcgaguacaacuucgugagccccagcaagagcuucuggaccagaaucaccugcgccgaggagggcuggagccccacccccaagugccugagacugugcuucuuccccuucguggagaacggccacagcgagagcagcggccagacccaccuggagggcgacaccgugcagaucaucugcaacaccggcuacagacugcagaacaacgagaacaacaucagcugcguggagagaggcuggagcaccccccccaagugcagaagcaccaucagcgccgagaagugcggcccccccccccccaucgacaacggcgacaucaccagcuuccugcugagcguguacgcccccggcagcagcguggaguaccagugccagaaccuguaccagcuggagggcaacaaccagaucaccugcagaaacggccaguggagcgagccccccaagugccuggaccccugcgugaucagccaggagaucauggagaaguacaacaucaagcugaaguggaccaaccagcagaagcuguacagcagaaccggcgacaucguggaguucgugugcaagagcggcuaccaccccaccaagagccacagcuucagagccaugugccagaacggcaagcugguguaccccagcugcgaggagaaguaa

SEQ ID NO: 15138 - RNA, 810 nt, Artificial Sequence
  CFHR3__Homo_sapiens__NP_001160096
augcugcugcugaucaacgugauccugacccugugggugagcugcgccaacggccaggugaagcccugcgacuuccccgacaucaagcacggcggccuguuccacgagaacaugagaagacccuacuuccccguggccgugggcaaguacuacagcuacuacugcgacgagcacuucgagacccccagcggcagcuacugggacuacauccacugcacccagaacggcuggagccccgccgugcccugccugagaaagugcuacuuccccuaccuggagaacggcuacaaccagaacuacggcagaaaguucgugcagggcaacagcaccgagguggccugccaccccggcuacggccugcccaaggcccagaccaccgugaccugcaccgagaagggcuggagccccacccccagaugcaucagagugaacagcagcgagaagugcggcccccccccccccaucagcaacggcgacaccaccagcuuccugcugaagguguacgugccccagagcagaguggaguaccagugccagcccuacuacgagcugcagggcagcaacuacgugaccugcagcaacggcgaguggagcgagccccccagaugcauccaccccugcaucaucaccgaggagaacaugaacaagaacaacaucaagcugaagggcagaagcgacagaaaguacuacgccaagaccggcgacaccaucgaguucaugugcaagcugggcuacaacgccaacaccagcauccugagcuuccaggccgugugcagagagggcaucguggaguaccccagaugcgaguaa

SEQ ID NO: 15139 - RNA, 1734 nt, Artificial Sequence
  CFHR4__Homo_sapiens__NP_001188480
augcugcugcugaucaacgugauccugacccugugggugagcugcgccaacggccaggugaagcccugcgacuuccccgagauccagcacggcggccuguacuacaagagccugagaagacuguacuuccccgccgccgccggccagagcuacagcuacuacugcgaccagaacuucgugacccccagcggcagcuacugggacuacauccacugcacccaggacggcuggagccccaccgugcccugccugagaaccugcagcaagagcgacguggagaucgagaacggcuucaucagcgagagcagcagcaucuacauccugaacgaggagacccaguacaacugcaagcccggcuacgccaccgccgagggcaacagcagcggcagcaucaccugccugcagaacggcuggagcacccagcccaucugcaucaaguucugcgacaugcccguguucgagaacagcagagccaagagcaacggcaugugguucaagcugcacgacacccuggacuacgagugcuacgacggcuacgagagcagcuacggcaacaccaccgacagcaucgugugcggcgaggacggcuggagccaccugcccaccugcuacaacagcagcgagaacugcggcccccccccccccaucagcaacggcgacaccaccagcuucccccagaagguguaccugcccuggagcagaguggaguaccagugccagagcuacuacgagcugcagggcagcaaguacgugaccugcagcaacggcgacuggagcgagccccccagaugcaucagcaugaagcccugcgaguuccccgagauccagcacggccaccuguacuacgagaacaccagaagacccuacuuccccguggccaccggccagagcuacagcuacuacugcgaccagaacuucgugacccccagcggcagcuacugggacuacauccacugcacccaggacggcuggcugcccaccgugcccugccugagaaccugcagcaagagcgacaucgagaucgagaacggcuucaucagcgagagcagcagcaucuacauccugaacaaggagauccaguacaagugcaagcccggcuacgccaccgccgacggcaacagcagcggcagcaucaccugccugcagaacggcuggagcgcccagcccaucugcaucaaguucugcgacaugcccguguucgagaacagcagagccaagagcaacggcaugagauucaagcugcacgacacccuggacuacgagugcuacgacggcuacgagaucagcuacggcaacaccaccggcagcaucgugugcggcgaggacggcuggagccacuuccccaccugcuacaacagcagcgagaagugcggcccccccccccccaucagcaacggcgacaccaccagcuuccugcugaagguguacgugccccagagcagaguggaguaccagugccagagcuacuacgagcugcagggcagcaacuacgugaccugcagcaacggcgaguggagcgagccccccagaugcauccaccccugcaucaucaccgaggagaacaugaacaagaacaacauccagcugaagggcaagagcgacaucaaguacuacgccaagaccggcgacaccaucgaguucaugugcaagcugggcuacaacgccaacaccagcgugcugagcuuccaggccgugugcagagagggcaucguggaguaccccagaugcgaguaa

SEQ ID NO: 15140 - RNA, 1710 nt, Artificial Sequence
  CFHR5__Homo_sapiens__NP_110414
augcugcugcuguucagcgugauccugaucagcugggugagcaccgugggcggcgagggcacccugugcgacuuccccaagauccaccacggcuuccuguacgacgaggaggacuacaaccccuucagccaggugcccaccggcgagguguucuacuacagcugcgaguacaacuucgugagccccagcaagagcuucuggaccagaaucaccugcaccgaggagggcuggagccccacccccaagugccugagaaugugcagcuuccccuucgugaagaacggccacagcgagagcagcggccugauccaccuggagggcgacaccgugcagaucaucugcaacaccggcuacagccugcagaacaacgagaagaacaucagcugcguggagagaggcuggagcaccccccccaucugcagcuucaccaagggcgagugccacgugcccauccuggaggccaacguggacgcccagcccaagaaggagagcuacaaggugggcgacgugcugaaguucagcugcagaaagaaccugaucagagugggcagcgacagcgugcagugcuaccaguucggcuggagccccaacuuccccaccugcaagggccaggugagaagcugcggcccccccccccagcugagcaacggcgaggugaaggagaucagaaaggaggaguacggccacaacgaggugguggaguacgacugcaaccccaacuucaucaucaacggccccaagaagauccagugcguggacggcgaguggaccacccugcccaccugcguggagcaggugaagaccugcggcuacauccccgagcuggaguacggcuacgugcagcccagcgugccccccuaccagcacggcgugagcguggaggugaacugcagaaacgaguacgccaugaucggcaacaacaugaucaccugcaucaacggcaucuggaccgagcugcccaugugcguggccacccaccagcugaagagaugcaagaucgccggcgugaacaucaagacccugcugaagcugagcggcaaggaguucaaccacaacagcagaaucagauacagaugcagcgacaucuucagauacagacacagcgugugcaucaacggcaaguggaaccccgagguggacugcaccgagaagagagagcaguucugccccccccccccccagauccccaacgcccagaacaugaccaccaccgugaacuaccaggacggcgagaagguggccgugcugugcaaggagaacuaccugcugcccgaggccaaggagaucgugugcaaggacggcagauggcagagccugcccagaugcguggagagcaccgccuacugcggccccccccccagcaucaacaacggcgacaccaccagcuucccccugagcguguacccccccggcagcaccgugaccuacagaugccagagcuucuacaagcugcagggcagcgugaccgugaccugcagaaacaagcaguggagcgagccccccagaugccuggaccccugcguggugagcgaggagaacaugaacaagaacaacauccagcugaaguggagaaacgacggcaagcuguacgccaagaccggcgacgccguggaguuccagugcaaguucccccacaaggccaugaucagcagcccccccuucagagccaucugccaggagggcaaguucgaguaccccaucugcgaguaa

SEQ ID NO: 15141 - RNA, 1752 nt, Artificial Sequence
  CFI__Homo_sapiens__NP_000195
augaagcugcugcacguguuccugcuguuccugugcuuccaccugagauucugcaaggugaccuacaccagccaggaggaccugguggagaagaagugccuggccaagaaguacacccaccugagcugcgacaagguguucugccagcccuggcagagaugcaucgagggcaccugcgugugcaagcugcccuaccagugccccaagaacggcaccgccgugugcgccaccaacagaagaagcuuccccaccuacugccagcagaagagccuggagugccugcaccccggcaccaaguuccugaacaacggcaccugcaccgccgagggcaaguucagcgugagccugaagcacggcaacaccgacagcgagggcaucguggaggugaagcugguggaccaggacaagaccauguucaucugcaagagcagcuggagcaugagagaggccaacguggccugccuggaccugggcuuccagcagggcgccgacacccagagaagauucaagcugagcgaccugagcaucaacagcaccgagugccugcacgugcacugcagaggccuggagaccagccuggccgagugcaccuucaccaagagaagaaccaugggcuaccaggacuucgccgacguggugugcuacacccagaaggccgacagccccauggacgacuucuuccagugcgugaacggcaaguacaucagccagaugaaggccugcgacggcaucaacgacugcggcgaccagagcgacgagcugugcugcaaggccugccagggcaagggcuuccacugcaagagcggcgugugcauccccagccaguaccagugcaacggcgagguggacugcaucaccggcgaggacgaggugggcugcgccggcuucgccagcguggcccaggaggagaccgagauccugaccgccgacauggacgccgagagaagaagaaucaagagccugcugcccaagcugagcugcggcgugaagaacagaaugcacaucagaagaaagagaaucgugggcggcaagagagcccagcugggcgaccugcccuggcagguggccaucaaggacgccagcggcaucaccugcggcggcaucuacaucggcggcugcuggauccugaccgccgcccacugccugagagccagcaagacccacagauaccagaucuggaccaccgugguggacuggauccaccccgaccugaagagaaucgugaucgaguacguggacagaaucaucuuccacgagaacuacaacgccggcaccuaccagaacgacaucgcccugaucgagaugaagaaggacggcaacaagaaggacugcgagcugcccagaagcauccccgccugcgugcccuggagccccuaccuguuccagcccaacgacaccugcaucgugagcggcuggggcagagagaaggacaacgagagaguguucagccugcaguggggcgaggugaagcugaucagcaacugcagcaaguucuacggcaacagauucuacgagaaggagauggagugcgccggcaccuacgacggcagcaucgacgccugcaagggcgacagcggcggcccccuggugugcauggacgccaacaacgugaccuacguguggggcguggugagcuggggcgagaacugcggcaagcccgaguuccccggcguguacaccaagguggccaacuacuucgacuggaucagcuaccacgugggcagacccuucaucagccaguacaacguguaa

SEQ ID NO: 15142 - RNA, 501 nt, Artificial Sequence
  CFL1__Homo_sapiens__NP_005498
auggccagcggcguggccgugagcgacggcgugaucaagguguucaacgacaugaaggugagaaagagcagcacccccgaggaggugaagaagagaaagaaggccgugcuguucugccugagcgaggacaagaagaacaucauccuggaggagggcaaggagauccuggugggcgacgugggccagaccguggacgaccccuacgccaccuucgugaagaugcugcccgacaaggacugcagauacgcccuguacgacgccaccuacgagaccaaggagagcaagaaggaggaccugguguucaucuucugggcccccgagagcgccccccugaagagcaagaugaucuacgccagcagcaaggacgccaucaagaagaagcugaccggcaucaagcacgagcugcaggccaacugcuacgaggaggugaaggacagaugcacccuggccgagaagcugggcggcagcgccgugaucagccuggagggcaagccccuguaa

SEQ ID NO: 15143 - RNA, 501 nt, Artificial Sequence
  CFL2__Homo_sapiens__NP_068733
auggccagcggcgugaccgugaacgacgaggugaucaagguguucaacgacaugaaggugagaaagagcagcacccaggaggagaucaagaagagaaagaaggccgugcuguucugccugagcgacgacaagagacagaucaucguggaggaggccaagcagauccuggugggcgacaucggcgacaccguggaggaccccuacaccagcuucgugaagcugcugccccugaacgacugcagauacgcccuguacgacgccaccuacgagaccaaggagagcaagaaggaggaccugguguucaucuucugggcccccgagagcgccccccugaagagcaagaugaucuacgccagcagcaaggacgccaucaagaagaaguucaccggcaucaagcacgaguggcaggugaacggccuggacgacaucaaggacagaagcacccugggcgagaagcugggcggcaacgugguggugagccuggagggcaagccccuguaa

SEQ ID NO: 15144 - RNA, 666 nt, Artificial Sequence
  CFLAR__Homo_sapiens__NP_001120656
augagcgccgaggugauccaccagguggaggaggcccuggacaccgacgagaaggagaugcugcuguuccugugcagagacguggccaucgacguggugccccccaacgugagagaccugcuggacauccugagagagagaggcaagcugagcgugggcgaccuggccgagcugcuguacagagugagaagauucgaccugcugaagagaauccugaagauggacagaaaggccguggagacccaccugcugagaaacccccaccuggugagcgacuacagagugcugauggccgagaucggcgaggaccuggacaagagcgacgugagcagccugaucuuccugaugaaggacuacaugggcagaggcaagaucagcaaggagaagagcuuccuggaccuggugguggagcuggagaagcugaaccugguggcccccgaccagcuggaccugcuggagaagugccugaagaacauccacagaaucgaccugaagaccaagauccagaaguacaagcagagcgugcagggcgccggcaccagcuacagaaacgugcugcaggccgccauccagaagagccugaaggaccccagcaacaacuucagaaugaucacccccuacgcccacugccccgaccugaagauccugggcaacugcagcauguaa

SEQ ID NO: 15145 - RNA, 1410 nt, Artificial Sequence
  CFP__Homo_sapiens__NP_002612
augaucaccgagggcgcccaggcccccagacugcugcugcccccccugcugcugcugcugacccugcccgccaccggcagcgaccccgugcugugcuucacccaguacgaggagagcagcggcaagugcaagggccugcugggcggcggcgugagcguggaggacugcugccugaacaccgccuucgccuaccagaagagaagcggcggccugugccagcccugcagaagccccagauggagccuguggagcaccugggcccccugcagcgugaccugcagcgagggcagccagcugagauacagaagaugcgugggcuggaacggccagugcagcggcaagguggcccccggcacccuggaguggcagcugcaggccugcgaggaccagcagugcugccccgagaugggcggcuggagcggcuggggccccugggagcccugcagcgugaccugcagcaagggcaccagaaccagaagaagagccugcaaccaccccgcccccaagugcggcggccacugccccggccaggcccaggagagcgaggccugcgacacccagcaggugugccccacccacggcgccugggccaccuggggccccuggacccccugcagcgccagcugccacggcggcccccacgagcccaaggagaccagaagcagaaagugcagcgcccccgagcccagccagaagccccccggcaagcccugccccggccuggccuacgagcagagaagaugcaccggccugccccccugccccguggccggcggcuggggccccuggggccccgugagccccugccccgugaccugcggccugggccagaccauggagcagagaaccugcaaccaccccgugccccagcacggcggccccuucugcgccggcgacgccaccagaacccacaucugcaacaccgccgugcccugccccguggacggcgagugggacagcuggggcgaguggagccccugcaucagaagaaacaugaagagcaucagcugccaggagauccccggccagcagagcagaggcagaaccugcagaggcagaaaguucgacggccacagaugcgccggccagcagcaggacaucagacacugcuacagcauccagcacugcccccugaagggcagcuggagcgaguggagcaccuggggccugugcaugccccccugcggccccaaccccaccagagccagacagagacugugcaccccccugcugcccaaguacccccccaccgugagcaugguggagggccagggcgagaagaacgugaccuucuggggcagaccccugcccagaugcgaggagcugcagggccagaagcuggugguggaggagaagagacccugccugcacgugcccgccugcaaggaccccgaggaggaggagcuguaa

SEQ ID NO: 15146 - RNA, 4443 nt, Artificial Sequence
  CFTR__Homo_sapiens__NP_000483
augcagagaagcccccuggagaaggccagcguggugagcaagcuguucuucagcuggaccagacccauccugagaaagggcuacagacagagacuggagcugagcgacaucuaccagauccccagcguggacagcgccgacaaccugagcgagaagcuggagagagagugggacagagagcuggccagcaagaagaaccccaagcugaucaacgcccugagaagaugcuucuucuggagauucauguucuacggcaucuuccuguaccugggcgaggugaccaaggccgugcagccccugcugcugggcagaaucaucgccagcuacgaccccgacaacaaggaggagagaagcaucgccaucuaccugggcaucggccugugccugcuguucaucgugagaacccugcugcugcaccccgccaucuucggccugcaccacaucggcaugcagaugagaaucgccauguucagccugaucuacaagaagacccugaagcugagcagcagagugcuggacaagaucagcaucggccagcuggugagccugcugagcaacaaccugaacaaguucgacgagggccuggcccuggcccacuucguguggaucgccccccugcagguggcccugcugaugggccugaucugggagcugcugcaggccagcgccuucugcggccugggcuuccugaucgugcuggcccuguuccaggccggccugggcagaaugaugaugaaguacagagaccagagagccggcaagaucagcgagagacuggugaucaccagcgagaugaucgagaacauccagagcgugaaggccuacugcugggaggaggccauggagaagaugaucgagaaccugagacagaccgagcugaagcugaccagaaaggccgccuacgugagauacuucaacagcagcgccuucuucuucagcggcuucuucgugguguuccugagcgugcugcccuacgcccugaucaagggcaucauccugagaaagaucuucaccaccaucagcuucugcaucgugcugagaauggccgugaccagacaguuccccugggccgugcagaccugguacgacagccugggcgccaucaacaagauccaggacuuccugcagaagcaggaguacaagacccuggaguacaaccugaccaccaccgagguggugauggagaacgugaccgccuucugggaggagggcuucggcgagcuguucgagaaggccaagcagaacaacaacaacagaaagaccagcaacggcgacgacagccuguucuucagcaacuucagccugcugggcacccccgugcugaaggacaucaacuucaagaucgagagaggccagcugcuggccguggccggcagcaccggcgccggcaagaccagccugcugauggugaucaugggcgagcuggagcccagcgagggcaagaucaagcacagcggcagaaucagcuucugcagccaguucagcuggaucaugcccggcaccaucaaggagaacaucaucuucggcgugagcuacgacgaguacagauacagaagcgugaucaaggccugccagcuggaggaggacaucagcaaguucgccgagaaggacaacaucgugcugggcgagggcggcaucacccugagcggcggccagagagccagaaucagccuggccagagccguguacaaggacgccgaccuguaccugcuggacagccccuucggcuaccuggacgugcugaccgagaaggagaucuucgagagcugcgugugcaagcugauggccaacaagaccagaauccuggugaccagcaagauggagcaccugaagaaggccgacaagauccugauccugcacgagggcagcagcuacuucuacggcaccuucagcgagcugcagaaccugcagcccgacuucagcagcaagcugaugggcugcgacagcuucgaccaguucagcgccgagagaagaaacagcauccugaccgagacccugcacagauucagccuggagggcgacgcccccgugagcuggaccgagaccaagaagcagagcuucaagcagaccggcgaguucggcgagaagagaaagaacagcauccugaaccccaucaacagcaucagaaaguucagcaucgugcagaagaccccccugcagaugaacggcaucgaggaggacagcgacgagccccuggagagaagacugagccuggugcccgacagcgagcagggcgaggccauccugcccagaaucagcgugaucagcaccggccccacccugcaggccagaagaagacagagcgugcugaaccugaugacccacagcgugaaccagggccagaacauccacagaaagaccaccgccagcaccagaaaggugagccuggccccccaggccaaccugaccgagcuggacaucuacagcagaagacugagccaggagaccggccuggagaucagcgaggagaucaacgaggaggaccugaaggagugcuucuucgacgacauggagagcauccccgccgugaccaccuggaacaccuaccugagauacaucaccgugcacaagagccugaucuucgugcugaucuggugccuggugaucuuccuggccgagguggccgccagccugguggugcuguggcugcugggcaacaccccccugcaggacaagggcaacagcacccacagcagaaacaacagcuacgccgugaucaucaccagcaccagcagcuacuacguguucuacaucuacgugggcguggccgacacccugcuggccaugggcuucuucagaggccugccccuggugcacacccugaucaccgugagcaagauccugcaccacaagaugcugcacagcgugcugcaggcccccaugagcacccugaacacccugaaggccggcggcauccugaacagauucagcaaggacaucgccauccuggacgaccugcugccccugaccaucuucgacuucauccagcugcugcugaucgugaucggcgccaucgccgugguggccgugcugcagcccuacaucuucguggccaccgugcccgugaucguggccuucaucaugcugagagccuacuuccugcagaccagccagcagcugaagcagcuggagagcgagggcagaagccccaucuucacccaccuggugaccagccugaagggccuguggacccugagagccuucggcagacagcccuacuucgagacccuguuccacaaggcccugaaccugcacaccgccaacugguuccuguaccugagcacccugagaugguuccagaugagaaucgagaugaucuucgugaucuucuucaucgccgugaccuucaucagcauccugaccaccggcgagggcgagggcagagugggcaucauccugacccuggccaugaacaucaugagcacccugcagugggccgugaacagcagcaucgacguggacagccugaugagaagcgugagcagaguguucaaguucaucgacaugcccaccgagggcaagcccaccaagagcaccaagcccuacaagaacggccagcugagcaaggugaugaucaucgagaacagccacgugaagaaggacgacaucuggcccagcggcggccagaugaccgugaaggaccugaccgccaaguacaccgagggcggcaacgccauccuggagaacaucagcuucagcaucagccccggccagagagugggccugcugggcagaaccggcagcggcaagagcacccugcugagcgccuuccugagacugcugaacaccgagggcgagauccagaucgacggcgugagcugggacagcaucacccugcagcaguggagaaaggccuucggcgugaucccccagaagguguucaucuucagcggcaccuucagaaagaaccuggaccccuacgagcaguggagcgaccaggagaucuggaagguggccgacgaggugggccugagaagcgugaucgagcaguuccccggcaagcuggacuucgugcugguggacggcggcugcgugcugagccacggccacaagcagcugaugugccuggccagaagcgugcugagcaaggccaagauccugcugcuggacgagcccagcgcccaccuggaccccgugaccuaccagaucaucagaagaacccugaagcaggccuucgccgacugcaccgugauccugugcgagcacagaaucgaggccaugcuggagugccagcaguuccuggugaucgaggagaacaaggugagacaguacgacagcauccagaagcugcugaacgagagaagccuguucagacaggccaucagccccagcgacagagugaagcuguucccccacagaaacagcagcaagugcaagagcaagccccagaucgccgcccugaaggaggagaccgaggaggaggugcaggacaccagacuguaa

SEQ ID NO: 15147 - RNA, 351 nt, Artificial Sequence
  CGA__Homo_sapiens__NP_000726
auggacuacuacagaaaguacgccgccaucuuccuggugacccugagcguguuccugcacgugcugcacagcgcccccgacgugcaggacugccccgagugcacccugcaggagaaccccuucuucagccagcccggcgcccccauccugcagugcaugggcugcugcuucagcagagccuaccccaccccccugagaagcaagaagaccaugcuggugcagaagaacgugaccagcgagagcaccugcugcguggccaagagcuacaacagagugaccgugaugggcggcuucaagguggagaaccacaccgccugccacugcagcaccugcuacuaccacaagagcuaa

SEQ ID NO: 15148 - RNA, 468 nt, Artificial Sequence
  CGB1__Homo_sapiens__NP_203695
augagcaagagacugcugcugcugcugcugcugagcaugggcggcaccugggccagcaaggagccccugagacccagaugcagacccaucaacgccacccuggccguggagaaggagggcugccccgugugcaucaccgugaacaccaccaucugcgccggcuacugccccaccaugaccagagugcugcagggcgugcugcccgcccugccccagguggugugcaacuacagagacgugagauucgagagcaucagacugcccggcugccccagaggcgugaaccccguggugagcuacgccguggcccugagcugccagugcgcccugugcagaagaagcaccaccgacugcggcggccccaaggaccacccccugaccugcgacgaccccagauuccaggacagcagcagcagcaaggcccccccccccagccugcccagccccagcagacugcccggccccuaa

SEQ ID NO: 15149 - RNA, 492 nt, Artificial Sequence
  CGB2__Homo_sapiens__NP_203696
augagcaagggccugcugcugcugcugcugcugagcaugggcggcaccugggccagcaaggagccccugagacccagaugcagacccaucaacgccacccuggccguggagaaggagggcugccccgugugcaucaccgugaacaccaccaucugcgccggcuacugccccaccaugaccagagugcugcagggcgugcugcccgcccugccccagguggugugcaacuacagagacgugagauucgagagcaucagacugcccggcugccccagaggcgugaaccccguggugagcuacgccguggcccugagcugccagugcgcccugugcagaagaagcaccaccgacugcggcggccccaaggaccacccccugaccugcgacgaccccagauuccaggccagcagcagcagcaaggcccccccccccagccugcccagccccagcagacugcccggccccagcgacacccccauccugccccaguaa

SEQ ID NO: 15150 - RNA, 498 nt, Artificial Sequence
  CGB5__Homo_sapiens__NP_149032
auggagauguuccagggccugcugcugcugcugcugcugagcaugggcggcaccugggccagcaaggagccccugagacccagaugcagacccaucaacgccacccuggccguggagaaggagggcugccccgugugcaucaccgugaacaccaccaucugcgccggcuacugccccaccaugaccagagugcugcagggcgugcugcccgcccugccccagguggugugcaacuacagagacgugagauucgagagcaucagacugcccggcugccccagaggcgugaaccccguggugagcuacgccguggcccugagcugccagugcgcccugugcagaagaagcaccaccgacugcggcggccccaaggaccacccccugaccugcgacgaccccagauuccaggacagcagcagcagcaaggcccccccccccagccugcccagccccagcagacugcccggccccagcgacacccccauccugccccaguaa

SEQ ID NO: 15151 - RNA, 498 nt, Artificial Sequence
  CGB7__Homo_sapiens__XP_011525821
auggagauguuccagggccugcugcugcugcugcugcugagcaugggcggcaccugggccagcagagagaugcugagacccagaugcagacccaucaacgccacccuggccguggagaaggagggcugccccgugugcaucaccgugaacaccaccaucugcgccggcuacugccccaccaugaccagagugcugcagggcgugcugcccgcccugccccagguggugugcaacuacagagacgugagauucgagagcaucagacugcccggcugccccagaggcgugaaccccguggugagcuacgccguggcccugagcugccagugcgcccugugcagaagaagcaccaccgacugcggcggccccaaggaccacccccugaccugcgacgaccccagauuccaggccagcagcagcagcaaggcccccccccccagccugcccagccccagcagacugcccggccccagcgacacccccauccugccccaguaa

SEQ ID NO: 15152 - RNA, 3612 nt, Artificial Sequence
  CGN__Homo_sapiens__XP_005245422
auggagcaggcccccaacauggccgagcccagaggccccguggaccacggcgugcagaucagauucaucaccgagcccgugagcggcgccgagaugggcacccugagaagaggcggcagaagacccgccaaggacgccagagccagcaccuacggcguggccgugagagugcagggcaucgccggccagcccuucguggugcugaacagcggcgagaagggcggcgacagcuucggcgugcagaucaagggcgccaacgaccagggcgccagcggcgcccugagcagcgaccuggagcugcccgagaaccccuacagccaggugaagggcuuccccgcccccagccagagcagcaccagcgacgaggagcccggcgccuacuggaacggcaagcugcugagaagccacagccaggccagccuggccggccccggccccguggaccccagcaacagaagcaacagcaugcuggagcuggcccccaagguggccagccccggcagcaccaucgacaccgccccccugagcagcguggacagccugaucaacaaguucgacagccagcugggcggccaggccagaggcagaaccggcagaagaaccagaaugcugccccccgagcagagaaagagaagcaagagccuggacagcagacugcccagagacaccuucgaggagagagagagacagagcaccaaccacuggaccagcagcaccaaguacgacaaccacgugggcaccagcaagcagcccgcccagagccagaaccugagcccccugagcggcuucagcagaagcagacagacccaggacugggugcugcagagcuucgaggagcccagaagaagcgcccaggaccccaccaugcugcaguucaagagcacccccgaccugcugagagaccagcaggaggccgccccccccggcagcguggaccacaugaaggccaccaucuacggcauccugagagagggcagcagcgagagcgagaccagcgugagaagaaaggugagccuggugcuggagaagaugcagccccuggugauggugagcagcggcagcaccaaggccguggccggccagggcgagcugaccagaaagguggaggagcugcagagaaagcuggacgaggaggugaagaagagacagaagcuggagcccagccaggugggccuggagagacagcuggaggagaagaccgaggagugcagcagacugcaggagcugcuggagagaagaaagggcgaggcccagcagagcaacaaggagcugcagaacaugaagagacugcuggaccagggcgaggaccugagacacggccuggagacccaggugauggagcugcagaacaagcugaagcacgugcagggccccgagcccgccaaggaggugcugcugaaggaccugcuggagaccagagagcugcuggaggaggugcuggagggcaagcagagaguggaggagcagcugagacugagagagagagagcugaccgcccugaagggcgcccugaaggaggagguggccagcagagaccaggagguggagcacgugagacagcaguaccagagagacaccgagcagcugagaagaagcaugcaggacgccacccaggaccacgccgugcuggaggccgagagacagaagaugagcgcccuggugagaggccugcagagagagcuggaggagaccagcgaggagaccggccacuggcagagcauguuccagaagaacaaggaggaccugagagccaccaagcaggagcugcugcagcugagaauggagaaggaggagauggaggaggagcugggcgagaagaucgaggugcugcagagagagcuggagcaggccagagccagcgccggcgacaccagacagguggaggugcugaagaaggagcugcugagaacccaggaggagcugaaggagcugcaggccgagagacagagccaggagguggccggcagacacagagacagagagcuggagaagcagcuggccgugcugagaguggaggccgacagaggcagagagcuggaggagcagaaccugcagcugcagaagacccugcagcagcugagacaggacugcgaggaggccagcaaggccaagaugguggccgaggccgaggccaccgugcugggccagagaagagccgccguggagaccacccugagagagacccaggaggagaacgacgaguucagaagaagaauccugggccuggagcagcagcugaaggagaccagaggccugguggacggcggcgaggccguggaggccagacugagagacaagcugcagagacuggaggccgagaagcagcagcuggaggaggcccugaacgccagccaggaggaggagggcagccuggccgccgccaagagagcccuggaggccagacuggaggaggcccagagaggccuggccagacugggccaggagcagcagacccugaacagagcccuggaggaggagggcaagcagagagaggugcugagaagaggcaaggccgagcuggaggagcagaagagacugcuggacagaaccguggacagacugaacaaggagcuggagaagaucggcgaggacagcaagcaggcccugcagcagcugcaggcccagcuggaggacuacaaggagaaggccagaagagagguggccgacgcccagagacaggccaaggacugggccagcgaggccgagaagaccagcggcggccugagcagacugcaggacgagauccagagacugagacaggcccugcaggccagccaggccgagagagacaccgccagacuggacaaggagcugcuggcccagagacugcagggccuggagcaggaggccgagaacaagaagagaagccaggacgacagagccagacagcugaagggccuggaggagaaggugagcagacuggagaccgagcuggacgaggagaagaacaccguggagcugcugaccgacagagugaacagaggcagagaccagguggaccagcugagaaccgagcugaugcaggagagaagcgccagacaggaccuggagugcgacaagaucagccuggagagacagaacaaggaccugaagaccagacuggccagcagcgagggcuuccagaagcccagcgccagccugagccagcuggagagccagaaccagcugcugcaggagagacugcaggccgaggagagagagaagaccgugcugcagagcaccaacagaaagcuggagagaaaggugaaggagcugagcauccagaucgaggacgagagacagcacgugaacgaccagaaggaccagcugagccugagagugaaggcccugaagagacagguggacgaggccgaggaggagaucgagagacuggacggccugagaaagaaggcccagagagagguggaggagcagcacgaggugaacgagcagcugcaggccagaaucaagagccuggagaaggacagcuggagaaaggccagcagaagcgccgccgagagcgcccugaagaacgagggccugagcagcgacgaggaguucgacagcguguacgaccccagcagcaucgccagccugcugaccgagagcaaccugcagaccagcagcugcuaa

SEQ ID NO: 15153 - RNA, 3909 nt, Artificial Sequence
  CGNL1__Homo_sapiens__NP_116255
auggagcuguacuucggcgaguaccagcacgugcagcaggaguacggcgugcaccugagacuggccagcgacgacacccagaagagcagaagcagccagaacagcaaggccggcagcuacggcgugagcaucagagugcagggcaucgacggccaccccuacaucgugcugaacaacaccgagagaugccuggccggcaccagcuucagcgagaacggcccccccuuccccccccccgugaucaacaaccugccccugcacagcagcaacggcagcgugcccaaggagaacagcgaggagcugcagcugcccgagaaccccuacgcccagcccagccccaucagaaaccugaagcagccccugcugcacgagggcaagaacggcgugcuggacagaaaggacggcagcgugaagcccagccaccugcugaacuuccagagacaccccgagcugcugcagcccuacgaccccgagaagaacgagcugaaccugcagaaccaccagcccagcgagagcaacuggcugaagacccugaccgaggagggcaucaacaacaagaagcccuggaccugcuuccccaagcccagcaacagccagcccaccagccccagccuggaggaccccgccaagagcggcgugaccgccaucagacugugcagcagcguggugaucgaggaccccaagaagcagaccagcgugugcgugaacgugcagagcugcaccaaggagagagugggcgaggaggcccuguucaccagcggcagaccccugaccgcccacagcccccacgcccaccccgagaccaagaagaccagacccgacgugcugcccuucagaagacaggacagcgccggccccgugcuggacggcgccagaagcagaagaagcagcagcagcagcaccacccccaccagcgccaacagccuguacagauuccugcuggacgaccaggagugcgccauccacgccgacaacgugaacagacacgagaacagaagauacauccccuuccugcccggcaccggcagagacaucgacaccggcagcauccccggcguggaccagcugaucgagaaguucgaccagaagcccggccugcagagaagaggcagaagcggcaagagaaacagaaucaacaccgacgacagaaagagaagcagaagcguggacagcgccuuccccuucggccugcagggcaacagcgaguaccugaucgaguucagcagaaaccugggcaagagcagcgagcaccugcugagacccagccaggugugcccccagagaccccugagccaggagagaagaggcaagcagagcgugggcagaaccuucgccaagcugcagggcgccgcccacggcgccagcugcgcccacagcagacccccccagcccaacaucgacggcaaggugcuggagaccgagggcagccaggagagcaccgugaucagagcccccagccugggcgcccagagcaagaaggaggaggaggugaagaccgccaccgccacccugaugcugcagaacagagccaccgccaccagccccgacagcggcgccaagaagaucagcgugaagaccuuccccagcgccagcaacacccaggccacccccgaccugcugaagggccagcaggagcugacccagcagaccaacgaggagaccgccaagcagauccuguacaacuaccugaaggagggcagcaccgacaacgacgacgccaccaagagaaaggugaaccugguguucgagaagauccagacccugaagagcagagccgccggcagcgcccagggcaacaaccaggccugcaacagcaccagcgaggugaaggaccugcuggagcagaagagcaagcugaccaucgagguggccgagcugcagagacagcugcagcuggaggugaagaaccagcagaacaucaaggaggagagagagagaaugagagccaaccuggaggagcugagaagccagcacaacgagaagguggaggagaacagcacccugcagcagagacuggaggagagcgagggcgagcugagaaagaaccuggaggagcuguuccaggugaagauggagagagagcagcaccagaccgagaucagagaccugcaggaccagcugagcgagaugcacgacgagcuggacagcgccaagagaagcgaggacagagagaagggcgcccugaucgaggagcugcugcaggccaagcaggaccugcaggaccugcugaucgccaaggaggagcaggaggaccugcugagaaagagagagagagagcugaccgcccugaagggcgcccugaaggaggaggugagcagccacgaccaggagauggacaagcugaaggagcaguacgacgccgagcugcaggcccugagagagagcguggaggaggccaccaagaacguggaggugcuggccagcagaagcaacaccagcgagcaggaccaggccggcaccgagaugagagugaagcugcugcaggaggagaacgagaagcugcagggcagaagcgaggagcuggagagaagaguggcccagcugcagagacagaucgaggaccugaagggcgacgaggccaaggccaaggagacccugaagaaguacgagggcgagaucagacagcuggaggaggcccuggugcacgccagaaaggaggagaaggaggccgugagcgccagaagagcccuggagaacgagcuggaggccgcccagggcaaccugagccagaccacccaggagcagaagcagcugagcgagaagcugaaggaggagagcgagcagaaggagcagcugagaagacugaagaacgagauggagaacgagagauggcaccugggcaagaccaucgagaagcugcagaaggagauggccgacaucguggaggccagcagaaccagcacccuggagcugcagaaccagcuggacgaguacaaggagaagaacagaagagagcuggccgagaugcagagacagcugaaggagaagacccuggaggccgagaagagcagacugaccgccaugaagaugcaggacgagaugagacugauggaggaggagcugagagacuaccagagagcccaggacgaggcccugaccaagagacagcugcuggagcagacccugaaggaccuggaguacgagcuggaggccaagagccaccugaaggacgacagaagcagacuggugaagcagauggaggacaaggugagccagcuggagauggagcuggaggaggagagaaacaacagcgaccugcugagcgagagaaucagcagaagcagagagcagauggagcagcugagaaacgagcugcugcaggagagagccgccagacaggaccuggagugcgacaagaucagccuggagagacagaacaaggaccugaagagcagaaucauccaccuggagggcagcuacagaagcagcaaggagggccugguggugcagauggaggccagaaucgccgagcuggaggacagacuggagagcgaggagagagacagagccaaccugcagcugagcaacagaagacuggagagaaaggugaaggagcuggugaugcagguggacgacgagcaccugagccugaccgaccagaaggaccagcugagccugagacugaaggccaugaagagacagguggaggaggccgaggaggagaucgacagacuggagagcagcaagaagaagcugcagagagagcuggaggagcagauggacaugaacgagcaccugcagggccagcugaacagcaugaagaaggaccugagacugaagaagcugcccagcaaggugcuggacgacauggacgacgacgacgaccugagcaccgacggcggcagccuguacgaggcccccgugagcuacaccuucagcaaggacagcaccguggccagccagaucuaa

SEQ ID NO: 15154 - RNA, 999 nt, Artificial Sequence
  CGRRF1__Homo_sapiens__NP_006559
auggccgccguguuccuggugacccuguacgaguacagcccccuguucuacaucgccgugguguucaccugcuucaucgugaccaccggccuggugcugggcugguucggcugggacgugcccgugauccugagaaacagcgaggagacccaguucagcaccagaguguucaagaagcagaugagacaggugaagaaccccuucggccuggagaucaccaaccccagcagcgccagcaucaccaccggcaucacccugaccaccgacugccuggaggacagccugcugaccugcuacuggggcugcagcgugcagaagcuguacgaggcccugcagaagcacguguacugcuucagaaucagcaccccccaggcccuggaggacgcccuguacagcgaguaccuguaccaggagcaguacuucaucaagaaggacagcaaggaggagaucuacugccagcugcccagagacaccaagaucgaggacuucggcaccgugcccagaagcagauacccccugguggcccugcugacccuggccgacgaggacgacagagagaucuacgacaucaucagcauggugagcgugauccacauccccgacagaaccuacaagcugagcugcagaauccuguaccaguaccugcugcuggcccagggccaguuccacgaccugaagcagcuguucaugagcgccaacaacaacuucacccccagcaacaacagcagcagcgaggagaagaacaccgacagaagccugcuggagaaggugggccugagcgagagcgagguggagcccagcgaggagaacagcaaggacugcguggugugccagaacggcaccgugaacugggugcugcugcccugcagacacaccugccugugcgacggcugcgugaaguacuuccagcagugccccaugugcagacaguucgugcaggagagcuucgcccugugcagccagaaggagcaggacaaggacaagcccaagacccuguaa

SEQ ID NO: 15155 - RNA, 819 nt, Artificial Sequence
  CH25H__Homo_sapiens__NP_003947
augagcugccacaacugcagcgacccccaggugcugugcagcagcggccagcuguuccugcagccccugugggaccaccugagaagcugggaggcccugcugcagagccccuucuuccccgugaucuucagcaucaccaccuacgugggcuucugccugcccuucguggugcuggacauccugugcagcugggugcccgcccugagaagauacaagauccaccccgacuucagccccagcgcccagcagcugcugcccugccugggccagacccuguaccagcacgugauguucguguuccccgugacccugcugcacugggccagaagccccgcccugcugccccacgaggcccccgagcugcugcugcugcugcaccacauccuguucugccugcugcuguucgacauggaguucuucguguggcaccugcugcaccacaaggugcccuggcuguacagaaccuuccacaaggugcaccaccagaacagcagcagcuucgcccuggccacccaguacaugagcgugugggagcuguucagccugggcuucuucgacaugaugaacgugacccugcugggcugccacccccugaccacccugaccuuccacguggugaacaucuggcugagcguggaggaccacagcggcuacaacuuccccuggagcacccacagacuggugcccuucggcugguacggcggcguggugcaccacgaccugcaccacagccacuucaacugcaacuucgcccccuacuucacccacugggacaagauccugggcacccugagaaccgccagcgugcccgccagauaa

SEQ ID NO: 15156 - RNA, 660 nt, Artificial Sequence
  CHAC1__Homo_sapiens__NP_001136248
augggcggcgcccagcuggagcugcccagcggcgccagacccggcgugugcgugagaagaagcuucagagcccacgccggcgaccagcccagaagaccccccggccccauccccgugcccggcaccaugaagcaggagagcgccgcccccaacaccccccccaccagccagagccccacccccagcgcccaguuccccagaaacgacggcgacccccaggcccuguggaucuucggcuacggcagccugguguggagacccgacuucgccuacagcgacagcagagugggcuucgugagaggcuacagcagaagauucuggcagggcgacaccuuccacagaggcagcgacaagaugcccggcagaguggugacccugcuggaggaccacgagggcugcaccuggggcguggccuaccaggugcagggcgagcagaaccccggcuaccugggccccgcccccgaggaggccaucgccacccagauccuggccugcagaggcuucagcggccacaaccuggaguaccugcugagacuggccgacuucaugcagcugugcggcccccaggcccaggacgagcaccuggccgccaucguggacgccgugggcaccaugcugcccugcuucugccccaccgagcaggcccuggcccugguguaa

SEQ ID NO: 15157 - RNA, 1323 nt, Artificial Sequence
  CHAD__Homo_sapiens__XP_011522516
augcacggcagcagacugggcgagagacccagaccccugcccagaggcggcagaggcagaaucagcggcagagagagagugaagcccagcggccuggacgcccccagaagaagcuggcugggcugcagacugagaagcggcccccccuacaaggagggcggcagacccgagagacugggccuggccgccgccagagccccccccccccugcugccccccgcccccgcccccggcgugcccgccauggugagacccaugcugcugcugagccugggccugcuggccggccugcugcccgcccuggccgccugcccccagaacugccacugccacagcgaccugcagcacgugaucugcgacaaggugggccugcagaagauccccaaggugagcgagaagaccaagcugcugaaccugcagagaaacaacuuccccgugcuggccgccaacagcuucagagccaugcccaaccuggugagccugcaccugcagcacugccagaucagagagguggccgccggcgccuucagaggccugaagcagcugaucuaccuguaccugagccacaacgacaucagagugcugagagccggcgccuucgacgaccugaccgagcugaccuaccuguaccuggaccacaacaaggugaccgagcugcccagaggccugcugagcccccuggugaaccuguucauccugcagcugaacaacaacaagaucagagagcugagagccggcgccuuccagggcgccaaggaccugagauggcuguaccugagcgagaacgcccugagcagccugcagcccggcgcccuggacgacguggagaaccuggccaaguuccacguggacagaaaccagcugagcagcuaccccagcgccgcccugagcaagcugagagugguggaggagcugaagcugagccacaacccccugaagagcauccccgacaacgccuuccagagcuucggcagauaccuggagacccuguggcuggacaacaccaaccuggagaaguucagcgacggcgccuuccugggcgugaccacccugaagcacgugcaccuggagaacaacagacugaaccagcugcccagcaacuuccccuucgacagccuggagacccuggcccugaccaacaaccccuggaagugcaccugccagcugagaggccugagaagauggcuggaggccaaggccagcagacccgacgccaccugcgccagccccgccaaguucaagggccagcacaucagagacaccgacgccuucagaagcugcaaguuccccaccaagagaagcaagaaggccggcagacacuaa

SEQ ID NO: 15158 - RNA, 2871 nt, Artificial Sequence
  CHAF1A__Homo_sapiens__NP_005474
augcuggaggagcuggagugcggcgcccccggcgccagaggcgccgccaccgccauggacugcaaggacagacccgccuuccccgugaagaagcugauccaggccagacugcccuucaagagacugaaccuggugcccaagggcaaggccgacgacaugagcgacgaccagggcaccagcgugcagagcaagagccccgaccuggaggccagccuggacacccuggagaacaacugccacgugggcagcgacaucgacuucagacccaagcuggugaacggcaagggcccccuggacaacuuccugagaaacagaaucgagaccagcaucggccagagcaccgugaucaucgaccugaccgaggacagcaacgagcagcccgacagccugguggaccacaacaagcugaacagcgaggccagccccagcagagaggccaucaacggccagagagaggacaccggcgaccagcagggccugcugaaggccauccagaacgacaagcuggccuuccccggcgagacccugagcgacauccccugcaagaccgaggaggagggcgugggcugcggcggcgccggcagaagaggcgacagccaggagugcagccccagaagcugccccgagcugaccagcggccccagaaugugccccagaaaggagcaggacagcuggagcgaggccggcggcauccuguucaagggcaaggugcccaugguggugcugcaggacauccuggccgugagacccccccagaucaagagccugcccgccaccccccagggcaagaacaugacccccgagagcgaggugcuggagagcuuccccgaggaggacagcgugcugagccacagcagccugagcagccccagcagcaccagcagccccgagggcccccccgccccccccaagcagcacagcagcaccagccccuuccccaccagcaccccccugagaagaaucaccaagaaguucgugaagggcagcaccgagaagaacaagcugagacugcagagagaccaggagagacugggcaagcagcugaagcugagagccgagagagaggagaaggagaagcugaaggaggaggccaagagagccaaggaggaggccaagaagaagaaggaggaggagaaggagcugaaggagaaggagagaagagagaagagagagaaggacgagaaggagaaggccgagaagcagagacugaaggaggagagaagaaaggagagacaggaggcccuggaggccaagcuggaggagaagagaaagaaggaggaggagaagagacugagagaggaggagaagagaaucaaggccgagaaggccgagaucaccagauucuuccagaagcccaagaccccccaggcccccaagacccuggccggcagcugcggcaaguucgcccccuucgagaucaaggagcacauggugcuggcccccagaagaagaaccgccuuccaccccgaccugugcagccagcuggaccagcugcugcagcagcagagcggcgaguucagcuuccugaaggaccugaagggcagacagccccugagaagcggccccacccacgugagcaccagaaacgccgacaucuucaacagcgacguggugaucguggagagaggcaagggcgacggcgugcccgagagaagaaaguucggcagaaugaagcugcugcaguucugcgagaaccacagacccgccuacuggggcaccuggaacaagaagaccgcccugaucagagccagagaccccugggcccaggacaccaagcugcuggacuacgagguggacagcgacgaggagugggaggaggaggagcccggcgagagccugagccacagcgagggcgacgacgacgacgacaugggcgaggacgaggacgaggacgacggcuucuucgugccccacggcuaccugagcgaggacgagggcgugaccgaggagugcgccgaccccgagaaccacaaggugagacagaagcugaaggccaaggagugggacgaguuccuggccaagggcaagagauucagagugcugcagcccgugaagaucggcugcgugugggccgccgacagagacugcgccggcgacgaccugaaggugcugcagcaguucgccgccugcuuccuggagacccugcccgcccaggaggagcagacccccaaggccagcaagagagagagaagagacgagcagauccuggcccagcugcugccccugcugcacggcaacgugaacggcagcaaggugaucaucagagaguuccaggagcacugcagaagaggccugcugagcaaccacaccggcagccccagaagccccagcaccaccuaccugcacacccccacccccagcgaggacgccgccauccccagcaagagcagacugaagagacugaucagcgagaacagcguguacgagaagagacccgacuucagaaugugcugguacgugcacccccaggugcugcagagcuuccagcaggagcaccugcccgugcccugccaguggagcuacgugaccagcgugcccagcgcccccaaggaggacagcggcagcgugcccagcaccggccccagccagggcacccccaucagccugaagagaaagagcgccggcagcaugugcaucacccaguucaugaagaagagaagacacgacggccagaucggcgccgaggacauggacggcuuccaggccgacaccgaggaggaggaggaggaggagggcgacugcaugaucguggacgugcccgacgccgccgaggugcaggcccccugcggcgccgccagcggcgccggcggcggcgugggcguggacaccggcaaggccacccugaccgccagcccccugggcgccagcuaa

SEQ ID NO: 15159 - RNA, 1680 nt, Artificial Sequence
  CHAF1B__Homo_sapiens__NP_005432
augaaggugaucaccugcgagaucgccuggcacaacaaggagcccguguacagccuggacuuccagcacggcaccgccggcagaauccacagacuggccagcgccggcguggacaccaacgugagaaucuggaagguggagaagggccccgacggcaaggccaucguggaguuccugagcaaccuggccagacacaccaaggccgugaacguggugagauucagccccaccggcgagauccuggccagcggcggcgacgacgccgugauccugcuguggaaggugaacgacaacaaggagcccgagcagaucgccuuccaggacgaggacgaggcccagcugaacaaggagaacuggaccguggugaagacccugagaggccaccuggaggacguguacgacaucugcugggccaccgacggcaaccugauggccagcgccagcguggacaacaccgccaucaucugggacgugagcaagggccagaagaucagcaucuucaacgagcacaagagcuacgugcagggcgugaccugggacccccugggccaguacguggccacccugagcugcgacagagugcugagaguguacagcauccagaagaagagaguggccuucaacgugagcaagaugcugagcggcaucggcgccgagggcgaggccagaagcuacagaauguuccacgacgacagcaugaagagcuucuucagaagacugagcuucacccccgacggcagccugcugcugacccccgccggcugcguggagagcggcgagaacgugaugaacaccaccuacguguucagcagaaagaaccugaagagacccaucgcccaccugcccugccccggcaaggccacccuggccgugagaugcugccccguguacuucgagcugagacccgugguggagaccggcguggagcugaugagccugcccuacagacugguguucgccguggccagcgaggacagcgugcugcuguacgacacccagcagagcuuccccuucggcuacgugagcaacauccacuaccacacccugagcgacaucagcuggagcagcgacggcgccuuccuggccaucagcagcaccgacggcuacugcagcuucgugaccuucgagaaggacgagcugggcaucccccugaaggagaagcccgugcugaacaugagaacccccgacaccgccaagaagaccaagagccagacccacagaggcagcagccccggccccagacccguggagggcacccccgccagcagaacccaggaccccagcagccccggcaccacccccccccaggccagacaggcccccgcccccaccgugaucagagacccccccagcaucacccccgccgugaagagcccccugcccggccccagcgaggagaagacccugcagcccagcagccagaacaccaaggcccaccccagcagaagagugacccugaacacccugcaggccuggagcaagaccacccccagaagaaucaaccugaccccccugaagaccgacaccccccccagcagcgugcccaccagcgugaucagcacccccagcaccgaggagauccagagcgagacccccggcgacgcccagggcagcccccccgagcugaagagacccagacuggacgagaacaagggcggcaccgagagccuggaccccuaa

SEQ ID NO: 15160 - RNA, 2439 nt, Artificial Sequence
  CHAMP1__Homo_sapiens__NP_001157617
auggaggccuuccaggagcugagaaagcccagcgccagacuggagugcgaccacugcagcuucagaggcaccgacuacgagaacgugcagauccacaugggcaccauccaccccgaguucugcgacgagauggacgccggcggccugggcaagaugaucuucuaccagaagagcgccaagcuguuccacugccacaagugcuucuucaccagcaagauguacagcaacguguacuaccacaucaccagcaagcacgccagccccgacaaguggaacgacaagcccaagaaccagcugaacaaggagaccgaccccgugaagagccccccccugcccgagcaccagaagauccccugcaacagcgccgagcccaagagcauccccgcccugagcauggagacccagaagcugggcagcgugcugagccccgagagccccaagcccaccccccugaccccccuggagccccagaagcccggcagcguggugagccccgagcugcagaccccccugcccagccccgagcccagcaagcccgccagcgugagcagccccgagccccccaagagcgugcccgugugcgagagccagaagcuggcccccgugcccagccccgagccccagaagcccgcccccgugagccccgagagcgugaaggccacccugagcaaccccaagccccagaagcagagccacuuccccgagacccugggcccccccagcgccagcagccccgagagccccgugcuggccgccagccccgagcccuggggccccagccccgccgccagccccgagagcagaaagagcgccagaaccaccagccccgagcccagaaagcccagccccagcgagagccccgagcccuggaagcccuuccccgccgugagccccgagcccagaagacccgcccccgccgugagccccggcagcuggaagcccggcccccccggcagccccagacccuggaagagcaaccccagcgccagcagcggccccuggaagcccgccaagcccgcccccagcgugagccccggccccuggaagcccauccccagcgugagccccggccccuggaagcccacccccagcgugagcagcgccagcuggaagagcagcagcgugagccccagcagcuggaagagcccccccgccagccccgagagcuggaagagcggcccccccgagcugagaaagaccgcccccacccugagccccgagcacuggaaggccgugccccccgugagccccgagcugagaaagcccggccccccccugagccccgagaucagaagccccgccggcagccccgagcugagaaagcccagcggcagccccgaccuguggaagcugagccccgaccagagaaagaccagccccgccagccuggacuuccccgagagccagaagagcagcagaggcggcagccccgaccuguggaagagcagcuucuucaucgagccccagaagcccguguuccccgagaccagaaagcccggccccagcggccccagcgagagccccaaggccgccagcgacaucuggaagcccgugcugagcaucgacaccgagcccagaaagcccgcccuguuccccgagcccgccaagaccgccccccccgccagccccgaggccagaaagagagcccuguuccccgagcccagaaagcacgcccuguuccccgagcugcccaagagcgcccuguucagcgagagccagaaggccguggagcugggcgacgagcugcagaucgacgccaucgacgaccagaagugcgacauccuggugcaggaggagcugcuggccagccccaagaagcugcuggaggacacccuguuccccagcagcaagaagcugaagaaggacaaccaggagagcagcgacgccgagcugagcagcagcgaguacaucaagaccgaccuggacgccauggacaucaagggccaggagagcagcagcgaccaggagcagguggacguggagagcaucgacuucagcaaggagaacaagauggacaugaccagccccgagcagagcagaaacgugcugcaguucaccgaggagaaggaggccuucaucagcgaggaggagaucgccaaguacaugaagagaggcaagggcaaguacuacugcaagaucugcugcugcagagccaugaagaagggcgccgugcugcaccaccuggugaacaagcacaacgugcacagccccuacaagugcaccaucugcggcaaggccuuccugcuggagagccugcugaagaaccacguggccgcccacggccagagccugcugaagugccccagaugcaacuucgagagcaacuuccccagaggcuucaagaagcaccugacccacugccagagcagacacaacgaggaggccaacaagaagcugauggaggcccuggagcccccccuggaggagcagcagaucuaa

SEQ ID NO: 15161 - RNA, 1893 nt, Artificial Sequence
  CHAT__Homo_sapiens__NP_001136401
auggccgccaagacccccagcagcgaggagagcggccugcccaagcugcccgugcccccccugcagcagacccuggccaccuaccugcagugcaugagacaccuggugagcgaggagcaguucagaaagagccaggccaucgugcagcaguucggcgcccccggcggccugggcgagacccugcagcagaagcugcuggagagacaggagaagaccgccaacugggugagcgaguacuggcugaacgacauguaccugaacaacagacuggcccugcccgugaacagcagccccgccgugaucuucgccagacagcacuuccccggcaccgacgaccagcugagauucgccgccagccugaucagcggcgugcugagcuacaaggcccugcuggacagccacagcauccccaccgacugcgccaagggccagcugagcggccagccccugugcaugaagcaguacuacggccuguucagcagcuacagacugcccggccacacccaggacacccugguggcccagaacagcagcaucaugcccgagcccgagcacgugaucguggccugcugcaaccaguucuucgugcuggacguggugaucaacuucagaagacugagcgagggcgaccuguucacccagcugagaaagaucgugaagauggccagcaacgaggacgagagacugccccccaucggccugcugaccagcgacggcagaagcgagugggccgaggccagaaccgugcuggugaaggacagcaccaacagagacagccuggacaugaucgagagaugcaucugccuggugugccuggacgcccccggcggcguggagcugagcgacacccacagagcccugcagcugcugcacggcggcggcuacagcaagaacggcgccaacagaugguacgacaagagccugcaguucguggugggcagagacggcaccugcggcguggugugcgagcacagccccuucgacggcaucgugcuggugcagugcaccgagcaccugcugaagcacaugacccagagcagcagaaagcugaucagagccgacagcgugagcgagcugcccgcccccagaagacugagauggaagugcagccccgagauccagggccaccuggccagcagcgccgagaagcugcagagaaucgugaagaaccuggacuucaucguguacaaguucgacaacuacggcaagaccuucaucaagaagcagaagugcagccccgacgccuucauccagguggcccugcagcuggccuucuacagacugcacagaagacuggugcccaccuacgagagcgccagcaucagaagauuccaggagggcagaguggacaacaucagaagcgccacccccgaggcccuggccuucgugagagccgugaccgaccacaaggccgccgugcccgccagcgagaagcugcugcugcugaaggacgccaucagagcccagaccgccuacaccgugauggccaucaccggcauggccaucgacaaccaccugcuggcccugagagagcuggccagagccaugugcaaggagcugcccgagauguucauggacgagaccuaccugaugagcaacagauucgugcugagcaccagccaggugcccaccaccaccgagauguucugcugcuacggccccguggugcccaacggcuacggcgccugcuacaacccccagcccgagaccauccuguucugcaucagcagcuuccacagcugcaaggagaccagcagcagcaaguucgccaaggccguggaggagagccugaucgacaugagagaccugugcagccugcugccccccaccgagagcaagccccuggccaccaaggagaaggccaccagacccagccagggccaccagcccuaa

SEQ ID NO: 15162 - RNA, 429 nt, Artificial Sequence
  CHCHD10__Homo_sapiens__NP_998885
augcccagaggcagcagaagcgccgccagcagacccgccagcagacccgccgcccccagcgcccacccccccgcccaccccccccccagcgccgccgcccccgcccccgcccccagcggccagcccggccugauggcccagauggccaccaccgccgccggcguggccgugggcagcgccgugggccacgugaugggcagcgcccugaccggcgccuucagcggcggcagcagcgagcccagccagcccgccgugcagcaggcccccacccccgccgccccccagccccugcagaugggccccugcgccuacgagaucagacaguuccuggacugcagcaccacccagagcgaccugagccugugcgagggcuucagcgaggcccugaagcagugcaaguacuaccacggccugagcagccugcccuaa

SEQ ID NO: 15163 - RNA, 357 nt, Artificial Sequence
  CHCHD1__Homo_sapiens__NP_976043
auggccacccccagccugagaggcagacuggccagauucggcaaccccagaaagcccgugcugaagcccaacaagccccugauccuggccaacagagugggcgagagaagaagagagaagggcgaggccaccugcaucaccgagaugagcgugaugauggccugcuggaagcagaacgaguucagagacgacgccugcagaaaggagauccagggcuuccuggacugcgccgccagagcccaggaggccagaaagaugagaagcauccaggagacccugggcgagagcggcagccugcugcccaacaagcugaacaagcugcugcagagauuccccaacaagcccuaccugagcuaa

SEQ ID NO: 15164 - RNA, 684 nt, Artificial Sequence
  CHCHD3__Homo_sapiens__NP_060282
augggcggcaccaccagcaccagaagagugaccuucgaggccgacgagaacgagaacaucaccguggugaagggcaucagacugagcgagaacgugaucgacagaaugaaggagagcagccccagcggcagcaagagccagagauacagcggcgccuacggcgccagcgugagcgacgaggagcugaagagaagaguggccgaggagcuggcccuggagcaggccaagaaggagagcgaggaccagaagagacugaagcaggccaaggagcuggacagagagagagccgccgccaacgagcagcugaccagagccauccugagagagagaaucugcagcgaggaggagagagccaaggccaagcaccuggccagacagcuggaggagaaggacagagugcugaagaagcaggacgccuucuacaaggagcagcuggccagacuggaggagagaagcagcgaguucuacagagugaccaccgagcaguaccagaaggccgccgaggagguggaggccaaguucaagagauacgagagccaccccgugugcgccgaccugcaggccaagauccugcagugcuacagagagaacacccaccagacccugaagugcagcgcccuggccacccaguacaugcacugcgugaaccacgccaagcagagcaugcuggagaagggcggcuaa

SEQ ID NO: 15165 - RNA, 333 nt, Artificial Sequence
  CHCHD5__Homo_sapiens__NP_115685
augcaggccgcccuggaggugaccgccagauacugcggcagagagcuggagcaguacggccagugcguggccgccaagcccgagagcuggcagagagacugccacuaccugaagaugagcaucgcccagugcaccagcagccaccccaucaucagacagaucagacaggccugcgcccagcccuucgaggccuucgaggagugccugagacagaacgaggccgccgugggcaacugcgccgagcacaugagaagauuccugcagugcgccgagcaggugcagccccccagaagccccgccaccguggaggcccagccccugcccgccagcuaa

SEQ ID NO: 15166 - RNA, 708 nt, Artificial Sequence
  CHCHD6__Homo_sapiens__NP_115719
augggcagcaccgagagcagcgagggcagaagagugagcuucggcguggacgaggaggagagagugagagugcugcagggcgugagacugagcgagaacguggugaacagaaugaaggagcccagcagccccccccccgcccccaccagcagcaccuucggccugcaggacggcaaccugagagccccccacaaggagagcacccugcccagaagcggcagcagcggcggccagcagcccagcggcaugaaggagggcgugaagagauacgagcaggagcacgccgccauccaggacaagcuguuccagguggccaagagagagagagaggccgccaccaagcacagcaaggccagccugcccaccggcgagggcagcaucagccacgaggagcagaagagcgugagacuggccagagagcuggagagcagagaggccgagcugagaagaagagacaccuucuacaaggagcagcuggagagaaucgagagaaagaacgccgagauguacaagcugagcagcgagcaguuccacgaggccgccagcaagauggagagcaccaucaagcccagaagaguggagcccgugugcagcggccugcaggcccagauccugcacugcuacagagacagaccccacgaggugcugcugugcagcgaccuggugaaggccuaccagagaugcgugagcgccgcccacaagggcuaa

SEQ ID NO: 15167 - RNA, 333 nt, Artificial Sequence
  CHCHD7__Homo_sapiens__NP_001011668
augaagugcgaggagacccacgcccccaacagcaacuggguguacgugaugcugcccagcaagaagaccgugagaaugcccagcgugacccagagacugagagaccccgacaucaaccccugccugagcgagagcgacgccagcaccagaugccuggacgagaacaacuacgacagagagagaugcagcaccuacuuccugagauacaagaacugcagaagauucuggaacagcaucgugaugcagagaagaaagaacggcgugaagcccuucaugcccaccgccgccgagagagacgagauccugagagccgugggcaacaugcccuacuaa

SEQ ID NO: 15168 - RNA, 5397 nt, Artificial Sequence
  CHD1__Homo_sapiens__XP_005271923
augaacggccacagcgacgaggagagcgugagaaacagcagcggcgagagcagccagagcgacgacgacagcggcagcgccagcggcagcggcagcggcagcagcagcggcagcagcagcgacggcagcagcagccagagcggcagcagcgacagcgacagcggcagcgagagcggcagccagagcgagagcgagagcgacaccagcagagagaacaaggugcaggccaagccccccaagguggacggcgccgaguucuggaagagcagccccagcauccuggccgugcagagaagcgccauccugaagaagcagcagcagcagcagcagcagcagcagcaccaggccagcagcaacagcggcagcgaggaggacagcagcagcagcgaggacagcgacgacagcagcagcgaggugaagagaaagaagcacaaggacgaggacuggcagaugagcggcagcggcagccccagccagagcggcagcgacagcgagagcgaggaggagagagagaagagcagcugcgacgagaccgagagcgacuacgagcccaagaacaaggugaagagcagaaagccccagaacagaagcaagagcaagaacggcaagaagauccugggccagaagaagagacagaucgacagcagcgaggaggacgacgacgaggaggacuacgacaacgacaagagaagcagcagaagacaggccaccgugaacgugagcuacaaggaggacgaggagaugaagaccgacagcgacgaccugcuggaggugugcggcgaggacgugccccagcccgaggaggaggaguucgagaccaucgagagauucauggacugcagaaucggcagaaagggcgccaccggcgccaccaccaccaucuacgccguggaggccgacggcgaccccaacgccggcuucgagaagaacaaggagcccggcgagauccaguaccugaucaaguggaagggcuggagccacauccacaacaccugggagaccgaggagacccugaagcagcagaacgugagaggcaugaagaagcuggacaacuacaagaagaaggaccaggagaccaagagauggcugaagaacgccagccccgaggacguggaguacuacaacugccagcaggagcugaccgacgaccugcacaagcaguaccagaucguggagagaaucaucgcccacagcaaccagaagagcgccgccggcuaccccgacuacuacugcaaguggcagggccugcccuacagcgagugcagcugggaggacggcgcccugaucagcaagaaguuccaggccugcaucgacgaguacuucagcagaaaccagagcaagaccacccccuucaaggacugcaaggugcugaagcagagacccagauucguggcccugaagaagcagcccagcuacaucggcggccacgagggccuggagcugagagacuaccagcugaacggccugaacuggcuggcccacagcuggugcaagggcaacagcugcauccuggccgacgagaugggccugggcaagaccauccagaccaucagcuuccugaacuaccuguuccacgagcaccagcuguacggccccuuccugcugguggugccccugagcacccugaccagcuggcagagagagauccagaccugggccagccagaugaacgccgugguguaccugggcgacaucaacagcagaaacaugaucagaacccacgaguggacccaccaccagaccaagagacugaaguucaacauccugcugaccaccuacgagauccugcugaaggacaaggccuuccugggcggccugaacugggccuucaucggcguggacgaggcccacagacugaagaacgacgacagccugcuguacaagacccugaucgacuucaagagcaaccacagacugcugaucaccggcaccccccugcagaacagccugaaggagcuguggagccugcugcacuucaucaugcccgagaaguucagcagcugggaggacuucgaggaggagcacggcaagggcagagaguacggcuacgccagccugcacaaggagcuggagcccuuccugcugagaagagugaagaaggacguggagaagagccugcccgccaagguggagcagauccugagaauggagaugagcgcccugcagaagcaguacuacaaguggauccugaccagaaacuacaaggcccugagcaagggcagcaagggcagcaccagcggcuuccugaacaucaugauggagcugaagaagugcugcaaccacugcuaccugaucaagccccccgacaacaacgaguucuacaacaagcaggaggcccugcagcaccugaucagaagcagcggcaagcugauccugcuggacaagcugcugaucagacugagagagagaggcaacagagugcugaucuucagccagauggugagaaugcuggacauccuggccgaguaccugaaguacagacaguuccccuuccagagacuggacggcagcaucaagggcgagcugagaaagcaggcccuggaccacuucaacgccgagggcagcgaggacuucugcuuccugcugagcaccagagccggcggccugggcaucaaccuggccagcgccgacaccguggugaucuucgacagcgacuggaacccccagaacgaccugcaggcccaggccagagcccacagaaucggccagaagaagcaggugaacaucuacagacuggugaccaagggcagcguggaggaggacauccuggagagagccaagaagaagauggugcuggaccaccuggugauccagagaauggacaccaccggcaagaccgugcugcacaccggcagcgcccccagcagcagcacccccuucaacaaggaggagcugagcgccauccugaaguucggcgccgaggagcuguucaaggagcccgagggcgaggagcaggagccccaggagauggacaucgacgagauccugaagagagccgagacccacgagaacgagcccggcccccugaccgugggcgacgagcugcugagccaguucaagguggccaacuucagcaacauggacgaggacgacaucgagcuggagcccgagagaaacagcaagaacugggaggagaucauccccgaggaccagagaagaagacuggaggaggaggagagacagaaggagcuggaggagaucuacaugcugcccagaaugagaaacugcgccaagcagaucagcuucaacggcagcgagggcagaagaagcagaagcagaagauacagcggcagcgacagcgacagcaucagcgagggcaagagacccaagaagagaggcagacccagaaccauccccagagagaacaucaagggcuucagcgacgccgagaucagaagauucaucaagagcuacaagaaguucggcggcccccuggagagacuggacgccaucgccagagacgccgagcugguggacaagagcgagaccgaccugagaagacugggcgagcuggugcacaacggcugcaucaaggcccugaaggacagcagcagcggcaccgagagaaccggcggcagacugggcaaggugaagggccccaccuucagaaucagcggcgugcaggugaacgccaagcuggugaucagccacgaggaggagcugaucccccugcacaagagcauccccagcgaccccgaggagagaaagcaguacaccauccccugccacaccaaggccgcccacuucgacaucgacuggggcaaggaggacgacagcaaccugcugaucggcaucuacgaguacggcuacggcagcugggagaugaucaagauggaccccgaccugagccugacccacaagauccugcccgacgaccccgacaagaagccccaggccaagcagcugcagaccagagccgacuaccugaucaagcugcugagcagagaccuggccaagaaggaggcccugagcggcgccggcagcagcaagagaagaaaggccagagccaagaagaacaaggccaugaagagcaucaaggugaaggaggagaucaagagcgacagcagcccccugcccagcgagaagagcgacgaggacgacgacaaggacgagaucagcagcgugaagcaccccaacaagaagaucaagaccgagagagacagcgaggagaagcccgagcccgacguguacaucaagaaggagcccgaggagaagagagaggccaaggagaaggagaacaagaaggagcugaagagagagaucaaggagaaggaggacaagaaggacaucaaggagaaggacuucaaggagaagagagagaacaaggugaaggaggccauccagaaggagaaggacaucaaggaggagaagcugagcgagagcaagagcgacggcagagagagaagcaagaagagcagcgugagcgacgcccccgugcacaucaccgccagcggcgagcccgugcccaucagcgaggagagcgaggagcuggaccagaagaccuucagcaucugcaaggagagaaugagacccgugaaggccgcccugaagcagcuggacagacccgagaagggccugagcgagagagagcagcuggagcacaccagacagugccugaucaagaucggcgaccacaucaccgagugccugaaggaguacaccaaccccgagcagaucaagcaguggagaaagaaccuguggaucuucgugagcaaguucaccgaguucgacgccagaaagcugcacaagcuguacaagcacgccaucaagaagagacaggagagccagcagaacagcgaccagaacagcaaccugaacccccacgugaucagaaaccccgacguggagagacugaaggagaacaccaaccacgacgacagcagcagagacagcuacagcagcgacagacaccugacccaguaccacgaccaccacaaggacagacaccagggcgacagcuacaagaagagcgacagcagaaagagacccuacagcagcuucagcaacggcaaggaccacagagacugggaccacuacaagcaggacagcagauacuacagcgacagagagaagcacagaaagcuggacgaccacagaagcagagaccacagaagcaaccuggagggcagccugaaggacagaagccacagcgaccacagaagccacagcgaccacagacugcacagcgaccacagaagcagcagcgaguacacccaccacaagagcagcagagacuacagauaccacagcgacuggcagauggaccacagagccagcagcagcggccccagaagcccccuggaccagagaagccccuacggcagcagaagccccuucgagcacagcguggagcacaagagcacccccgagcacaccuggagcagcagaaagaccuaa

SEQ ID NO: 15169 - RNA, 1506 nt, Artificial Sequence
  CHD2__Homo_sapiens__NP_001036037
augaugagaaacaaggacaagagccaggaggaggacagcagccugcacagcaacgccagcagccacagcgccagcgaggaggccagcggcagcgacagcggcagccagagcgagagcgagcagggcagcgaccccggcagcggccacggcagcgagagcaacagcagcagcgagagcagcgagagccagagcgagagcgagagcgagagcgccggcagcaagagccagcccgugcugcccgaggccaaggagaagcccgccagcaagaaggagagaaucgccgacgugaagaagaugugggaggaguaccccgacguguacggcgugagaagaagcaacagaagcagacaggagcccagcagauucaacaucaaggaggaggccagcagcggcagcgagagcggcagccccaagagaagaggccagagacagcugaagaagcaggagaaguggaagcaggagcccagcgaggacgagcaggagcagggcaccagcgccgagagcgagcccgagcagaagaaggugaaggccagaagacccgugcccagaagaaccgugcccaagcccagagugaagaagcagcccaagacccagagaggcaagagaaagaagcaggacagcagcgacgaggacgacgacgacgacgaggcccccaagagacagaccagaagaagagccgccaagaacgugagcuacaaggaggacgacgacuucgagaccgacagcgacgaccugaucgagaugaccggcgagggcguggacgagcagcaggacaacagcgagaccaucgagaaggugcuggacagcagacugggcaagaagggcgccaccggcgccagcaccaccguguacgccaucgaggccaacggcgaccccagcggcgacuucgacaccgagaaggacgagggcgagauccaguaccugaucaaguggaagggcuggagcuacauccacagcaccugggagagcgaggagagccugcagcagcagaaggugaagggccugaagaagcuggagaacuucaagaagaaggaggacgagaucaagcaguggcugggcaaggugagccccgaggacguggaguacuucaacugccagcaggagcuggccagcgagcugaacaagcaguaccagaucguggagagagugaucgccgugaagaccagcaagagcacccugggccagaccgacuuccccgcccacagcagaaagcccgcccccagcaacgagcccgaguaccugugcaaguggaugggccugcccuacagcgagugcagcugggaggacgaggcccugaucggcaagaaguuccagaacugcaucgacagcuuccacagcagaaacaacagcaagaccauccccaccagagagugcaaggcccugaagcagagacccagauucguggcccugaagaagcagcccgccuaccugggcggcgagaaccuggagcugagagacuaccagcuggagggccugaacuggcuggcccacagcuggugcaaguaa

SEQ ID NO: 15170 - RNA, 6180 nt, Artificial Sequence
  CHD3__Homo_sapiens__NP_001005271
auggccagcccccugagagacgaggaggaggaggaggaggagaugguggugagcgaggaggaggaggaggaggaggaggagggcgacgaggaggaggaggaggagguggaggccgccgacgaggacgacgaggaggacgacgacgagggcgugcugggcagaggccccggccacgacagaggcagagacagacacagcccccccggcugccaccuguucccccccccccccccccccccccccccccugcccccccccccccccccccccccccccgacaaggacgacaucagacugcugcccagcgcccugggcgugaagaagagaaagagaggccccaagaagcagaaggagaacaagcccggcaagcccagaaagagaaagaagagagacagcgaggaggaguucggcagcgagagagacgaguacagagagaagagcgagagcggcggcagcgaguacggcaccggccccggcagaaagagaagaagaaagcacagagagaagaaggagaagaagaccaagagaagaaagaagggcgagggcgacggcggccagaagcagguggagcagaagagcagcgccacccugcugcugaccuggggccuggaggacguggagcacguguucagcgaggaggacuaccacacccugaccaacuacaaggccuucagccaguucaugagaccccugaucgccaagaagaaccccaagauccccaugagcaagaugaugaccauccugggcgccaaguggagagaguucagcgccaacaaccccuucaagggcagcgccgccgccguggccgccgccgccgccgccgccgccgccgccguggccgagcaggugagcgccgccgugagcagcgccacccccaucgcccccagcggcccccccgcccugccccccccccccgccgccgacauccagcccccccccaucagaagagccaagaccaaggagggcaagggccccggccacaagagaagaagcaagagccccagagugcccgacggcagaaagaagcugagaggcaagaagauggccccccugaagaucaagcugggccugcugggcggcaagagaaagaagggcggcagcuacguguuccagagcgacgagggccccgagcccgaggccgaggagagcgaccuggacagcggcagcgugcacagcgccagcggcagacccgacggccccgugagaaccaagaagcugaagagaggcagacccggcagaaagaagaagaaggugcugggcugccccgccguggccggcgaggaggagguggacggcuacgagaccgaccaccaggacuacugcgaggugugccagcagggcggcgagaucauccugugcgacaccugccccagagccuaccaccuggugugccuggaccccgagcuggacagagcccccgagggcaaguggagcugcccccacugcgagaaggagggcgugcagugggaggccaaggaggaggaggaggaguacgaggaggagggcgaggaggagggcgagaaggaggaggaggacgaccacauggaguacugcagagugugcaaggacggcggcgagcugcugugcugcgacgccugcaucagcagcuaccacauccacugccugaaccccccccugcccgacauccccaacggcgaguggcugugccccagaugcaccugccccgugcugaagggcagagugcagaagauccugcacuggagauggggcgagccccccguggccgugcccgccccccagcaggccgacggcaaccccgacgugcccccccccagaccccugcagggcagaagcgagagagaguucuucgugaagugggugggccugagcuacuggcacugcagcugggccaaggagcugcagcuggagaucuuccaccuggugauguacagaaacuaccagagaaagaacgacauggacgagccccccccccuggacuacggcagcggcgaggacgacggcaagagcgacaagagaaaggugaaggacccccacuacgccgagauggaggagaaguacuacagauucggcaucaagcccgaguggaugaccgugcacagaaucaucaaccacagcguggacaagaagggcaacuaccacuaccuggugaaguggagagaccugcccuacgaccagagcaccugggaggaggacgagaugaacauccccgaguacgaggagcacaagcagagcuacuggagacacagagagcugaucaugggcgaggaccccgcccagcccagaaaguacaagaagaagaagaaggagcugcagggcgacggcccccccagcagccccaccaacgaccccaccgugaaguacgagacccagcccagauucaucaccgccaccggcggcacccugcacauguaccagcuggagggccugaacuggcugagauucagcugggcccagggcaccgacaccauccuggccgacgagaugggccugggcaagaccauccagaccaucguguuccuguacagccuguacaaggagggccacaccaagggccccuuccuggugagcgccccccugagcaccaucaucaacugggagagagaguuccagaugugggcccccaaguucuacguggugaccuacaccggcgacaaggacagcagagccaucaucagagagaacgaguucagcuucgaggacaacgccaucaagggcggcaagaaggccuucaagaugaagagagaggcccaggugaaguuccacgugcugcugaccagcuacgagcugaucaccaucgaccaggccgcccugggcagcaucagaugggccugccuggugguggacgaggcccacagacugaagaacaaccagagcaaguucuucagagugcugaacggcuacaagaucgaccacaagcugcugcugaccggcaccccccugcagaacaaccuggaggagcuguuccaccugcugaacuuccugacccccgagagauucaacaaccuggagggcuuccuggaggaguucgccgacaucagcaaggaggaccagaucaagaagcugcacgaccugcugggcccccacaugcugagaagacugaaggccgacguguucaagaacaugcccgccaagaccgagcugaucgugagaguggagcugagccccaugcagaagaaguacuacaaguacauccugaccagaaacuucgaggcccugaacagcagaggcggcggcaaccaggugagccugcugaacaucaugauggaccugaagaagugcugcaaccaccccuaccuguuccccguggccgccauggagagccccaagcugcccagcggcgccuacgagggcggcgcccugaucaagagcagcggcaagcugaugcugcugcagaagaugcugagaaagcugaaggagcagggccacagagugcugaucuucagccagaugaccaagaugcuggaccugcuggaggacuuccuggacuacgagggcuacaaguacgagagaaucgacggcggcaucaccggcgcccugagacaggaggccaucgacagauucaacgcccccggcgcccagcaguucugcuuccugcugagcaccagagccggcggccugggcaucaaccuggccaccgccgacaccgugaucaucuucgacagcgacuggaacccccacaacgacauccaggccuucagcagagcccacagaaucggccaggccaacaaggugaugaucuacagauucgugaccagagccagcguggaggagagaaucacccagguggccaagagaaagaugaugcugacccaccugguggugagacccggccugggcagcaaggccggcagcaugagcaagcaggagcuggacgacauccugaaguucggcaccgaggagcuguucaaggacgagaacgagggcgagaacaaggaggaggacagcagcgugauccacuacgacaacgaggccaucgccagacugcuggacagaaaccaggacgccaccgaggacaccgacgugcagaacaugaacgaguaccugagcagcuucaagguggcccaguacguggugagagaggaggacaagaucgaggagaucgagagagagaucaucaagcaggaggagaacguggaccccgacuacugggagaagcugcugagacaccacuacgagcagcagcaggaggaccuggccagaaaccugggcaagggcaagagagugagaaagcaggugaacuacaacgacgccgcccaggaggaccaggacaaccagagcgaguacagcgugggcagcgaggaggaggacgaggacuucgacgagagacccgagggcagaagacagagcaagagacagcugagaaacgagaaggacaagccccugcccccccugcuggccagagugggcggcaacaucgaggugcugggcuucaacaccagacagagaaaggccuuccugaacgccgugaugagauggggcaugcccccccaggacgccuucaccacccaguggcuggugagagaccugagaggcaagaccgagaaggaguucaaggccuacgugagccuguucaugagacaccugugcgagcccggcgccgacggcagcgagaccuucgccgacggcgugcccagagagggccugagcagacagcaggugcugaccagaaucggcgugaugagccuggugaagaagaaggugcaggaguucgagcacaucaacggcagauggagcaugcccgagcugaugcccgaccccagcgccgacagcaagagaagcagcagagccagcagccccaccaagaccagccccaccacccccgaggccagcgccaccaacagccccugcaccagcaagcccgccacccccgcccccagcgagaagggcgagggcaucagaaccccccuggagaaggaggaggccgagaaccaggaggagaagcccgagaagaacagcagaaucggcgagaagauggagaccgaggccgacgcccccagccccgcccccagccugggcgagagacuggagcccagaaagaucccccuggaggacgaggugcccggcgugcccggcgagauggagcccgagcccggcuacagaggcgacagagagaagagcgccaccgagagcacccccggcgagagaggcgaggagaagccccuggacggccaggagcacagagagagacccgagggcgagaccggcgaccugggcaagagagaggacgugaagggcgacagagagcugagacccggccccagagacgagcccagaagcaacggcagaagagaggagaagaccgagaagcccagauucauguucaacaucgccgacggcggcuucaccgagcugcacacccuguggcagaacgaggagagagccgccaucagcagcggcaagcugaacgagaucuggcacagaagacacgacuacuggcugcuggccggcaucgugcugcacggcuacgccagauggcaggacauccagaacgacgcccaguucgccaucaucaacgagcccuucaagaccgaggccaacaagggcaacuuccuggagaugaagaacaaguuccuggccagaagauucaagcugcuggagcaggcccuggugaucgaggagcagcugagaagagccgccuaccugaaccugagccaggagcccgcccaccccgccauggcccugcacgccagauucgccgaggccgagugccuggccgagagccaccagcaccugagcaaggagagccuggccggcaacaagcccgccaacgccgugcugcacaaggugcugaaccagcuggaggagcugcugagcgacaugaaggccgacgugaccagacugcccgccacccugagcagaaucccccccaucgccgccagacugcagaugagcgagagaagcauccugagcagacuggccagcaagggcaccgagccccaccccacccccgccuacccccccggccccuacgccaccccccccggcuacggcgccgccuucagcgccgcccccgugggcgcccuggccgccgccggcgccaacuacagccagaugcccgccggcagcuucaucaccgccgccaccaacggcccccccgugcuggugaagaaggagaaggagauggugggcgcccuggugagcgacggccuggacagaaaggagcccagagccggcgaggugaucugcaucgacgacuaa

SEQ ID NO: 15171 - RNA, 5718 nt, Artificial Sequence
  CHD4__Homo_sapiens__NP_001284482
auggccagcggccugggcagccccagccccugcagcgccggcagcgaggaggaggacauggacgcccugcugaacaacagccugccccccccccaccccgagaacgaggaggaccccgaggaggaccugagcgagaccgagacccccaagcugaagaagaagaagaagcccaagaagcccagagaccccaagauccccaagagcaagagacagaagaaggagcugggcgacagcagcggcgagggccccgaguucguggaggaggaggaggagguggcccugagaagcgacagcgagggcagcgacuacacccccggcaagaagaagaagaagaagcugggccccaagaaggagaagaagagcaagagcaagagaaaggaggaggaggaggaggaggacgacgacgacgacagcaaggagcccaagagcagcgcccagcugcuggaggacuggggcauggaggacaucgaccacguguucagcgaggaggacuacagaacccugaccaacuacaaggccuucagccaguucgugagaccccugaucgccgccaagaaccccaagaucgccgugagcaagaugaugauggugcugggcgccaaguggagagaguucagcaccaacaaccccuucaagggcagcagcggcgccagcguggccgccgccgccgccgccgccguggccgugguggagagcauggugaccgccaccgagguggcccccccccccccccccguggaggugcccaucagaaaggccaagaccaaggagggcaagggccccaacgccagaagaaagcccaagggcagccccagagugcccgacgccaagaagcccaagcccaagaagguggccccccugaagaucaagcugggcggcuucggcagcaagagaaagagaagcagcagcgaggacgacgaccuggacguggagagcgacuucgacgacgccagcaucaacagcuacagcgugagcgacggcagcaccagcagaagcagcagaagcagaaagaagcugagaaccaccaagaagaagaagaagggcgaggaggaggugaccgccguggacggcuacgagaccgaccaccaggacuacugcgaggugugccagcagggcggcgagaucauccugugcgacaccugccccagagccuaccacauggugugccuggaccccgacauggagaaggcccccgagggcaaguggagcugcccccacugcgagaaggagggcauccagugggaggccaaggaggacaacagcgagggcgaggagauccuggaggaggugggcggcgaccuggaggaggaggacgaccaccacauggaguucugcagagugugcaaggacggcggcgagcugcugugcugcgacaccugccccagcagcuaccacauccacugccugaaccccccccugcccgagauccccaacggcgaguggcugugccccagaugcaccugccccgcccugaagggcaaggugcagaagauccugaucuggaaguggggccagccccccagccccacccccgugcccagaccccccgacgccgaccccaacacccccagccccaagccccuggagggcagacccgagagacaguucuucgugaaguggcagggcaugagcuacuggcacugcagcugggugagcgagcugcagcuggagcugcacugccaggugauguucagaaacuaccagagaaagaacgacauggacgagccccccagcggcgacuucggcggcgacgaggagaagagcagaaagagaaagaacaaggaccccaaguucgccgagauggaggagagauucuacagauacggcaucaagcccgaguggaugaugauccacagaauccugaaccacagcguggacaagaagggccacgugcacuaccugaucaaguggagagaccugcccuacgaccaggccagcugggagagcgaggacguggagauccaggacuacgaccuguucaagcagagcuacuggaaccacagagagcugaugagaggcgaggagggcagacccggcaagaagcugaagaaggugaagcugagaaagcuggagagaccccccgagacccccaccguggaccccaccgugaaguacgagagacagcccgaguaccuggacgccaccggcggcacccugcaccccuaccagauggagggccugaacuggcugagauucagcugggcccagggcaccgacaccauccuggccgacgagaugggccugggcaagaccgugcagaccgccguguuccuguacagccuguacaaggagggccacagcaagggccccuuccuggugagcgccccccugagcaccaucaucaacugggagagagaguucgagaugugggcccccgacauguacguggugaccuacgugggcgacaaggacagcagagccaucaucagagagaacgaguucagcuucgaggacaacgccaucagaggcggcaagaaggccagcagaaugaagaaggaggccagcgugaaguuccacgugcugcugaccagcuacgagcugaucaccaucgacauggccauccugggcagcaucgacugggccugccugaucguggacgaggcccacagacugaagaacaaccagagcaaguucuucagagugcugaacggcuacagccugcagcacaagcugcugcugaccggcaccccccugcagaacaaccuggaggagcuguuccaccugcugaacuuccugacccccgagagauuccacaaccuggagggcuuccuggaggaguucgccgacaucgccaaggaggaccagaucaagaagcugcacgacaugcugggcccccacaugcugagaagacugaaggccgacguguucaagaacaugcccagcaagaccgagcugaucgugagaguggagcugagccccaugcagaagaaguacuacaaguacauccugaccagaaacuucgaggcccugaacgccagaggcggcggcaaccaggugagccugcugaacguggugauggaccugaagaagugcugcaaccaccccuaccuguuccccguggccgccauggaggcccccaagaugcccaacggcauguacgacggcagcgcccugaucagagccagcggcaagcugcugcugcugcagaagaugcugaagaaccugaaggagggcggccacagagugcugaucuucagccagaugaccaagaugcuggaccugcuggaggacuuccuggagcacgagggcuacaaguacgagagaaucgacggcggcaucaccggcaacaugagacaggaggccaucgacagauucaacgcccccggcgcccagcaguucugcuuccugcugagcaccagagccggcggccugggcaucaaccuggccaccgccgacaccgugaucaucuacgacagcgacuggaacccccacaacgacauccaggccuucagcagagcccacagaaucggccagaacaagaaggugaugaucuacagauucgugaccagagccagcguggaggagagaaucacccagguggccaagaagaagaugaugcugacccaccugguggugagacccggccugggcagcaagaccggcagcaugagcaagcaggagcuggacgacauccugaaguucggcaccgaggagcuguucaaggacgaggccaccgacggcggcggcgacaacaaggagggcgaggacagcagcgugauccacuacgacgacaaggccaucgagagacugcuggacagaaaccaggacgagaccgaggacaccgagcugcagggcaugaacgaguaccugagcagcuucaagguggcccaguacguggugagagaggaggagaugggcgaggaggaggagguggagagagagaucaucaagcaggaggagagcguggaccccgacuacugggagaagcugcugagacaccacuacgagcagcagcaggaggaccuggccagaaaccugggcaagggcaagagaaucagaaagcaggugaacuacaacgacggcagccaggaggacagagacuggcaggacgaccagagcgacaaccagagcgacuacagcguggccagcgaggagggcgacgaggacuucgacgagagaagcgaggcccccagaagacccagcagaaagggccugagaaacgacaaggacaagccccugcccccccugcuggccagagugggcggcaacaucgaggugcugggcuucaacgccagacagagaaaggccuuccugaacgccaucaugagauacggcaugcccccccaggacgccuucaccacccaguggcuggugagagaccugagaggcaagagcgagaaggaguucaaggccuacgugagccuguucaugagacaccugugcgagcccggcgccgacggcgccgagaccuucgccgacggcgugcccagagagggccugagcagacagcacgugcugaccagaaucggcgugaugagccugaucagaaagaaggugcaggaguucgagcacgugaacggcagauggagcaugcccgagcuggccgagguggaggagaacaagaagaugagccagcccggcagccccagccccaagacccccacccccagcacccccggcgacacccagcccaacacccccgcccccgugccccccgccgaggacggcaucaagaucgaggagaacagccugaaggaggaggagagcaucgagggcgagaaggaggugaagagcaccgcccccgagaccgccaucgagugcacccaggcccccgcccccgccagcgaggacgagaagguggugguggagccccccgagggcgaggagaagguggagaaggccgaggugaaggagagaaccgaggagcccauggagaccgagcccaagggcgccgccgacguggagaagguggaggagaagagcgccaucgaccugacccccaucgugguggaggacaaggaggagaagaaggaggaggaggagaagaaggaggugaugcugcagaacggcgagacccccaaggaccugaacgacgagaagcagaagaagaacaucaagcagagauucauguucaacaucgccgacggcggcuucaccgagcugcacagccuguggcagaacgaggagagagccgccaccgugaccaagaagaccuacgagaucuggcacagaagacacgacuacuggcugcuggccggcaucaucaaccacggcuacgccagauggcaggacauccagaacgaccccagauacgccauccugaacgagcccuucaagggcgagaugaacagaggcaacuuccuggagaucaagaacaaguuccuggccagaagauucaagcugcuggagcaggcccuggugaucgaggagcagcugagaagagccgccuaccugaacaugagcgaggaccccagccaccccagcauggcccugaacaccagauucgccgagguggagugccuggccgagagccaccagcaccugagcaaggagagcauggccggcaacaagcccgccaacgccgugcugcacaaggugcugaagcagcuggaggagcugcugagcgacaugaaggccgacgugaccagacugcccgccaccaucgccagaaucccccccguggccgugagacugcagaugagcgagagaaacauccugagcagacuggccaacagagcccccgagcccaccccccagcagguggcccagcagcaguaa

SEQ ID NO: 15172 - RNA, 8148 nt, Artificial Sequence
  CHD6__Homo_sapiens__NP_115597
augaagaugaagauccagaagaaggagaagcagcugagcaaccugaaggugcugaaccacagccccaugagcgacgccagcgugaacuucgacuacaagagccccagccccuucgacugcagcaccgaccaggaggagaagaucgaggacguggccagccacugccugccccagaaggaccuguacaccgccgaggaggaggccgccacccuguuccccagaaagaugaccagccacaacggcauggaggacagcggcggcggcggcaccggcgugaagaagaagagaaagaagaaggagcccggcgaccaggagggcgccgccaagggcagcaaggacagagagcccaagcccaagagaaagagagagcccaaggagcccaaggagcccagaaaggccaaggagcccaagaaggccaaggagcacaaggagcccaagcagaaggacggcgccaagaaggccagaaagcccagagaggccagcggcaccaaggaggccaaggagaagagaagcugcaccgacagcgccgccagaaccaagagcagaaaggccagcaaggagcagggccccacccccguggagaagaagaagaagggcaagagaaagagcgagaccaccguggagagccuggagcuggaccagggccugaccaaccccagccugagaagccccgaggagagcaccgagagcaccgacagccagaagagaagaagcggcagacaggugaagagaagaaaguacaacgaggaccuggacuucaaggugguggacgacgacggcgagaccaucgccgugcugggcgccggcagaaccagcgcccugagcgccagcacccuggccuggcaggccgaggagccccccgaggacgacgccaacaucaucgagaagauccuggccagcaagaccgugcaggaggugcaccccggcgagccccccuucgaccuggagcuguucuacgugaaguacagaaacuucagcuaccugcacugcaagugggccaccauggaggagcuggagaaggaccccagaaucgcccagaagaucaagagauucagaaacaagcaggcccagaugaagcacaucuucaccgagcccgacgaggaccuguucaaccccgacuacguggagguggacagaauccuggagguggcccacaccaaggacgccgagaccggcgaggaggugacccacuaccuggugaaguggugcagccugcccuacgaggagagcaccugggagcuggaggaggacguggaccccgccaaggugaaggaguucgagagccugcaggugcugcccgagaucaagcacguggagagacccgccagcgacagcuggcagaagcuggagaagagcagagaguacaagaacagcaaccagcugagagaguaccagcuggagggcaugaacuggcugcuguucaacugguacaacagaaagaacugcauccuggccgacgagaugggccugggcaagaccauccagagcaucaccuuccugagcgagaucuuccugagaggcauccacggccccuuccugaucaucgccccccugagcaccaucaccaacugggagagagaguucagaaccuggaccgagaugaacgccaucguguaccacggcagccagaucagcagacagaugauccagcaguacgagaugguguacagagacgcccagggcaacccccugagcggcguguucaaguuccacguggugaucaccaccuucgagaugauccuggccgacugccccgagcugaagaagauccacuggagcugcgugaucaucgacgaggcccacagacugaagaacagaaacugcaagcugcuggagggccugaagcugauggcccuggagcacaaggugcugcugaccggcaccccccugcagaacagcguggaggagcuguucagccugcugaacuuccuggagcccagccaguuccccagcgagaccgccuuccuggaggaguucggcgaccugaagaccgaggagcaggugaagaagcugcagagcauccugaagcccaugaugcugagaagacugaaggacgacguggagaagaaccuggcccccaagcaggagaccaucaucgagguggagcugaccaacauccagaagaaguacuacagagccauccuggagaagaacuucagcuuccugaccaagggcgccaaccagcacaacaugcccaaccugaucaacaccaugauggagcugagaaagugcugcaaccaccccuaccugaucaacggcgccgaggagaagauccuggaggacuucagaaagacccacagccccgacgcccccgacuuccagcugcaggccaugauccaggccgccggcaagcuggugcugaucgacaagcugcugcccaagcugaucgccggcggccacaaggugcugaucuucagccagauggugagaugccuggacauccuggaggacuaccugauccagagaagauacaccuacgagagaaucgacggcagagugagaggcaaccugagacaggccgccaucgacagauucugcaagcccgacagcgacagauucguguuccugcugugcaccagagccggcggccugggcaucaaccugaccgccgccgacaccugcaucaucuucgacagcgacuggaacccccagaacgaccugcaggcccaggccagaugccacagaaucggccagagcaaggccgugaagguguacagacugaucaccagaaacagcuacgagagagagauguucgacaaggccagccugaagcugggccuggacaaggccgugcugcaggacaucaacagaaagggcggcaccaacggcgugcagcagcugagcaagauggagguggaggaccugcugagaaagggcgccuacggcgcccugauggacgaggaggacgagggcagcaaguucugcgaggaggacaucgaccagauccugcagagaagaacccacaccaucaccauccagagcgagggcaagggcagcaccuucgccaaggccagcuucguggccagcggcaacagaaccgacaucagccuggacgaccccaacuucuggcagaagugggccaagaucgccgagcuggacaccgaggccaagaacgagaaggagagccuggugaucgacagacccagagugagaaagcagaccaagcacuacaacagcuucgaggaggacgagcugauggaguucagcgagcuggacagcgacagcgacgagagacccaccagaagcagaagacugaacgacaaggccagaagauaccugagagccgagugcuucagaguggagaagaaccugcugaucuucggcuggggcagauggaaggacauccugacccacggcagauucaaguggcaccugaacgagaaggacauggagaugaucugcagagcccugcugguguacugcgugaagcacuacaagggcgacgagaagaucaagagcuucaucugggagcugaucacccccaccaaggacggccaggcccagacccugcagaaccacagcggccugagcgcccccgugcccagaggcagaaagggcaagaagaccaagaaccagcugcugauccccgagcugaaggacgccgacuggcuggccaccugcaaccccgagguggugcugcacgacgacggcuacaagaagcaccugaagcagcacugcaacaaggugcugcugagagugagaaugcuguacuaccugaaggccgagauccugggcgaggccgccgagaaggccuucgagggcagccccgccagagagcuggacgugccccugcccgacaucgacuacauggagauccccguggacuggugggacgccgaggccgacaagagccugcugaucggcguguucaagcacggcuacgagagauacaacgccaugagagccgaccccgcccugugcuuccuggagaaggugggcaugcccgacgagaagagccugagcgccgagcagggcgugaccgacggcaccagcgacauccccgagagaggcaacaccgacaaggaggacaacgccgaggacaagguggacggccugcagaagcagaccgagagcagcagcgacggcggcgacggcguguucagcgagaagaaggacgacagcagagccgcccaggacggcagcgaccccgacaagagccccuggcccgugagcagcgcccugaccgccagacugagaagacuggugaccguguaccagagaugcaacagaaaggagcugugcagacccgagauccugggccccggcaaccagggcuacugggugcaggaggagauguucagaagaaccagcgagauggaccugaucaacaaggaggcccagaagagauggaccagaagagagcaggccgacuucuacagaaccgugagcagcuucggcgugguguacgaccaggagaagaagaccuucgacuggacccaguucagaaucaucagcagacuggacaagaagagcgacgagagccuggagcaguacuucuacagcuucguggccaugugcagaaacgugugcagacugcccaccuggaaggacggcggcccccccgacaccaccaucuacguggagcccaucaccgaggagagagccgccagaacccuguacagaaucgagcugcugagaaaggugagagagcaggugcugaagugcccccagcugcacgagagacugcagcugugcagacccagccuguaccugcccguguggugggagugcggcaagcacgacagagaccugcugaucggcaccgccaagcacggccugaacagaaccgacugcuacaucaugaacgacccccagcugagcuuccuggacgccuacagaaacuacgcccagcacaagagaagcggcacccaggcccccggcaaccugugcugccuguaccagaccaacagcaagcuguacgagagccugaccuacagccagaugagcagaaccagcgagagccuggagaacgagcccgagaaccuggugagaguggagagcagagacgaccaccugagccugcccgacgugaccugcgagaacuucaucagcaaggugcaggacgugaucagcaucaaccacgacgagagccugcugcccgagagccuggagagcaugauguacggcaagaaggugcugagccaggagcccagcagcuuccaggagagccccagcaccaacaccgagagcagaaaggacgugaucaccaucagcaucagcaaggacggcaacugccagagcggcggccccgaggccgagaucgccagcggccccaccuucaugggcagccuggaggccggcggcguggcccaggccaacaucaagaacggcaagcaccugcugaugagcaucagcaaggagggcgagcugugcugcagcgaggccggccagagacccgagaacaucggccagcuggaggccaagugccuggccagccccagccugaaccccggcaacgagagcggcuucguggacaugugcagccugagcgugugcgacagcaagagaaaccugagcagcgaccagcagcugaucgaccugcuggagaacaagagccuggagagcaagcugauccugagccagaaccacagcgacgaggaggaggaggaggaggagaacgaggaggagaaccuggccauggccgugggcaugggcgagagacccgaggugcugcaccugaccgagcccaccaccaacaucagcagagagaagaaccagggcuuccaggacgagaccaagaagggcagccuggagguggccaaccagacccccggccugcagagagccuuccccgcccccgccgccugccagugccacugcaagcacauggagagauggaugcacggccuggagaacgacgaguucgagaucgagaagcccaaggccuacauccccgaccuguucaagagcaagaccaacaccaucgccauggagggcgagcccaccgccauccccagccagcccuucaaggugaagcacgagcugcugaaggagcccuggaaggagagcgccgagggccagaacguguuccccaccuacccccuggagggcagcgagcugaagagcgaggacauggacuucgagaacaaggacgacuacgacagagacggcaacugccacagccaggacuaccccggcaaguacagcgaggaggagagcaagagcagcaccagcggcaucaccggcgacaucggcgacgagcugcaggaggccagagcccccaccaucgcccagcugcugcaggagaagacccuguacagcuucagcgaguggcccaaggacagagugaucaucaacagacuggacaacaucugccacguggugcugaagggcaaguggcccagcagccagcaguacgagcccagcggcacccugcccacccccgugcugaccagcagcgccggcagcagaaccagccugagcgagcccgaggccgccgagcacagcuucagcaacggcgccgcccuggccgcccagauccacaaggagagcuuccuggcccccguguucaccaaggacgagcagaagcacagaagacccuacgaguucgagguggagagagacgccaaggccagaggccuggagcaguucagcgccacccacggccacacccccaucauccugaacggcuggcacggcgagagcgccauggaccugagcugcagcagcgagggcagccccggcgccaccagccccuuccccgugagcgccagcacccccaagaucggcgccaucagcagccugcagggcgcccugggcauggaccugagcggcauccugcaggccggccugauccaccccgugaccggccagaucgugaacggcagccugagaagagacgacgccgccaccagaagaagaagaggcagaagaaagcacguggagggcggcauggaccugaucuuccugaaggagcagacccugcaggccggcauccuggaggugcacgaggaccccggccaggccacccugagcaccacccaccccgagggccccggccccgccaccagcgcccccgagcccgccaccgccgccagcagccaggccgagaagagcauccccagcaagagccugcuggacuggcugagacagcaggccgacuacagccuggaggugcccggcuucggcgccaacuucagcgacaagcccaagcagagaagacccagaugcaaggagcccggcaagcuggacgugagcagccugagcggcgaggagagagugcccgccauccccaaggagcccggccugagaggcuuccugcccgagaacaaguucaaccacacccuggccgagcccauccugagagacaccggccccagaagaagaggcagaagacccagaagcgagcugcugaaggcccccagcaucguggccgacagccccagcggcaugggcccccuguucaugaacggccugaucgccggcauggaccuggugggccugcagaacaugagaaacaugcccggcaucccccugaccggccuggugggcuuccccgccggcuucgccaccaugcccaccggcgaggaggugaagagcacccugagcaugcugcccaugaugcugcccggcauggccgccgugccccagauguucggcgugggcggccugcugagcccccccauggccaccaccugcaccagcaccgcccccgccagccugagcagcaccaccaagagcggcaccgccgugaccgagaagaccgccgaggacaagcccagcagccacgacgugaagaccgacacccuggccgaggacaagcccggccccggccccuucagcgaccagagcgagcccgccaucaccaccagcagccccguggccuucaaccccuuccugauccccggcgugagccccggccugaucuaccccagcauguuccugagccccggcaugggcauggcccugcccgccaugcagcaggccagacacagcgagaucgugggccuggagagccagaagagaaagaagaagaagaccaagggcgacaaccccaacagccaccccgagcccgcccccagcugcgagagagagcccagcggcgacgagaacugcgccgagcccagcgccccccugcccgccgagagagagcacggcgcccaggccggcgagggcgcccugaaggacagcaacaacgacaccaacuaa

SEQ ID NO: 15173 - RNA, 8994 nt, Artificial Sequence
  CHD7__Homo_sapiens__NP_060250
auggccgaccccggcaugaugagccuguucggcgaggacggcaacaucuucagcgagggccuggagggccugggcgagugcggcuaccccgagaaccccgugaaccccaugggccagcagaugcccaucgaccagggcuucgccagccugcagcccagccugcaccaccccagcaccaaccagaaccagaccaagcugacccacuucgaccacuacaaccaguacgagcagcagaagaugcaccugauggaccagcccaacagaaugaugagcaacacccccggcaacggccuggccagcccccacagccaguaccacaccccccccgugccccaggugccccacggcggcagcggcggcggccagaugggcguguaccccggcaugcagaacgagagacacggccagagcuucguggacagcagcagcauguggggccccagagccgugcaggugcccgaccagaucagagcccccuaccagcagcagcagccccagccccagcccccccagcccgcccccagcggcccccccgcccagggccacccccagcacaugcagcagaugggcagcuacauggccagaggcgacuucagcaugcagcagcacggccagccccagcagagaaugagccaguucagccagggccaggagggccugaaccagggcaaccccuucaucgccaccagcggccccggccaccugagccacgugccccagcagagccccagcauggcccccagccugagacacagcgugcagcaguuccaccaccaccccagcaccgcccugcacggcgagagcguggcccacagccccagauucagccccaaccccccccagcagggcgccgugagaccccagacccugaacuucagcagcagaagccagaccgugcccagccccaccaucaacaacagcggccaguacagcagauaccccuacagcaaccugaaccagggccuggugaacaacaccggcaugaaccagaaccugggccugaccaacaacacccccaugaaccagagcgugcccagauaccccaacgccgugggcuuccccagcaacagcggccagggccugaugcaccagcagcccauccaccccagcggcagccugaaccagaugaacacccagaccaugcaccccagccagccccagggcaccuacgccagccccccccccaugagccccaugaaggccaugagcaaccccgccggcaccccccccccccaggugagacccggcagcgccggcauccccauggaggugggcagcuaccccaacaugccccacccccagcccagccaccagccccccggcgccaugggcaucggccagagaaacaugggccccagaaacaugcagcagagcagacccuucaucggcaugagcagcgcccccagagagcugaccggccacaugagacccaacggcugccccggcgugggccugggcgacccccaggccauccaggagagacugauccccggccagcagcaccccggccagcagcccagcuuccagcagcugcccaccugccccccccugcagccccaccccggccugcaccaccagagcagccccccccacccccaccaccagcccugggcccagcugcaccccagcccccagaacaccccccagaaggugcccgugcaccagcacagccccagcgagcccuuccuggagaagcccgugcccgacaugacccaggugagcggccccaacgcccagcuggugaagagcgacgacuaccugcccagcaucgagcagcagccccagcagaagaagaagaagaagaagaacaaccacaucguggccgaggaccccagcaagggcuucggcaaggacgacuuccccggcggcguggacaaccaggagcugaacagaaacagccuggacggcagccaggaggagaagaagaagaagaagagaagcaaggccaagaaggaccccaaggagcccaaggagcccaaggagaagaaggagcccaaggagcccaagacccccaaggcccccaagauccccaaggagcccaaggagaagaaggccaagaccgccacccccaagcccaagagcagcaagaagagcagcaacaagaagcccgacagcgaggccagcgcccugaagaagaaggugaacaagggcaagaccgagggcagcgagaacagcgaccuggacaagacccccccccccagccccccccccgaggaggacgaggaccccggcgugcagaagagaagaagcagcagacaggugaagagaaagagauacaccgaggaccuggaguucaagaucagcgacgaggaggccgacgacgccgacgccgccggcagagacagccccagcaacaccagccagagcgagcagcaggagagcguggacgccgagggccccgugguggagaagaucaugagcagcagaagcgugaagaagcagaaggagagcggcgaggagguggagaucgaggaguucuacgugaaguacaagaacuucagcuaccugcacugccagugggccagcaucgaggaccuggagaaggacaagagaauccagcagaagaucaagagauucaaggccaagcagggccagaacaaguuccugagcgagaucgaggacgagcuguucaaccccgacuacguggagguggacagaaucauggacuucgccagaagcaccgacgacagaggcgagcccgugacccacuaccuggugaaguggugcagccugcccuacgaggacagcaccugggagagaagacaggacaucgaccaggccaagaucgaggaguucgagaagcugaugagcagagagcccgagaccgagagaguggagagaccccccgccgacgacuggaagaagagcgagagcagcagagaguacaagaacaacaacaagcugagagaguaccagcuggagggcgugaacuggcugcuguucaacugguacaacaugagaaacugcauccuggccgacgagaugggccugggcaagaccauccagagcaucaccuuccuguacgagaucuaccugaagggcauccacggccccuuccuggugaucgccccccugagcaccauccccaacugggagagagaguucagaaccuggaccgagcugaacguggugguguaccacggcagccaggccagcagaagaaccauccagcuguacgagauguacuucaaggacccccagggcagagugaucaagggcagcuacaaguuccacgccaucaucaccaccuucgagaugauccugaccgacugccccgagcugagaaacauccccuggagaugcguggugaucgacgaggcccacagacugaagaacagaaacugcaagcugcuggagggccugaagaugauggaccuggagcacaaggugcugcugaccggcaccccccugcagaacaccguggaggagcuguucagccugcugcacuuccuggagcccagcagauuccccagcgagaccaccuucaugcaggaguucggcgaccugaagaccgaggagcaggugcagaagcugcaggccauccugaagcccaugaugcugagaagacugaaggaggacguggagaagaaccuggcccccaaggaggagaccaucaucgagguggagcugaccaacauccagaagaaguacuacagagccauccuggagaagaacuucaccuuccugagcaagggcggcggccaggccaacgugcccaaccugcugaacaccaugauggagcugagaaagugcugcaaccaccccuaccugaucaacggcgccgaggagaagauccuggaggaguucaaggagacccacaacgccgagagccccgacuuccagcugcaggccaugauccaggccgccggcaagcuggugcugaucgacaagcugcugcccaagcugaaggccggcggccacagagugcugaucuucagccagauggugagaugccuggacauccuggaggacuaccugauccagagaagauaccccuacgagagaaucgacggcagagugagaggcaaccugagacaggccgccaucgacagauucagcaagcccgacagcgacagauucguguuccugcugugcaccagagccggcggccugggcaucaaccugaccgccgccgacaccugcaucaucuucgacagcgacuggaacccccagaacgaccugcaggcccaggccagaugccacagaaucggccagagcaagagcgugaagaucuacagacugaucaccagaaacagcuacgagagagagauguucgacaaggccagccugaagcugggccuggacaaggccgugcugcagagcaugagcggcagagagaacgccaccaacggcgugcagcagcugagcaagaaggagaucgaggaccugcugagaaagggcgccuacggcgcccugauggacgaggaggacgagggcagcaaguucugcgaggaggacaucgaccagauccugcugagaagaacccacaccaucaccaucgagagcgagggcaagggcagcaccuucgccaaggccagcuucguggccagcggcaacagaaccgacaucagccuggacgaccccaacuucuggcagaagugggccaagaaggccgagcuggacaucgacgcccugaacggcagaaacaaccuggugaucgacacccccagagugagaaagcagaccagacuguacagcgccgugaaggaggacgagcugauggaguucagcgaccuggagagcgacagcgaggagaagcccugcgccaagcccagaagaccccaggacaagagccagggcuacgccagaagcgagugcuucagaguggagaagaaccugcugguguacggcuggggcagauggaccgacauccugagccacggcagauacaagagacagcugaccgagcaggacguggagaccaucugcagaaccauccugguguacugccugaaccacuacaagggcgacgagaacaucaagagcuucaucugggaccugaucacccccaccgccgacggccagaccagagcccuggugaaccacagcggccugagcgcccccgugcccagaggcagaaagggcaagaaggugaaggcccagagcacccagcccguggugcaggacgccgacuggcuggccagcugcaaccccgacgcccuguuccaggaggacagcuacaagaagcaccugaagcaccacugcaacaaggugcugcugagagugagaaugcuguacuaccugagacaggaggugaucggcgaccaggccgacaagauccuggagggcgccgacagcagcgaggccgacguguggauccccgagcccuuccacgccgaggugcccgccgacuggugggacaaggaggccgacaagagccugcugaucggcguguucaagcacggcuacgagaaguacaacagcaugagagccgaccccgcccugugcuuccuggagagagugggcaugcccgacgccaaggccaucgccgccgagcagagaggcaccgacaugcuggccgacggcggcgacggcggcgaguucgacagagaggacgaggaccccgaguacaagcccaccagaacccccuucaaggacgagaucgacgaguucgccaacagccccagcgaggacaaggaggagagcauggagauccacgccaccggcaagcacagcgagagcaacgccgagcugggccagcuguacuggcccaacaccagcacccugaccaccagacugagaagacugaucaccgccuaccagagaagcuacaagagacagcagaugagacaggaggcccugaugaagaccgacagaagaagaagaagacccagagaggaggugagagcccuggaggccgagagagaggccaucaucagcgagaagagacagaaguggaccagaagagaggaggccgacuucuacagaguggugagcaccuucggcgugaucuucgaccccgugaagcagcaguucgacuggaaccaguucagagccuucgccagacuggacaagaagagcgacgagagccuggagaaguacuucagcugcuucguggccaugugcagaagagugugcagaaugcccgugaagcccgacgacgagccccccgaccugagcagcaucaucgagcccaucaccgaggagagagccagcagaacccuguacagaaucgagcugcugagaaagaucagagagcaggugcugcaccacccccagcugggcgagagacugaagcugugccagcccagccuggaccugcccgaguggugggagugcggcagacacgacagagaccugcuggugggcgccgccaagcacggcgugagcagaaccgacuaccacauccugaacgaccccgagcugagcuuccuggacgcccacaagaacuucgcccagaacagaggcgccggcaacaccagcagccugaacccccuggccgugggcuucgugcagaccccccccgugaucagcagcgcccacauccaggacgagagagugcuggagcaggccgagggcaagguggaggagcccgagaaccccgccgccaaggagaagugcgagggcaaggaggaggaggaggagaccgacggcagcggcaaggagagcaagcaggagugcgaggccgaggccagcagcgugaagaacgagcugaagggcguggaggugggcgccgacaccggcagcaagagcaucagcgagaagggcagcgaggaggacgaggaggagaagcuggaggacgacgacaagagcgaggagagcagccagcccgaggccggcgccgugagcagaggcaagaacuucgacgaggagagcaacgccagcaugagcaccgccagagacgagaccagagacggcuucuacauggaggacggcgaccccagcguggcccagcugcugcacgagagaaccuucgccuucagcuucuggcccaaggacagagugaugaucaacagacuggacaacaucugcgaggccgugcugaagggcaaguggcccgugaacagaagacagauguucgacuuccagggccugauccccggcuacacccccaccaccguggacagcccccugcagaagagaagcuucgccgagcugagcauggugggccaggccagcaucagcggcagcgaggacaucaccaccagcccccagcugagcaaggaggacgcccugaaccugagcgugcccagacagagaagaagaagaagaagaaagaucgagaucgaggccgagagagccgccaagagaagaaaccugauggagaugguggcccagcugagagagagccagguggugagcgagaacggccaggagaaggugguggaccugagcaaggccagcagagaggccaccagcagcaccagcaacuucagcagccugagcagcaaguucauccugcccaacgugagcacccccgugagcgacgccuucaagacccagauggagcugcugcaggccggccugagcagaacccccaccagacaccugcugaacggcagccugguggacggcgagccccccaugaagagaagaagaggcagaagaaagaacguggagggccuggaccugcuguucaugagccacaagagaaccagccugagcgccgaggacgccgaggugaccaaggccuucgaggaggacaucgagaccccccccaccagaaacauccccagccccggccagcuggaccccgacaccagaauccccgugaucaaccuggaggacggcaccagacuggugggcgaggacgcccccaagaacaaggaccugguggaguggcugaagcugcaccccaccuacaccguggacaugcccagcuacgugcccaagaacgccgacgugcuguucagcagcuuccagaagcccaagcagaagagacacagaugcagaaaccccaacaagcuggacaucaacacccugaccggcgaggagagagugcccguggugaacaagagaaacggcaagaagaugggcggcgccauggccccccccaugaaggaccugcccagauggcuggaggagaaccccgaguucgccguggcccccgacuggaccgacaucgugaagcagagcggcuucgugcccgagagcauguucgacagacugcugaccggccccguggugagaggcgagggcgccagcagaagaggcagaagacccaagagcgagaucgccagagccgccgccgccgccgccgccguggccagcaccagcggcaucaacccccugcuggugaacagccuguucgccggcauggaccugaccagccugcagaaccugcagaaccugcagagccugcagcuggccggccugaugggcuucccccccggccuggccaccgccgccaccgccggcggcgacgccaagaaccccgccgccgugcugccccugaugcugcccggcauggccggccugcccaacguguucggccugggcggccugcugaacaacccccugagcgccgccaccggcaacaccaccaccgccagcagccagggcgagcccgaggacagcaccagcaagggcgaggagaagggcaacgagaacgaggacgagaacaaggacagcgagaagagcaccgacgccgugagcgccgccgacagcgccaacggcagcgugggcgccgccaccgcccccgccggccugcccagcaacccccuggccuucaaccccuuccugcugagcaccauggcccccggccuguucuaccccagcauguuccugccccccggccugggcggccugacccugcccggcuuccccgcccuggccggccugcagaacgccgugggcagcagcgaggagaaggccgccgacaaggccgagggcggccccuucaaggacggcgagacccuggagggcagcgacgccgaggagagccuggacaagaccgccgagagcagccugcuggaggacgagaucgcccagggcgaggagcuggacagccuggacggcggcgacgagaucgagaacaacgagaacgacgaguaa

SEQ ID NO: 15174 - RNA, 7746 nt, Artificial Sequence
  CHD8__Homo_sapiens__NP_001164100
auggccgaccccaucauggaccuguucgacgaccccaaccuguucggccuggacagccugaccgacgacagcuucaaccaggugacccaggaccccaucgaggaggcccugggccugcccagcagccuggacagccuggaccagaugaaccaggacggcggcggcggcgacgugggcaacagcagcgccagcgagcuggugcccccccccgaggagaccgcccccaccgagcugagcaaggagagcaccgcccccgcccccgagagcaucacccugcacgacuacaccacccagcccgccagccaggagcagcccgcccagcccgugcugcagaccagcacccccaccagcggccugcugcaggugagcaagagccaggagauccugagccagggcaaccccuucaugggcgugagcgccaccgccgugagcagcagcagcgccggcggccagcccccccagagcgcccccaagaucgugauccugaaggccccccccagcagcagcgugaccggcgcccacguggcccagauccaggcccagggcaucaccagcaccgcccagccccugguggccggcaccgccaacggcggcaaggugaccuucaccaaggugcugaccggcaccccccugagacccggcgugagcaucgugagcggcaacaccgugcuggccgccaaggugcccggcaaccaggccgccgugcagagaaucgugcagcccagcagacccgugaagcagcuggugcugcagcccgugaagggcagcgcccccgccggcaaccccggcgccaccggccccccccugaagcccgccgugacccugaccagcacccccacccagggcgagagcaagagaaucacccuggugcugcagcagccccagagcggcggcccccagggccacagacacguggugcugggcagccugcccggcaagaucgugcugcagggcaaccagcuggccgcccugacccaggccaagaacgcccagggccagcccgccaagguggugaccauccagcugcaggugcagcagccccagcagaagauccagaucgugccccagccccccagcagccagccccagccccagcagccccccagcacccagcccgugacccugagcagcgugcagcaggcccagaucaugggccccggccagagccccggccagagacugagcgugcccgugaagguggugcugcagccccaggccggcagcagccagggcgccagcagcggccugagcguggugaaggugcugagcgccagcgagguggccgcccugagcagccccgccagcagcgccccccacagcggcggcaagaccggcauggaggagaacagaagacuggagcaccagaagaagcaggagaaggccaacagaaucguggccgaggccaucgccagagccagagccagaggcgagcagaacauccccagagugcugaacgaggacgagcugcccagcgugagacccgaggaggagggcgagaagaagagaagaaagaagagcgccggcgagagacugaaggaggagaagcccaagaagagcaagaccagcggcgccagcaagaccaagggcaagagcaagcugaacaccaucacccccguggugggcaagaagagaaagagaaacaccagcagcgacaacagcgacguggaggugaugcccgcccagagccccagagaggacgaggagagcagcauccagaagagaagaagcaacagacaggugaagagaaagaaguacaccgaggaccuggacaucaagaucaccgacgacgaggaggaggaggagguggacgugaccggccccaucaagcccgagcccauccugcccgagcccgugcaggagcccgacggcgagacccugcccagcaugcaguucuucguggagaaccccagcgaggaggacgccgccaucguggacaaggugcugagcaugagaaucgugaagaaggagcugcccagcggccaguacaccgaggccgaggaguucuucgugaaguacaagaacuacagcuaccugcacugcgagugggccaccaucagccagcuggagaaggacaagagaauccaccagaagcugaagagauucaagaccaagauggcccagaugagacacuucuuccacgaggacgaggagcccuucaaccccgacuacguggagguggacagaauccuggacgagagccacagcaucgacaaggacaacggcgagcccgugaucuacuaccuggugaaguggugcagccugcccuacgaggacagcaccugggagcugaaggaggacguggacgagggcaagaucagagaguucaagagaauccagagcagacaccccgagcugaagagagugaacagaccccaggccagcgccuggaagaagcuggagcugagccacgaguacaagaacagaaaccagcugagagaguaccagcuggagggcgugaacuggcugcuguucaacugguacaacagacagaacugcauccuggccgacgagaugggccugggcaagaccauccagagcaucgccuuccugcaggagguguacaacgugggcauccacggccccuuccuggugaucgccccccugagcaccaucaccaacugggagagagaguucaacaccuggaccgagaugaacaccaucguguaccacggcagccuggccagcagacagaugauccagcaguacgagauguacugcaaggacagcagaggcagacugauccccggcgccuacaaguucgacgcccugaucaccaccuucgagaugauccugagcgacugccccgagcugagagagaucgaguggagaugcgugaucaucgacgaggcccacagacugaagaacagaaacugcaagcugcuggacagccugaagcacauggaccuggagcacaaggugcugcugaccggcaccccccugcagaacaccguggaggagcuguucagccugcugcacuuccuggagcccagccaguuccccagcgagagcgaguuccugaaggacuucggcgaccugaagaccgaggagcaggugcagaagcugcaggccauccugaagcccaugaugcugagaagacugaaggaggacguggagaagaaccuggcccccaagcaggagaccaucaucgagguggagcugaccaacauccagaagaaguacuacagagccauccuggagaagaacuucagcuuccugagcaagggcgccggccacaccaacaugcccaaccugcugaacaccaugauggagcugagaaagugcugcaaccaccccuaccugaucaacggcgccgaggagaagauccugaccgaguucagagaggccugccacaucaucccccacgacuuccaccugcaggccauggugagaagcgccggcaagcuggugcugaucgacaagcugcugcccaagcugaaggccggcggccacaaggugcugaucuucagccagauggugagaugccuggacauccuggaggacuaccugauccagagaagauaccuguacgagagaaucgacggcagagugagaggcaaccugagacaggccgccaucgacagauucagcaagcccgacagcgacagauucguguuccugcugugcaccagagccggcggccugggcaucaaccugaccgccgccgacaccugcaucaucuucgacagcgacuggaacccccagaacgaccugcaggcccaggccagaugccacagaaucggccagagcaaggccgugaagguguacagacugaucaccagaaacagcuacgagagagagauguucgacaaggccagccugaagcugggccuggacaaggccgugcugcagagcaugagcggcagagacggcaacaucaccggcauccagcaguucagcaagaaggagaucgaggaccugcugagaaagggcgccuacgccgccaucauggaggaggacgacgagggcagcaaguucugcgaggaggacaucgaccagauccugcugagaagaaccaccaccaucaccaucgagagcgagggcaagggcagcaccuucgccaaggccagcuucguggccagcgagaacagaaccgacaucagccuggacgaccccaacuucuggcagaagugggccaagaaggccgaccuggacauggaccugcugaacagcaagaacaaccuggugaucgacacccccagagugagaaagcagaccagacacuucagcacccugaaggacgacgaccugguggaguucagcgaccuggagagcgaggacgacgagagacccagaagcagaagacacgacagacaccacgccuacggcagaaccgacugcuucagaguggagaagcaccugcugguguacggcuggggcagauggagagacauccugagccacggcagauucaagagaagaaugaccgagagagacguggagaccaucugcagagccauccugguguacugccugcugcacuacagaggcgacgagaacaucaagggcuucaucugggaccugaucagccccgccgagaacggcaagaccaaggagcugcagaaccacagcggccugagcauccccgugcccagaggcagaaagggcaagaaggugaagagccagagcaccuucgacauccacaaggccgacuggaucagaaaguacaaccccgacacccuguuccaggacgagagcuacaagaagcaccugaagcaccagugcaacaaggugcugcugagagugagaaugcuguacuaccugagacaggaggugaucggcgaccaggccgagaaggugcugggcggcgccaucgccagcgagaucgacaucugguuccccgugguggaccagcuggaggugcccaccaccuggugggacagcgaggccgacaagagccugcugaucggcguguucaagcacggcuacgagaaguacaacaccaugagagccgaccccgcccugugcuuccuggagaaggccggcagacccgacgacaaggccaucgccgccgagcacagagugcuggacaacuucagcgacaucguggagggcguggacuucgacaaggacugcgaggaccccgaguacaagccccugcagggcccccccaaggaccaggacgacgagggcgacccccugaugaugauggacgaggagaucagcgugaucgacggcgacgaggcccaggugacccagcagcccggccaccuguucuggccccccggcagcgcccugaccgccagacugagaagacuggugaccgccuaccagagaagcuacaagagagagcagaugaagaucgaggccgccgagagaggcgacagaagaagaagaagaugcgaggccgccuucaagcugaaggagaucgccagaagagagaagcagcagagauggaccagaagagagcagaccgacuucuacagaguggugagcaccuucggcguggaguacgaccccgacaccaugcaguuccacugggacagauucagaaccuucgccagacuggacaagaagaccgacgagagccugaccaaguacuuccacggcuucguggccaugugcagacaggugugcagacugccccccgccgccggcgacgagccccccgaccccaaccuguucaucgagcccaucaccgaggagagagccagcagaacccuguacagaaucgagcugcugagaagacugagagagcaggugcugugccacccccugcuggaggacagacuggcccugugccagccccccggccccgagcugcccaaguggugggagcccgugagacacgacggcgagcugcugagaggcgccgccagacacggcgugagccagaccgacugcaacaucaugcaggaccccgacuucagcuuccuggccgccagaaugaacuacaugcagaaccaccaggccggcgcccccgcccccagccugagcagaugcagcaccccccugcugcaccagcaguacaccagcagaaccgccagcccccugccccugagacccgacgcccccguggagaagagccccgaggagaccgccacccaggugcccagccuggagagccugacccugaagcuggagcacgaggugguggccagaagcagacccaccccccaggacuacgagaugagagugagccccagcgacaccaccccccuggugagcagaagcgugccccccgugaagcuggaggacgaggacgacagcgacagcgagcuggaccugagcaagcugagccccagcagcagcagcagcagcagcagcagcagcagcagcagcagcaccgacgagagcgaggacgagaaggaggagaagcugaccgaccagagcagaagcaagcuguacgacgaggagagccugcugagccugaccaugagccaggacggcuuccccaacgaggacggcgagcagaugacccccgagcugcugcugcugcaggagagacagagagccagcgaguggcccaaggacagagugcugaucaacagaaucgaccuggugugccaggccgugcugagcggcaaguggcccagcagcagaagaagccaggagauggugaccggcggcauccugggccccggcaaccaccugcuggacagccccagccugacccccggcgaguacggcgacagccccgugcccacccccagaagcagcagcgccgccagcauggccgaggaggaggccagcgccgugagcaccgccgccgcccaguucaccaagcugagaagaggcauggacgagaaggaguucaccgugcagaucaaggacgaggagggccugaagcugaccuuccagaagcacaagcugauggccaacggcgugaugggcgacggccacccccuguuccacaagaagaagggcaacagaaagaagcugguggagcuggagguggagugcauggaggagcccaaccaccuggacguggaccuggagaccagaauccccgugaucaacaagguggacggcacccugcuggugggcgaggacgcccccagaagagccgagcuggagauguggcugcagggccaccccgaguucgccguggaccccagauuccuggccuacauggaggacagaagaaagcagaaguggcagagaugcaagaagaacaacaaggccgagcugaacugccugggcauggagcccgugcagaccgccaacagcagaaacggcaagaagggccaccacaccgagaccguguucaacagagugcugcccggccccaucgcccccgagagcagcaagaagagagccagaagaaugagacccgaccugagcaagaugauggcccugaugcagggcggcagcaccggcagccugagccugcacaacaccuuccagcacagcagcagcggccugcagagcgugagcagccugggccacagcagcgccaccagcgccagccugcccuucaugcccuucgugaugggcggcgcccccagcagcccccacguggacagcagcaccaugcugcaccaccaccaccaccacccccacccccaccaccaccaccaccaccaccccggccugagagcccccggcuaccccagcagccccgugaccaccgccagcggcaccacccugagacugcccccccugcagcccgaggaggacgacgacgaggacgaggaggacgacgacgaccugagccagggcuacgacagcagcgagagagacuucagccugaucgacgaccccaugaugcccgccaacagcgacagcagcgaggacgccgacgacuaa

SEQ ID NO: 15175 - RNA, 1785 nt, Artificial Sequence
  CHDH__Homo_sapiens__NP_060867
auguggugccugcugagaggccugggcagacccggcgcccuggccagaggcgcccugggccagcagcagagccugggcgccagagcccuggccagcgccggcagcgagagcagagacgaguacagcuacgugguggugggcgccggcagcgccggcugcgugcuggccggcagacugaccgaggaccccgccgagagagugcugcugcuggaggccggccccaaggacgugcuggccggcagcaagagacugagcuggaagauccacaugcccgccgcccugguggccaaccugugcgacgacagauacaacuggugcuaccacaccgaggugcagagaggccuggacggcagagugcuguacuggcccagaggcagaguguggggcggcagcagcagccugaacgccaugguguacgugagaggccacgccgaggacuacgagagauggcagagacagggcgccagaggcugggacuacgcccacugccugcccuacuucagaaaggcccagggccacgagcugggcgccagcagauacagaggcgccgacggcccccugagagugagcagaggcaagaccaaccacccccugcacugcgccuuccuggaggccacccagcaggccggcuacccccugaccgaggacaugaacggcuuccagcaggagggcuucggcuggauggacaugaccauccacgagggcaagagauggagcgccgccugcgccuaccugcaccccgcccugagcagaaccaaccugaaggccgaggccgagacccuggugagcagagugcuguucgagggcaccagagccgugggcguggaguacgugaagaacggccagagccacagagccuacgccagcaaggaggugauccugagcggcggcgccaucaacagcccccagcugcugaugcugagcggcaucggcaacgccgacgaccugaagaagcugggcauccccguggugugccaccugcccggcgugggccagaaccugcaggaccaccuggagaucuacauccagcaggccugcaccagacccaucacccugcacagcgcccagaagccccugagaaaggugugcaucggccuggaguggcuguggaaguucaccggcgagggcgccaccgcccaccuggagaccggcggcuucaucagaagccagcccggcgugccccaccccgacauccaguuccacuuccugcccagccaggugaucgaccacggcagagugcccacccagcaggaggccuaccaggugcacgugggccccaugagaggcaccagcgugggcuggcugaagcugagaagcgccaacccccaggaccaccccgugauccagcccaacuaccugagcaccgagaccgacaucgaggacuucagacugugcgugaagcugaccagagagaucuucgcccaggaggcccuggcccccuucagaggcaaggagcugcagcccggcagccacauccagagcgacaaggagaucgacgccuucgugagagccaaggccgacagcgccuaccaccccagcugcaccugcaagaugggccagcccagcgaccccaccgccgugguggacccccagaccagagugcugggcguggagaaccugagagugguggacgccagcaucaugcccagcauggugagcggcaaccugaacgcccccaccaucaugaucgccgagaaggccgccgacaucaucaagggccagcccgcccugugggacaaggacgugcccguguacaagcccagaacccuggccacccagagauaa

SEQ ID NO: 15176 - RNA, 1329 nt, Artificial Sequence
  CHEK1__Homo_sapiens__NP_001231775
auggccgugcccuucguggaggacugggaccuggugcagacccugggcgagggcgccuacggcgaggugcagcuggccgugaacagagugaccgaggaggccguggccgugaagaucguggacaugaagagagccguggacugccccgagaacaucaagaaggagaucugcaucaacaagaugcugaaccacgagaacguggugaaguucuacggccacagaagagagggcaacauccaguaccuguuccuggaguacugcagcggcggcgagcuguucgacagaaucgagcccgacaucggcaugcccgagcccgacgcccagagauucuuccaccagcugauggccggcgugguguaccugcacggcaucggcaucacccacagagacaucaagcccgagaaccugcugcuggacgagagagacaaccugaagaucagcgacuucggccuggccaccguguucagauacaacaacagagagagacugcugaacaagaugugcggcacccugcccuacguggcccccgagcugcugaagagaagagaguuccacgccgagcccguggacguguggagcugcggcaucgugcugaccgccaugcuggccggcgagcugcccugggaccagcccagcgacagcugccaggaguacagcgacuggaaggagaagaagaccuaccugaaccccuggaagaagaucgacagcgccccccuggcccugcugcacaagauccugguggagaaccccagcgccagaaucaccauccccgacaucaagaaggacagaugguacaacaagccccugaagaagggcgccaagagacccagagugaccagcggcggcgugagcgagagccccagcggcuucagcaagcacauccagagcaaccuggacuucagccccgugaacagcgccagcagcgaggagaacgugaaguacagcagcagccagcccgagcccagaaccggccugagccugugggacaccagccccagcuacaucgacaagcuggugcagggcaucagcuucagccagcccaccugccccgaccacaugcugcugaacagccagcugcugggcacccccggcagcagccagaaccccuggcagagacuggugaagagaaugaccagauucuucaccaagcuggacgccgacaagagcuaccagugccugaaggagaccugcgagaagcugggcuaccaguggaagaagagcugcaugaaccagggcgacggccuggaguucaagagacacuuccugaagaucaagggcaagcugaucgacaucgugagcagccagaagaucuggcugcccgccaccuaa

SEQ ID NO: 15177 - RNA, 969 nt, Artificial Sequence
  CHEK2__Homo_sapiens__NP_001244316
augagcaagacccugggcagcggcgccugcggcgaggugaagcuggccuucgagagaaagaccugcaagaagguggccaucaagaucaucagcaagagaaaguucgccaucggcagcgccagagaggccgaccccgcccugaacguggagaccgagaucgagauccugaagaagcugaaccaccccugcaucaucaagaucaagaacuucuucgacgccgaggacuacuacaucgugcuggagcugauggagggcggcgagcuguucgacaagguggugggcaacaagagacugaaggaggccaccugcaagcuguacuucuaccagaugcugcuggccgugcaguaccugcacgagaacggcaucauccacagagaccugaagcccgagaacgugcugcugagcagccaggaggaggacugccugaucaagaucaccgacuucggccacagcaagauccugggcgagaccagccugaugagaacccugugcggcacccccaccuaccuggcccccgaggugcuggugagcgugggcaccgccggcuacaacagagccguggacugcuggagccugggcgugauccuguucaucugccugagcggcuacccccccuucagcgagcacagaacccaggugagccugaaggaccagaucaccagcggcaaguacaacuucauccccgaggugugggccgaggugagcgagaaggcccuggaccuggugaagaagcugcuggugguggaccccaaggccagauucaccaccgaggaggcccugagacaccccuggcugcaggacgaggacaugaagagaaaguuccaggaccugcugagcgaggagaacgagagcaccgcccugccccaggugcuggcccagcccagcaccagcagaaagagacccagagagggcgaggccgagggcgccgagaccaccaagagacccgccgugugcgccgccgugcuguaa

SEQ ID NO: 15178 - RNA, 2751 nt, Artificial Sequence
  CHERP__Homo_sapiens__NP_006378
auggagaugccccugccccccgacgaccaggagcugagaaacgugaucgacaagcuggcccaguucguggccagaaacggccccgaguucgagaagaugaccauggagaagcagaaggacaaccccaaguucagcuuccuguucggcggcgaguucuacagcuacuacaagugcaagcuggcccuggagcagcagcagcugaucugcaagcagcagacccccgagcuggagcccgccgccaccaugcccccccugccccagcccccccuggcccccgccgcccccaucccccccgcccagggcgcccccagcauggacgagcugauccagcagagccaguggaaccugcagcagcaggagcagcaccugcuggcccugagacaggagcaggugaccgccgccguggcccacgccguggagcagcagaugcagaagcugcuggaggagacccagcuggacaugaacgaguucgacaaccugcugcagcccaucaucgacaccugcaccaaggacgccaucagcgccggcaagaacuggauguucagcaacgccaagagccccccccacugcgagcugauggccggccaccugagaaacagaaucaccgccgacggcgcccacuucgagcugagacugcaccugaucuaccugaucaacgacgugcugcaccacugccagagaaagcaggccagagagcugcuggccgcccugcagaaggugguggugcccaucuacugcaccagcuuccuggccguggaggaggacaagcagcagaagaucgccagacugcugcagcugugggagaagaacggcuacuucgacgacagcaucauccagcagcugcagagccccgcccugggccugggccaguaccaggccacccugaucaacgaguacagcagcguggugcagcccgugcagcuggccuuccagcagcagauccagacccugaagacccagcacgaggaguucgugaccagccuggcccagcagcagcagcagcagcagcagcagcagcagcagcugcagaugccccagauggaggccgaggugaaggccaccccccccccccccgcccccccccccgcccccgcccccgcccccgccaucccccccaccacccagcccgacgacagcaagccccccauccagaugcccggcagcagcgaguacgaggcccccggcggcgugcaggaccccgccgccgccggccccagaggccccggcccccacgaccagaucccccccaacaagccccccugguucgaccagccccaccccguggcccccuggggccagcagcagccccccgagcagccccccuacccccaccaccagggcggccccccccacugcccccccuggaacaacagccacgagggcauguggggcgagcagagaggcgaccccggcuggaacggccagagagacgcccccuggaacaaccagcccgacgccgccuggaacagccaguucgagggccccuggaacagccagcacgagcagccccccuggggcggcggccagagagagccccccuucagaaugcagagacccccccacuucagaggccccuuccccccccaccagcagcacccccaguucaaccagcccccccacccccacaacuucaacagauucccccccagauucaugcaggacgacuucccccccagacaccccuucgagagaccccccuacccccacagauucgacuacccccagggcgacuuccccgccgagaugggccccccccaccaccaccccggccacagaaugccccaccccggcaucaacgagcacccccccugggccggcccccagcaccccgacuucggcccccccccccacggcuucaacggccagcccccccacaugagaagacagggccccccccacaucaaccacgacgaccccagccuggugcccaacgugcccuacuucgaccugcccgccggccugauggccccccuggugaagcuggaggaccacgaguacaagccccuggaccccaaggacaucagacugcccccccccaugccccccagcgagagacugcuggccgccguggaggccuucuacagcccccccagccacgacagacccagaaacagcgagggcugggagcagaacggccuguacgaguucuucagagccaagaugagagccagaagaagaaagggccaggagaagagaaacagcggccccagcagaagcagaagcagaagcaagagcagaggcagaagcagcagcagaagcaacagcagaagcagcaagagcagcggcagcuacagcagaagcagaagcagaagcugcagcagaagcuacagcagaagcagaagcagaagcagaagcagaagcagaagcagcagaagcagaagcagaagccagagcagaagcagaagcaagagcuacagccccggcagaagaagaagaagcagaagcagaagccccaccccccccagcagcgccggccugggcagcaacagcgccccccccauccccgacagcagacugggcgaggagaacaagggccaccagaugcuggugaagaugggcuggagcggcagcggcggccugggcgccaaggagcagggcauccaggaccccaucaagggcggcgacgugagagacaagugggaccaguacaagggcgugggcguggcccuggacgaccccuacgagaacuacagaagaaacaagagcuacagcuucaucgccagaaugaaggccagagacgagugcaaguaa

SEQ ID NO: 15179 - RNA, 1995 nt, Artificial Sequence
  CHFR__Homo_sapiens__NP_001154816
auggagagacccgaggagggcaagcagagcccccccccccagcccuggggcagacugcugagacugggcgccgaggagggcgagccccacgugcugcugagaaagagagaguggaccaucggcagaagaagaggcugcgaccugagcuuccccagcaacaagcuggugagcggcgaccacugcagaaucgugguggacgagaagagcggccaggugacccuggaggacaccagcaccagcggcaccgugaucaacaagcugaagguggugaagaagcagaccugcccccugcagaccggcgacgugaucuaccugguguacagaaagaacgagcccgagcacaacguggccuaccuguacgagagccugagcgagaagcagggcaugacccaggagagcuucgaggccaacaaggagaacguguuccacggcaccaaggacaccagcggcgccggcgccggcagaggcgccgaccccagagugccccccagcagccccgccacccaggugugcuucgaggagccccagcccagcaccagcaccagcgaccuguuccccaccgccagcgccagcagcaccgagcccagccccgccggcagagagagaagcagcagcugcggcagcggcggcggcggcaucagccccaagggcagcggccccagcguggccagcgacgaggugagcagcuucgccagcgcccugcccgacagaaagaccgccagcuucagcagccuggagccccaggaccaggaggaccuggagcccgugaagaagaagaugagaggcgacggcgaccuggaccugaacggccagcugcugguggcccagcccagaagaaacgcccagaccgugcacgaggacgugagagccgccgccggcaagcccgacaagauggaggagacccugaccugcaucaucugccaggaccugcugcacgacugcgugagccugcagcccugcaugcacaccuucugcgccgccugcuacagcggcuggauggagagaagcagccugugccccaccugcagaugccccguggagagaaucugcaagaaccacauccugaacaaccugguggaggccuaccugauccagcaccccgacaagagcagaagcgaggaggacgugcagagcauggacgccagaaacaagaucacccaggacaugcugcagcccaaggugagaagaagcuucagcgacgaggagggcagcagcgaggaccugcuggagcugagcgacguggacagcgagagcagcgacaucagccagcccuacguggugugcagacagugccccgaguacagaagacaggccgcccagcccccccacugccccgcccccgagggcgagcccggcgccccccaggcccugggcgacgcccccagcaccagcgugagccugaccaccgccgugcaggacuacgugugcccccugcagggcagccacgcccugugcaccugcugcuuccagcccaugcccgacagaagagccgagagagagcaggaccccagaguggccccccagcagugcgccgugugccugcagcccuucugccaccuguacuggggcugcaccagaaccggcugcuacggcugccuggcccccuucugcgagcugaaccugggcgacaagugccuggacggcgugcugaacaacaacagcuacgagagcgacauccugaagaacuaccuggccaccagaggccugaccuggaagaacaugcugaccgagagccugguggcccugcagagaggcguguuccugcugagcgacuacagagugaccggcgacaccgugcugugcuacugcugcggccugagaagcuucagagagcugaccuaccaguacagacagaacauccccgccagcgagcugcccguggccgugaccagcagacccgacugcuacuggggcagaaacugcagaacccaggugaaggcccaccacgccaugaaguucaaccacaucugcgagcagaccagauucaagaacuaa

SEQ ID NO: 15180 - RNA, 921 nt, Artificial Sequence
  CHGA__Homo_sapiens__NP_001288619
augagaagcgccgccgugcuggcccugcugcugugcgccggccaggugaccgcccugcccgugaacagccccaugaacaagggcgacaccgaggugaugaagugcaucguggaggugaucagcgacacccugagcaagcccagccccaugcccgugagccaggagugcuucgagacccugagaggcgacgagagaauccugagcauccugagacaccagaaccugcugaaggagcugcaggaccuggcccugcagggcgccaaggagagagcccaccagcagaagaagcacagcggcuucgaggacgagcugagcgaggugcuggagaaccagagcagccaggccgagcugaagggcagaagcgaggcccuggccguggacggcgccggcaagcccggcgccgaggaggcccaggaccccgagggcaagggcgagcaggagcacagccagcagaaggaggaggaggaggagauggccguggugccccagggccuguucagaggcggcaagagcggcgagcuggagcaggaggaggagagacugagcaaggagugggaggacagcaagagauggagcaagauggaccagcuggccaaggagcugaccgccgagaagagacuggagggccaggaggaggaggaggacaacagagacagcagcaugaagcugagcuucagagccagagccuacggcuucagaggccccggcccccagcugagaagaggcuggagacccagcagcagagaggacagccuggaggccggccugccccugcaggugagaggcuaccccgaggagaagaaggaggaggagggcagcgccaacagaagacccgaggaccaggagcuggagagccugagcgccaucgaggccgagcuggagaagguggcccaccagcugcaggcccugagaagaggcuaa

SEQ ID NO: 15181 - RNA, 2034 nt, Artificial Sequence
  CHGB__Homo_sapiens__NP_001810
augcagcccacccugcugcugagccugcugggcgccgugggccuggccgccgugaacagcaugcccguggacaacagaaaccacaacgagggcauggugaccagaugcaucaucgaggugcugagcaacgcccugagcaagagcagcgccccccccaucacccccgagugcagacaggugcugaagaccagcagaaaggacgugaaggacaaggagaccaccgagaacgagaacaccaaguucgaggugagacugcugagagaccccgccgacgccagcgaggcccacgagagcagcagcagaggcgaggccggcgcccccggcgaggaggacauccagggccccaccaaggccgacaccgagaagugggccgagggcggcggccacagcagagagagagccgacgagccccaguggagccuguaccccagcgacagccaggugagcgaggaggugaagaccagacacagcgagaagagccagagagaggacgaggaggaggaggagggcgagaacuaccagaagggcgagagaggcgaggacagcagcgaggagaagcaccuggaggagcccggcgagacccagaacgccuuccugaacgagagaaagcaggccagcgccaucaagaaggaggagcugguggccagaagcgagacccacgccgccggccacagccaggagaagacccacagcagagagaagagcagccaggagagcggcgaggagaccggcagccaggagaaccacccccaggagagcaagggccagcccagaagccaggaggagagcgaggagggcgaggaggacgccaccagcgagguggacaagagaagaaccagacccagacaccaccacggcagaagcagacccgacagaagcagccagggcggcagccugcccagcgaggagaagggccacccccaggaggagagcgaggagagcaacgugagcauggccagccugggcgagaagagagaccaccacagcacccacuacagagccagcgaggaggagcccgaguacggcgaggagaucaagggcuaccccggcgugcaggcccccgaggaccuggagugggagagauacagaggcagaggcagcgaggaguacagagcccccagaccccagagcgaggagagcugggacgaggaggacaagagaaacuaccccagccuggagcuggacaagauggcccacggcuacggcgaggagagcgaggaggagagaggccuggagcccggcaagggcagacaccacagaggcagaggcggcgagcccagagccuacuucaugagcgacaccagagaggagaagagauuccugggcgagggccaccacagagugcaggagaaccagauggacaaggccagaagacacccccagggcgccuggaaggagcuggacagaaacuaccugaacuacggcgaggagggcgcccccggcaaguggcagcagcagggcgaccugcaggacaccaaggagaacagagaggaggccagauuccaggacaagcaguacagcagccaccacaccgccgagaagagaaagagacugggcgagcuguucaaccccuacuacgacccccugcaguggaagagcagccacuucgagagaagagacaacaugaacgacaacuuccuggagggcgaggaggagaacgagcugacccugaacgagaagaacuucuuccccgaguacaacuacgacuggugggagaagaagcccuucagcgaggacgugaacuggggcuacgagaagagaaaccuggccagagugcccaagcuggaccugaagagacaguacgacagaguggcccagcuggaccagcugcugcacuacagaaagaagagcgccgaguuccccgacuucuacgacagcgaggagcccgugagcacccaccaggaggccgagaacgagaaggacagagccgaccagaccgugcugaccgaggacgagaagaaggagcuggagaaccuggccgccauggaccuggagcugcagaagaucgccgagaaguucagccagagaggcuaa

SEQ ID NO: 15182 - RNA, 987 nt, Artificial Sequence
  CHI3L1__Homo_sapiens__XP_011507410
augggcgugaaggccagccagaccggcuucguggugcuggugcugcugcagugcugcagcgccuacaagcuggugugcuacuacaccagcuggagccaguacagagagggcgacggcagcugcuuccccgacgcccuggacagauuccugugcacccacaucaucuacagcuucgccaacaucagcaacgaccacaucgacaccugggaguggaacgacgugacccuguacggcaugcugaacacccugaagaacagaaaccccaaccugaagacccugcugagcgugggcggcuggaacuucggcagccagagagccgacuucggccccagauucagcaagaucgccagcaacacccagagcagaagaaccuucaucaagagcgugccccccuuccugagaacccacggcuucgacggccuggaccuggccuggcuguaccccggcagaagagacaagcagcacuucaccacccugaucaaggagaugaaggccgaguucaucaaggaggcccagcccggcaagaagcagcugcugcugagcgccgcccugagcgccggcaaggugaccaucgacagcagcuacgacaucgccaagaucagccagcaccuggacuucaucagcaucaugaccuacgacuuccacggcgccuggagaggcaccaccggccaccacagcccccuguucagaggccaggaggacgccagccccgacagauucagcaacaccaucugcgacuuccugagaggcgccaccgugcacagaauccugggccagcaggugcccuacgccaccaagggcaaccagugggugggcuacgacgaccaggagagcgugaagagcaaggugcaguaccugaaggacagacagcuggccggcgccauggugugggcccuggaccuggacgacuuccagggcagcuucugcggccaggaccugagauucccccugaccaacgccaucaaggacgcccuggccgccaccuaa

SEQ ID NO: 15183 - RNA, 675 nt, Artificial Sequence
  CHIC1__Homo_sapiens__NP_001034929
augagcauccugcugcccaacauggccgaguucgacaccaucagcgagcuggaggaggaggaggaggaggaggccgccaccagcagcagcagccccagcagcagcagcagcgugagcggccccgacgacgacgaggaggacgaggaggaggaggaggaggaggaggaggaggaggaggaggaggaggaggaggaggaggaggaggccccccccccccccagaguggugagcgaggagcaccugagaagauacgcccccgaccccgugcuggugagaggcgccggccacaucaccguguucggccugagcaacaaguucgacaccgaguuccccagcgugcugaccggcaagguggcccccgaggaguucaagaccagcaucggcagagugaacgccugccugaagaaggcccugcccgugaacgugaaguggcugcugugcggcugccugugcugcugcugcacccugggcugcagccuguggcccgugaucugccugaacaagagaaccagaagaagcauccagaagcugaucgagugggagaacaacagacuguaccacaagcuggcccugcacuggaagcugaccaagagaaagugcgagaccagcaacaugauggaguacgugauccugaucgaguuccugcccaaguaccccaucuucagacccgacuaa

SEQ ID NO: 15184 - RNA, 498 nt, Artificial Sequence
  CHIC2__Homo_sapiens__NP_036242
auggccgacuucgacgagaucuacgaggaggaggaggacgaggagagagcccuggaggagcagcugcugaaguacagccccgaccccgugguggugagaggcagcggccacgugaccguguucggccugagcaacaaguucgagagcgaguuccccagcagccugaccggcaagguggcccccgaggaguucaaggccagcaucaacagagugaacagcugccugaagaagaaccugcccgugaacgugagauggcugcugugcggcugccugugcugcugcugcacccugggcugcagcauguggcccgugaucugccugagcaagagaaccagaagaagcaucgagaagcugcuggagugggagaacaacagacuguaccacaagcugugccugcacuggagacugagcaagagaaagugcgagaccaacaacaugauggaguacgugauccugaucgaguuccugcccaagacccccaucuucagacccgacuaa

SEQ ID NO: 15185 - RNA, 1344 nt, Artificial Sequence
  CHIT1__Homo_sapiens__NP_001243054
auggugagaagcguggccugggccggcuucauggugcugcugaugauccccuggggcagcgccgccaagcuggugugcuacuucaccaacugggcccaguacagacagggcgaggccagauuccugcccaaggaccuggaccccagccugugcacccaccugaucuacgccuucgccggcaugaccaaccaccagcugagcaccaccgaguggaacgacgagacccuguaccaggaguucaacggccugaagaagauguucaccgacaugguggccaccgccaacaacagacagaccuucgugaacagcgccaucagauuccugagaaaguacagcuucgacggccuggaccuggacugggaguaccccggcagccagggcagccccgccguggacaaggagagauucaccacccuggugcaggaccuggccaacgccuuccagcaggaggcccagaccagcggcaaggagagacugcugcugagcgccgccgugcccgccggccagaccuacguggacgccggcuacgagguggacaagaucgcccagaaccuggacuucgugaaccugauggccuacgacuuccacggcagcugggagaaggugaccggccacaacagcccccuguacaagagacaggaggagagcggcgccgccgccagccugaacguggacgccgccgugcagcaguggcugcagaagggcacccccgccagcaagcugauccugggcaugcccaccuacggcagaagcuucacccuggccagcagcagcgacaccagagugggcgcccccgccaccggcagcggcacccccggccccuucaccaaggagggcggcaugcuggccuacuacgaggugugcagcuggaagggcgccaccaagcagagaauccaggaccagaaggugcccuacaucuucagagacaaccagugggugggcuucgacgacguggagagcuucaagaccaaggugagcuaccugaagcagaagggccugggcggcgccauggugugggcccuggaccuggacgacuucgccggcuucagcugcaaccagggcagauacccccugauccagacccugagacaggagcugagccugcccuaccugcccagcggcacccccgagcuggaggugcccaagcccggccagcccagcgagcccgagcacggccccagccccggccaggacaccuucugccagggcaaggccgacggccuguaccccaaccccagagagagaagcagcuucuacagcugcgccgccggcagacuguuccagcagagcugccccaccggccugguguucagcaacagcugcaagugcugcaccuggaacuaa

SEQ ID NO: 15186 - RNA, 1320 nt, Artificial Sequence
  CHKA__Homo_sapiens__NP_997634
augaagaccaaguucugcaccggcggcgaggccgagcccagcccccugggccugcugcugagcugcggcagcggcagcgccgcccccgcccccggcgugggccagcagagagacgccgccagcgaccuggagagcaagcagcugggcggccagcagcccccccuggcccugccccccccccccccccugccccugccccugccccugccccagcccccccccccccagccccccgccgacgagcagcccgagcccagaaccagaagaagagccuaccuguggugcaaggaguuccugcccggcgccuggagaggccugagagaggacgaguuccacaucagcgugaucagaggcggccugagcaacaugcuguuccagugcagccugcccgacaccaccgccacccugggcgacgagcccagaaaggugcugcugagacuguacggcgccauccugcagaugggcgccgaggccauggugcuggagagcgugauguucgccauccuggccgagagaagccugggccccaagcuguacggcaucuucccccagggcagacuggagcaguucauccccagcagaagacuggacaccgaggagcugagccugcccgacaucagcgccgagaucgccgagaagauggccaccuuccacggcaugaagaugcccuucaacaaggagcccaaguggcuguucggcaccauggagaaguaccugaaggaggugcugagaaucaaguucaccgaggagagcagaaucaagaagcugcacaagcugcugagcuacaaccugccccuggagcuggagaaccugagaagccugcuggagagcacccccagccccgugguguucugccacaacgacugccaggagggcaacauccugcugcuggagggcagagagaacagcgagaagcagaagcugaugcugaucgacuucgaguacagcagcuacaacuacagaggcuucgacaucggcaaccacuucugcgaguggauguacgacuacagcuacgagaaguaccccuucuucagagccaacaucagaaaguaccccaccaagaagcagcagcugcacuucaucagcagcuaccugcccgccuuccagaacgacuucgagaaccugagcaccgaggagaagagcaucaucaaggaggagaugcugcuggaggugaacagauucgcccuggccagccacuuccuguggggccuguggagcaucgugcaggccaagaucagcagcaucgaguucggcuacauggacuacgcccaggccagauucgacgccuacuuccaccagaagagaaagcugggcguguaa

SEQ ID NO: 15187 - RNA, 1188 nt, Artificial Sequence
  CHKB__Homo_sapiens__NP_005189
auggccgccgaggccaccgccguggccggcagcggcgccgugggcggcugccuggccaaggacggccugcagcagagcaagugccccgacaccacccccaagagaagaagagccagcagccugagcagagacgccgagagaagagccuaccaguggugcagagaguaccugggcggcgccuggagaagagugcagcccgaggagcugagaguguaccccgugagcggcggccugagcaaccugcuguucagaugcagccugcccgaccaccugcccagcgugggcgaggagcccagagaggugcugcugagacuguacggcgccauccugcagggcguggacagccuggugcuggagagcgugauguucgccauccuggccgagagaagccugggcccccagcuguacggcguguuccccgagggcagacuggagcaguacauccccagcagaccccugaagacccaggagcugagagagcccgugcugagcgccgccaucgccaccaagauggcccaguuccacggcauggagaugcccuucaccaaggagccccacuggcuguucggcaccauggagagauaccugaagcagauccaggaccugccccccaccggccugcccgagaugaaccugcuggagauguacagccugaaggacgagaugggcaaccugagaaagcugcuggagagcacccccagccccgugguguucugccacaacgacauccaggagggcaacauccugcugcugagcgagcccgagaacgccgacagccugaugcugguggacuucgaguacagcagcuacaacuacagaggcuucgacaucggcaaccacuucugcgaguggguguacgacuacacccacgaggaguggcccuucuacaaggccagacccaccgacuaccccacccaggagcagcagcugcacuucaucagacacuaccuggccgaggccaagaagggcgagacccugagccaggaggagcagagaaagcuggaggaggaccugcugguggaggugagcagauacgcccuggccagccacuucuucuggggccuguggagcauccugcaggccagcaugagcaccaucgaguucggcuaccuggacuacgcccagagcagauuccaguucuacuuccagcagaagggccagcugaccagcgugcacagcagcagcuaa

SEQ ID NO: 15188 - RNA, 3516 nt, Artificial Sequence
  CHL1__Homo_sapiens__NP_001240317
auggagccccugcugcugggcagaggccugaucguguaccugauguuccugcugcugaaguucagcaaggccaucgagauccccagcagcgugcagcaggugcccaccaucaucaagcagagcaaggugcagguggccuuccccuucgacgaguacuuccagaucgagugcgaggccaagggcaaccccgagcccaccuucagcuggaccaaggacggcaaccccuucuacuucaccgaccacagaaucauccccagcaacaacagcggcaccuucagaauccccaacgagggccacaucagccacuuccagggcaaguacagaugcuucgccagcaacaagcugggcaucgccaugagcgaggagaucgaguucaucgugcccagcgugcccaaguuccccaaggagaagaucgacccccuggagguggaggagggcgaccccaucgugcugcccugcaacccccccaagggccugcccccccugcacaucuacuggaugaacaucgagcuggagcacaucgagcaggacgagagaguguacaugagccagaagggcgaccuguacuucgccaacguggaggagaaggacagcagaaacgacuacugcugcuucgccgccuuccccagacugagaaccaucgugcagaagaugcccaugaagcugaccgugaacagccugaagcacgccaacgacagcagcagcagcaccgagaucggcagcaaggccaacagcaucaagcagagaaagcccaagcugcugcugccccccaccgagagcggcagcgagagcagcaucaccauccugaagggcgagauccugcugcuggagugcuucgccgagggccugcccaccccccagguggacuggaacaagaucggcggcgaccugcccaagggcagagagaccaaggagaacuacggcaagacccugaagaucgagaacgugagcuaccaggacaagggcaacuacagaugcaccgccagcaacuuccugggcaccgccacccacgacuuccacgugaucguggaggagccccccagauggaccaagaagccccagagcgccguguacagcaccggcagcaacggcauccugcugugcgaggccgagggcgagccccagcccaccaucaaguggagagugaacggcagccccguggacaaccaccccuucgccggcgacgugguguuccccagagagaucagcuucaccaaccugcagcccaaccacaccgccguguaccagugcgaggccagcaacgugcacggcaccauccuggccaacgccaacaucgacgugguggacgugagaccccugauccagaccaaggacggcgagaacuacgccaccguggugggcuacagcgccuuccugcacugcgaguucuucgccagccccgaggccguggugagcuggcagaagguggaggaggugaagccccuggagggcagaagauaccacaucuacgagaacggcacccugcagaucaacagaaccaccgaggaggacgccggcagcuacagcugcuggguggagaacgccaucggcaagaccgccgugaccgccaaccuggacaucagaaacgccaccaagcugagagugagccccaagaaccccagaauccccaagcugcacaugcuggagcugcacugcgagagcaagugcgacagccaccugaagcacagccugaagcugagcuggagcaaggacggcgaggccuucgagaucaacggcaccgaggacggcagaaucaucaucgacggcgccaaccugaccaucagcaacgugacccuggaggaccagggcaucuacugcugcagcgcccacaccgcccuggacagcgccgccgacaucacccaggugaccgugcuggacgugcccgacccccccgagaaccugcaccugagcgagagacagaacagaagcgugagacugaccugggaggccggcgccgaccacaacagcaacaucagcgaguacaucguggaguucgagggcaacaaggaggagcccggcagaugggaggagcugaccagagugcagggcaagaagaccaccgugauccugccccuggcccccuucgugagauaccaguucagagugaucgccgugaacgaggugggcagaagccagcccagccagcccagcgaccaccacgagaccccccccgccgcccccgacagaaacccccagaacaucagagugcaggccagccagcccaaggagaugaucaucaagugggagccccugaagagcauggagcagaacggccccggccuggaguacagagugaccuggaagccccagggcgcccccguggagugggaggaggagaccgugaccaaccacacccugagagugaugacccccgccguguacgcccccuacgacgugaaggugcaggccaucaaccagcugggcagcggccccgacccccagagcgugacccuguacagcggcgaggacuaccccgacaccgcccccgugauccacggcguggacgugaucaacagcacccuggugaaggugaccuggagcaccgugcccaaggacagagugcacggcagacugaagggcuaccagaucaacugguggaagaccaagagccugcuggacggcagaacccaccccaaggaggugaacauccugagauucagcggccagagaaacagcggcauggugcccagccuggacgccuucagcgaguuccaccugaccgugcuggccuacaacagcaagggcgccggccccgagagcgagcccuacaucuuccagacccccgagggcgugcccgagcagcccaccuuccugaaggugaucaagguggacaaggacaccgccacccugagcuggggccugcccaagaagcugaacggcaaccugaccggcuaccugcugcaguaccagaucaucaacgacaccuacgagaucggcgagcugaacgacaucaacaucaccacccccagcaagcccagcuggcaccugagcaaccugaacgccaccaccaaguacaaguucuaccugagagccugcaccagccagggcugcggcaagcccaucaccgaggagagcagcacccugggcgagggcaaguacgccggccuguacgacgacaucagcacccagggcugguucaucggccugaugugcgccaucgcccugcugacccugcugcugcugaccgugugcuucgugaagagaaacagaggcggcaaguacagcgugaaggagaaggaggaccugcaccccgaccccgagauccagagcgugaaggacgagaccuucggcgaguacagcgacagcgacgagaagccccugaagggcagccugagaagccugaacagagacaugcagcccaccgagagcgccgacagccugguggaguacggcgagggcgaccacggccuguucagcgaggacggcagcuucaucggcgccuacgccggcagcaaggagaagggcagcguggagagcaacggcagcagcaccgccaccuucccccugagagccuaa

SEQ ID NO: 15189 - RNA, 1962 nt, Artificial Sequence
  CHM__Homo_sapiens__NP_000381
auggccgacacccugcccagcgaguucgacgugaucgugaucggcaccggccugcccgagagcaucaucgccgccgccugcagcagaagcggcagaagagugcugcacguggacagcagaagcuacuacggcggcaacugggccagcuucagcuucagcggccugcugagcuggcugaaggaguaccaggagaacagcgacaucgugagcgacagccccguguggcaggaccagauccuggagaacgaggaggccaucgcccugagcagaaaggacaagaccauccagcacguggagguguucugcuacgccagccaggaccugcacgaggacguggaggaggccggcgcccugcagaagaaccacgcccuggugaccagcgccaacagcaccgaggccgccgacagcgccuuccugcccaccgaggacgagagccugagcaccaugagcugcgagaugcugaccgagcagacccccagcagcgaccccgagaacgcccuggaggugaacggcgccgaggugaccggcgagaaggagaaccacugcgacgacaagaccugcgugcccagcaccagcgccgaggacaugagcgagaacgugcccaucgccgaggacaccaccgagcagcccaagaagaacagaaucaccuacagccagaucaucaaggagggcagaagauucaacaucgaccuggugagcaagcugcuguacagcagaggccugcugaucgaccugcugaucaagagcaacgugagcagauacgccgaguucaagaacaucaccagaauccuggccuucagagagggcagaguggagcaggugcccugcagcagagccgacguguucaacagcaagcagcugaccaugguggagaagagaaugcugaugaaguuccugaccuucugcauggaguacgagaaguaccccgacgaguacaagggcuacgaggagaucaccuucuacgaguaccugaagacccagaagcugacccccaaccugcaguacaucgugaugcacagcaucgccaugaccagcgagaccgccagcagcaccaucgacggccugaaggccaccaagaacuuccugcacugccugggcagauacggcaacacccccuuccuguucccccuguacggccagggcgagcugccccagugcuucugcagaaugugcgccguguucggcggcaucuacugccugagacacagcgugcagugccuggugguggacaaggagagcagaaagugcaaggccaucaucgaccaguucggccagagaaucaucagcgagcacuuccugguggaggacagcuacuuccccgagaacaugugcagcagagugcaguacagacagaucagcagagccgugcugaucaccgacagaagcgugcugaagaccgacagcgaccagcagaucagcauccugaccgugcccgccgaggagcccggcaccuucgccgugagagugaucgagcugugcagcagcaccaugaccugcaugaagggcaccuaccuggugcaccugaccugcaccagcagcaagaccgccagagaggaccuggagagcguggugcagaagcuguucgugcccuacaccgagauggagaucgagaacgagcagguggagaagcccagaauccugugggcccuguacuucaacaugagagacagcagcgacaucagcagaagcugcuacaacgaccugcccagcaacguguacgugugcagcggccccgacugcggccugggcaacgacaacgccgugaagcaggccgagacccuguuccaggagaucugccccaacgaggacuucugcccccccccccccaaccccgaggacaucauccuggacggcgacagccugcagcccgaggccagcgagagcagcgccauccccgaggccaacagcgagaccuucaaggagagcaccaaccugggcaaccuggaggagagcagcgaguaa

SEQ ID NO: 15190 - RNA, 1971 nt, Artificial Sequence
  CHML__Homo_sapiens__NP_001812
auggccgacaaccugcccaccgaguucgacguggugaucaucggcaccggccugcccgagagcauccuggccgccgccugcagcagaagcggccagagagugcugcacaucgacagcagaagcuacuacggcggcaacugggccagcuucagcuucagcggccugcugagcuggcugaaggaguaccagcagaacaacgacaucggcgaggagagcaccgugguguggcaggaccugauccacgagaccgaggaggccaucacccugagaaagaaggacgagaccauccagcacaccgaggccuucugcuacgccagccaggacauggaggacaacguggaggagaucggcgcccugcagaagaaccccagccugggcgugagcaacaccuucaccgaggugcuggacagcgcccugcccgaggagagccagcugagcuacuucaacagcgacgagaugcccgccaagcacacccagaagagcgacaccgagaucagccuggaggugaccgacguggaggagagcguggagaaggagaaguacugcggcgacaagaccugcaugcacaccgugagcgacaaggacggcgacaaggacgagagcaagagcaccguggaggacaaggccgacgagcccaucagaaacagaaucaccuacagccagaucgugaaggagggcagaagauucaacaucgaccuggugagcaagcugcuguacagccagggccugcugaucgaccugcugaucaagagcgacgugagcagauacguggaguucaagaacgugaccagaauccuggccuucagagagggcaagguggagcaggugcccugcagcagagccgacguguucaacagcaaggagcugaccaugguggagaagagaaugcugaugaaguuccugaccuucugccuggaguacgagcagcaccccgacgaguaccaggccuucagacagugcagcuucagcgaguaccugaagaccaagaagcugacccccaaccugcagcacuucgugcugcacagcaucgccaugaccagcgagagcagcugcaccaccaucgacggccugaacgccaccaagaacuuccugcagugccugggcagauucggcaacacccccuuccuguucccccuguacggccagggcgagaucccccagggcuucugcagaaugugcgccguguucggcggcaucuacugccugagacacaaggugcagugcuucgugguggacaaggagagcggcagaugcaaggccaucaucgaccacuucggccagagaaucaacgccaaguacuucaucguggaggacagcuaccugagcgaggagaccugcagcaacgugcaguacaagcagaucagcagagccgugcugaucaccgaccagagcauccugaagaccgaccuggaccagcagaccagcauccugaucgugccccccgccgagcccggcgccugcgccgugagagugaccgagcugugcagcagcaccaugaccugcaugaaggacaccuaccuggugcaccugaccugcagcagcagcaagaccgccagagaggaccuggagagcguggugaagaagcuguucacccccuacaccgagaccgagaucaacgaggaggagcugaccaagcccagacugcugugggcccuguacuucaacaugagagacagcagcggcaucagcagaagcagcuacaacggccugcccagcaacguguacgugugcagcggccccgacugcggccugggcaacgagcacgccgugaagcaggccgagacccuguuccaggagaucuuccccaccgaggaguucugcccccccccccccaaccccgaggacaucaucuucgacggcgacgacaagcagcccgaggcccccggcaccaacaacguggugauggccaagcuggagagcagcgaggagagcaagaaccuggagagccccgagaagcaccugcagaacuaa

SEQ ID NO: 15191 - RNA, 723 nt, Artificial Sequence
  CHMP1A__Homo_sapiens__NP_001076783
auggacgugcacggcgaggccgccggcgaggccggccaggagggcggcgagggccugcagggcggcgccggccagagcgaggagggccccagcgccgagaagugcagagugugccccugcgugugcagagagagacacccccaggaggagagaagaugcgagcuggccagcgacggcgugcccagaagaagaagcggccugcagggcgccgacagcugcgacuacgagggcggcgaccaggaguacggccccggcgaccagagccccggccagggccccgagcaccacggccccgccgagggccugcugagcgacggccaggugagagccgccggcgccgagcccggcagacccuacaucggcgacggcggccugcacgagcugggccaccaccccgaccacgccgccggcgccggcggccagccccaccacgccgacagaagaggcgaguggcccggcggcgccggccccgcccagcccgccgccagaggcagacugugcagaggcagagagcugugcgcccagcccggcggccccgccgugaccgaggugggcagacuggaggagcuggccgugcccagaagaugcgcccccccccugcccagagacgugcuggagggcagcugcccccugcccaccgccagcugccugugcgccgaccccgccggccugagacccgccgccacccugagacugagccccgccagacccgccuggcccuaa

SEQ ID NO: 15192 - RNA, 600 nt, Artificial Sequence
  CHMP1B__Homo_sapiens__NP_065145
augagcaacauggagaagcaccuguucaaccugaaguucgccgccaaggagcugagcagaagcgccaagaagugcgacaaggaggagaaggccgagaaggccaagaucaagaaggccauccagaagggcaacauggagguggccagaauccacgccgagaacgccaucagacagaagaaccaggccgugaacuuccugagaaugagcgccagaguggacgccguggccgccagagugcagaccgccgugaccaugggcaaggugaccaagagcauggccggcguggugaagagcauggacgccacccugaagaccaugaaccuggagaagaucagcgcccugauggacaaguucgagcaccaguucgagacccuggacgugcagacccagcagauggaggacaccaugagcagcaccaccacccugaccaccccccagaaccagguggacaugcugcugcaggagauggccgacgaggccggccuggaccugaacauggagcugccccagggccagaccggcagcgugggcaccagcguggccagcgccgagcaggacgagcugagccagagacuggccagacugagagaccagguguaa

SEQ ID NO: 15193 - RNA, 519 nt, Artificial Sequence
  CHMP2B__Homo_sapiens__NP_001231573
auggagcuggagaucaagaagauggccaagaucggcaacaaggaggccugcaaggugcuggccaagcagcuggugcaccugagaaagcagaagaccagaaccuucgccgugagcagcaaggugaccagcaugagcacccagaccaaggugaugaacagccagaugaagauggccggcgccaugagcaccaccgccaagaccaugcaggccgugaacaagaagauggacccccagaagacccugcagaccaugcagaacuuccagaaggagaacaugaagauggagaugaccgaggagaugaucaacgacacccuggacgacaucuucgacggcagcgacgacgaggaggagagccaggacaucgugaaccaggugcuggacgagaucggcaucgagaucagcggcaagauggccaaggcccccagcgccgccagaagccugcccagcgccagcaccagcaaggccaccaucagcgacgaggagaucgagagacagcugaaggcccugggcguggacuaa

SEQ ID NO: 15194 - RNA, 471 nt, Artificial Sequence
  CHMP3__Homo_sapiens__NP_001005753
augaucagaagcagaaaggccgugagcaagcuguacgccagcaaggcccacaugaacagcgugcugaugggcaugaagaaccagcuggccgugcugagaguggccggcagccugcagaagagcaccgaggugaugaaggccaugcagagccuggugaagauccccgagauccaggccaccaugagagagcugagcaaggagaugaugaaggccggcaucaucgaggagaugcuggaggacaccuucgagagcauggacgaccaggaggagauggaggaggaggccgagauggagaucgacagaauccuguucgagaucaccgccggcgcccugggcaaggcccccagcaaggugaccgacgcccugcccgagcccgagccccccggcgccauggccgccagcgaggacgaggaggaggaggaggaggcccuggaggccaugcagagcagacuggccacccugagaagcuaa

SEQ ID NO: 15195 - RNA, 798 nt, Artificial Sequence
  CHMP4A__Homo_sapiens__NP_054888
augagcagaagaagacccgaggacggccugggcaaggccggccccugcgugaugagacaccacccccccagaagcaaggccgagguguggagaacccugagaggcggcggcggcagaggcgagcuggccaugagcggccugggcagacuguucggcaagggcaagaaggagaagggccccacccccgaggaggccauccagaagcugaaggagaccgagaagauccugaucaagaagcaggaguuccuggagcagaagauccagcaggagcugcagaccgccaagaaguacggcaccaagaacaagagagccgcccugcaggcccugagaagaaagaagagauucgagcagcagcuggcccagaccgacggcacccugagcacccuggaguuccagagagaggccaucgagaacgccaccaccaacgccgaggugcugagaaccauggagcuggccgcccagagcaugaagaaggccuaccaggacauggacaucgacaagguggacgagcugaugaccgacaucaccgagcagcaggagguggcccagcagaucagcgacgccaucagcagacccaugggcuucggcgacgacguggacgaggacgagcugcuggaggagcuggaggagcuggagcaggaggagcuggcccaggagcugcugaacgugggcgacaaggaggaggagcccagcgugaagcugcccagcgugcccagcacccaccugcccgccggccccgcccccaagguggacgaggacgaggaggcccugaagcagcuggccgagugggugagcuaa

SEQ ID NO: 15196 - RNA, 675 nt, Artificial Sequence
  CHMP4B__Homo_sapiens__NP_789782
augagcguguucggcaagcuguucggcgccggcggcggcaaggccggcaagggcggccccaccccccaggaggccauccagagacugagagacaccgaggagaugcugagcaagaagcaggaguuccuggagaagaagaucgagcaggagcugaccgccgccaagaagcacggcaccaagaacaagagagccgcccugcaggcccugaagagaaagaagagauacgagaagcagcuggcccagaucgacggcacccugagcaccaucgaguuccagagagaggcccuggagaacgccaacaccaacaccgaggugcugaagaacaugggcuacgccgccaaggccaugaaggccgcccacgacaacauggacaucgacaagguggacgagcugaugcaggacaucgccgaccagcaggagcuggccgaggagaucagcaccgccaucagcaagcccgugggcuucggcgaggaguucgacgaggacgagcugauggccgagcuggaggagcuggagcaggaggagcuggacaagaaccugcuggagaucagcggccccgagaccgugccccugcccaacgugcccagcaucgcccugcccagcaagcccgccaagaagaaggaggaggaggacgacgacaugaaggagcuggagaacugggccggcagcauguaa

SEQ ID NO: 15197 - RNA, 702 nt, Artificial Sequence
  CHMP4C__Homo_sapiens__NP_689497
augagcaagcugggcaaguucuucaagggcggcggcagcagcaagagcagagccgcccccagcccccaggaggcccuggugagacugagagagaccgaggagaugcugggcaagaagcaggaguaccuggagaacagaauccagagagagaucgcccuggccaagaagcacggcacccagaacaagagagccgcccugcaggcccugaagagaaagaagagauucgagaagcagcugacccagaucgacggcacccugagcaccaucgaguuccagagagaggcccuggagaacagccacaccaacaccgaggugcugagaaacaugggcuucgccgccaaggccaugaagagcgugcacgagaacauggaccugaacaagaucgacgaccugaugcaggagaucaccgagcagcaggacaucgcccaggagaucagcgaggccuucagccagagagugggcuucggcgacgacuucgacgaggacgagcugauggccgagcuggaggagcuggagcaggaggagcugaacaagaagaugaccaacaucagacugcccaacgugcccagcagcagccugcccgcccagcccaacagaaagcccggcaugagcagcaccgccagaagaagcagagccgccagcagccagagagccgaggaggaggacgacgacaucaagcagcuggccgccugggccaccuaa

SEQ ID NO: 15198 - RNA, 516 nt, Artificial Sequence
  CHMP5__Homo_sapiens__NP_001182465
augaacagacuguucggcaaggccaagcccaaggcccccccccccagccugaccgacugcaucggcaccguggacagcagagccgagagcaucgacaagaagaucagcagacuggacgccgagcuggugaaguacaaggaccagaucaagaagaugagagagggccccgccaagaacauggugaagcagaaggcccugagagugcugaagcagaagagaauguacgagcagcagagagacaaccuggcccagcagagcuucaacauggagcaggccaacuacaccauccagagccugaaggacaccaagaccaccguggacgccaugaagcugggcgugaaggagaugaagaaggccuacaagcaggugaagaucgaccagaucgaggaccugcaggaccagcuggaggacaugauggaggacgccaacgagauccaggaggcccugagcagaagcuacggcacccccgagcuggacgaggacgaccuggaggccggcuggagcagcggcggcuaa

SEQ ID NO: 15199 - RNA, 1302 nt, Artificial Sequence
  CHN1__Homo_sapiens__NP_001020372
auggcccugacccuguucgacaccgacgaguacagaccccccguguggaagagcuaccuguaccagcugcagcaggaggccccccaccccagaagaaucaccugcaccugcgagguggagaacagacccaaguacuacggcagagaguuccacggcaugaucagcagagaggccgccgaccagcugcugaucguggccgagggcagcuaccugaucagagagagccagagacagcccggcaccuacacccuggcccugagauucggcagccagaccagaaacuucagacuguacuacgacggcaagcacuucgugggcgagaagagauucgagagcauccacgaccuggugaccgacggccugaucacccuguacaucgagaccaaggccgccgaguacaucgccaagaugaccaucaaccccaucuacgagcacgugggcuacaccacccugaacagagagcccgccuacaagaagcacaugcccgugcugaaggagacccacgacgagagagacagcaccggccaggacggcgugagcgagaagagagugcacaccuucagaggcccccacuggugcgaguacugcgccaacuucauguggggccugaucgcccagggcgugaagugcgccgacugcggccugaacgugcacaagcagugcagcaagauggugcccaacgacugcaagcccgaccugaagcacgugaagaagguguacagcugcgaccugaccacccuggugaaggcccacaccaccaagagacccauggugguggacaugugcaucagagagaucgagagcagaggccugaacagcgagggccuguacagagugagcggcuucagcgaccugaucgaggacgugaagauggccuucgacagagacggcgagaaggccgacaucagcgugaacauguacgaggacaucaacaucaucaccggcgcccugaagcuguacuucagagaccugcccaucccccugaucaccuacgacgccuaccccaaguucaucgagagcgccaagaucauggaccccgacgagcagcuggagacccugcacgaggcccugaagcugcugccccccgcccacugcgagacccugagauaccugauggcccaccugaagagagugacccugcacgagaaggagaaccugaugaacgccgagaaccugggcaucguguucggccccacccugaugagaagccccgagcuggacgccauggccgcccugaacgacaucagauaccagagacuggugguggagcugcugaucaagaacgaggacauccuguucuaa

SEQ ID NO: 15200 - RNA, 999 nt, Artificial Sequence
  CHN2__Homo_sapiens__NP_001035025
auguucagcgaggagcuguggcuggagaacgagaagaagugcgccguggugagaaagagcaagcagggcagaaagagacaggagcugcuggccguggccuucggcgugaaggugggcgugaagggcggcuuccuguggcccccccugaagcuguucgccugcagccagaucagcagccuggugagaagagccgcccugacccacaacgacaaccacuucaacuacgagaagacccacaacuucaaggugcacaccuucagaggcccccacuggugcgaguacugcgccaacuucauguggggccugaucgcccagggcgugagaugcagcgacugcggccugaacgugcacaagcagugcagcaagcacgugcccaacgacugccagcccgaccugaagagaaucaagaagguguacugcugcgaccugaccacccuggugaaggcccacaacacccagagacccauggugguggacaucugcaucagagagaucgaggccagaggccugaagagcgagggccuguacagagugagcggcuucaccgagcacaucgaggacgugaagauggccuucgacagagacggcgagaaggccgacaucagcgccaacguguaccccgacaucaacaucaucaccggcgcccugaagcuguacuucagagaccugcccauccccgugaucaccuacgacaccuacagcaaguucaucgacgccgccaagaucagcaacgccgacgagagacuggaggccgugcacgaggugcugaugcugcugccccccgcccacuacgagacccugagauaccugaugauccaccugaagaaggugaccaugaacgagaaggacaacuucaugaacgccgagaaccugggcaucguguucggccccacccugaugagaccccccgaggacagcacccugaccacccugcacgacaugagauaccagaagcugaucgugcagauccugaucgagaacgaggacgugcuguucuaa

SEQ ID NO: 15201 - RNA, 765 nt, Artificial Sequence
  CHODL__Homo_sapiens__NP_001191103
augaccgccggcagcgcccacagccagaaggugugcuucgccgacuucaagcaccccugcuacaagauggccuacuuccacgagcugagcagcagagugagcuuccaggaggccagacuggccugcgagagcgagggcggcgugcugcugagccuggagaacgaggccgagcagaagcugaucgagagcaugcugcagaaccugaccaagcccggcaccggcaucagcgacggcgacuucuggaucggccuguggagaaacggcgacggccagaccagcggcgccugccccgaccuguaccaguggagcgacggcagcaacagccaguacagaaacugguacaccgacgagcccagcugcggcagcgagaagugcguggugauguaccaccagcccaccgccaaccccggccugggcggccccuaccuguaccaguggaacgacgacagaugcaacaugaagcacaacuacaucugcaaguacgagcccgagaucaaccccaccgcccccguggagaagcccuaccugaccaaccagcccggcgacacccaccagaacgugguggugaccgaggccggcaucauccccaaccugaucuacguggugauccccaccaucccccugcugcugcugauccugguggccuucggcaccugcugcuuccagaugcugcacaagagcaagggcagaaccaagaccagccccaaccagagcacccuguggaucagcaagagcaccagaaaggagagcggcauggagguguaa

SEQ ID NO: 15202 - RNA, 942 nt, Artificial Sequence
  CHORDC1__Homo_sapiens__NP_001137545
auggcccugcugugcuacaacagaggcugcggccagagauucgaccccgagaccaacagcgacgacgccugcaccuaccaccccggcgugcccguguuccacgacgcccugaagggcugcaccaagggcagacacaacagcgagaagccccccgagcccgugaagcccgaggugaagaccaccgagaagaaggagcugugcgagcugaagcccaaguuccaggagcacaucauccaggcccccaagcccguggaggccaucaagagacccagccccgacgagcccaugaccaaccuggagcugaagaucagcgccagccugaagcaggcccuggacaagcugaagcugagcagcggcaacgaggagaacaagaaggaggaggacaacgacgagaucaagaucggcaccagcugcaagaacggcggcugcagcaagaccuaccagggccuggagagccuggaggaggugugcguguaccacagcggcgugcccaucuuccacgagggcaugaaguacuggagcugcugcagaagaaagaccagcgacuucaacaccuuccuggcccaggagggcugcaccaagggcaagcacauguggaccaagaaggacgccggcaagaagguggugcccugcagacacgacuggcaccagaccggcggcgaggugaccaucagcguguacgccaagaacagccugcccgagcugagcagaguggaggccaacagcacccugcugaacgugcacaucguguucgagggcgagaaggaguucgaccagaacgugaagcuguggggcgugaucgacgugaagagaagcuacgugaccaugaccgccaccaagaucgagaucaccaugagaaaggccgagcccaugcagugggccagccuggagcugcccgccgccaagaagcaggagaagcagaaggacgccaccaccgacuaa

SEQ ID NO: 15203 - RNA, 588 nt, Artificial Sequence
  CHP1__Homo_sapiens__NP_009167
augggcagcagagccagcacccugcugagagacgaggagcuggaggagaucaagaaggagaccggcuucagccacagccagaucaccagacuguacagcagauucaccagccuggacaagggcgagaacggcacccugagcagagaggacuuccagagaauccccgagcuggccaucaacccccugggcgacagaaucaucaacgccuucuuccccgagggcgaggaccaggugaacuucagaggcuucaugagaacccuggcccacuucagacccaucgaggacaacgagaagagcaaggacgugaacggccccgagccccugaacagcagaagcaacaagcugcacuucgccuucagacuguacgaccuggacaaggacgagaagaucagcagagacgagcugcugcaggugcugagaaugauggugggcgugaacaucagcgacgagcagcugggcagcaucgccgacagaaccauccaggaggccgaccaggacggcgacagcgccaucagcuucaccgaguucgugaaggugcuggagaagguggacguggagcagaagaugagcaucagauuccugcacuaa

SEQ ID NO: 15204 - RNA, 591 nt, Artificial Sequence
  CHP2__Homo_sapiens__NP_071380
augggcagcagaagcagccacgccgccgugauccccgacggcgacagcaucagaagagagaccggcuucagccaggccagccugcugagacugcaccacagauucagagcccuggacagaaacaagaagggcuaccugagcagaauggaccugcagcagaucggcgcccuggccgugaacccccugggcgacagaaucaucgagagcuucuuccccgacggcagccagagaguggacuuccccggcuucgugagagugcuggcccacuucagacccguggaggacgaggacaccgagacccaggaccccaagaagcccgagccccugaacagcagaagaaacaagcugcacuacgccuuccagcuguacgaccuggacagagacggcaagaucagcagacacgagaugcugcaggugcugagacugauggugggcgugcaggugaccgaggagcagcuggagaacaucgccgacagaaccgugcaggaggccgacgaggacggcgacggcgccgugagcuucguggaguucaccaagagccuggagaagauggacguggagcagaagaugagcaucagaauccugaaguaa

SEQ ID NO: 15205 - RNA, 2328 nt, Artificial Sequence
  CHPF__Homo_sapiens__NP_078812
augagagccagccugcugcugagcgugcugagacccgccggccccguggccgugggcaucagccugggcuucacccugagccugcugagcgugaccuggguggaggagcccugcggccccggccccccccagcccggcgacagcgagcugccccccagaggcaacaccaacgccgccagaagacccaacagcgugcagcccggcgccgagagagagaagcccggcgccggcgagggcgccggcgagaacugggagcccagagugcugcccuaccaccccgcccagcccggccaggccgccaagaaggccgugagaaccagauacaucagcaccgagcugggcaucagacagagacugcugguggccgugcugaccagccagaccacccugcccacccugggcguggccgugaacagaacccugggccacagacuggagagagugguguuccugaccggcgccagaggcagaagagccccccccggcauggccguggugacccugggcgaggagagacccaucggccaccugcaccuggcccugagacaccugcuggagcagcacggcgacgacuucgacugguucuuccuggugcccgacaccaccuacaccgaggcccacggccuggccagacugaccggccaccugagccuggccagcgccgcccaccuguaccugggcagaccccaggacuucaucggcggcgagcccacccccggcagauacugccacggcggcuucggcgugcugcugagcagaaugcugcugcagcagcugagaccccaccuggagggcugcagaaacgacaucgugagcgccagacccgacgaguggcugggcagaugcauccuggacgccaccggcgugggcugcaccggcgaccacgagggcgugcacuacagccaccuggagcugagccccggcgagcccgugcaggagggcgacccccacuucagaagcgcccugaccgcccaccccgugagagaccccgugcacauguaccagcugcacaaggccuucgccagagccgagcuggagagaaccuaccaggagauccaggagcugcagugggagauccagaacaccagccaccuggccguggacggcgacagagccgccgccuggcccgugggcauccccgcccccagcagacccgccagcagauucgaggugcugagaugggacuacuucaccgagcagcacgccuucagcugcgccgacggcagccccagaugcccccugagaggcgccgacagagccgacguggccgacgugcugggcaccgcccuggaggagcugaacagaagauaccaccccgcccugagacugcagaagcagcagcuggugaacggcuacagaagauucgaccccgccagaggcauggaguacacccuggaccugcagcuggaggcccugaccccccagggcggcagaagaccccugaccagaagagugcagcugcugagaccccugagcagaguggagauccugcccgugcccuacgugaccgaggccagcagacugaccgugcugcugccccuggccgccgccgagagagaccuggcccccggcuuccuggaggccuucgccaccgccgcccuggagcccggcgacgccgccgccgcccugacccugcugcugcuguacgagcccagacaggcccagagaguggcccacgccgacguguucgcccccgugaaggcccacguggccgagcuggagagaagauuccccggcgccagagugcccuggcugagcgugcagaccgccgcccccagcccccugagacugauggaccugcugagcaagaagcacccccuggacacccuguuccugcuggccggccccgacaccgugcugacccccgacuuccugaacagaugcagaaugcacgccaucagcggcuggcaggccuucuuccccaugcacuuccaggccuuccaccccgccguggcccccccccagggccccggcccccccgagcugggcagagacaccggcagauucgacagacaggccgccagcgaggccugcuucuacaacagcgacuacguggccgccagaggcagacuggccgccgccagcgagcaggaggaggagcugcuggagagccuggacguguacgagcuguuccugcacuucagcagccugcacgugcugagagccguggagcccgcccugcugcagagauacagagcccagaccugcagcgccagacugagcgaggaccuguaccacagaugccugcagagcgugcuggagggccugggcagcagaacccagcuggccaugcugcuguucgagcaggagcagggcaacagcaccuaa

SEQ ID NO: 15206 - RNA, 1221 nt, Artificial Sequence
  CHPT1__Homo_sapiens__NP_064629
auggccgccggcgccggcgccggcagcgcccccagauggcugagagcccugagcgagccccugagcgccgcccagcugagaagacuggaggagcacagauacagcgccgccggcgugagccugcuggagcccccccugcagcuguacuggaccuggcugcugcaguggaucccccuguggauggcccccaacagcaucacccugcugggccuggccgugaacguggugaccacccuggugcugaucagcuacugccccaccgccaccgaggaggcccccuacuggaccuaccugcugugcgcccugggccuguucaucuaccagagccuggacgccaucgacggcaagcaggccagaagaaccaacagcugcagcccccugggcgagcuguucgaccacggcugcgacagccugagcaccguguucauggccgugggcgccagcaucgccgccagacugggcaccuaccccgacugguucuucuucugcagcuucaucggcauguucguguucuacugcgcccacuggcagaccuacgugagcggcaugcugagauucggcaagguggacgugaccgagauccagaucgcccuggugaucguguucgugcugagcgccuucggcggcgccaccaugugggacuacaccauccccauccuggagaucaagcugaagauccugcccgugcugggcuuccugggcggcgugaucuucagcugcagcaacuacuuccacgugauccugcacggcggcgugggcaagaacggcagcaccaucgccggcaccagcgugcugagccccggccugcacaucggccugaucaucauccuggccaucaugaucuacaagaagagcgccaccgacguguucgagaagcaccccugccuguacauccugauguucggcugcguguucgccaaggugagccagaagcuggugguggcccacaugaccaagagcgagcuguaccugcaggacaccguguuccugggccccggccugcuguuccuggaccaguacuucaacaacuucaucgacgaguacguggugcuguggauggccauggugaucagcagcuucgacauggugaucuacuucagcgcccugugccugcagaucagcagacaccugcaccugaacaucuucaagaccgccugccaccaggcccccgagcaggugcaggugcugagcagcaagagccaccagaacaacauggacuaa

SEQ ID NO: 15207 - RNA, 396 nt, Artificial Sequence
  CHRAC1__Homo_sapiens__NP_059140
auggccgacgugguggugggcaaggacaagggcggcgagcagagacugaucagccugccccugagcagaaucagagugaucaugaagagcagccccgaggugagcagcaucaaccaggaggcccuggugcugaccgccaaggccaccgagcuguucgugcagugccuggccaccuacagcuacagacacggcagcggcaaggagaagaaggugcugaccuacagcgaccuggccaacaccgcccagcagagcgagaccuuccaguuccuggccgacauccugcccaagaagauccuggccagcaaguaccugaagaugcugaaggaggagaagagagaggaggacgaggagaacgacaacgacaacgagagcgaccacgacgaggccgacagcuaa

SEQ ID NO: 15208 - RNA, 2865 nt, Artificial Sequence
  CHRD__Homo_sapiens__NP_001291401
augcccagccugcccgccccccccgccccccugcugcugcugggccugcugcugcugggcagcagacccgccagaggcgccggccccgagccccccgugcugcccaucagaagcgagaaggagccccugcccgugagaggcgccgccggcugcaccuucggcggcaagguguacgcccuggacgagaccuggcaccccgaccugggcgagcccuucggcgugaugagaugcgugcugugcgccugcgaggccccccaguggggcagaagaaccagaggccccggcagagugagcugcaagaacaucaagcccgagugccccacccccgccugcggccagcccagacagcugcccggccacugcugccagaccugcccccaggagagaagcagcagcgagagacagcccagcggccugagcuucgaguaccccagagaccccgagcacagaagcuacagcgacagaggcgagcccggcgccgaggagagagccagaggcgacggccacaccgacuucguggcccugcugaccggccccagaagccaggccguggccagagccagagugagccugcugagaagcagccugagauucagcaucagcuacagaagacuggacagacccaccagaaucagauucagcgacagcaacggcagcgugcuguucgagcaccccgccgcccccacccaggacggccuggugugcggcguguggagagccgugcccagacugagccugagacugcugagagccgagcagcugcacguggcccuggugacccugacccaccccagcggcgagguguggggcccccugaucagacacagagcccuggccgccgagaccuucagcgccauccugacccuggagggccccccccagcagggcgugggcggcaucacccugcugacccugagcgacaccgaggacagccugcacuuccugcugcuguucagaggccugcuggagcccagaagcggcggccugacccaggugccccugagacugcagauccugcaccagggccagcugcugagagagcugcaggccaacgugagcgcccaggagcccggcuucgccgaggugcugcccaaccugaccgugcaggagauggacuggcuggugcugggcgagcugcagauggcccuggagugggccggcagacccggccugagaaucagcggccacaucgccgccagaaagagcugcgacgugcugcagagcgugcugugcggcgccgacgcccugauccccgugcagaccggcgccgccggcagcgccagccugacccugcugggcaacggcagccugaucuaccaggugcagguggugggcaccagcagcgaggugguggccaugacccuggagaccaagccccagagaagagaccagagaaccgugcugugccacauggccggccugcagcccggcggccacaccgccgugggcaucugccccggccugggcgccagaggcgcccacaugcugcugcagaacgagcuguuccugaacgugggcaccaaggacuuccccgacggcgagcugagaggccacguggccgcccugcccuacugcggccacagcgccagacacgacacccugcccgugccccuggccggcgcccuggugcugccccccgugaagagccaggccgccggccacgccuggcugagccuggacacccacugccaccugcacuacgaggugcugcuggccggccugggcggcagcgagcagggcaccgugaccgcccaccugcugggcccccccggcacccccggccccagaagacugcugaagggcuucuacggcagcgaggcccagggcguggugaaggaccuggagcccgagcugcugagacaccuggccaagggcauggccagccugaugaucaccaccaagggcagccccagaggcgagcugagaggccaggugcacaucgccaaccagugcgaggugggcggccugagacuggaggccgccggcgccgagggcgugagagcccugggcgcccccgacaccgccagcgccgccccccccguggugcccggccugcccgcccuggcccccgccaagcccggcggccccggcagacccagagaccccaacaccugcuucuucgagggccagcagagaccccacggcgccagaugggcccccaacuacgacccccugugcagccugugcaccugccagagaagaaccgugaucugcgaccccguggugugccccccccccagcugcccccaccccgugcaggcccccgaccagugcugccccgugugccccgagaagcaggacgugagagaccugcccggccugcccagaagcagagaccccggcgagggcugcuacuucgacggcgacagaagcuggagagccgccggcaccagauggcaccccguggugccccccuucggccugaucaagugcgccgugugcaccugcaagggcggcaccggcgaggugcacugcgagaaggugcagugccccagacuggccugcgcccagcccgugagagugaaccccaccgacugcugcaagcagugccccgugggcagcggcgcccacccccagcugggcgaccccaugcaggccgacggccccagaggcugcagauucgccggccagugguuccccgagagccagagcuggcaccccagcgugccccccuucggcgagaugagcugcaucaccugcagaugcggcgccggcgugccccacugcgagagagacgacugcagccugccccugagcugcggcagcggcaaggagagcagaugcugcagcagaugcaccgcccacagaagaccccccgagaccagaaccgaccccgagcuggagaaggaggccgagggcagcuaa

SEQ ID NO: 15209 - RNA, 1137 nt, Artificial Sequence
  CHRDL1__Homo_sapiens__NP_001137455
augagaaagaaguggaagaugggcggcaugaaguacaucuucagccugcuguucuuccugcugcuggagggcggcaagaccgagcaggugaagcacagcgagaccuacugcauguuccaggacaagaaguacagagugggcgagagauggcaccccuaccuggagcccuacggccugguguacugcgugaacugcaucugcagcgagaacggcaacgugcugugcagcagagugagaugccccaacgugcacugccugagccccgugcacaucccccaccugugcugccccagaugccccggcgacggcgagcugagcugggagcacagcgacggcgacaucuucagacagcccgccaacagagaggccagacacagcuaccacagaagccacuacgaccccccccccagcagacaggccggcggccugagcagauuccccggcgccagaagccacagaggcgcccugauggacagccagcaggccagcggcaccaucgugcagaucgugaucaacaacaagcacaagcacggccaggugugcgugagcaacggcaagaccuacagccacggcgagagcuggcaccccaaccugagagccuucggcaucguggagugcgugcugugcaccugcaacgugaccaagcaggagugcaagaagauccacugccccaacagauaccccugcaaguacccccagaagaucgacggcaagugcugcaaggugugccccggcaagaaggccaaggaggagcugcccggccagagcuucgacaacaagggcuacuucugcggcgaggagaccaugcccguguacgagagcguguucauggaggacggcgagaccaccagaaagaucgcccuggagaccgagagacccccccagguggaggugcacguguggaccaucagaaagggcauccugcagcacuuccacaucgagaagaucagcaagagaauguucgaggagcugccccacuucaagcuggugaccagaaccacccugagccaguggaagaucuucaccgagggcgaggcccagaucagccagaugugcagcagcagagugugcagaaccgagcuggaggaccuggugaaggugcuguaccuggagagaagcgagaagggccacugcuaa

SEQ ID NO: 15210 - RNA, 1239 nt, Artificial Sequence
  CHRFAM7A__Homo_sapiens__XP_011520455
augcagaaguacugcaucuaccagcacuuccaguuccagcugcugauccagcaccuguggaucgccgccaacugcgacaucgccgacgagagauucgacgccaccuuccacaccaacgugcuggugaacagcagcggccacugccaguaccugccccccggcaucuucaagagcagcugcuacaucgacgugagaugguuccccuucgacgugcagcacugcaagcugaaguucggcagcuggagcuacggcggcuggagccuggaccugcagaugcaggaggccgacaucagcggcuacauccccaacggcgagugggaccuggugggcauccccggcaagagaagcgagagauucuacgagugcugcaaggagcccuaccccgacgugaccuucaccgugaccaugagaagaagaacccuguacuacggccugaaccugcugauccccugcgugcugaucagcgcccuggcccugcugguguuccugcugcccgccgacagcggcgagaagaucagccugggcaucaccgugcugcugagccugaccguguucaugcugcugguggccgagaucaugcccgccaccagcgacagcgugccccugaucgcccaguacuucgccagcaccaugaucaucgugggccugagcgugguggugaccgugaucgugcugcaguaccaccaccacgaccccgacggcggcaagaugcccaaguggaccagagugauccugcugaacuggugcgccugguuccugagaaugaagagacccggcgaggacaaggugagacccgccugccagcacaagcagagaagaugcagccuggccagcguggagaugagcgccguggcccccccccccgccagcaacggcaaccugcuguacaucggcuucagaggccuggacggcgugcacugcgugcccacccccgacagcggcguggugugcggcagaauggccugcagccccacccacgacgagcaccugcugcacggcggccagccccccgagggcgaccccgaccuggccaagauccuggaggaggugagauacaucgccaacagauucagaugccaggacgagagcgaggccgugugcagcgaguggaaguucgccgccugcgugguggacagacugugccugauggccuucagcguguucaccaucaucugcaccaucggcauccugaugagcgcccccaacuucguggaggccgugagcaaggacuucgccuaa

SEQ ID NO: 15211 - RNA, 1383 nt, Artificial Sequence
  CHRM1__Homo_sapiens__XP_011543044
augaacaccagcgccccccccgccgugagccccaacaucaccgugcuggcccccggcaagggccccuggcagguggccuucaucggcaucaccaccggccugcugagccuggccaccgugaccggcaaccugcuggugcugaucagcuucaaggugaacaccgagcugaagaccgugaacaacuacuuccugcugagccuggccugcgccgaccugaucaucggcaccuucagcaugaaccuguacaccaccuaccugcugaugggccacugggcccugggcacccuggccugcgaccuguggcuggcccuggacuacguggccagcaacgccagcgugaugaaccugcugcugaucagcuucgacagauacuucagcgugaccagaccccugagcuacagagccaagagaacccccagaagagccgcccugaugaucggccuggccuggcuggugagcuucgugcugugggcccccgccauccuguucuggcaguaccuggugggcgagagaaccgugcuggccggccagugcuacauccaguuccugagccagcccaucaucaccuucggcaccgccauggccgccuucuaccugcccgugaccgugaugugcacccuguacuggagaaucuacagagagaccgagaacagagccagagagcuggccgcccugcagggcagcgagacccccggcaagggcggcggcagcagcagcagcagcgagagaagccagcccggcgccgagggcagccccgagaccccccccggcagaugcugcagaugcugcagagcccccagacugcugcaggccuacagcuggaaggaggaggaggaggaggacgagggcagcauggagagccugaccagcagcgagggcgaggagcccggcagcgagguggugaucaagaugcccaugguggaccccgaggcccaggcccccaccaagcagccccccagaagcagccccaacaccgugaagagacccaccaagaagggcagagacagagccggcaagggccagaagcccagaggcaaggagcagcuggccaagagaaagaccuucagccuggugaaggagaagaaggccgccagaacccugagcgccauccugcuggccuucauccugaccuggacccccuacaacaucauggugcuggugagcaccuucugcaaggacugcgugcccgagacccugugggagcugggcuacuggcugugcuacgugaacagcaccaucaaccccaugugcuacgcccugugcaacaaggccuucagagacaccuucagacugcugcugcugugcagaugggacaagagaagauggagaaagauccccaagagacccggcagcgugcacagaacccccagcagacagugcuaa

SEQ ID NO: 15212 - RNA, 1401 nt, Artificial Sequence
  CHRM2__Homo_sapiens__XP_011514073
augaacaacagcaccaacagcagcaacaacagccuggcccugaccagccccuacaagaccuucgaggugguguucaucgugcugguggccggcagccugagccuggugaccaucaucggcaacauccuggugauggugagcaucaaggugaacagacaccugcagaccgugaacaacuacuuccuguucagccuggccugcgccgaccugaucaucggcguguucagcaugaaccuguacacccuguacaccgugaucggcuacuggccccugggccccguggugugcgaccuguggcuggcccuggacuacguggugagcaacgccagcgugaugaaccugcugaucaucagcuucgacagauacuucugcgugaccaagccccugaccuaccccgugaagagaaccaccaagauggccggcaugaugaucgccgccgccugggugcugagcuucauccugugggcccccgccauccuguucuggcaguucaucgugggcgugagaaccguggaggacggcgagugcuacauccaguucuucagcaacgccgccgugaccuucggcaccgccaucgccgccuucuaccugcccgugaucaucaugaccgugcuguacuggcacaucagcagagccagcaagagcagaaucaagaaggacaagaaggagcccguggccaaccaggaccccgugagccccagccuggugcagggcagaaucgugaagcccaacaacaacaacaugcccagcagcgacgacggccuggagcacaacaagauccagaacggcaaggcccccagagaccccgugaccgagaacugcgugcagggcgaggagaaggagagcagcaacgacagcaccagcgugagcgccguggccagcaacaugagagacgacgagaucacccaggacgagaacaccgugagcaccagccugggccacagcaaggacgagaacagcaagcagaccugcaucagaaucggcaccaagacccccaagagcgacagcugcacccccaccaacaccaccguggagguggugggcagcagcggccagaacggcgacgagaagcagaacaucguggccagaaagaucgugaagaugaccaagcagcccgccaagaagaagcccccccccagcagagagaagaaggugaccagaaccauccuggccauccugcuggccuucaucaucaccugggcccccuacaacgugauggugcugaucaacaccuucugcgcccccugcauccccaacaccguguggaccaucggcuacuggcugugcuacaucaacagcaccaucaaccccgccugcuacgcccugugcaacgccaccuucaagaagaccuucaagcaccugcugaugugccacuacaagaacaucggcgccaccagauaa

SEQ ID NO: 15213 - RNA, 1773 nt, Artificial Sequence
  CHRM3__Homo_sapiens__NP_000731
augacccugcacaacaacagcaccaccagcccccuguuccccaacaucagcagcagcuggauccacagccccagcgacgccggccugccccccggcaccgugacccacuucggcagcuacaacgugagcagagccgccggcaacuucagcagccccgacggcaccaccgacgacccccugggcggccacaccguguggcaggugguguucaucgccuuccugaccggcauccuggcccuggugaccaucaucggcaacauccuggugaucgugagcuucaaggugaacaagcagcugaagaccgugaacaacuacuuccugcugagccuggccugcgccgaccugaucaucggcgugaucagcaugaaccuguucaccaccuacaucaucaugaacagaugggcccugggcaaccuggccugcgaccuguggcuggccaucgacuacguggccagcaacgccagcgugaugaaccugcuggugaucagcuucgacagauacuucagcaucaccagaccccugaccuacagagccaagagaaccaccaagagagccggcgugaugaucggccuggccugggugaucagcuucgugcugugggcccccgccauccuguucuggcaguacuucgugggcaagagaaccgugccccccggcgagugcuucauccaguuccugagcgagcccaccaucaccuucggcaccgccaucgccgccuucuacaugcccgugaccaucaugaccauccuguacuggagaaucuacaaggagaccgagaagagaaccaaggagcuggccggccugcaggccagcggcaccgaggccgagaccgagaacuucgugcaccccaccggcagcagcagaagcugcagcagcuacgagcugcagcagcagagcaugaagagaagcaacagaagaaaguacggcagaugccacuucugguucaccaccaagagcuggaagcccagcagcgagcagauggaccaggaccacagcagcagcgacagcuggaacaacaacgacgccgccgccagccuggagaacagcgccagcagcgacgaggaggacaucggcagcgagaccagagccaucuacagcaucgugcugaagcugcccggccacagcaccauccugaacagcaccaagcugcccagcagcgacaaccugcaggugcccgaggaggagcugggcaugguggaccuggagagaaaggccgacaagcugcaggcccagaagagcguggacgacggcggcagcuuccccaagagcuucagcaagcugcccauccagcuggagagcgccguggacaccgccaagaccagcgacgugaacagcagcgugggcaagagcaccgccacccugccccugagcuucaaggaggccacccuggccaagagauucgcccugaagaccagaagccagaucaccaagagaaagagaaugagccuggugaaggagaagaaggccgcccagacccugagcgccauccugcuggccuucaucaucaccuggacccccuacaacaucauggugcuggugaacaccuucugcgacagcugcauccccaagaccuucuggaaccugggcuacuggcugugcuacaucaacagcaccgugaaccccgugugcuacgcccugugcaacaagaccuucagaaccaccuucaagaugcugcugcugugccagugcgacaagaagaagagaagaaagcagcaguaccagcagagacagagcgugaucuuccacaagagagcccccgagcaggcccuguaa

SEQ ID NO: 15214 - RNA, 1440 nt, Artificial Sequence
  CHRM4__Homo_sapiens__NP_000732
auggccaacuucacccccgugaacggcagcagcggcaaccagagcgugagacuggugaccagcagcagccacaacagauacgagaccguggagaugguguucaucgccaccgugaccggcagccugagccuggugaccguggugggcaacauccuggugaugcugagcaucaaggugaacagacagcugcagaccgugaacaacuacuuccuguucagccuggccugcgccgaccugaucaucggcgccuucagcaugaaccuguacaccguguacaucaucaagggcuacuggccccugggcgccguggugugcgaccuguggcuggcccuggacuacguggugagcaacgccagcgugaugaaccugcugaucaucagcuucgacagauacuucugcgugaccaagccccugaccuaccccgccagaagaaccaccaagauggccggccugaugaucgccgccgccugggugcugagcuucgugcugugggcccccgccauccuguucuggcaguucguggugggcaagagaaccgugcccgacaaccagugcuucauccaguuccugagcaaccccgccgugaccuucggcaccgccaucgccgccuucuaccugcccguggugaucaugaccgugcuguacauccacaucagccuggccagcagaagcagagugcacaagcacagacccgagggccccaaggagaagaaggccaagacccuggccuuccugaagagcccccugaugaagcagagcgugaagaagcccccccccggcgaggccgccagagaggagcugagaaacggcaagcuggaggaggcccccccccccgcccugccccccccccccagacccguggccgacaaggacaccagcaacgagagcagcagcggcagcgccacccagaacaccaaggagagacccgccaccgagcugagcaccaccgaggccaccacccccgccaugcccgcccccccccugcagcccagagcccugaaccccgccagcagauggagcaagauccagaucgugaccaagcagaccggcaacgagugcgugaccgccaucgagaucgugcccgccacccccgccggcaugagacccgccgccaacguggccagaaaguucgccagcaucgccagaaaccaggugagaaagaagagacagauggccgccagagagagaaaggugaccagaaccaucuucgccauccugcuggccuucauccugaccuggacccccuacaacgugauggugcuggugaacaccuucugccagagcugcauccccgacaccguguggagcaucggcuacuggcugugcuacgugaacagcaccaucaaccccgccugcuacgcccugugcaacgccaccuucaagaagaccuucagacaccugcugcugugccaguacagaaacaucggcaccgccagauaa

SEQ ID NO: 15215 - RNA, 1599 nt, Artificial Sequence
  CHRM5__Homo_sapiens__XP_005254198
auggagggcgacagcuaccacaacgccaccaccgugaacggcacccccgugaaccaccagccccuggagagacacagacugugggaggugaucaccaucgccgccgugaccgccguggugagccugaucaccaucgugggcaacgugcuggugaugaucagcuucaaggugaacagccagcugaagaccgugaacaacuacuaccugcugagccuggccugcgccgaccugaucaucggcaucuucagcaugaaccuguacaccaccuacauccugaugggcagaugggcccugggcagccuggccugcgaccuguggcuggcccuggacuacguggccagcaacgccagcgugaugaaccugcuggugaucagcuucgacagauacuucagcaucaccagaccccugaccuacagagccaagagaacccccaagagagccggcaucaugaucggccuggccuggcugaucagcuucauccugugggcccccgccauccugugcuggcaguaccuggugggcaagagaaccgugccccuggacgagugccagauccaguuccugagcgagcccaccaucaccuucggcaccgccaucgccgccuucuacauccccgugagcgugaugaccauccuguacugcagaaucuacagagagaccgagaagagaaccaaggaccuggccgaccugcagggcagcgacagcgugaccaaggccgagaagagaaagcccgcccacagagcccuguucagaagcugccugagaugccccagacccacccuggcccagagagagagaaaccaggccagcuggagcagcagcagaagaagcaccagcaccaccggcaagcccagccaggccaccggccccagcgccaacugggccaaggccgagcagcugaccaccugcagcagcuaccccagcagcgaggacgaggacaagcccgccaccgaccccgugcugcaggugguguacaagagccagggcaaggagagccccggcgaggaguucagcgccgaggagaccgaggagaccuucgugaaggccgagaccgagaagagcgacuacgacacccccaacuaccugcugagccccgccgccgcccacagacccaagagccagaagugcguggccuacaaguucagacugguggugaaggccgacggcaaccaggagaccaacaacggcugccacaaggugaagaucaugcccugccccuuccccguggccaaggagcccagcaccaagggccugaaccccaaccccagccaccagaugaccaagagaaagagaguggugcuggugaaggagagaaaggccgcccagacccugagcgccauccugcuggccuucaucaucaccuggacccccuacaacaucauggugcuggugagcaccuucugcgacaagugcgugcccgugacccuguggcaccugggcuacuggcugugcuacgugaacagcaccgugaaccccaucugcuacgcccugugcaacagaaccuucagaaagaccuucaagaugcugcugcugugcagauggaagaagaagaagguggaggagaagcuguacuggcagggcaacagcaagcugcccuaa

SEQ ID NO: 15216 - RNA, 1353 nt, Artificial Sequence
  CHRNA10__Homo_sapiens__NP_065135
augggccugagaagccaccaccugagccugggccugcugcugcuguuccugcugcccgccgagugccugggcgccgagggcagacuggcccugaagcuguucagagaccuguucgccaacuacaccagcgcccugagacccguggccgacaccgaccagacccugaacgugacccuggaggugacccugagccagaucaucgacauggacgagagaaaccaggugcugacccuguaccuguggaucagacaggaguggaccgacgccuaccugagaugggaccccaacgccuacggcggccuggacgccaucagaauccccagcagccugguguggagacccgacaucgugcuguacaacaaggccgacgcccagccccccggcagcgccagcaccaacguggugcugagacacgacggcgccgugagaugggacgcccccgccaucaccagaagcagcugcagaguggacguggccgccuuccccuucgacgcccagcacugcggccugaccuucggcagcuggacccacggcggccaccagcuggacgugagacccagaggcgccgccgccagccuggccgacuucguggagaacguggaguggagagugcugggcaugcccgccagaagaagagugcugaccuacggcugcugcagcgagcccuaccccgacgugaccuucacccugcugcugagaagaagagccgccgccuacgugugcaaccugcugcugcccugcgugcugaucagccugcuggccccccuggccuuccaccugcccgccgacagcggcgagaaggugagccugggcgugaccgugcugcuggcccugaccguguuccagcugcugcuggccgagagcaugccccccgccgagagcgugccccugaucggcaaguacuacauggccaccaugaccauggugaccuucagcaccgcccugaccauccugaucaugaaccugcacuacugcggccccagcgugagacccgugcccgccugggccagagcccugcugcugggccaccuggccagaggccugugcgugagagagagaggcgagcccugcggccagagcagaccccccgagcugagccccagcccccagagccccgagggcggcgccggcccccccgccggccccugccacgagcccagaugccugugcagacaggaggcccugcugcaccacguggccaccaucgccaacaccuucagaagccacagagccgcccagagaugccacgaggacuggaagagacuggccagagugauggacagauucuuccuggccaucuucuucagcauggcccuggugaugagccugcuggugcuggugcaggcccuguaa

SEQ ID NO: 15217 - RNA, 1374 nt, Artificial Sequence
  CHRNA1__Homo_sapiens__NP_000070
auggagcccuggccccugcugcugcuguucagccugugcagcgccggccuggugcugggcagcgagcacgagaccagacugguggccaagcuguucaaggacuacagcagcguggugagacccguggaggaccacagacaggugguggaggugaccgugggccugcagcugauccagcugaucaacguggacgaggugaaccagaucgugaccaccaacgugagacugaagcagcaguggguggacuacaaccugaaguggaaccccgacgacuacggcggcgugaagaagauccacauccccagcgagaagaucuggagacccgaccuggugcuguacaacaacgccgacggcgacuucgccaucgugaaguucaccaaggugcugcugcaguacaccggccacaucaccuggaccccccccgccaucuucaagagcuacugcgagaucaucgugacccacuuccccuucgacgagcagaacugcagcaugaagcugggcaccuggaccuacgacggcagcgugguggccaucaaccccgagagcgaccagcccgaccugagcaacuucauggagagcggcgagugggugaucaaggagagcagaggcuggaagcacagcgugaccuacagcugcugccccgacacccccuaccuggacaucaccuaccacuucgugaugcagagacugccccuguacuucaucgugaacgugaucauccccugccugcuguucagcuuccugaccggccugguguucuaccugcccaccgacagcggcgagaagaugacccugagcaucagcgugcugcugagccugaccguguuccugcuggugaucguggagcugauccccagcaccagcagcgccgugccccugaucggcaaguacaugcuguucaccaugguguucgugaucgccagcaucaucaucaccgugaucgugaucaacacccaccacagaagccccagcacccacgugaugcccaacugggugagaaagguguucaucgacaccauccccaacaucauguucuucagcaccaugaagagacccagcagagagaagcaggacaagaagaucuucaccgaggacaucgacaucagcgacaucagcggcaagcccggccccccccccaugggcuuccacagcccccugaucaagcaccccgaggugaagagcgccaucgagggcaucaaguacaucgccgagaccaugaagagcgaccaggagagcaacaacgccgccgccgaguggaaguacguggccauggugauggaccacauccugcugggcguguucaugcuggugugcaucaucggcacccuggccguguucgccggcagacugaucgagcugaaccagcagggcuaa

SEQ ID NO: 15218 - RNA, 1590 nt, Artificial Sequence
  CHRNA2__Homo_sapiens__NP_000733
augggccccagcugccccguguuccugagcuucaccaagcugagccugugguggcugcugcugacccccgccggcggcgaggaggccaagagacccccccccagagcccccggcgacccccugagcagccccagccccaccgcccugccccagggcggcagccacaccgagaccgaggacagacuguucaagcaccuguucagaggcuacaacagaugggccagacccgugcccaacaccagcgacguggugaucgugagauucggccugagcaucgcccagcugaucgacguggacgagaagaaccagaugaugaccaccaacguguggcugaagcaggaguggagcgacuacaagcugagauggaaccccaccgacuucggcaacaucaccagccugagagugcccagcgagaugaucuggauccccgacaucgugcuguacaacaacgccgacggcgaguucgccgugacccacaugaccaaggcccaccuguucagcaccggcaccgugcacugggugccccccgccaucuacaagagcagcugcagcaucgacgugaccuucuuccccuucgaccagcagaacugcaagaugaaguucggcagcuggaccuacgacaaggccaagaucgaccuggagcagauggagcagaccguggaccugaaggacuacugggagagcggcgagugggccaucgugaacgccaccggcaccuacaacagcaagaaguacgacugcugcgccgagaucuaccccgacgugaccuacgccuucgugaucagaagacugccccuguucuacaccaucaaccugaucauccccugccugcugaucagcugccugaccgugcugguguucuaccugcccagcgacugcggcgagaagaucacccugugcaucagcgugcugcugagccugaccguguuccugcugcugaucaccgagaucauccccagcaccagccuggugaucccccugaucggcgaguaccugcuguucaccaugaucuucgugacccugagcaucgugaucaccguguucgugcugaacgugcaccacagaagccccagcacccacaccaugccccacugggugagaggcgcccugcugggcugcgugcccagauggcugcugaugaacagaccccccccccccguggagcugugccacccccugagacugaagcugagccccagcuaccacuggcuggagagcaacguggacgccgaggagagagagguggugguggaggaggaggacagaugggccugcgccggccacguggcccccagcgugggcacccugugcagccacggccaccugcacagcggcgccagcggccccaaggccgaggcccugcugcaggagggcgagcugcugcugagcccccacaugcagaaggcccuggagggcgugcacuacaucgccgaccaccugagaagcgaggacgccgacagcagcgugaaggaggacuggaaguacguggccauggugaucgacagaaucuuccuguggcuguucaucaucgugugcuuccugggcaccaucggccuguuccugccccccuuccuggccggcaugaucuaa

SEQ ID NO: 15219 - RNA, 1518 nt, Artificial Sequence
  CHRNA3__Homo_sapiens__NP_000734
augggcagcggcccccugagccugccccuggcccugagcccccccagacugcugcugcugcugcugcugagccugcugcccguggccagagccagcgaggccgagcacagacuguucgagagacuguucgaggacuacaacgagaucaucagacccguggccaacgugagcgaccccgugaucauccacuucgaggugagcaugagccagcuggugaagguggacgaggugaaccagaucauggagaccaaccuguggcugaagcagaucuggaacgacuacaagcugaaguggaaccccagcgacuacggcggcgccgaguucaugagagugcccgcccagaagaucuggaagcccgacaucgugcuguacaacaacgccgugggcgacuuccagguggacgacaagaccaaggcccugcugaaguacaccggcgaggugaccuggaucccccccgccaucuucaagagcagcugcaagaucgacgugaccuacuuccccuucgacuaccagaacugcaccaugaaguucggcagcuggagcuacgacaaggccaagaucgaccuggugcugaucggcagcagcaugaaccugaaggacuacugggagagcggcgagugggccaucaucaaggcccccggcuacaagcacgacaucaaguacaacugcugcgaggagaucuaccccgacaucaccuacagccuguacaucagaagacugccccuguucuacaccaucaaccugaucauccccugccugcugaucagcuuccugaccgugcugguguucuaccugcccagcgacugcggcgagaaggugacccugugcaucagcgugcugcugagccugaccguguuccugcuggugaucaccgagaccauccccagcaccagccuggugaucccccugaucggcgaguaccugcuguucaccaugaucuucgugacccugagcaucgugaucaccguguucgugcugaacgugcacuacagaacccccaccacccacaccaugcccagcugggugaagaccguguuccugaaccugcugcccagagugauguucaugaccagacccaccagcaacgagggcaacgcccagaagcccagaccccuguacggcgccgagcugagcaaccugaacugcuucagcagagccgagagcaagggcugcaaggagggcuaccccugccaggacggcaugugcggcuacugccaccacagaagaaucaagaucagcaacuucagcgccaaccugaccagaagcagcagcagcgagagcguggacgccgugcugagccugagcgcccugagccccgagaucaaggaggccauccagagcgugaaguacaucgccgagaacaugaaggcccagaacgaggccaaggagauccaggacgacuggaaguacguggccauggugaucgacagaaucuuccuguggguguucacccuggugugcauccugggcaccgccggccuguuccugcagccccugauggccagagaggacgccuaa

SEQ ID NO: 15220 - RNA, 1884 nt, Artificial Sequence
  CHRNA4__Homo_sapiens__NP_000735
auggagcugggcggccccggcgcccccagacugcugcccccccugcugcugcugcugggcaccggccugcugagagccagcagccacguggagaccagagcccacgccgaggagagacugcugaagaagcuguucagcggcuacaacaaguggagcagacccguggccaacaucagcgacguggugcuggugagauucggccugagcaucgcccagcugaucgacguggacgagaagaaccagaugaugaccaccaacgugugggugaagcaggaguggcacgacuacaagcugagaugggaccccgccgacuacgagaacgugaccagcaucagaauccccagcgagcugaucuggagacccgacaucgugcuguacaacaacgccgacggcgacuucgccgugacccaccugaccaaggcccaccuguuccacgacggcagagugcaguggaccccccccgccaucuacaagagcagcugcagcaucgacgugaccuucuuccccuucgaccagcagaacugcaccaugaaguucggcagcuggaccuacgacaaggccaagaucgaccuggugaacaugcacagcagaguggaccagcuggacuucugggagagcggcgagugggugaucguggacgccgugggcaccuacaacaccagaaaguacgagugcugcgccgagaucuaccccgacaucaccuacgccuucgugaucagaagacugccccuguucuacaccaucaaccugaucauccccugccugcugaucagcugccugaccgugcugguguucuaccugcccagcgagugcggcgagaagaucacccugugcaucagcgugcugcugagccugaccguguuccugcugcugaucaccgagaucauccccagcaccagccuggugaucccccugaucggcgaguaccugcuguucaccaugaucuucgugacccugagcaucgugaucaccguguucgugcugaacgugcaccacagaagccccagaacccacaccaugcccaccugggugagaagaguguuccuggacaucgugcccagacugcugcugaugaagagacccagcguggugaaggacaacugcagaagacugaucgagagcaugcacaagauggccagcgcccccagauucuggcccgagcccgagggcgagccccccgccaccagcggcacccagagccugcacccccccagccccagcuucugcgugccccuggacgugcccgccgagcccggccccagcugcaagagccccagcgaccagcugcccccccagcagccccuggaggccgagaaggccagcccccaccccagccccggccccugcagacccccccacggcacccaggcccccggccuggccaaggccagaagccugagcgugcagcacaugagcagccccggcgaggccguggagggcggcgugagaugcagaagcagaagcauccaguacugcgugcccagagacgacgccgcccccgaggccgacggccaggccgccggcgcccuggccagcagaaacacccacagcgccgagcugcccccccccgaccagcccagccccugcaagugcaccugcaagaaggagcccagcagcgugagccccagcgccaccgugaagaccagaagcaccaaggccccccccccccaccugccccugagccccgcccugaccagagccguggagggcgugcaguacaucgccgaccaccugaaggccgaggacaccgacuucagcgugaaggaggacuggaaguacguggccauggugaucgacagaaucuuccuguggauguucaucaucgugugccugcugggcaccgugggccuguuccugccccccuggcuggccggcaugaucuaa

SEQ ID NO: 15221 - RNA, 1407 nt, Artificial Sequence
  CHRNA5__Homo_sapiens__NP_000736
auggccgccagaggcagcggccccagagcccugagacugcugcugcuggugcagcugguggccggcagaugcggccuggccggcgccgccggcggcgcccagagaggccugagcgagcccagcagcaucgccaagcacgaggacagccugcugaaggaccuguuccaggacuacgagagaugggugagacccguggagcaccugaacgacaagaucaagaucaaguucggccuggccaucagccagcugguggacguggacgagaagaaccagcugaugaccaccaacguguggcugaagcaggaguggaucgacgugaagcugagauggaaccccgacgacuacggcggcaucaaggugaucagagugcccagcgacagcguguggacccccgacaucgugcuguucgacaacgccgacggcagauucgagggcaccagcaccaagaccgugaucagauacaacggcaccgugaccuggaccccccccgccaacuacaagagcagcugcaccaucgacgugaccuucuuccccuucgaccugcagaacugcagcaugaaguucggcagcuggaccuacgacggcagccagguggacaucauccuggaggaccaggacguggacaagagagacuucuucgacaacggcgagugggagaucgugagcgccaccggcagcaagggcaacagaaccgacagcugcugcugguaccccuacgugaccuacagcuucgugaucaagagacugccccuguucuacacccuguuccugaucauccccugcaucggccugagcuuccugaccgugcugguguucuaccugcccagcaacgagggcgagaagaucugccugugcaccagcgugcuggugagccugaccguguuccugcuggugaucgaggagaucauccccagcagcagcaaggugaucccccugaucggcgaguaccugguguucaccaugaucuucgugacccugagcaucauggugaccguguucgccaucaacauccaccacagaagcagcagcacccacaacgccauggccccccuggugagaaagaucuuccugcacacccugcccaagcugcugugcaugagaagccacguggacagauacuucacccagaaggaggagaccgagagcggcagcggccccaagagcagcagaaacacccuggaggccgcccuggacagcaucagauacaucaccagacacaucaugaaggagaacgacgugagagaggugguggaggacuggaaguucaucgcccaggugcuggacagaauguuccuguggaccuuccuguucgugagcaucgugggcagccugggccuguucgugcccgugaucuacaagugggccaacauccugauccccgugcacaucggcaacgccaacaaguaa

SEQ ID NO: 15222 - RNA, 1440 nt, Artificial Sequence
  CHRNA6__Homo_sapiens__NP_001186208
augcugaccagcaagggccagggcuuccugcacggcggccugugccuguggcugugcguguucacccccuucuucaagggcugcgugggcugcgccaccgaggagagacuguuccacaagcuguucagccacuacaaccaguucaucagacccguggagaacgugagcgaccccgugaccgugcacuucgagguggccaucacccagcuggccaacgugaucuggaacgacuacaagcugagaugggaccccauggaguacgacggcaucgagacccugagagugcccgccgacaagaucuggaagcccgacaucgugcuguacaacaacgccgugggcgacuuccagguggagggcaagaccaaggcccugcugaaguacaacggcaugaucaccuggaccccccccgccaucuucaagagcagcugccccauggacaucaccuucuuccccuucgaccaccagaacugcagccugaaguucggcagcuggaccuacgacaaggccgagaucgaccugcugaucaucggcagcaagguggacaugaacgacuucugggagaacagcgagugggagaucaucgacgccagcggcuacaagcacgacaucaaguacaacugcugcgaggagaucuacaccgacaucaccuacagcuucuacaucagaagacugcccauguucuacaccaucaaccugaucauccccugccuguucaucagcuuccugaccgugcugguguucuaccugcccagcgacugcggcgagaaggugacccugugcaucagcgugcugcugagccugaccguguuccugcuggugaucaccgagaccauccccagcaccagccugguggugccccuggugggcgaguaccugcuguucaccaugaucuucgugacccugagcaucguggugaccguguucgugcugaacauccacuacagaacccccaccacccacaccaugcccagaugggugaagaccguguuccugaagcugcugccccaggugcugcugaugagauggccccuggacaagaccagaggcaccggcagcgacgccgugcccagaggccuggccagaagacccgccaagggcaagcuggccagccacggcgagcccagacaccugaaggagugcuuccacugccacaagagcaacgagcuggccaccagcaagagaagacugagccaccagccccugcagugggugguggagaacagcgagcacagccccgagguggaggacgugaucaacagcgugcaguucaucgccgagaacaugaagagccacaacgagaccaaggagguggaggacgacuggaaguacguggccauggugguggacagaguguuccuguggguguucaucaucgugugcguguucggcaccgccggccuguuccugcagccccugcugggcaacaccggcaagagcuaa

SEQ ID NO: 15223 - RNA, 1509 nt, Artificial Sequence
  CHRNA7__Homo_sapiens__NP_000737
augagaugcagccccggcggcguguggcuggcccuggccgccagccugcugcacgugagccugcagggcgaguuccagagaaagcuguacaaggagcuggugaagaacuacaacccccuggagagacccguggccaacgacagccagccccugaccguguacuucagccugagccugcugcagaucauggacguggacgagaagaaccaggugcugaccaccaacaucuggcugcagaugagcuggaccgaccacuaccugcaguggaacgugagcgaguaccccggcgugaagaccgugagauuccccgacggccagaucuggaagcccgacauccugcuguacaacagcgccgacgagagauucgacgccaccuuccacaccaacgugcuggugaacagcagcggccacugccaguaccugccccccggcaucuucaagagcagcugcuacaucgacgugagaugguuccccuucgacgugcagcacugcaagcugaaguucggcagcuggagcuacggcggcuggagccuggaccugcagaugcaggaggccgacaucagcggcuacauccccaacggcgagugggaccuggugggcauccccggcaagagaagcgagagauucuacgagugcugcaaggagcccuaccccgacgugaccuucaccgugaccaugagaagaagaacccuguacuacggccugaaccugcugauccccugcgugcugaucagcgcccuggcccugcugguguuccugcugcccgccgacagcggcgagaagaucagccugggcaucaccgugcugcugagccugaccguguucaugcugcugguggccgagaucaugcccgccaccagcgacagcgugccccugaucgcccaguacuucgccagcaccaugaucaucgugggccugagcgugguggugaccgugaucgugcugcaguaccaccaccacgaccccgacggcggcaagaugcccaaguggaccagagugauccugcugaacuggugcgccugguuccugagaaugaagagacccggcgaggacaaggugagacccgccugccagcacaagcagagaagaugcagccuggccagcguggagaugagcgccguggcccccccccccgccagcaacggcaaccugcuguacaucggcuucagaggccuggacggcgugcacugcgugcccacccccgacagcggcguggugugcggcagaauggccugcagccccacccacgacgagcaccugcugcacggcggccagccccccgagggcgaccccgaccuggccaagauccuggaggaggugagauacaucgccaacagauucagaugccaggacgagagcgaggccgugugcagcgaguggaaguucgccgccugcgugguggacagacugugccugauggccuucagcguguucaccaucaucugcaccaucggcauccugaugagcgcccccaacuucguggaggccgugagcaaggacuucgccuaa

SEQ ID NO: 15224 - RNA, 1506 nt, Artificial Sequence
  CHRNB1__Homo_sapiens__NP_000738
augacccccggcgcccugcugaugcugcugggcgcccugggcgccccccuggcccccggcgugagaggcagcgaggccgagggcagacugagagagaagcuguucagcggcuacgacagcagcgugagacccgccagagaggugggcgacagagugagagugagcgugggccugauccuggcccagcugaucagccugaacgagaaggacgaggagaugagcaccaagguguaccuggaccuggaguggaccgacuacagacugagcugggaccccgccgagcacgacggcaucgacagccugagaaucaccgccgagagcguguggcugcccgacguggugcugcugaacaacaacgacggcaacuucgacguggcccuggacaucagcgugguggugagcagcgacggcagcgugagauggcagccccccggcaucuacagaagcagcugcagcauccaggugaccuacuuccccuucgacuggcagaacugcaccaugguguucagcagcuacagcuacgacagcagcgaggugagccugcagaccggccugggccccgacggccagggccaccaggagauccacauccacgagggcaccuucaucgagaacggccagugggagaucauccacaagcccagcagacugauccagccccccggcgaccccagaggcggcagagagggccagagacaggaggugaucuucuaccugaucaucagaagaaagccccuguucuaccuggugaacgugaucgcccccugcauccugaucacccugcuggccaucuucguguucuaccugccccccgacgccggcgagaagaugggccugagcaucuucgcccugcugacccugaccguguuccugcugcugcuggccgacaaggugcccgagaccagccugagcgugcccaucaucaucaaguaccugauguucaccauggugcuggugaccuucagcgugauccugagcgugguggugcugaaccugcaccacagaagcccccacacccaccagaugccccugugggugagacagaucuucauccacaagcugccccuguaccugagacugaagagacccaagcccgagagagaccugaugcccgagcccccccacugcagcagccccggcagcggcuggggcagaggcaccgacgaguacuucaucagaaagccccccagcgacuuccuguuccccaagcccaacagauuccagcccgagcugagcgcccccgaccugagaagauucaucgacggccccaacagagccguggcccugcugcccgagcugagagagguggugagcagcaucagcuacaucgccagacagcugcaggagcaggaggaccacgacgcccugaaggaggacuggcaguucguggccauggugguggacagacuguuccuguggaccuucaucaucuucaccagcgugggcacccuggugaucuuccuggacgccaccuaccaccugcccccccccgaccccuuccccuaa

SEQ ID NO: 15225 - RNA, 1509 nt, Artificial Sequence
  CHRNB2__Homo_sapiens__NP_000739
auggccagaagaugcggccccguggcccugcugcugggcuucggccugcugagacugugcagcggcguguggggcaccgacaccgaggagagacugguggagcaccugcuggaccccagcagauacaacaagcugaucagacccgccaccaacggcagcgagcuggugaccgugcagcugauggugagccuggcccagcugaucagcgugcacgagagagagcagaucaugaccaccaacguguggcugacccaggagugggaggacuacagacugaccuggaagcccgaggaguucgacaacaugaagaaggugagacugcccagcaagcacaucuggcugcccgacguggugcuguacaacaacgccgacggcauguacgaggugagcuucuacagcaacgccguggugagcuacgacggcagcaucuucuggcugccccccgccaucuacaagagcgccugcaagaucgaggugaagcacuuccccuucgaccagcagaacugcaccaugaaguucagaagcuggaccuacgacagaaccgagaucgaccuggugcugaagagcgagguggccagccuggacgacuucacccccagcggcgagugggacaucguggcccugcccggcagaagaaacgagaaccccgacgacagcaccuacguggacaucaccuacgacuucaucaucagaagaaagccccuguucuacaccaucaaccugaucauccccugcgugcugaucaccagccuggccauccugguguucuaccugcccagcgacugcggcgagaagaugacccugugcaucagcgugcugcuggcccugaccguguuccugcugcugaucagcaagaucgugccccccaccagccuggacgugccccuggugggcaaguaccugauguucaccauggugcuggugaccuucagcaucgugaccagcgugugcgugcugaacgugcaccacagaagccccaccacccacaccauggcccccugggugaaggugguguuccuggagaagcugcccgcccugcuguucaugcagcagcccagacaccacugcgccagacagagacugagacugagaagaagacagagagagagagagggcgccggcgcccuguucuucagagaggcccccggcgccgacagcugcaccugcuucgugaacagagccagcgugcagggccuggccggcgccuucggcgccgagcccgcccccguggccggccccggcagaagcggcgagcccugcggcugcggccugagagaggccguggacggcgugagauucaucgccgaccacaugagaagcgaggacgacgaccagagcgugagcgaggacuggaaguacguggccauggugaucgacagacuguuccuguggaucuucguguucgugugcguguucggcaccaucggcauguuccugcagccccuguuccagaacuacaccaccaccaccuuccugcacagcgaccacagcgcccccagcagcaaguaa

SEQ ID NO: 15226 - RNA, 1377 nt, Artificial Sequence
  CHRNB3__Homo_sapiens__NP_000740
augcugcccgacuucaugcuggugcugaucgugcugggcauccccagcagcgccaccaccggcuucaacagcaucgccgagaacgaggacgcccugcugagacaccuguuccagggcuaccagaagugggugagacccgugcugcacagcaacgacaccaucaagguguacuucggccugaagaucagccagcugguggacguggacgagaagaaccagcugaugaccaccaacguguggcugaagcaggaguggaccgaccacaagcugagauggaaccccgacgacuacggcggcauccacagcaucaaggugcccagcgagagccuguggcugcccgacaucgugcuguucgagaacgccgacggcagauucgagggcagccugaugaccaaggugaucgugaagagcaacggcaccgugguguggaccccccccgccagcuacaagagcagcugcaccauggacgugaccuucuuccccuucgacagacagaacugcagcaugaaguucggcagcuggaccuacgacggcaccaugguggaccugauccugaucaacgagaacguggacagaaaggacuucuucgacaacggcgagugggagauccugaacgccaagggcaugaagggcaacagaagagacggcguguacagcuaccccuucaucaccuacagcuucgugcugagaagacugccccuguucuacacccuguuccugaucauccccugccugggccugagcuuccugaccgugcugguguucuaccugcccagcgacgagggcgagaagcugagccugagcaccagcgugcuggugagccugaccguguuccugcuggugaucgaggagaucauccccagcagcagcaaggugaucccccugaucggcgaguaccugcuguucaucaugaucuucgugacccugagcaucaucgugaccguguucgugaucaacgugcaccacagaagcagcagcaccuaccaccccauggcccccugggugaagagacuguuccugcagaagcugcccaagcugcugugcaugaaggaccacguggacagauacagcagccccgagaaggaggagagccagcccguggugaagggcaaggugcuggagaagaagaagcagaagcagcugagcgacggcgagaaggugcugguggccuuccuggagaaggccgccgacagcaucagauacaucagcagacacgugaagaaggagcacuucaucagccagguggugcaggacuggaaguucguggcccaggugcuggacagaaucuuccuguggcuguuccugaucgugagcgugaccggcagcgugcugaucuucacccccgcccugaagauguggcugcacagcuaccacuaa

SEQ ID NO: 15227 - RNA, 1497 nt, Artificial Sequence
  CHRNB4__Homo_sapiens__NP_000741
augagaagagcccccagccuggugcuguucuuccugguggcccugugcggcagaggcaacugcagaguggccaacgccgaggagaagcugauggacgaccugcugaacaagaccagauacaacaaccugaucagacccgccaccagcagcagccagcugaucagcaucaagcugcagcugagccuggcccagcugaucagcgugaacgagagagagcagaucaugaccaccaacguguggcugaagcaggaguggaccgacuacagacugaccuggaacagcagcagauacgagggcgugaacauccugagaauccccgccaagagaaucuggcugcccgacaucgugcuguacaacaacgccgacggcaccuacgaggugagcguguacaccaaccugaucgugagaagcaacggcagcgugcuguggcugccccccgccaucuacaagagcgccugcaagaucgaggugaaguacuuccccuucgaccagcagaacugcacccugaaguucagaagcuggaccuacgaccacaccgagaucgacauggugcugaugacccccaccgccagcauggacgacuucacccccagcggcgagugggacaucguggcccugcccggcagaagaaccgugaacccccaggaccccagcuacguggacgugaccuacgacuucaucaucaagagaaagccccuguucuacaccaucaaccugaucauccccugcgugcugaccacccugcuggccauccugguguucuaccugcccagcgacugcggcgagaagaugacccugugcaucagcgugcugcuggcccugaccuucuuccugcugcugaucagcaagaucgugccccccaccagccuggacgugccccugaucggcaaguaccugauguucaccauggugcuggugaccuucagcaucgugaccagcgugugcgugcugaacgugcaccacagaagccccagcacccacaccauggcccccugggugaagagaugcuuccugcacaagcugcccaccuuccuguucaugaagagacccggccccgacagcagccccgccagagccuucccccccagcaagagcugcgugaccaagcccgaggccaccgccaccagcaccagccccagcaacuucuacggcaacagcauguacuucgugaaccccgccagcgccgccagcaagagccccgccggcagcacccccguggccauccccagagacuucuggcugagaagcagcggcagauucagacaggacgugcaggaggcccuggagggcgugagcuucaucgcccagcacaugaagaacgacgacgaggaccagagcgugguggaggacuggaaguacguggccauggugguggacagacuguuccuguggguguucauguucgugugcgugcugggcaccgugggccuguuccugcccccccuguuccagacccacgccgccagcgagggccccuacgccgcccagagagacuaa

SEQ ID NO: 15228 - RNA, 1554 nt, Artificial Sequence
  CHRND__Homo_sapiens__NP_000742
auggagggccccgugcugacccugggccugcuggccgcccuggccgugugcggcagcuggggccugaacgaggaggagagacugaucagacaccuguuccaggagaagggcuacaacaaggagcugagacccguggcccacaaggaggagagcguggacguggcccuggcccugacccugagcaaccugaucagccugaaggagguggaggagacccugaccaccaacguguggaucgagcacggcuggaccgacaacagacugaaguggaacgccgaggaguucggcaacaucagcgugcugagacugccccccgacaugguguggcugcccgagaucgugcuggagaacaacaacgacggcagcuuccagaucagcuacagcugcaacgugcugguguaccacuacggcuucguguacuggcugccccccgccaucuucagaagcagcugccccaucagcgugaccuacuuccccuucgacuggcagaacugcagccugaaguucagcagccugaaguacaccgccaaggagaucacccugagccugaagcaggacgccaaggagaacagaaccuaccccguggaguggaucaucaucgaccccgagggcuucaccgagaacggcgagugggagaucgugcacagacccgccagagugaacguggaccccagagccccccuggacagccccagcagacaggacaucaccuucuaccugaucaucagaagaaagccccuguucuacaucaucaacauccuggugcccugcgugcugaucagcuucauggugaaccugguguucuaccugcccgccgacagcggcgagaagaccagcguggccaucagcgugcugcuggcccagagcguguuccugcugcugaucagcaagagacugcccgccaccagcauggccaucccccugaucggcaaguuccugcuguucggcauggugcuggugaccauggugguggugaucugcgugaucgugcugaacauccacuucagaacccccagcacccacgugcugagcgagggcgugaagaagcuguuccuggagacccugcccgagcugcugcacaugagcagacccgccgaggacggccccagccccggcgcccuggugagaagaagcagcagccugggcuacaucagcaaggccgaggaguacuuccugcugaagagcagaagcgaccugauguucgagaagcagagcgagagacacggccuggccagaagacugaccaccgccagaagaccccccgccagcagcgagcaggcccagcaggagcuguucaacgagcugaagcccgccguggacggcgccaacuucaucgugaaccacaugagagaccagaacaacuacaacgaggagaaggacagcuggaacagaguggccagaaccguggacagacugugccuguucguggugacccccgugaugguggugggcaccgccuggaucuuccugcagggcguguacaaccagccccccccccagcccuuccccggcgaccccuacagcuacaacgugcaggacaagagauucaucuaa

SEQ ID NO: 15229 - RNA, 1482 nt, Artificial Sequence
  CHRNE__Homo_sapiens__NP_000071
auggccagagccccccugggcgugcugcugcugcugggccugcugggcagaggcgugggcaagaacgaggagcugagacuguaccaccaccuguucaacaacuacgaccccggcagcagacccgugagagagcccgaggacaccgugaccaucagccugaaggugacccugaccaaccugaucagccugaacgagaaggaggagacccugaccaccagcguguggaucggcaucgacuggcaggacuacagacugaacuacagcaaggacgacuucggcggcaucgagacccugagagugcccagcgagcugguguggcugcccgagaucgugcuggagaacaacaucgacggccaguucggcguggccuacgacgccaacgugcugguguacgagggcggcagcgugaccuggcugccccccgccaucuacagaagcgugugcgccguggaggugaccuacuuccccuucgacuggcagaacugcagccugaucuucagaagccagaccuacaacgccgaggagguggaguucaccuucgccguggacaacgacggcaagaccaucaacaagaucgacaucgacaccgaggccuacaccgagaacggcgagugggccaucgacuucugccccggcgugaucagaagacaccacggcggcgccaccgacggccccggcgagaccgacgugaucuacagccugaucaucagaagaaagccccuguucuacgugaucaacaucaucgugcccugcgugcugaucagcggccuggugcugcuggccuacuuccugcccgcccaggccggcggccagaagugcaccgugagcaucaacgugcugcuggcccagaccguguuccuguuccugaucgcccagaagauccccgagaccagccugagcgugccccugcugggcagauuccugaucuucgugauggugguggccacccugaucgugaugaacugcgugaucgugcugaacgugagccagagaacccccaccacccacgccaugagccccagacugagacacgugcugcuggagcugcugcccagacugcugggcagcccccccccccccgaggcccccagagccgccagcccccccagaagagccagcagcgugggccugcugcugagagccgaggagcugauccugaagaagcccagaagcgagcugguguucgagggccagagacacagacagggcaccuggaccgccgccuucugccagagccugggcgccgccgcccccgaggugagaugcugcguggacgccgugaacuucguggccgagagcaccagagaccaggaggccaccggcgaggaggugagcgacugggugagaaugggcaacgcccuggacaacaucugcuucugggccgcccuggugcuguucagcgugggcagcagccugaucuuccugggcgccuacuucaacagagugcccgaccugcccuacgcccccugcauccagcccuaa

SEQ ID NO: 15230 - RNA, 1554 nt, Artificial Sequence
  CHRNG__Homo_sapiens__NP_005190
augcacggcggccagggcccccugcugcugcugcugcugcuggccgugugccugggcgcccagggcagaaaccaggaggagagacugcuggccgaccugaugcagaacuacgaccccaaccugagacccgccgagagagacagcgacguggugaacgugagccugaagcugacccugaccaaccugaucagccugaacgagagagaggaggcccugaccaccaacguguggaucgagaugcaguggugcgacuacagacugagaugggaccccagagacuacgagggccugugggugcugagagugcccagcaccaugguguggagacccgacaucgugcuggagaacaacguggacggcguguucgagguggcccuguacugcaacgugcuggugagccccgacggcugcaucuacuggcugccccccgccaucuucagaagcgccugcagcaucagcgugaccuacuuccccuucgacuggcagaacugcagccugaucuuccagagccagaccuacagcaccaacgagaucgaccugcagcugagccaggaggacggccagaccaucgaguggaucuucaucgaccccgaggccuucaccgagaacggcgagugggccauccagcacagacccgccaagaugcugcuggaccccgccgcccccgcccaggaggccggccaccagaaggugguguucuaccugcugauccagagaaagccccuguucuacgugaucaacaucaucgcccccugcgugcugaucagcagcguggccauccugauccacuuccugcccgccaaggccggcggccagaagugcaccguggccaucaacgugcugcuggcccagaccguguuccuguuccugguggccaagaaggugcccgagaccagccaggccgugccccugaucagcaaguaccugaccuuccugcugguggugaccauccugaucguggugaacgccgugguggugcugaacgugagccugagaagcccccacacccacagcauggccagaggcgugagaaagguguuccugagacugcugccccagcugcugagaaugcacgugagaccccuggcccccgccgccgugcaggacacccagagcagacugcagaacggcagcagcggcuggagcaucaccaccggcgaggagguggcccugugccugcccagaagcgagcugcuguuccagcaguggcagagacagggccugguggccgccgcccuggagaagcuggagaagggccccgagcugggccugagccaguucugcggcagccugaagcaggccgcccccgccauccaggccugcguggaggccugcaaccugaucgccugcgccagacaccagcagagccacuucgacaacggcaacgaggagugguuccuggugggcagagugcuggacagagugugcuuccuggccaugcugagccuguucaucugcggcaccgccggcaucuuccugauggcccacuacaacagagugcccgcccugcccuuccccggcgaccccagacccuaccugcccagccccgacuaa

SEQ ID NO: 15231 - RNA, 1071 nt, Artificial Sequence
  CHST10__Homo_sapiens__NP_004845
augcaccaccaguggcugcugcuggccgccugcuucugggugaucuucauguucaugguggccagcaaguucaucacccugaccuucaaggaccccgacguguacagcgccaagcaggaguuccuguuccugaccaccaugcccgaggugagaaagcugcccgaggagaagcacauccccgaggagcugaagcccaccggcaaggagcugcccgacagccagcuggugcagccccugguguacauggagagacuggagcugaucagaaacgugugcagagacgacgcccugaagaaccugagccacacccccgugagcaaguucgugcuggacagaaucuucgugugcgacaagcacaagauccuguucugccagacccccaaggugggcaacacccaguggaagaaggugcugaucgugcugaacggcgccuucagcagcaucgaggagauccccgagaacguggugcacgaccacgagaagaacggccugcccagacugagcagcuucagcgacgccgagauccagaagagacugaagaccuacuucaaguucuucaucgugagagaccccuucgagagacugaucagcgccuucaaggacaaguucgugcacaaccccagauucgagcccugguacagacacgagaucgcccccggcaucaucagaaaguacagaagaaacagaaccgagaccagaggcauccaguucgaggacuucgugagauaccugggcgaccccaaccacagauggcuggaccugcaguucggcgaccacaucauccacugggugaccuacguggagcugugcgcccccugcgagaucauguacagcgugaucggccaccacgagacccuggaggacgacgcccccuacauccugaaggaggccggcaucgaccaccuggugagcuaccccaccaucccccccggcaucaccguguacaacagaaccaagguggagcacuacuuccugggcaucagcaagagagacaucagaagacuguacgccagauucgagggcgacuucaagcuguucggcuaccagaagcccgacuuccugcugaacuaa

SEQ ID NO: 15232 - RNA, 1044 nt, Artificial Sequence
  CHST11__Homo_sapiens__NP_001167453
augaagcccgcccugcuggaggugaugagaaugaacagaaucugcagaauggugcuggccaccugccugggcagcuucauccuggugaucuucuacuuccagaucaugagaagaaaccccuucggcguggacaucugcugcagaaagggcagcagaagcccccugcaggagcuguacaaccccauccagcuggagcugagcaacaccgccgugcugcaccagaugagaagagaccaggugaccgacaccugcagagccaacagcgccaccagcagaaagagaagagugcugacccccaacgaccugaagcaccuggugguggacgaggaccacgagcugaucuacugcuacgugcccaagguggccugcaccaacuggaagagacugaugauggugcugaccggcagaggcaaguacagcgaccccauggagauccccgccaacgaggcccacgugagcgccaaccugaagacccugaaccaguacagcauccccgagaucaaccacagacugaagagcuacaugaaguuccuguucgugagagagcccuucgagagacuggugagcgccuacagaaacaaguucacccagaaguacaacaucagcuuccacaagagauacggcaccaagaucaucaagagacagagaaagaacgccacccaggaggcccugagaaagggcgacgacgugaaguucgaggaguucguggccuaccugaucgacccccacacccagagagaggagcccuucaacgagcacuggcagaccguguacagccugugccaccccugccacauccacuacgaccuggugggcaaguacgagacccuggaggaggacagcaacuacgugcugcagcuggccggcgugggcagcuaccugaaguuccccaccuacgccaagagcaccagaaccaccgacgagaugaccaccgaguucuuccagaacaucagcagcgagcaccagacccagcuguacgagguguacaagcuggacuuccugauguucaacuacagcgugcccagcuaccugaagcuggaguaa

SEQ ID NO: 15233 - RNA, 1245 nt, Artificial Sequence
  CHST12__Homo_sapiens__NP_001230724
augaccaaggccagacuguucagacuguggcuggugcugggcagcguguucaugauccugcugaucaucguguacugggacagcgccggcgccgcccacuucuaccugcacaccagcuucagcagaccccacaccggccccccccugcccacccccggccccgacagagacagagagcugaccgccgacagcgacguggacgaguuccuggacaaguuccugagcgccggcgugaagcagagcgaccugcccagaaaggagaccgagcagccccccgcccccggcagcauggaggagagcgugagaggcuacgacuggagccccagagacgccagaagaagccccgaccagggcagacagcaggccgagagaagaagcgugcugagaggcuucugcgccaacagcagccuggccuuccccaccaaggagagagccuucgacgacauccccaacagcgagcugagccaccugaucguggacgacagacacggcgccaucuacugcuacgugcccaagguggccugcaccaacuggaagagagugaugaucgugcugagcggcagccugcugcacagaggcgcccccuacagagacccccugagaauccccagagagcacgugcacaacgccagcgcccaccugaccuucaacaaguucuggagaagauacggcaagcugagcagacaccugaugaaggugaagcugaagaaguacaccaaguuccuguucgugagagaccccuucgugagacugaucagcgccuucagaagcaaguucgagcuggagaacgaggaguucuacagaaaguucgccgugcccaugcugagacuguacgccaaccacaccagccugcccgccagcgccagagaggccuucagagccggccugaaggugagcuucgccaacuucauccaguaccugcuggacccccacaccgagaagcuggcccccuucaacgagcacuggagacagguguacagacugugccaccccugccagaucgacuacgacuucgugggcaagcuggagacccuggacgaggacgccgcccagcugcugcagcugcugcagguggacagacagcugagauucccccccagcuacagaaacagaaccgccagcagcugggaggaggacugguucgccaagaucccccuggccuggagacagcagcuguacaagcuguacgaggccgacuucgugcuguucggcuaccccaagcccgagaaccugcugagagacuaa

SEQ ID NO: 15234 - RNA, 1026 nt, Artificial Sequence
  CHST13__Homo_sapiens__NP_690849
augggcagaagaugcugcagaagaagagugcuggccgccgccugccugggcgccgcccugcugcugcugugcgccgcccccagaagccugagacccgccuucggcaacagagcccugggcagcagcuggcugggcggcgagaagagaagcccccugcagaagcuguacgaccuggaccaggaccccagaagcacccuggccaaggugcacagacagagaagagaccugcugaacagcgccugcagcagacacagcagaagacagagacugcugcagcccgaggaccugagacacgugcugguggacgacgcccacggccugcuguacugcuacgugcccaagguggccugcaccaacuggaagagagugcugcuggcccugagcggccaggccagaggcgaccccagagccaucagcgcccaggaggcccacgcccccggcagacugcccagccuggccgacuucagccccgccgagaucaacagaagacugagagccuaccuggccuuccuguucgugagagagcccuucgagagacuggccagcgccuacagaaacaagcuggccagacccuacagcgccgccuuccagagaagauacggcgccagaaucgugcagagacugagacccagagcccugcccgacgccagagccagaggccacgacgugagauucgccgaguuccuggccuaccugcuggaccccagaaccagaagagaggagcccuucaacgagcacugggagagagcccacgcccugugccaccccugcagacugagauacgacguggugggcaaguucgagacccuggccgaggacgccgccuucgugcugggccuggccggcgccagcgaccugagcuuccccggcccccccagacccagaggcgccgccgccagcagagaccuggccgccagacuguucagagacaucagccccuucuaccagagaagacuguucgaccuguacaagauggacuuccugcuguucaacuacagcgcccccagcuaccugagacugcuguaa

SEQ ID NO: 15235 - RNA, 1131 nt, Artificial Sequence
  CHST14__Homo_sapiens__NP_569735
auguuccccagaccccugaccccccuggccgcccccaacggcgccgagccccugggcagagcccugagaagagccccccugggcagagccagagccggccugggcggccccccccugcugcugcccagcaugcugauguucgccgugaucguggccagcagcggccugcugcugaugaucgagagaggcauccuggccgagaugaagccccugccccugcacccccccggcagagagggcaccgccuggagaggcaaggcccccaagcccggcggccugagccugagagccggcgacgccgaccugcaggugagacaggacgugagaaacagaacccugagagccgugugcggccagcccggcaugcccagagaccccugggaccugcccgugggccagagaagaacccugcugagacacauccuggugagcgacagauacagauuccuguacugcuacgugcccaagguggccugcagcaacuggaagagagugaugaaggugcuggccggcgugcuggacagcguggacgugagacugaagauggaccacagaagcgaccugguguuccuggccgaccugagacccgaggagaucagauacagacugcagcacuacuucaaguuccuguucgugagagagccccuggagagacugcugagcgccuacagaaacaaguucggcgagaucagagaguaccagcagagauacggcgccgagaucgugagaagauacagagccggcgccggccccagccccgccggcgacgacgugaccuuccccgaguuccugagauaccugguggacgaggaccccgagagaaugaacgagcacuggaugcccguguaccaccugugccagcccugcgccgugcacuacgacuucgugggcagcuacgagagacuggaggccgacgccaaccaggugcuggagugggugagagcccccccccacgugagauuccccgccagacaggccugguacagacccgccagccccgagagccugcacuaccaccugugcagcgcccccagagcccugcugcaggacgugcugcccaaguacauccuggacuucagccuguucgccuacccccugcccaacgugaccaaggaggccugccagcaguaa

SEQ ID NO: 15236 - RNA, 1521 nt, Artificial Sequence
  CHST15__Homo_sapiens__NP_001257694
augagacacugcaucaacugcugcauccagcugcugcccgacggcgcccacaagcagcaggugaacugccagggcggcccccaccacggccaccaggccugccccaccugcaagggcgagaacaagauccuguucagaguggacagcaagcagaugaaccugcuggccgugcuggaggugagaaccgagggcaacgagaacuggggcggcuuccugagauucaagaagggcaagagaugcagccugguguucggccugaucaucaugacccuggugauggccagcuacauccugagcggcgcccaccaggagcugcugaucagcagccccuuccacuacggcggcuuccccagcaaccccagccugauggacagcgagaaccccagcgacaccaaggagcaccaccaccagagcagcgugaacaacaucagcuacaugaaggacuaccccagcaucaagcugaucaucaacagcaucaccaccagaaucgaguucaccaccagacagcugcccgaccuggaggaccugaagaagcaggagcugcacauguucagcgugauccccaacaaguuccugcccaacagcaagagccccugcugguacgaggaguucagcggccagaacaccaccgaccccuaccugaccaacagcuacgugcuguacagcaagagauucagaagcaccuucgacgcccugagaaaggccuucuggggccaccuggcccacgcccacggcaagcacuucagacugagaugccugccccacuucuacaucaucggccagcccaagugcggcaccaccgaccuguacgacagacugagacugcaccccgaggugaaguucagcgccaucaaggagccccacugguggaccagaaagagauucggcaucgugagacugagagacggccugagagacagauaccccguggaggacuaccuggaccuguucgaccuggccgcccaccagauccaccagggccugcaggccagcagcgccaaggagcagagcaagaugaacaccaucaucaucggcgaggccagcgccagcaccaugugggacaacaacgccuggaccuucuucuacgacaacagcaccgacggcgagccccccuuccugacccaggacuucauccacgccuuccagcccaacgccagacugaucgugaugcugagagaccccguggagagacuguacagcgacuaccuguacuucgccagcagcaacaagagcgccgacgacuuccacgagaaggugaccgaggcccugcagcuguucgagaacugcaugcuggacuacagccugagagccugcguguacaacaacacccugaacaacgccaugcccgugugcacccccccccccagaacccccagagccggccccuggcagaaggagcuggugugcugcuacuacgccagcggcaucgugggccugagauucagcaucggcaccgagagaagcgugcugaugugcaagugcugcagcccccuguucauggacgugaaggccgagaacuaa

SEQ ID NO: 15237 - RNA, 1236 nt, Artificial Sequence
  CHST1__Homo_sapiens__NP_003645
augcagugcagcuggaaggccgugcugcugcuggcccuggccagcaucgccauccaguacaccgccaucagaaccuucaccgccaagagcuuccacaccugccccggccuggccgaggccggccuggccgagagacugugcgaggagagccccaccuucgccuacaaccugagcagaaagacccacauccugauccuggccaccaccagaagcggcagcagcuucgugggccagcuguucaaccagcaccuggacguguucuaccuguucgagccccuguaccacgugcagaacacccugauccccagauucacccagggcaagagccccgccgacagaagagugaugcugggcgccagcagagaccugcugagaagccuguacgacugcgaccuguacuuccuggagaacuacaucaagcccccccccgugaaccacaccaccgacagaaucuucagaagaggcgccagcagagugcugugcagcagacccgugugcgacccccccggccccgccgaccuggugcuggaggagggcgacugcgugagaaagugcggccugcugaaccugaccguggccgccgaggccugcagagagagaagccacguggccaucaagaccgugagagugcccgaggugaacgaccugagagcccugguggaggaccccagacugaaccugaaggugauccagcuggugagagaccccagaggcauccuggccagcagaagcgagaccuucagagacaccuacagacuguggagacugugguacggcaccggcagaaagcccuacaaccuggacgugacccagcugaccaccgugugcgaggacuucagcaacagcgugagcaccggccugaugagaccccccuggcugaagggcaaguacaugcuggugagauacgaggaccuggccagaaaccccaugaagaagaccgaggagaucuacggcuuccugggcaucccccuggacagccacguggccagauggauccagaacaacaccagaggcgaccccacccugggcaagcacaaguacggcaccgugagaaacagcgccgccaccgccgagaaguggagauucagacugagcuacgacaucguggccuucgcccagaacgccugccagcaggugcuggcccagcugggcuacaagaucgccgccagcgaggaggagcugaagaaccccagcgugagccugguggaggagagagacuucagacccuucagcuaa

SEQ ID NO: 15238 - RNA, 1593 nt, Artificial Sequence
  CHST2__Homo_sapiens__NP_004258
augagcagaagcccccagagagcccugccccccggcgcccugcccagacugcugcaggccgcccccgccgccgcccccagagcccugcugccccaguggcccagaagacccggcagaagauggcccgccagcccccugggcaugaagguguucagaagaaaggcccuggugcugugcgccggcuacgcccugcugcuggugcugaccaugcugaaccugcuggacuacaaguggcacaaggagccccugcagcagugcaaccccgacggcccccugggcgccgccgccggcgccgccggcggcagcuggggcagacccggccccccccccgccggcccccccagagcccacgccagacuggaccugagaacccccuacagaccccccgccgccgccgugggcgccgcccccgccgccgccgccggcauggccggcguggccgccccccccggcaacggcaccagaggcaccggcggcgugggcgacaagagacagcugguguacguguucaccaccuggagaagcggcagcagcuucuucggcgagcuguucaaccagaaccccgagguguucuuccuguacgagcccguguggcacguguggcagaagcuguaccccggcgacgccgugagccugcagggcgccgccagagacaugcugagcgcccuguacagaugcgaccugagcguguuccagcuguacagccccgccggcagcggcggcagaaaccugaccacccugggcaucuucggcgccgccaccaacaagguggugugcagcagcccccugugccccgccuacagaaaggagguggugggccugguggacgacagagugugcaagaagugccccccccagagacuggccagauucgaggaggagugcagaaaguacagaacccuggugaucaagggcgugagaguguucgacguggccgugcuggccccccugcugagagaccccgcccuggaccugaaggugauccaccuggugagagaccccagagccguggccagcagcagaaucagaagcagacacggccugaucagagagagccugcagguggugagaagcagagaccccagagcccacagaaugcccuuccuggaggccgccggccacaagcugggcgccaagaaggagggcgugggcggccccgccgacuaccacgcccugggcgccauggaggugaucugcaacagcauggccaagacccugcagaccgcccugcagccccccgacuggcugcagggccacuaccugguggugagauacgaggaccuggugggcgaccccgugaagacccugagaagaguguacgacuucgugggccugcuggugagccccgagauggagcaguucgcccugaacaugaccagcggcagcggcagcagcagcaagcccuucguggugagcgccagaaacgccacccaggccgccaacgccuggagaaccgcccugaccuuccagcagaucaagcagguggaggaguucugcuaccagcccauggccgugcugggcuacgagagagugaacagccccgaggaggugaaggaccugagcaagacccugcugagaaagcccagacuguaa

SEQ ID NO: 15239 - RNA, 1440 nt, Artificial Sequence
  CHST3__Homo_sapiens__XP_006718138
auggagaagggccugacccugccccaggacugcagagacuucgugcacagccugaagaugagaagcaaguacgcccuguuccugguguucguggugaucguguucguguucaucgagaaggagaacaagaucaucagcagagugagcgacaagcugaagcagaucccccaggcccuggccgacgccaacagcaccgaccccgcccugauccuggccgagaacgccagccugcugagccugagcgagcuggacagcgccuucagccagcugcagagcagacugagaaaccugagccugcagcugggcguggagcccgccauggaggccgccggcgaggaggaggaggagcagagaaaggaggaggagccccccagacccgccguggccggccccagaagacacgugcugcugauggccaccaccagaaccggcagcagcuucgugggcgaguucuucaaccagcagggcaacaucuucuaccuguucgagccccuguggcacaucgagagaaccgugagcuucgagcccggcggcgccaacgccgccggcagcgcccugguguacagagacgugcugaagcagcuguuccugugcgaccuguacgugcuggagcacuucaucaccccccugcccgaggaccaccugacccaguucauguucagaagaggcagcagcagaagccugugcgaggaccccgugugcacccccuucgugaagaagguguucgagaaguaccacugcaagaacagaagaugcggcccccugaacgugacccuggccgccgaggccugcagaagaaaggagcacauggcccugaaggccgugagaaucagacagcuggaguuccugcagccccuggccgaggaccccagacuggaccugagagugauccagcuggugagagaccccagagccgugcuggccagcagaaugguggccuucgccggcaaguacaagaccuggaagaaguggcuggacgacgagggccaggacggccugagagaggaggaggugcagagacugagaggcaacugcgagagcaucagacugagcgccgagcugggccugagacagcccgccuggcugagaggcagauacaugcuggugagauacgaggacguggccagaggcccccugcagaaggccagagagauguacagauucgccggcaucccccugaccccccagguggaggacuggauccagaagaacacccaggccgcccacgacggcagcggcaucuacagcacccagaagaacagcagcgagcaguucgagaaguggagauucagcaugcccuucaagcuggcccagguggugcaggccgccugcggccccgccaugagacuguucggcuacaagcuggccagagacgccgccgcccugaccaacagaagcgugagccugcuggaggagagaggcaccuucugggugaccuaa

SEQ ID NO: 15240 - RNA, 1161 nt, Artificial Sequence
  CHST4__Homo_sapiens__NP_005760
augcugcugcccaagaagaugaagcugcugcuguuccuggugagccagauggccauccuggcccuguucuuccacauguacagccacaacaucagcagccugagcaugaaggcccagcccgagagaaugcacgugcuggugcugagcagcuggagaagcggcagcagcuucgugggccagcuguucggccagcaccccgacguguucuaccugauggagcccgccuggcacguguggaugaccuucaagcagagcaccgccuggaugcugcacauggccgugagagaccugaucagagccguguuccugugcgacaugagcguguucgacgccuacauggagcccggccccagaagacagagcagccuguuccagugggagaacagcagagcccugugcagcgcccccgccugcgacaucaucccccaggacgagaucauccccagagcccacugcagacugcugugcagccagcagcccuucgaggugguggagaaggccugcagaagcuacagccacguggugcugaaggaggugagauucuucaaccugcagagccuguacccccugcugaaggaccccagccugaaccugcacaucgugcaccuggugagagaccccagagccguguucagaagcagagagagaaccaagggcgaccugaugaucgacagcagaaucgugaugggccagcacgagcagaagcugaagaaggaggaccagcccuacuacgugaugcaggugaucugccagagccagcuggagaucuacaagaccauccagagccugcccaaggcccugcaggagagauaccugcuggugagauacgaggaccuggccagagcccccguggcccagaccagcagaauguacgaguucgugggccuggaguuccugccccaccugcagaccugggugcacaacaucaccagaggcaagggcaugggcgaccacgccuuccacaccaacgccagagacgcccugaacgugagccaggccuggagauggagccugcccuacgagaaggugagcagacugcagaaggccugcggcgacgccaugaaccugcugggcuacagacacgugagaagcgagcaggagcagagaaaccugcugcuggaccugcugagcaccuggaccgugcccgagcagauccacuaa

SEQ ID NO: 15241 - RNA, 1236 nt, Artificial Sequence
  CHST5__Homo_sapiens__NP_078809
augggcaugagagccagagugcccaagguggcccacagcaccagaagaccccccgccgccagaauguggcugcccagauucagcagcaagaccgugaccgugcugcugcuggcccagaccaccugccugcugcuguucaucaucagcagacccggccccagcagccccgccggcggcgaggacagagugcacgugcuggugcugagcagcuggagaagcggcagcagcuuccugggccagcuguucagccagcaccccgacguguucuaccugauggagcccgccuggcacguguggaccacccugagccagggcagcgccgccacccugcacauggccgugagagaccugaugagaagcaucuuccugugcgacauggacguguucgacgccuacaugccccagagcagaaaccugagcgccuucuucaacugggccaccagcagagcccugugcagcccccccgccugcagcgccuuccccagaggcaccaucagcaagcaggacgugugcaagacccugugcaccagacagcccuucagccuggccagagaggccugcagaagcuacagccacguggugcugaaggaggugagauucuucaaccugcaggugcuguacccccugcugagcgaccccgcccugaaccugagaaucgugcaccuggugagagaccccagagccgugcugagaagcagagaggccgccggccccauccuggccagagacaacggcaucgugcugggcaccaacggcaaguggguggaggccgacccccaccugagacugaucagagaggugugcagaagccacgugagaaucgccgaggccgccacccugaagcccccccccuuccugagaggcagauacagacuggugagauucgaggaccuggccagagagccccuggccgagaucagagcccuguacgccuucaccggccugacccugaccccccagcuggaggccuggauccacaacaucacccacggcagcggcaucggcaagcccaucgaggccuuccacaccagcagcagaaacgccagaaacgugagccaggccuggagacacgcccugcccuucaccaagauccugagagugcaggaggugugcgccggcgcccugcagcugcugggcuacagacccguguacagcgccgaccagcagagagaccugacccuggaccuggugcugcccagaggccccgaccacuucagcugggccagccccgacuaa

SEQ ID NO: 15242 - RNA, 1188 nt, Artificial Sequence
  CHST6__Homo_sapiens__XP_011521387
auguggcugcccagagugagcagcaccgccgugaccgcccugcugcuggcccagaccuuccugcugcuguuccuggugagcagacccggccccagcagccccgccggcggcgaggccagagugcacgugcuggugcugagcagcuggagaagcggcagcagcuucgugggccagcuguucaaccagcaccccgacguguucuaccugauggagcccgccuggcacguguggaccacccugagccagggcagcgccgccacccugcacauggccgugagagaccuggugagaagcguguuccugugcgacauggacguguucgacgccuaccugcccuggagaagaaaccugagcgaccuguuccagugggccgugagcagagcccugugcagcccccccgccugcagcgccuuccccagaggcgccaucagcagcgaggccgugugcaagccccugugcgccagacagagcuucacccuggccagagaggccugcagaagcuacagccacguggugcugaaggaggugagauucuucaaccugcaggugcuguacccccugcugagcgaccccgcccugaaccugagaaucgugcaccuggugagagaccccagagccgugcugagaagcagagagcagaccgccaaggcccuggccagagacaacggcaucgugcugggcaccaacggcaccuggguggaggccgaccccggccugagaguggugagagaggugugcagaagccacgugagaaucgccgaggccgccacccugaagcccccccccuuccugagaggcagauacagacuggugagauucgaggaccuggccagagagccccuggccgagaucagagcccuguacgccuucaccggccugagccugaccccccagcuggaggccuggauccacaacaucacccacggcagcggccccggcgccagaagagaggccuucaagaccagcagcagaaacgcccugaacgugagccaggccuggagacacgcccugcccuucgccaagaucagaagagugcaggagcugugcgccggcgcccugcagcugcugggcuacagacccguguacagcgaggacgagcagagaaaccuggcccuggaccuggugcugcccagaggccugaacggcuucaccugggccagcagcaccgccagccaccccagaaacuaa

SEQ ID NO: 15243 - RNA, 1275 nt, Artificial Sequence
  CHST8__Homo_sapiens__XP_011525528
augacccugagacccggcaccaugagacuggccugcauguucagcagcauccugcuguucggcgccgccggccugcugcuguucaucagccugcaggaccccaccgagcuggccccccagcaggugcccggcaucaaguucaacaucagacccagacagccccaccacgaccugccccccggcggcagccaggacggcgaccugaaggagcccaccgagagagugaccagagaccugagcagcggcgcccccagaggcagaaaccugcccgcccccgaccagccccagcccccccugcagagaggcaccagacugagacugagacagagaagaagaagacugcugaucaagaagaugcccgccgccgccaccauccccgccaacagcagcgacgcccccuucaucagacccggccccggcacccuggacggcagaugggugagccugcacagaagccagcaggagagaaagagagugaugcaggaggccugcgccaaguacagagccagcagcagcagaagagccgugacccccagacacgugagcagaaucuucguggaggacagacacagagugcuguacugcgaggugcccaaggccggcugcagcaacuggaagagagugcugauggugcuggccggccuggccagcagcaccgccgacauccagcacaacaccgugcacuacggcagcgcccugaagagacuggacaccuucgacagacagggcauccugcacagacugagcaccuacaccaagaugcuguucgugagagagcccuucgagagacuggugagcgccuucagagacaaguucgagcaccccaacagcuacuaccaccccguguucggcaaggccauccuggccagauacagagccaacgccagcagagaggcccugagaaccggcagcggcgugagauuccccgaguucgugcaguaccugcuggacgugcacagacccgugggcauggacauccacugggaccacgugagcagacugugcagccccugccugaucgacuacgacuucgugggcaaguucgagagcauggaggacgacgccaacuucuuccugagccugaucagagcccccagaaaccugaccuuccccagauucaaggacagacacagccaggaggccagaaccaccgccagaaucgcccaccaguacuucgcccagcugagcgcccugcagagacagagaaccuacgacuucuacuacauggacuaccugauguucaacuacagcaagcccuucgccgaccuguacuaa

SEQ ID NO: 15244 - RNA, 225 nt, Artificial Sequence
  CHST9__Homo_sapiens__NP_001243245
augcagcccagcgagauggugaugaaccccaagcagguguuccugagcgugcugaucuucggcguggccggccugcugcuguucauguaccugcagguguggaucgaggagcagcacaccggcagaguggagaagagaagagagcagaaggugaccagcggcuggggccccgugaaguaccugagacccgugcccagaaucaagccccaggugagccacgccuaa

SEQ ID NO: 15245 - RNA, 2409 nt, Artificial Sequence
  CHSY1__Homo_sapiens__NP_055733
auggccgccagaggcagaagagccuggcugagcgugcugcugggccuggugcugggcuucgugcuggccagcagacuggugcugcccagagccagcgagcugaagagagccggccccagaagaagagccagccccgagggcugcagaagcggccaggccgccgccagccaggccggcggcgccagaggcgacgccagaggcgcccagcuguggccccccggcagcgaccccgacggcggccccagagacagaaacuuccuguucgugggcgugaugaccgcccagaaguaccugcagaccagagccguggccgccuacagaaccuggagcaagaccauccccggcaaggugcaguucuucagcagcgagggcagcgacaccagcgugcccauccccguggugccccugagaggcguggacgacagcuaccccccccagaagaagagcuucaugaugcugaaguacaugcacgaccacuaccuggacaaguacgagugguucaugagagccgacgacgacguguacaucaagggcgacagacuggagaacuuccugagaagccugaacagcagcgagccccuguuccugggccagaccggccugggcaccaccgaggagaugggcaagcuggcccuggagcccggcgagaacuucugcaugggcggccccggcgugaucaugagcagagaggugcugagaagaauggugccccacaucggcaagugccugagagagauguacaccacccacgaggacguggaggugggcagaugcgugagaagauucgccggcgugcagugcguguggagcuacgagaugcagcagcuguucuacgagaacuacgagcagaacaagaagggcuacaucagagaccugcacaacagcaagauccaccaggccaucacccugcaccccaacaagaacccccccuaccaguacagacugcacagcuacaugcugagcagaaagaucagcgagcugagacacagaaccauccagcugcacagagagaucgugcugaugagcaaguacagcaacaccgagauccacaaggaggaccugcagcugggcaucccccccagcuucaugagauuccagcccagacagagagaggagauccuggagugggaguuccugaccggcaaguaccuguacagcgccguggacggccagccccccagaagaggcauggacagcgcccagagagaggcccuggacgacaucgugaugcaggugauggagaugaucaacgccaacgccaagaccagaggcagaaucaucgacuucaaggagauccaguacggcuacagaagagugaaccccauguacggcgccgaguacauccuggaccugcugcugcuguacaagaagcacaagggcaagaagaugaccgugcccgugagaagacacgccuaccugcagcagaccuucagcaagauccaguucguggagcacgaggagcuggacgcccaggagcuggccaagagaaucaaccaggagagcggcagccugagcuuccugagcaacagccugaagaagcuggugcccuuccagcugcccggcagcaagagcgagcacaaggagcccaaggacaagaagaucaacauccugaucccccugagcggcagauucgacauguucgugagauucaugggcaacuucgagaagaccugccugauccccaaccagaacgugaagcugguggugcugcuguucaacagcgacagcaaccccgacaaggccaagcagguggagcugaugagagacuacagaaucaaguaccccaaggccgacaugcagauccugcccgugagcggcgaguucagcagagcccuggcccuggaggugggcagcagccaguucaacaacgagagccugcuguucuucugcgacguggaccugguguucaccaccgaguuccugcagagaugcagagccaacaccgugcugggccagcagaucuacuuccccaucaucuucagccaguacgaccccaagaucguguacagcggcaaggugcccagcgacaaccacuucgccuucacccagaagaccggcuucuggagaaacuacggcuucggcaucaccugcaucuacaagggcgaccuggugagagugggcggcuucgacgugagcauccagggcuggggccuggaggacguggaccuguucaacaagguggugcaggccggccugaagaccuucagaagccaggaggugggcguggugcacgugcaccaccccguguucugcgaccccaaccuggaccccaagcaguacaagaugugccugggcagcaaggccagcaccuacggcagcacccagcagcuggccgagauguggcuggagaagaacgaccccagcuacagcaagagcagcaacaacaacggcagcgugagaaccgccuaa

SEQ ID NO: 15246 - RNA, 2649 nt, Artificial Sequence
  CHSY3__Homo_sapiens__NP_787052
auggccgugagaagcagaagacccuggaugagcguggcccugggccuggugcugggcuucaccgccgccagcuggcugaucgcccccagaguggccgagcugagcgagagaaagagaagaggcagcagccugugcagcuacuacggcagaagcgccgccggccccagagccggcgcccagcagccccugccccagccccagagcagacccagacaggagcagagccccccccccgccagacaggaccugcagggccccccccugcccgaggccgcccccggcaucaccagcuucagaagcagccccuggcagcagccccccccccugcagcagagaagaagaggcagagagcccgagggcgccaccggccugcccggcgcccccgccgccgagggcgagcccgaggaggaggacggcggcgccgccggccagagaagagacggcagacccggcagcagccacaacggcagcggcgacggcggcgccgccgcccccagcgccagacccagagacuuccuguacgugggcgugaugaccgcccagaaguaccugggcagcagagcccuggccgcccagagaaccugggccagauucauccccggcagaguggaguucuucagcagccagcagccccccaacgccggccagcccccccccccccugcccgugaucgcccugcccggcguggacgacagcuaccccccccagaagaagagcuucaugaugaucaaguacaugcacgaccacuaccuggacaaguacgagugguucaugagagccgacgacgacguguacaucaagggcgacaagcuggaggaguuccugagaagccugaacagcagcaagccccuguaccugggccagaccggccugggcaacaucgaggagcugggcaagcugggccuggagcccggcgagaacuucugcaugggcggccccggcaugaucuucagcagagaggugcugagaagaauggugccccacaucggcgagugccugagagagauguacaccacccacgaggacguggaggugggcagaugcgugagaagauucggcggcacccagugcguguggagcuacgagaugcagcagcuguuccacgagaacuacgagcacaacagaaagggcuacauccaggaccugcacaacagcaagauccacgccgccaucacccugcaccccaacaagagacccgccuaccaguacagacugcacaacuacaugcugagcagaaagaucagcgagcugagauacagaaccauccagcugcacagagagagcgcccugaugagcaagcugagcaacaccgaggugagcaaggaggaccagcagcugggcgugauccccagcuucaaccacuuccagcccagagagagaaacgaggugaucgagugggaguuccugaccggcaagcugcuguacagcgccgccgagaaccagccccccagacagagccugagcagcauccugagaaccgcccuggacgacaccgugcugcaggugauggagaugaucaacgagaacgccaagagcagaggcagacugaucgacuucaaggagauccaguacggcuacagaagagugaaccccaugcacggcguggaguacauccuggaccugcugcugcuguacaagagacacaagggcagaaagcugaccgugcccgugagaagacacgccuaccugcagcagcuguucagcaagcccuucuucagagagaccgaggagcuggacgugaacagccugguggagagcaucaacagcgagacccagagcuucagcuucaucagcaacagccugaagauccugagcagcuuccagggcgccaaggagaugggcggccacaacgagaagaaggugcacauccuggugccccugaucggcagauacgacaucuuccugagauucauggagaacuucgagaacaugugccugauccccaagcagaacgugaagcuggugaucauccuguucagcagagacagcggccaggacagcagcaagcacaucgagcugaucaagggcuaccagaacaaguaccccaaggccgagaugacccugauccccaugaagggcgaguucagcagaggccugggccuggagauggccagcgcccaguucgacaacgacacccugcugcuguucugcgacguggaccugaucuucagagaggacuuccugcagagaugcagagacaacaccauccagggccagcagguguacuaccccaucaucuucagccaguacgaccccaaggugaccaacggcggcaacccccccaccgacgacuacuucaucuucagcaagaagaccggcuucuggagagacuacggcuacggcaucaccugcaucuacaagagcgaccugcugggcgccggcggcuucgacaccagcauccagggcuggggccuggaggacguggaccuguacaacaaggugauccugagcggccugagacccuucagaagccaggaggugggcguggugcacaucuuccaccccgugcacugcgaccccaaccuggaccccaagcaguacaagaugugccugggcagcaaggccagcaccuucgccagcaccaugcagcuggccgagcuguggcuggagaagcaccugggcgugagauacaacagaacccugagcuaa

SEQ ID NO: 15247 - RNA, 2928 nt, Artificial Sequence
  CHTF18__Homo_sapiens__NP_071375
auggaggacuacgagcaggagcugugcggcguggaggacgacuuccacaaccaguucgccgccgagcuggaggugcuggccgagcuggagggcgccagcacccccagccccagcggcgugccccuguucaccgccggcagaccccccagaaccuucgaggaggcccuggccagaggcgacgccgccagcagccccgcccccgccgccagcgugggcagcagccagggcggcgccagaaagagacagguggacgccgaccugcagcccgccggcagccugccccacgcccccagaaucaagagacccagacugcagguggugaagagacugaacuucagaagcgaggagauggaggagccccccccccccgacagcagccccaccgacaucacccccccccccagccccgaggaccuggccgagcuguggggccacggcgugagcgaggccgccgccgacgugggccugaccagagccagccccgccgccagaaaccccgugcugagaagaccccccauccuggaggacuacgugcacgugaccagcaccgagggcgugagagccuaccuggugcugagagccgaccccauggcccccggcgugcagggcagccugcugcacgugcccuggagaggcggcggccagcuggaccugcugggcgugagccuggccagccugaagaagcagguggacggcgagagaagagagagacugcugcaggaggcccagaagcugagcgacacccugcacagccugagaagcggcgaggaggaggccgcccagccccugggcgcccccgaggaggagcccaccgacggccaggacgccagcagccacugccuguggguggacgaguucgcccccagacacuacaccgagcugcugagcgacgacuucaccaacagaugccugcugaaguggcugaagcugugggaccuggugguguucggccacgagagacccagcagaaagcccagacccagcguggagcccgccagagugagcaaggaggccaccgcccccggcaaguggaagagccacgagcaggugcuggaggagaugcuggaggccggccuggaccccagccagagacccaagcagaagguggcccugcugugcggcccccccggccugggcaagaccacccuggcccacgugaucgccagacacgccggcuacagcgugguggagaugaacgccagcgacgacagaagccccgagguguucagaaccagaaucgaggccgccacccagauggagagcgugcugggcgccggcggcaagcccaacugccuggugaucgacgagaucgacggcgcccccguggccgccaucaacgugcugcugagcauccugaacagaaagggcccccaggaggugggcccccagggccccgccgugcccagcggcggcggcagaagaagaagagccgagggcggccugcugaugagacccaucaucugcaucugcaacgaccaguucgcccccagccugagacagcugaagcagcaggccuuccugcugcacuucccccccacccugcccagcagacuggugcagagacugcaggaggugagccugagacagggcaugagagccgaccccggcgugcuggccgcccugugcgagaagaccgacaacgacaucagagccugcaucaacacccugcaguuccuguacagcagaggccagagagagcugagcgugagagacgugcaggccaccagagugggccugaaggaccagagaagaggccuguucagcguguggcaggagguguuccagcugcccagagcccagagaagaagagugggccaggaccccgcccugcccgccgacacccugcugcugggcgacggcgacgccggcagccugaccagcgccagccagagauucuacagagugcugcacgccgccgccagcgccggcgagcacgagaagguggugcagggccuguucgacaacuuccugagacugagacugagagacagcagccugggcgccgugugcguggcccuggacuggcuggccuucgacgaccugcuggccggcgccgcccaccacagccagagcuuccagcugcugagauacccccccuuccugcccguggccuuccacgugcuguucgccagcagccacacccccagaaucaccuuccccagcagccagcaggaggcccagaacagaaugagccagaugagaaaccugauccagacccuggugagcggcaucgcccccgccaccagaagcagagccaccccccaggcccugcugcuggacgcccugugccugcugcuggacauccuggcccccaagcugagacccgugagcacccagcuguacagcaccagagagaagcagcagcuggccagccuggugggcaccaugcuggccuacagccugaccuacagacaggagagaacccccgacggccaguacaucuacagacuggagcccaacguggaggagcugugcagauuccccgagcugcccgccagaaagccccugaccuaccagaccaagcagcugaucgccagagagaucgagguggagaagaugagaagagccgaggccagcgccagaguggagaacagcccccagguggacggcagcccccccggccuggagggccugcugggcggcaucggcgagaagggcgugcacagacccgcccccagaaaccacgagcagagacuggagcacaucaugagaagagccgccagagaggagcagcccgagaaggacuucuucggcagagugguggugagaagcaccgccgugcccagcgccggcgacaccgcccccgagcaggacagcguggagagaagaaugggcaccgccgugggcagaagcgaggugugguucagauucaacgagggcgugagcaacgccgugagaagaagccuguacaucagagaccugcuguaa

SEQ ID NO: 15248 - RNA, 750 nt, Artificial Sequence
  CHTOP__Homo_sapiens__NP_001193541
auggccgcccagagcgcccccaagguggugcugaagagcaccaccaagaugagccugaacgagagauucaccaacaugcugaagaacaagcagcccacccccgugaacaucagagccagcaugcagcagcagcagcagcuggccagcgccagaaacagaagacuggcccagcagauggagaacagacccagcgugcaggccgcccugaagcugaagcagaagagccugaagcagagacugggcaagagcaacauccaggccagacugggcagacccaucggcgcccuggccagaggcgccaucggcggcagaggccugcccaucauccagagaggccugcccagaggcggccugagaggcggcagagccaccagaacccugcugagaggcggcaugagccugagaggccagaaccugcugagaggcggcagagccguggcccccagaaugggccugagaagaggcggcgugagaggcagaggcggccccggcagaggcggccugggcagaggcgccaugggcagaggcggcaucggcggcagaggcagaggcaugaucggcagaggcagaggcggcuucggcggcagaggcagaggcagaggcagaggcagaggcgcccuggccagacccgugcugaccaaggagcagcuggacaaccagcuggacgccuacaugagcaagaccaagggccaccuggacgccgagcuggacgccuacauggcccagaccgaccccgagaccaacgacuaa

SEQ ID NO: 15249 - RNA, 420 nt, Artificial Sequence
  CHURC1__Homo_sapiens__NP_001190992
augagacagcccuaccugagcagcagagaggugagcagcagcagaaagagauggagaaccuuccccguggacugcguggccaugugcggcgacugcguggagaaggaguaccccaacagaggcaacaccugccuggagaacggcagcuuccugcugaacuucaccggcugcgccgugugcagcaagagagacuucaugcugaucaccaacaagagccugaaggaggaggacggcgaggagaucgugaccuacgaccaccugugcaagaacugccaccacgugaucgccagacacgaguacaccuucagcaucauggacgaguuccaggaguacaccaugcugugccugcugugcggcaaggccgaggacaccaucagcauccugcccgacgaccccagacagaugacccugcuguucuaa

SEQ ID NO: 15250 - RNA, 1020 nt, Artificial Sequence
  CIAO1__Homo_sapiens__NP_004795
augaaggacagccuggugcugcugggcagagugcccgcccaccccgacagcagaugcugguuccuggccuggaaccccgccggcacccugcuggccagcugcggcggcgacagaagaaucagaaucuggggcaccgagggcgacagcuggaucugcaagagcgugcugagcgagggccaccagagaaccgugagaaagguggccuggagccccugcggcaacuaccuggccagcgccagcuucgacgccaccaccugcaucuggaagaagaaccaggacgacuucgagugcgugaccacccuggagggccacgagaacgaggugaagagcguggccugggcccccagcggcaaccugcuggccaccugcagcagagacaagagcgugugggugugggagguggacgaggaggacgaguacgagugcgugagcgugcugaacagccacacccaggacgugaagcacgugguguggcaccccagccaggagcugcuggccagcgccagcuacgacgacaccgugaagcuguacagagaggaggaggacgacugggugugcugcgccacccuggagggccacgagagcaccguguggagccuggccuucgaccccagcggccagagacuggccagcugcagcgacgacagaaccgugagaaucuggagacaguaccugcccggcaacgagcagggcguggccugcagcggcagcgaccccagcuggaagugcaucugcacccugagcggcuuccacagcagaaccaucuacgacaucgccuggugccagcugaccggcgcccuggccaccgccugcggcgacgacgccaucagaguguuccaggaggaccccaacagcgacccccagcagcccaccuucagccugaccgcccaccugcaccaggcccacagccaggacgugaacugcguggccuggaaccccaaggagcccggccugcuggccagcugcagcgacgacggcgagguggccuucuggaaguaccagagacccgagggccuguaa

SEQ ID NO: 15251 - RNA, 939 nt, Artificial Sequence
  CIAPIN1__Homo_sapiens__NP_064709
auggccgacuucggcaucagcgccggccaguucguggccguggugugggacaagagcagccccguggaggcccugaagggccugguggacaagcugcaggcccugaccggcaacgagggcagagugagcguggagaacaucaagcagcugcugcagagcgcccacaaggagagcagcuucgacaucauccugagcggccuggugcccggcagcaccacccugcacagcgccgagauccuggccgagaucgccagaauccugagacccggcggcugccuguuccugaaggagcccguggagaccgccguggacaacaacagcaaggugaagaccgccagcaagcugugcagcgcccugacccugagcggccugguggaggugaaggagcugcagagagagccccugacccccgaggaggugcagagcgugagagagcaccugggccacgagagcgacaaccugcuguucgugcagaucaccggcaagaagcccaacuucgaggugggcagcagcagacagcugaagcugagcaucaccaagaagagcagccccagcgugaagcccgccguggaccccgccgccgccaagcuguggacccugagcgccaacgacauggaggacgacagcauggaccugaucgacagcgacgagcugcuggaccccgaggaccugaagaagcccgaccccgccagccugagagccgccagcugcggcgagggcaagaagagaaaggccugcaagaacugcaccugcggccuggccgaggagcuggagaaggagaagagcagagagcagaugagcagccagcccaagagcgccugcggcaacugcuaccugggcgacgccuucagaugcgccagcugccccuaccugggcaugcccgccuucaagcccggcgagaaggugcugcugagcgacagcaaccugcacgacgccuaa

SEQ ID NO: 15252 - RNA, 576 nt, Artificial Sequence
  CIB1__Homo_sapiens__NP_006375
augggcggcagcggcagcagacugagcaaggagcugcuggccgaguaccaggaccugaccuuccugaccaagcaggagauccugcuggcccacagaagauucugcgagcugcugccccaggagcagagaagcguggagagcagccugagagcccaggugcccuucgagcagauccugagccugcccgagcugaaggccaaccccuucaaggagagaaucugcagaguguucagcaccagccccgccaaggacagccugagcuucgaggacuuccuggaccugcugagcguguucagcgacaccgccacccccgacaucaagagccacuacgccuucagaaucuucgacuucgacgacgacggcacccugaacagagaggaccugagcagacuggugaacugccugaccggcgagggcgaggacaccagacugagcgccagcgagaugaagcagcugaucgacaacauccuggaggagagcgacaucgacagagacggcaccaucaaccugagcgaguuccagcacgugaucagcagaagccccgacuucgccagcagcuucaagaucgugcuguaa

SEQ ID NO: 15253 - RNA, 564 nt, Artificial Sequence
  CIB2__Homo_sapiens__NP_006374
augggcaacaagcagaccaucuucaccgaggagcagcuggacaacuaccaggacugcaccuucuucaacaagaaggacauccugaagcugcacagcagauucuacgagcuggcccccaaccuggugcccauggacuacagaaagagccccaucgugcacgugcccaugagccugaucauccagaugcccgagcugagagagaaccccuucaaggagagaaucguggccgccuucagcgaggacggcgagggcaaccugaccuucaacgacuucguggacauguucagcgugcugugcgagagcgcccccagagagcugaaggccaacuacgccuucaagaucuacgacuucaacaccgacaacuucaucugcaaggaggaccuggagcugacccuggccagacugaccaagagcgagcuggacgaggaggagguggugcuggugugcgacaaggugaucgaggaggccgaccuggacggcgacggcaagcugggcuucgccgacuucgaggacaugaucgccaaggcccccgacuuccugagcaccuuccacaucagaaucuaa

SEQ ID NO: 15254 - RNA, 4827 nt, Artificial Sequence
  CIC__Homo_sapiens__NP_055940
auguacagcgcccacagaccccugaugcccgccagcagcgccgccagcagaggccugggcauguucguguggaccaacguggagcccagaagcguggccguguuccccuggcacagccuggugcccuuccuggcccccagccagcccgaccccagcgugcagcccagcgaggcccagcagcccgccagccaccccguggccagcaaccagagcaaggagcccgccgagagcgccgccguggcccacgagagaccccccggcggcaccggcagcgccgaccccgagagaccccccggcgccaccugccccgagagccccggccccggccccccccacccccugggcgugguggagagcggcaagggccccccccccaccaccgaggaggaggccagcggcccccccggcgagcccagacuggacagcgagaccgagagcgaccacgacgacgccuuccugagcaucaugagccccgagauccagcugccccugccccccggcaagagaagaacccagagccugagcgcccugcccaaggagagagacagcagcagcgagaaggacggcagaagccccaacaagagagagaaggaccacaucagaagacccaugaacgccuucaugaucuucagcaagagacacagagcccuggugcaccagagacaccccaaccaggacaacagaaccgugagcaagauccugggcgaguggugguacgcccugggccccaaggagaagcagaaguaccacgaccuggccuuccaggugaaggaggcccacuucaaggcccaccccgacuggaaguggugcaacaaggacagaaagaagagcagcagcgaggccaagcccaccagccugggccuggccggcggccacaaggagaccagagagagaagcaugagcgagaccggcaccgccgccgcccccggcgugagcagcgagcugcugagcguggccgcccagacccugcugagcagcgacaccaaggcccccggcagcagcagcugcggcgccgagagacugcacaccgugggcggccccggcagcgccagacccagagccuucagccacagcggcgugcacagccuggacggcggcgagguggacagccaggcccugcaggagcugacccagauggugagcggccccgccagcuacagcggccccaagcccagcacccaguacggcgcccccggccccuucgccgcccccggcgagggcggcgcccuggccgccaccggcagacccccccugcugcccaccagagccagcagaagccagagagccgccagcgaggacaugaccagcgacgaggagagaauggugaucugcgaggaggagggcgacgacgacgugaucgccgacgacggcuucggcaccaccgacaucgaccugaagugcaaggagagagugaccgacagcgagagcggcgacagcagcggcgaggaccccgagggcaacaagggcuucggcagaaagguguucagccccgugaucagaagcagcuucacccacugcagacccccccuggaccccgagccccccggcccccccgacccccccguggccuucggcaagggcuacggcagcgcccccagcagcagcgccagcagccccgccagcagcagcgccagcgccgccaccagcuucagccugggcagcggcaccuucaaggcccaggagagcggccagggcagcaccgccggcccccugagaccccccccccccggcgccggcggccccgccacccccagcaaggccaccagauuccugcccauggaccccgccaccuucagaagaaagagacccgagagcgugggcggccuggagccccccggccccagcgugaucgccgccccccccagcggcggcggcaacauccugcagacccuggugcugccccccaacaaggaggagcaggagggcggcggcgccagagugcccagcgcccccgcccccagccuggccuacggcgcccccgccgccccccugagcagacccgccgccaccauggugaccaacguggugagacccgugagcagcacccccgugcccaucgccagcaagcccuuccccaccagcggcagagccgaggccagccccaacgacaccgccggcgccagaaccgagaugggcaccggcagcagagugcccggcggcagcccccugggcgugagccugguguacagcgacaagaagagcgccgccgccaccagccccgccccccaccugguggccggcccccugcugggcaccgugggcaaggcccccgccaccgugaccaaccugcuggugggcacccccggcuacggcgcccccgccccccccgccgugcaguucaucgcccagggcgcccccggcggcggcaccaccgccggcagcggcgccggcgccggcagcggccccaacggccccgugccccugggcauccugcagcccggcgcccugggcaaggccggcggcaucacccaggugcaguacauccugcccacccugccccagcagcugcagguggcccccgcccccgcccccgcccccggcaccaaggccgccgcccccagcggccccgcccccaccaccagcaucagauucacccugccccccggcaccagcaccaacggcaaggugcuggccgccaccgcccccacccccggcauccccauccugcagagcgugcccagcgcccccccccccaaggcccagagcgugagccccgugcaggcccccccccccggcggcagcgcccagcugcugcccggcaaggugcuggugccccuggccgcccccagcaugagcgugagaggcggcggcgccggccagccccugccccuggugagcccccccuucagcgugcccgugcagaacggcgcccagccccccagcaagaucauccagcugacccccgugcccgugagcacccccagcggccuggugcccccccugagccccgccacccugcccggccccaccagccagccccagaaggugcugcugcccagcagcaccagaaucaccuacgugcagagcgccggcggccacgcccugccccugggcaccagccccgccagcagccaggccggcaccgugaccagcuacggccccaccagcagcguggcccugggcuucaccagccugggccccagcggccccgccuucgugcagccccugcugagcgccggccaggccccccugcuggcccccggccaggugggcgugagccccgugcccagcccccagcugccccccgccugcgccgcccccggcggccccgugaucaccgccuucuacagcggcagccccgcccccaccagcagcgccccccuggcccagcccagccaggccccccccagccugguguacaccguggccaccagcaccaccccccccgccgccaccauccugcccaagggcccccccgcccccgccaccgccacccccgcccccaccagccccuuccccagcgccaccgccggcagcaugaccuacagccugguggcccccaaggcccagagacccagccccaaggccccccagaaggugaaggccgccaucgccagcauccccgugggcagcuucgaggccggcgccagcggcagacccggccccgcccccagacagccccuggagcccggccccgugagagagcccaccgcccccgagagcgagcuggagggccagcccaccccccccgccccccccccccugcccgagaccuggacccccaccgccagaagcagccccccccugcccccccccgccgaggagagaaccagcgccaagggccccgagaccauggccagcaaguuccccagcagcagcagcgacuggagagugcccggccagggccuggagaacagaggcgagccccccaccccccccagccccgcccccgcccccgccguggcccccggcggcagcagcgagagcagcagcggcagagccgccggcgacacccccgagagaaaggaggccgccggcaccggcaagaaggugaaggugagaccccccccccugaagaagaccuucgacagcguggacaacagagugcugagcgagguggacuucgaggagagauucgccgagcugcccgaguucagacccgaggaggugcugcccagccccacccugcagagccuggccaccagccccagagccauccugggcagcuacagaaagaagagaaagaacagcaccgaccuggacagcgcccccgaggaccccaccagccccaagagaaagaugagaagaagaagcagcugcagcagcgagcccaacacccccaagagcgccaagugcgagggcgacaucuucaccuucgacagaaccggcaccgaggccgaggacgugcugggcgagcuggaguacgacaaggugcccuacagcagccugagaagaacccuggaccagagaagagcccuggugaugcagcuguuccaggaccacggcuucuuccccagcgcccaggccaccgccgccuuccaggccagauacgccgacaucuuccccagcaaggugugccugcagcugaagaucagagaggugagacagaagaucaugcaggccgccacccccaccgagcagccccccggcgccgaggccccccugcccgugcccccccccaccggcaccgccgccgcccccgcccccacccccagccccgccggcggccccgaccccaccagccccagcagcgacagcggcaccgcccaggccgcccccccccugccccccccccccgagagcggccccggccagcccggcugggagggcgccccccagcccagcccccccccccccggccccagcaccgccgccaccggcagauaa

SEQ ID NO: 15255 - RNA, 660 nt, Artificial Sequence
  CIDEB__Homo_sapiens__NP_001305736
auggaguaccugagcgcccugaaccccagcgaccugcugagaagcgugagcaacaucagcagcgaguucggcagaagaguguggaccagcgccccccccccccagagacccuucagagugugcgaccacaagagaaccaucagaaagggccugaccgccgccaccagacaggagcugcuggccaaggcccuggagacccugcugcugaacggcgugcugacccuggugcuggaggaggacggcaccgccguggacagcgaggacuucuuccagcugcuggaggacgacaccugccugauggugcugcagagcggccagagcuggagccccaccagaagcggcgugcugagcuacggccugggcagagagagacccaagcacagcaaggacaucgccagauucaccuucgacguguacaagcagaaccccagagaccuguucggcagccugaacgugaaggccaccuucuacggccuguacagcaugagcugcgacuuccagggccugggccccaagaaggugcugagagagcugcugagauggaccagcacccugcugcagggccugggccacaugcugcugggcaucagcagcacccugagacacgccguggagggcgccgagcaguggcagcagaagggcagacugcacagcuacuaa

SEQ ID NO: 15256 - RNA, 747 nt, Artificial Sequence
  CIDEC__Homo_sapiens__NP_001186480
auggaguacgccaugaagagccugagccugcuguaccccaagagccugagcagacacgugagcgugagaaccagcguggugacccagcagcugcugagcgagcccagccccaaggcccccagagccagacccugcagagugagcaccgccgacagaagcgugagaaagggcaucauggccuacagccuggaggaccugcugcugaagaccagaaaccccgaggccagaagccaggaggugagagacacccugaugcuggccgacaagcccuucuuccuggugcuggaggaggacggcaccaccguggagaccgaggaguacuuccaggcccuggccggcgacaccguguucauggugcugcagaagggccagaaguggcagccccccagcgagcagggcaccagacacccccugagccugagccacaagcccgccaagaagaucgacguggccagagugaccuucgaccuguacaagcugaacccccaggacuucaucggcugccugaacgugaaggccaccuucuacgacaccuacagccugagcuacgaccugcacugcugcggcgccaagagaaucaugaaggaggccuucagaugggcccuguucagcaugcaggccaccggccacgugcugcugggcaccagcugcuaccugcagcagcugcuggacgccaccgaggagggccagccccccaagggcaaggccagcagccugauccccaccugccugaagauccugcaguaa

SEQ ID NO: 15257 - RNA, 3393 nt, Artificial Sequence
  CIITA__Homo_sapiens__NP_000237
augagaugccuggcccccagacccgccggcagcuaccugagcgagccccagggcagcagccagugcgccaccauggagcugggcccccuggagggcggcuaccuggagcugcugaacagcgacgccgacccccugugccuguaccacuucuacgaccagauggaccuggccggcgaggaggagaucgagcuguacagcgagcccgacaccgacaccaucaacugcgaccaguucagcagacugcugugcgacauggagggcgacgaggagaccagagaggccuacgccaacaucgccgagcuggaccaguacguguuccaggacagccagcuggagggccugagcaaggacaucuucaagcacaucggccccgacgaggugaucggcgagagcauggagaugcccgccgaggugggccagaagagccagaagagacccuuccccgaggagcugcccgccgaccugaagcacuggaagcccgccgagccccccaccguggugaccggcagccugcuggugggccccgugagcgacugcagcacccugcccugccugccccugcccgcccuguucaaccaggagcccgccagcggccagaugagacuggagaagaccgaccagauccccaugcccuucagcagcagcagccugagcugccugaaccugcccgagggccccauccaguucgugcccaccaucagcacccugccccacggccuguggcagaucagcgaggccggcaccggcgugagcagcaucuucaucuaccacggcgaggugccccaggccagccaggugcccccccccagcggcuucaccgugcacggccugcccaccagccccgacagacccggcagcaccagccccuucgcccccagcgccaccgaccugcccagcaugcccgagcccgcccugaccagcagagccaacaugaccgagcacaagaccagccccacccagugccccgccgccggcgaggugagcaacaagcugcccaaguggcccgagcccguggagcaguucuacagaagccugcaggacaccuacggcgccgagcccgccggccccgacggcauccugguggagguggaccuggugcaggccagacuggagagaagcagcagcaagagccuggagagagagcuggccacccccgacugggccgagagacagcuggcccagggcggccuggccgaggugcugcuggccgccaaggagcacagaagacccagagagaccagagugaucgccgugcugggcaaggccggccagggcaagagcuacugggccggcgccgugagcagagccugggccugcggcagacugccccaguacgacuucguguucagcgugcccugccacugccugaacagacccggcgacgccuacggccugcaggaccugcuguucagccugggcccccagccccugguggccgccgacgagguguucagccacauccugaagagacccgacagagugcugcugauccuggacggcuucgaggagcuggaggcccaggacggcuuccugcacagcaccugcggccccgcccccgccgagcccugcagccugagaggccugcuggccggccuguuccagaagaagcugcugagaggcugcacccugcugcugaccgccagacccagaggcagacuggugcagagccugagcaaggccgacgcccuguucgagcugagcggcuucagcauggagcaggcccaggccuacgugaugagauacuucgagagcagcggcaugaccgagcaccaggacagagcccugacccugcugagagacagaccccugcugcugagccacagccacagccccacccugugcagagccgugugccagcugagcgaggcccugcuggagcugggcgaggacgccaagcugcccagcacccugaccggccuguacgugggccugcugggcagagccgcccuggacagcccccccggcgcccuggccgagcuggccaagcuggccugggagcugggcagaagacaccagagcacccugcaggaggaccaguuccccagcgccgacgugagaaccugggccauggccaagggccuggugcagcacccccccagagccgccgagagcgagcuggccuuccccagcuuccugcugcagugcuuccugggcgcccuguggcuggcccugagcggcgagaucaaggacaaggagcugccccaguaccuggcccugacccccagaaagaagagacccuacgacaacuggcuggagggcgugcccagauuccuggccggccugaucuuccagccccccgccagaugccugggcgcccugcugggccccagcgccgccgccagcguggacagaaagcagaaggugcuggccagauaccugaagagacugcagcccggcacccugagagccagacagcugcuggagcugcugcacugcgcccacgaggccgaggaggccggcaucuggcagcacguggugcaggagcugcccggcagacugagcuuccugggcaccagacugaccccccccgacgcccacgugcugggcaaggcccuggaggccgccggccaggacuucagccuggaccugagaagcaccggcaucugccccagcggccugggcagccuggugggccugagcugcgugaccagauucagagccgcccugagcgacaccguggcccugugggagagccugcagcagcacggcgagaccaagcugcugcaggccgccgaggagaaguucaccaucgagcccuucaaggccaagagccugaaggacguggaggaccugggcaagcuggugcagacccagagaaccagaagcagcagcgaggacaccgccggcgagcugcccgccgugagagaccugaagaagcuggaguucgcccugggccccgugagcggcccccaggccuuccccaagcuggugagaauccugaccgccuucagcagccugcagcaccuggaccuggacgcccugagcgagaacaagaucggcgacgagggcgugagccagcugagcgccaccuucccccagcugaagagccuggagacccugaaccugagccagaacaacaucaccgaccugggcgccuacaagcuggccgaggcccugcccagccuggccgccagccugcugagacugagccuguacaacaacugcaucugcgacgugggcgccgagagccuggccagagugcugcccgacauggugagccugagagugauggacgugcaguacaacaaguucaccgccgccggcgcccagcagcuggccgccagccugagaagaugcccccacguggagacccuggccauguggacccccaccauccccuucagcgugcaggagcaccugcagcagcaggacagcagaaucagccugagauaa

SEQ ID NO: 15258 - RNA, 3471 nt, Artificial Sequence
  CILP2__Homo_sapiens__NP_694953
auggccagccugcugccccugcugugccugugcgugguggccgcccaccuggccggcgccagagacgccacccccaccgaggagcccauggccaccgcccugggccuggagagaagaagcguguacaccggccagcccagccccgcccuggaggacugggaggaggccagcgaguggaccagcugguucaacguggaccaccccggcggcgacggcgacuucgagagccuggccgccaucagauucuacuacggccccgccagagugugccccagaccccuggcccuggaggccagaaccaccgacugggcccugcccagcgccgugggcgagagagugcaccugaaccccaccagaggcuucuggugccugaacagagagcagcccagaggcagaagaugcagcaacuaccacgugagauucagaugcccccuggaggccagcuggggcgccuggggccccuggggccccugcagcggcagcugcggccccggcagaagacugagaagaagacacugccccagccccgccggcgacgccugccccggcagaccccuggaggcccagaagugcgugagacccagaugccccggcugcagccuggacaccugcgagugccccgaccacauccugcugggcagcguggugacccccagcggccagccccugcugggcgccagagugagccugagagaccagcccggcaccguggccaccagcgacgcccacggcaccuucagagugcccggcgugugcgccgacagcagagccaacaucagagcccagauggacggcuucagcgccggcgaggcccaggcccaggccaacggcagcaucagcguggugaccaucauccuggacaagcuggagaagcccuaccuggugaagcaccccgagagcagagugagagaggccggccagaacgugaccuucugcugcaaggccagcggcacccccaugcccaagaaguacagcugguuccacaacggcacccugcuggacagaagagcccacggcuacggcgcccaccuggagcugagaggccugagacccgaccaggccggcaucuaccacugcaaggccuggaacgaggccggcgccgugagaagcggcaccgccagacugaccgugcuggcccccggccagcccgccugcgaccccagacccagagaguaccugaucaagcugcccgaggacugcggccagcccggcagcggccccgccuaccuggacgugggccugugccccgacaccagaugccccagccuggccggcagcagccccagaugcggcgacgccagcagcagaugcugcagcgugagaagacuggagagaagagagauccacugccccggcuacgugcugcccgugaaggugguggccgagugcggcugccagaagugccugccccccagaggccuggugagaggcagagugguggccgccgacagcggcgagccccugagauucgccagaauccugcugggccaggagcccaucggcuucaccgccuaccagggcgacuucaccaucgaggugccccccagcacccagagacugguggugaccuucguggaccccagcggcgaguucauggacgccgugagagugcugcccuucgaccccagaggcgccggcguguaccacgaggugaaggccaugagaaagaaggcccccgugauccugcacaccagccagagcaacaccaucccccugggcgagcuggaggacgaggccccccugggcgagcuggugcugcccagcggcgccuucagaagagccgacggcaagcccuacagcggccccguggaggccagagugaccuucguggaccccagagaccugaccagcgccgccagcgcccccagcgaccugagauucguggacagcgacggcgagcuggccccccugagaaccuacggcauguucagcguggaccugagagcccccggcagcgccgagcagcugcaggugggccccguggccgugagaguggccgccagccagauccacaugcccggccacguggaggcccugaagcuguggagccugaaccccgagaccggccugugggaggaggagagcggcuucagaagagagggcagcagcggccccagagugagaagagaggagagaguguuccuggugggcaacguggagaucagagagagaagacuguucaaccuggacgugcccgagagaagaagaugcuucgugaaggugagagccuacgccaacgacaaguucacccccagcgagcagguggagggcgugguggugacccuggugaaccuggagcccgcccccggcuucagcgccaaccccagagccuggggcagauucgacagcgccgugaccggccccaacggcgccugccugcccgccuucugcgacgccgacagacccgacgccuacaccgcccuggugaccgccacccugggcggcgaggagcuggagcccgcccccagccugcccagaccccugcccgccaccgugggcgugacccagcccuaccuggacagacugggcuacagaagaaccgaccacgacgaccccgccuucaagagaaacggcuucagaaucaaccuggccaagcccagacccggcgaccccgccgaggccaacggccccguguaccccuggagaagccugagagagugccagggcgcccccgugaccgccagccacuucagauucgccagaguggaggccgacaaguacgaguacaacguggugcccuucagagagggcacccccgccagcuggaccggcgaccugcuggccugguggcccaacccccaggaguucagagccugcuuccugaaggugaagauccagggcccccaggaguacauggugagaagccacaacgccggcggcagccaccccagaaccagaggccagcuguacggccugagagacgccagaagcgugagagaccccgagagacccggcaccagcgccgccugcguggaguucaagugcagcggcaugcuguucgaccagagacagguggacagaacccuggugaccaucaugccccagggcagcugcagaagaguggccgugaacggccugcugagagacuaccugaccagacaccccccccccgugcccgccgaggaccccgccgccuucagcaugcuggccccccuggacccccugggccacaacuacggcguguacaccgugaccgaccagagccccagacuggccaaggagaucgccaucggcagaugcuucgacggcagcagcgacggcuucagcagagagaugaaggccgacgccggcaccgccgugaccuuccagugcagagagccccccgccggcagacccagccuguuccagagacugcuggagagccccgccaccgcccugggcgacaucagaagagagaugagcgaggccgcccaggcccaggccagagccagcggcccccugagaaccagaagaggcagagugagacaguaa

SEQ ID NO: 15259 - RNA, 3555 nt, Artificial Sequence
  CILP__Homo_sapiens__NP_003604
auggugggcaccaaggccuggguguucagcuuccuggugcuggaggugaccagcgugcugggcagacagaccaugcugacccagagcgugagaagagugcagcccggcaagaagaaccccagcaucuucgccaagcccgccgacacccuggagagccccggcgaguggaccaccugguucaacaucgacuaccccggcggcaagggcgacuacgagagacuggacgccaucagauucuacuacggcgacagagugugcgccagaccccugagacuggaggccagaaccaccgacuggacccccgccggcagcaccggccagguggugcacggcagccccagagagggcuucuggugccugaacagagagcagagacccggccagaacugcagcaacuacaccgugagauuccugugcccccccggcagccugagaagagacaccgagagaaucuggagccccuggagccccuggagcaagugcagcgccgccugcggccagaccggcgugcagaccagaaccagaaucugccuggccgagauggugagccugugcagcgaggccagcgaggagggccagcacugcaugggccaggacugcaccgccugcgaccugaccugccccaugggccaggugaacgccgacugcgacgccugcaugugccaggacuucaugcugcacggcgccgugagccugcccggcggcgcccccgccagcggcgccgccaucuaccugcugaccaagacccccaagcugcugacccagaccgacagcgacggcagauucagaauccccggccugugccccgacggcaagagcauccugaagaucaccaaggugaaguucgcccccaucgugcugaccaugcccaagaccagccugaaggccgccaccaucaaggccgaguucgugagagccgagacccccuacauggugaugaaccccgagaccaaggccagaagagccggccagagcgugagccugugcugcaaggccaccggcaagcccagacccgacaaguacuucugguaccacaacgacacccugcuggaccccagccuguacaagcacgagagcaagcuggugcugagaaagcugcagcagcaccaggccggcgaguacuucugcaaggcccagagcgacgccggcgccgugaagagcaagguggcccagcugaucgugaucgccagcgacgagacccccugcaaccccgugcccgagagcuaccugaucagacugccccacgacugcuuccagaacgccaccaacagcuucuacuacgacgugggcagaugccccgugaagaccugcgccggccagcaggacaacggcaucagaugcagagacgccgugcagaacugcugcggcaucagcaagaccgaggagagagagauccagugcagcggcuacacccugcccaccaagguggccaaggagugcagcugccagagaugcaccgagaccagaagcaucgugagaggcagagugagcgccgccgacaacggcgagcccaugagauucggccacguguacaugggcaacagcagagugagcaugaccggcuacaagggcaccuucacccugcacgugccccaggacaccgagagacuggugcugaccuucguggacagacugcagaaguucgugaacaccaccaaggugcugcccuucaacaagaagggcagcgccguguuccacgagaucaagaugcugagaagaaaggagcccaucacccuggaggccauggagaccaacaucaucccccugggcgagguggugggcgaggaccccauggccgagcuggagauccccagcagaagcuucuacagacagaacggcgagcccuacaucggcaaggugaaggccagcgugaccuuccuggaccccagaaacaucagcaccgccaccgccgcccagaccgaccugaacuucaucaacgacgagggcgacaccuucccccugagaaccuacggcauguucagcguggacuucagagacgaggugaccagcgagccccugaacgccggcaaggugaaggugcaccuggacagcacccaggugaagaugcccgagcacaucagcaccgugaagcuguggagccugaaccccgacaccggccugugggaggaggagggcgacuucaaguucgagaaccagagaagaaacaagagagaggacagaaccuuccuggugggcaaccuggagaucagagagagaagacuguucaaccuggacgugcccgagagcagaagaugcuucgugaaggugagagccuacagaagcgagagauuccugcccagcgagcagauccagggcguggugaucagcgugaucaaccuggagcccagaaccggcuuccugagcaaccccagagccuggggcagauucgacagcgugaucaccggccccaacggcgccugcgugcccgccuucugcgacgaccagagccccgacgccuacagcgccuacgugcuggccagccuggccggcgaggagcugcaggccguggagagcagccccaaguucaaccccaacgccaucggcgugccccagcccuaccugaacaagcugaacuacagaagaaccgaccacgaggaccccagagugaagaagaccgccuuccagaucagcauggccaagcccagacccaacagcgccgaggagagcaacggccccaucuacgccuucgagaaccugagagccugcgaggaggccccccccagcgccgcccacuucagauucuaccagaucgagggcgacagauacgacuacaacaccgugcccuucaacgaggacgaccccaugagcuggaccgaggacuaccuggccugguggcccaagcccauggaguucagagccugcuacaucaaggugaagaucgugggcccccuggaggugaacgugagaagcagaaacaugggcggcacccacagacagaccgugggcaagcuguacggcaucagagacgugagaagcaccagagacagagaccagcccaacgugagcgccgccugccuggaguucaagugcagcggcaugcuguacgaccaggacagaguggacagaacccuggugaaggugaucccccagggcagcugcagaagagccagcgugaaccccaugcugcacgaguaccuggugaaccaccugccccuggccgugaacaacgacaccagcgaguacaccaugcuggccccccuggacccccugggccacaacuacggcaucuacaccgugaccgaccaggaccccagaaccgccaaggagaucgcccugggcagaugcuucgacggcaccagcgacggcagcagcagaaucaugaagagcaacgugggcguggcccugaccuucaacugcguggagagacaggugggcagacagagcgccuuccaguaccugcagagcacccccgcccagagccccgccgccggcaccgugcagggcagagugcccagcagaagacagcagagagccagcagaggcggccagagacagggcggcgugguggccagccugagauuccccagaguggcccagcagccccugaucaacuaa

SEQ ID NO: 15260 - RNA, 639 nt, Artificial Sequence
  CINP__Homo_sapiens__NP_116019
auggaggccaagacccugggcaccgugacccccagaaagcccgugcugagcgugagcgccagaaagaucaaggacaacgccgccgacuggcacaaccugauccugaagugggagacccugaacgacgccggcuucaccaccgccaacaacaucgccaaccugaagaucagccugcugaacaaggacaagaucgagcuggacagcagcagccccgccagcaaggagaacgaggagaaggugugccuggaguacaacgaggagcuggagaagcugugcgaggagcugcaggccacccuggacggccugaccaagauccaggugaagauggagaagcugagcagcaccaccaagggcaucugcgagcuggagaacuaccacuacggcgaggagagcaagagacccccccuguuccacaccuggcccaccacccacuucuacgaggugagccacaagcugcuggagauguacagaaaggagcugcugcugaagagaaccguggccaaggagcuggcccacaccggcgaccccgaccugacccugagcuaccugagcauguggcugcaccagcccuacguggagagcgacagcagacugcaccuggagagcaugcugcuggagaccggccacagagcccuguaa

SEQ ID NO: 15261 - RNA, 1200 nt, Artificial Sequence
  CIPC__Homo_sapiens__NP_219494
auggagagaaagaaccccagcagagagagccccagaagacugagcgccaaggugggcaagggcaccgagaugaagaagguggccagacagcugggcauggccgccgccgagagcgacaaggacagcggcuucagcgacggcagcagcgagugccugagcagcgccgagcagauggagagcgaggacaugcugagcgcccugggcuggagcagagaggacagacccagacagaacagcaagaccgccaagaacgccuuccccacccugagccccaugguggugaugaagaacgugcuggugaagcagggcagcagcagcagccagcugcagagcuggaccgugcagcccagcuucgaggugaucagcgcccagccccagcugcuguuccugcacccccccgugcccagccccgugagccccugccacaccggcgagaagaagagcgacagcagaaacuaccugcccauccugaacagcuacaccaagaucgccccccaccccggcaagagaggccugagccugggccccgaggagaagggcaccagcggcgugcagaagaagaucugcaccgagagacugggccccagccugagcagcagcgagcccaccaaggccggcgccgugcccagcagccccagcacccccgccccccccagcgccaagcuggccgaggacagcgcccugcagggcgugcccagccugguggccggcggcagcccccagacccugcagcccgugagcagcagccacguggccaaggcccccagccugaccuucgccagccccgccagccccgugugcgccagcgacagcacccugcacggccuggagagcaacagcccccugagcccccugagcgccaacuacagcagcccccugugggccgccgagcaccugugcagaagccccgacaucuucagcgagcagagacagagcaagcacagaagauuccagaacacccugguggugcugcacaagagcggccugcuggagaucacccugaagaccaaggagcugaucagacagaaccaggccacccagguggagcuggaccagcugaaggagcagacccagcuguucaucgaggccaccaagagcagagccccccaggccugggccaagcugcaggccagccugacccccggcagcagcaacaccggcagcgaccuggaggccuucagcgaccaccccgccaucuaa

SEQ ID NO: 15262 - RNA, 1353 nt, Artificial Sequence
  CIR1__Homo_sapiens__NP_004873
augggcaagagcuucgccaacuucaugugcaagaaggacuuccaccccgccagcaagagcaacaucaagaagguguggauggccgagcagaagaucagcuacgacaagaagaagcaggaggagcugaugcagcaguaccugaaggagcaggagagcuacgacaacagacugcugaugggcgacgagagagugaagaacggccugaacuucauguacgaggccccccccggcgccaagaaggagaacaaggagaaggaggagaccgagggcgagaccgaguacaaguucgaguggcagaagggcgcccccagagagaaguacgccaaggacgacaugaacaucagagaccagcccuucggcauccaggugagaaacgugagaugcaucaagugccacaaguggggccacgugaacaccgacagagagugcccccuguucggccugagcggcaucaacgccagcagcgugcccaccgacggcagcggccccagcaugcaccccagcgagcugaucgccgagaugagaaacagcggcuucgcccugaagagaaacgugcugggcagaaaccugaccgccaacgaccccagccaggaguacguggccagcgagggcgaggaggaccccgagguggaguuccugaagagccugaccaccaagcagaagcagaagcugcugagaaagcuggacagacuggagaagaagaagaagaagaaggacagaaagaagaagaaguuccagaagagcagaagcaagcacaagaagcacaagagcagcagcagcagcagcagcagcagcagcagcagcagcagcaccgagaccagcgagagcagcagcgagagcgagagcaacaacaaggagaagaagauccagagaaagaagagaaagaagaacaagugcagcggccacaacaacagcgacagcgaggagaaggacaagagcaagaagagaaagcugcacgaggagcugagcagcagccaccacaacagagagaaggccaaggagaagcccagauuccugaagcacgagagcagcagagaggacagcaaguggagccacagcgacagcgacaagaagagcagaacccacaagcacagccccgagaagagaggcagcgagagaaaggagggcagcagcagaagccacggcagagaggagagaagcagaagaagcagaagcagaagccccggcagcuacaagcagagagagaccagaaagagagcccagagaaaccccggcgaggagcagagcagaagaaacgacagcagaagccacggcaccgaccuguacagaggcgagaagauguacagagagcaccccggcggcacccacaccaaggugacccagagagaguaa

SEQ ID NO: 15263 - RNA, 507 nt, Artificial Sequence
  CIRBP__Homo_sapiens__NP_001287744
auggccagcgacgagggcaagcuguucgugggcggccugagcuucgacaccaacgagcagagccuggagcagguguucagcaaguacggccagaucagcgagguggugguggugaaggacagagagacccagagaagcagaggcuucggcuucgugaccuucgagaacaucgacgacgccaaggacgccaugauggccaugaacggcaagagcguggacggcagacagaucagaguggaccaggccggcaagagcagcgacaacagaagcagaggcuacagaggcggcagcgccggcggcagaggcuucuucagaggcggcagaggcagaggcagaggcuucagcagaggcggcggcgacagaggcuacggcggcaacagauucgagagcagaagcggcggcuacggcggcagcagagacuacuacagcagcagaagccagagcggcggcuacagcgacagaagcagcggcggcagcuacagagacagcuacgacagcuacggcuaa

SEQ ID NO: 15264 - RNA, 2061 nt, Artificial Sequence
  CIRH1A__Homo_sapiens__NP_116219
augggcgaguucaaggugcacagagugagauucuucaacuacgugcccagcggcaucagaugcguggccuacaacaaccagagcaacagacuggccgugagcagaaccgacggcaccguggagaucuacaaccugagcgccaacuacuuccaggagaaguucuuccccggccacgagagcagagccaccgaggcccugugcugggccgagggccagagacuguucagcgccggccugaacggcgagaucauggaguacgaccugcaggcccugaacaucaaguacgccauggacgccuucggcggccccaucuggagcauggccgccagccccagcggcagccagcugcuggugggcugcgaggacggcagcgugaagcuguuccagaucacccccgacaagauccaguucgagagaaacuucgacagacagaagagcagaauccugagccugagcuggcaccccagcggcacccacaucgccgccggcagcaucgacuacaucagcguguucgacgugaagagcggcagcgccgugcacaagaugaucguggacagacaguacaugggcgugagcaagagaaagugcaucguguggggcguggccuuccugagcgacggcaccaucaucagcguggacagcgccggcaaggugcaguucugggacagcgccaccggcacccuggugaagagccaccugaucgccaacgccgacgugcagagcaucgccguggccgaccaggaggacagcuucguggugggcaccgccgagggcaccguguuccacuuccagcuggugcccgugaccagcaacagcagcgagaagcagugggugagaaccaagcccuuccagcaccacacccacgacgugagaaccguggcccacagccccaccgcccugaucagcggcggcaccgacacccaccugguguucagaccccugauggagaagguggaggugaagaacuacgacgccgcccugagaaagaucaccuucccccacagaugccugaucagcugcagcaagaagagacagcugcugcuguuccaguucgcccaccaccuggagcuguggagacugggcagcaccguggccaccggcaagaacggcgacacccugccccugagcaagaacgccgaccaccugcugcaccugaagaccaagggccccgagaacaucaucugcagcugcaucagccccugcggcagcuggaucgccuacagcaccgugagcagauucuuccuguacagacugaacuacgagcacgacaacaucagccugaagagagugagcaagaugcccgccuuccugagaagcgcccugcagauccuguucagcgaggacagcaccaagcuguucguggccagcaaccagggcgcccugcacaucgugcagcugagcggcggcagcuucaagcaccugcacgccuuccagccccagagcggcaccguggaggccaugugccugcuggccgugagccccgacggcaacuggcuggccgccagcggcaccagcgccggcgugcacguguacaacgugaagcagcugaagcugcacugcaccgugcccgccuacaacuuccccgugaccgccauggccaucgcccccaacaccaacaaccuggugaucgcccacagcgaccagcagguguucgaguacagcauccccgacaagcaguacaccgacuggagcagaaccgugcagaagcagggcuuccaccaccuguggcugcagagagacacccccaucacccacaucagcuuccaccccaagagacccaugcacauccugcugcacgacgccuacauguucugcaucaucgacaagagccugccccugcccaacgacaagacccugcuguacaaccccuucccccccaccaacgagagcgacgugaucagaagaagaaccgcccacgccuucaagaucagcaagaucuacaagccccugcuguucauggaccugcuggacgagagaacccugguggccguggagagaccccuggacgacaucaucgcccagcugcccccccccaucaagaagaagaaguucggcaccuaa

SEQ ID NO: 15265 - RNA, 327 nt, Artificial Sequence
  CISD1__Homo_sapiens__NP_060934
augagccugaccagcagcagcagcgugagaguggaguggaucgccgccgugaccaucgccgccggcaccgccgccaucggcuaccuggccuacaagagauucuacgugaaggaccacagaaacaaggccaugaucaaccugcacauccagaaggacaaccccaagaucgugcacgccuucgacauggaggaccugggcgacaaggccguguacugcagaugcuggagaagcaagaaguuccccuucugcgacggcgcccacaccaagcacaacgaggagaccggcgacaacgugggcccccugaucaucaagaagaaggagaccuaa

SEQ ID NO: 15266 - RNA, 408 nt, Artificial Sequence
  CISD2__Homo_sapiens__NP_001008389
auggugcuggagagcguggccagaaucgugaaggugcagcugcccgccuaccugaagagacugcccgugcccgagagcaucaccggcuucgccagacugaccgugagcgaguggcugagacugcugcccuuccugggcgugcuggcccugcugggcuaccuggccgugagacccuuccugcccaagaagaagcagcagaaggacagccugaucaaccugaagauccagaaggagaaccccaagguggugaacgagaucaacaucgaggaccugugccugaccaaggccgccuacugcagaugcuggagaagcaagaccuuccccgccugcgacggcagccacaacaagcacaacgagcugaccggcgacaacgugggcccccugauccugaagaagaaggagguguaa

SEQ ID NO: 15267 - RNA, 828 nt, Artificial Sequence
  CISH__Homo_sapiens__NP_037456
auguaccuggagcacaccagccacugcccccaccacgacgacgacaccgccauggacaccccccugcccagacccagaccccugcuggccguggagagaaccggccagagaccccugugggcccccagccuggagcugcccaagcccgugaugcagccccugcccgccggcgccuuccuggaggagguggccgagggcacccccgcccagaccgagagcgagcccaaggugcuggaccccgaggaggaccugcugugcaucgccaagaccuucagcuaccugagagagagcggcugguacuggggcagcaucaccgccagcgaggccagacagcaccugcagaagaugcccgagggcaccuuccuggugagagacagcacccaccccagcuaccuguucacccugagcgugaagaccaccagaggccccaccaacgugagaaucgaguacgccgacagcagcuucagacuggacagcaacugccugagcagacccagaauccuggccuuccccgacguggugagccuggugcagcacuacguggccagcugcaccgccgacaccagaagcgacagccccgaccccgcccccacccccgcccugcccaugcccaaggaggacgcccccagcgaccccgcccugcccgcccccccccccgccaccgccgugcaccugaagcuggugcagcccuucgugagaagaagcagcgccagaagccugcagcaccugugcagacuggugaucaacagacugguggccgacguggacugccugccccugcccagaagaauggccgacuaccugagacaguaccccuuccagcuguaa

SEQ ID NO: 15268 - RNA, 660 nt, Artificial Sequence
  CITED1__Homo_sapiens__NP_001138357
auggagcccagcgcccagcagcugcagcuggccgccagccugcccgccaaccugagcaacuucugccagggcagcgagaugcccaccaccagcagacccgcccuggacgugaagggcggcaccagccccgccaaggaggacgccaaccaggagaugagcagcguggccuacagcaaccuggccgugaaggacagaaaggccguggccauccugcacuaccccggcguggccagcaacggcaccaaggccagcggcgcccccaccagcagcagcggcagccccaucggcagccccaccaccaccccccccaccaagccccccagcuucaaccugcaccccgccccccaccugcuggccagcaugcaccugcagaagcugaacagccaguaccagggcauggccgccgccacccccggccagcccggcgaggccggcccccugcagaacugggacuucggcgcccaggccggcggcgccgagagccugagccccagcgccggcgcccagagccccgccaucaucgacagcgaccccguggacgaggaggugcugaugagccuggugguggagcugggccuggacagagccaacgagcugcccgagcuguggcugggccagaacgaguucgacuucaccgccgacuuccccagcagcugcuaa

SEQ ID NO: 15269 - RNA, 813 nt, Artificial Sequence
  CITED2__Homo_sapiens__NP_001161860
auggccgaccacaugauggccaugaaccacggcagauuccccgacggcaccaacggccugcaccaccaccccgcccacagaaugggcaugggccaguuccccagcccccaccaccaccagcagcagcagccccagcacgccuucaacgcccugaugggcgagcacauccacuacggcgccggcaacaugaacgccaccagcggcaucagacacgccaugggccccggcaccgugaacggcggccacccccccagcgcccuggcccccgccgccagauucaacaacagccaguucaugggcccccccguggccagccagggcggcagccugcccgccagcaugcagcugcagaagcugaacaaccaguacuucaaccaccaccccuacccccacaaccacuacaugcccgaccugcaccccgccgccggccaccagaugaacggcaccaaccagcacuucagagacugcaaccccaagcacagcggcggcagcagcacccccggcggcagcggcggcagcagcacccccggcggcagcggcagcagcagcggcggcggcgccggcagcagcaacagcggcggcggcagcggcagcggcaacaugcccgccagcguggcccacgugcccgccgccaugcugccccccaacgugaucgacaccgacuucaucgacgaggaggugcugaugagccuggugaucgagaugggccuggacagaaucaaggagcugcccgagcuguggcugggccagaacgaguucgacuucaugaccgacuucgugugcaagcagcagcccagcagagugagcugcuaa

SEQ ID NO: 15270 - RNA, 6210 nt, Artificial Sequence
  CIT__Homo_sapiens__NP_001193928
augcugaaguucaaguacggcgccagaaacccccuggacgccggcgccgccgagcccaucgccagcagagccagcagacugaaccuguucuuccagggcaagccccccuucaugacccagcagcagaugagcccccugagcagagagggcauccuggacgcccuguucgugcuguucgaggagugcagccagcccgcccugaugaagaucaagcacgugagcaacuucgugagaaaguacagcgacaccaucgccgagcugcaggagcugcagcccagcgccaaggacuucgaggugagaagccuggugggcugcggccacuucgccgaggugcagguggugagagagaaggccaccggcgacaucuacgccaugaaggugaugaagaagaaggcccugcuggcccaggagcaggugagcuucuucgaggaggagagaaacauccugagcagaagcaccagccccuggaucccccagcugcaguacgccuuccaggacaagaaccaccuguaccuggugauggaguaccagcccggcggcgaccugcugagccugcugaacagauacgaggaccagcuggacgagaaccugauccaguucuaccuggccgagcugauccuggccgugcacagcgugcaccugaugggcuacgugcacagagacaucaagcccgagaacauccugguggacagaaccggccacaucaagcugguggacuucggcagcgccgccaagaugaacagcaacaagauggugaacgccaagcugcccaucggcacccccgacuacauggcccccgaggugcugaccgugaugaacggcgacggcaagggcaccuacggccuggacugcgacugguggagcgugggcgugaucgccuacgagaugaucuacggcagaagccccuucgccgagggcaccagcgccagaaccuucaacaacaucaugaacuuccagagauuccugaaguuccccgacgaccccaaggugagcagcgacuuccuggaccugauccagagccugcugugcggccagaaggagagacugaaguucgagggccugugcugccaccccuucuucagcaagaucgacuggaacaacaucagaaacagccccccccccuucgugcccacccugaagagcgacgacgacaccagcaacuucgacgagcccgagaagaacagcugggugagcagcagccccugccagcugagccccagcggcuucagcggcgaggagcugcccuucgugggcuucagcuacagcaaggcccugggcauccugggcagaagcgagagcguggugagcggccuggacagccccgccaagaccagcagcauggagaagaagcugcugaucaagagcaaggagcugcaggacagccaggacaagugccacaagauggagcaggagaugaccagacugcacagaagagugagcgagguggaggccgugcugagccagaaggagguggagcugaaggccagcgagacccagagaagccugcuggagcaggaccuggccaccuacaucaccgagugcagcagccugaagagaagccuggagcaggccagaauggaggugagccaggaggacgacaaggcccugcagcugcugcacgacaucagagagcagagcagaaagcugcaggagaucaaggagcaggaguaccaggcccagguggaggagaugagacugaugaugaaccagcuggaggaggaccuggugagcgccagaagaagaagcgaccuguacgagagcgagcugagagagagcagacuggccgccgaggaguucaagagaaaggccaccgagugccagcacaagcugcugaaggccaaggaccagggcaagcccgaggugggcgaguacgccaagcuggagaagaucaacgccgagcagcagcugaagauccaggagcugcaggagaagcuggagaaggccgugaaggccagcaccgaggccaccgagcugcugcagaacaucagacaggccaaggagagagccgagagagagcuggagaagcugcagaacagagaggacagcagcgagggcaucagaaagaagcugguggaggccgaggagagaagacacagccuggagaacaaggugaagagacuggagaccauggagagaagagagaacagacugaaggacgacauccagaccaagagccagcagauccagcagauggccgacaagauccuggagcuggaggagaagcacagagaggcccaggugagcgcccagcaccuggaggugcaccugaagcagaaggagcagcacuacgaggagaagaucaaggugcuggacaaccagaucaagaaggaccuggccgacaaggagacccuggagaacaugaugcagagacacgaggaggaggcccacgagaagggcaagauccugagcgagcagaaggccaugaucaacgccauggacagcaagaucagaagccuggagcagagaaucguggagcugagcgaggccaacaagcuggccgccaacagcagccuguucacccagagaaacaugaaggcccaggaggagaugaucagcgagcugagacagcagaaguucuaccuggagacccaggccggcaagcuggaggcccagaacagaaagcuggaggagcagcuggagaagaucagccaccaggaccacagcgacaagaacagacugcuggagcuggagaccagacugagagaggugagccuggagcacgaggagcagaagcuggagcugaagagacagcugaccgagcugcagcugagccugcaggagagagagagccagcugaccgcccugcaggccgccagagccgcccuggagagccagcugagacaggccaagaccgagcuggaggagaccaccgccgaggccgaggaggagauccaggcccugaccgcccacagagacgagauccagagaaaguucgacgcccugagaaacagcugcaccgugaucaccgaccuggaggagcagcugaaccagcugaccgaggacaacgccgagcugaacaaccagaacuucuaccugagcaagcagcuggacgaggccagcggcgccaacgacgagaucgugcagcugagaagcgagguggaccaccugagaagagagaucaccgagagagagaugcagcugaccagccagaagcagaccauggaggcccugaagaccaccugcaccaugcuggaggagcaggugauggaccuggaggcccugaacgacgagcugcuggagaaggagagacagugggaggccuggagaagcgugcugggcgacgagaagagccaguucgagugcagagugagagagcugcagagaaugcuggacaccgagaagcagagcagagccagagccgaccagagaaucaccgagagcagacaggugguggagcuggccgugaaggagcacaaggccgagauccuggcccugcagcaggcccugaaggagcagaagcugaaggccgagagccugagcgacaagcugaacgaccuggagaagaagcacgccaugcuggagaugaacgccagaagccugcagcagaagcuggagaccgagagagagcugaagcagagacugcuggaggagcaggccaagcugcagcagcagauggaccugcagaagaaccacaucuucagacugacccagggccugcaggaggcccuggacagagccgaccugcugaagaccgagagaagcgaccuggaguaccagcuggagaacauccaggugcuguacagccacgagaaggugaagauggagggcaccaucagccagcagaccaagcugaucgacuuccugcaggccaagauggaccagcccgccaagaagaagaagggccuguucagcagaagaaaggaggaccccgcccugcccacccaggugccccugcaguacaacgagcugaagcuggcccuggagaaggagaaggccagaugcgccgagcuggaggaggcccugcagaagaccagaaucgagcugagaagcgccagagaggaggccgcccacagaaaggccaccgaccacccccaccccagcacccccgccaccgccagacagcagaucgccaugagcgccaucgugagaagccccgagcaccagcccagcgccaugagccugcuggccccccccagcagcagaagaaaggagagcagcacccccgaggaguucagcagaagacugaaggagagaaugcaccacaacaucccccacagauucaacgugggccugaacaugagagccaccaagugcgccgugugccuggacaccgugcacuucggcagacaggccagcaagugccuggagugccaggugaugugccaccccaagugcagcaccugccugcccgccaccugcggccugcccgccgaguacgccacccacuucaccgaggccuucugcagagacaagaugaacagccccggccugcagaccaaggagcccagcagcagccugcaccuggagggcuggaugaaggugcccagaaacaacaagagaggccagcagggcugggacagaaaguacaucgugcuggagggcagcaaggugcugaucuacgacaacgaggccagagaggccggccagagacccguggaggaguucgagcugugccugcccgacggcgacgugagcauccacggcgccgugggcgccagcgagcuggccaacaccgccaaggccgacgugcccuacauccugaagauggagagccacccccacaccaccugcuggcccggcagaacccuguaccugcuggcccccagcuuccccgacaagcagagaugggugaccgcccuggagagcgugguggccggcggcagagugagcagagagaaggccgaggccgacgccaagcugcugggcaacagccugcugaagcuggagggcgacgacagacuggacaugaacugcacccugcccuucagcgaccagguggugcuggugggcaccgaggagggccuguacgcccugaacgugcugaagaacagccugacccacgugcccggcaucggcgccguguuccagaucuacaucaucaaggaccuggagaagcugcugaugaucgccggcgaggagagagcccugugccugguggacgugaagaaggugaagcagagccuggcccagagccaccugcccgcccagcccgacaucagccccaacaucuucgaggccgugaagggcugccaccuguucggcgccggcaagaucgagaacggccugugcaucugcgccgccaugcccagcaagguggugauccugagauacaacgagaaccugagcaaguacugcaucagaaaggagaucgagaccagcgagcccugcagcugcauccacuucaccaacuacagcauccugaucggcaccaacaaguucuacgagaucgacaugaagcaguacacccuggaggaguuccuggacaagaacgaccacagccuggcccccgccguguucgccgccagcagcaacagcuuccccgugagcaucgugcaggugaacagcgccggccagagagaggaguaccugcugugcuuccacgaguucggcguguucguggacagcuacggcagaagaagcagaaccgacgaccugaaguggagcagacugccccuggccuucgccuacagagagcccuaccuguucgugacccacuucaacagccuggaggugaucgagauccaggccagaagcagcgccggcacccccgccagagccuaccuggacauccccaaccccagauaccugggccccgccaucagcagcggcgccaucuaccuggccagcagcuaccaggacaagcugagagugaucugcugcaagggcaaccuggugaaggagagcggcaccgagcaccacagaggccccagcaccagcagaagcagccccaacaagagaggcccccccaccuacaacgagcacaucaccaagagaguggccagcagccccgccccccccgagggccccagccaccccagagagcccagcaccccccacagauacagagagggcagaaccgagcugagaagagacaagagccccggcagaccccuggagagagagaagagccccggcagaaugcugagcaccagaagagagagaagccccggcagacuguucgaggacagcagcagaggcagacugcccgccggcgccgugagaaccccccugagccaggugaacaaggugugggaccagagcagcguguaa

SEQ ID NO: 15271 - RNA, 2457 nt, Artificial Sequence
  CIZ1__Homo_sapiens__NP_001124490
auguucagccagcagcagcagcagcagcugcagcagcagcagcagcagcugcagcagcugcagcagcagcagcugcagcagcagcagcugcagcagcagcagcugcugcagcugcagcagcugcugcagcagagccccccccaggccccccugcccauggccgugagcagaggccugcccccccagcagccccagcagccccugcugaaccugcagggcaccaacagcgccagccugcugaacggcagcaugcugcagagagcccugcugcugcagcagcugcagggcaaccugagaggcuacggcauggccagccccggccuggccgcccccagccugacccccccccagcuggccacccccaaccugcagcaguucuucccccaggccaccagacagagccugcugggccccccccccgugggcgugcccaugaaccccagccaguucaaccugagcggcagaaacccccagaagcaggccagaaccagcagcagcaccacccccaacagaaaggacagcagcagccagaccaugcccguggaggacaagagcgacccccccgagggcagcgaggaggccgccgagcccagaauggacacccccgaggaccaggaccugccccccugccccgaggacaucgccaaggagaagagaacccccgcccccgagcccgagcccugcgaggccagcgagcugcccgccaagagacugagaagcagcgaggagcccaccgagaaggagccccccggccagcugcaggugaaggcccagccccaggccagaaugaccgugcccaagcagacccagacccccgaccugcugcccgaggcccuggaggcccaggugcugcccagauuccagcccagagugcugcaggugcaggcccaggugcagagccagacccagcccagaauccccagcaccgacacccaggugcagcccaagcugcagaagcaggcccagacccagaccagccccgagcaccuggugcugcagcagaagcaggugcagccccagcugcagcaggaggccgagccccagaagcaggugcagccccaggugcacacccaggcccagcccagcgugcagccccaggagcacccccccgcccaggugagcgugcagccccccgagcagacccacgagcagccccacacccagccccaggugagccugcuggcccccgagcagacccccgugguggugcacgugugcggccuggagaugccccccgacgccguggaggccggcggcggcauggagaagacccugcccgagcccgugggcacccaggugagcauggaggagauccagaacgagagcgccugcggccuggacgugggcgagugcgagaacagagccagagagaugcccggcguguggggcgccggcggcagccugaaggugaccauccugcagagcagcgacagcagagccuucagcaccgugccccugacccccgugcccagacccagcgacagcgugagcagcacccccgccgccaccagcacccccagcaagcaggcccugcaguucuucugcuacaucugcaaggccagcugcagcagccagcaggaguuccaggaccacaugagcgagccccagcaccagcagagacugggcgagauccagcacaugagccaggccugccugcugagccugcugcccgugcccagagacgugcuggagaccgaggacgaggagcccccccccagaagauggugcaacaccugccagcuguacuacaugggcgaccugauccagcacagaagaacccaggaccacaagaucgccaagcagagccugagacccuucugcaccgugugcaacagauacuucaagacccccagaaaguucguggagcacgugaagagccagggccacaaggacaaggccaaggagcugaagagccuggagaaggagaucgccggccaggacgaggaccacuucaucaccguggacgccgugggcugcuucgagggcgacgaggaggaggaggaggacgacgaggacgaggaggagaucgagguggaggaggagcugugcaagcaggugagaagcagagacaucagcagagaggaguggaagggcagcgagaccuacagccccaacaccgccuacggcguggacuuccuggugcccgugaugggcuacaucugcagaaucugccacaaguucuaccacagcaacagcggcgcccagcugagccacugcaagagccugggccacuucgagaaccugcagaaguacaaggccgccaagaaccccagccccaccaccagacccgugagcagaagaugcgccaucaacgccagaaacgcccugaccgcccuguucaccagcagcggcagaccccccagccagcccaacacccaggacaagacccccagcaaggugaccgccagacccagccagcccccccugcccagaagaagcaccagacugaagaccuaa

SEQ ID NO: 15272 - RNA, 2052 nt, Artificial Sequence
  CKAP2__Homo_sapiens__NP_001091995
augagcacccccgccgugccccaggaccugcagcugccccccagccagagagcccagagcgccuucaaggagcagagaagacagaagcugaaggagcaccugcugagaagaaagacccuguucgccuacaagcaggagaacgagaugcugagcagcagcagagaccagagaguggugaccagcgaggaccaggugcaggagggcaccaaggugcugaagcugaagaccaagauggccgacaaggagaacaugaagagacccgccgagagcaagaacaacaccguggugggcaagcacugcaucccccugaagcccagcaacgagcugaccaacagcaccguggugaucgacacccacaagcccaaggacagcaaccagaccccccaccugcugcugaccgaggacgacccccagagccagcacaugacccugagccaggccuuccaccugaagaacaacagcaagaagaagcagaugaccaccgagaagcagaagcaggacgccaacaugcccaagaagcccgugcugggcagcuacagaggccagaucgugcagagcaagaucaacagcuucagaaagccccugcaggugaaggacgagagcagcgccgccaccaagaagcugagcgccaccauccccaaggccaccaagccccagcccgugaacaccagcagcgugaccgugaagagcaacagaagcagcaacaugaccgccaccaccaaguucgugagcaccaccagccagaacacccagcuggugagaccccccaucagaagccaccacagcaacaccagagacaccgugaagcagggcaucagcagaaccagcgccaacgugaccaucagaaagggcccccacgagaaggagcugcugcagagcaagaccgcccugagcagcgugaagaccagcagcagccagggcaucaucagaaacaagacccugagcagaagcaucgccagcgaggugaucgccagacccgccagccugagcaacgacaagcugauggagaagagcgagcccguggaccagagaagacacaccgccggcaaggccaucguggacagcagaagcgcccagcccaaggagaccagcgaggagagaaaggccagacugagcgaguggaaggccggcaagggcagagugcugaagagaccccccaacagcguggugacccagcacgagcccgccggccagaacgagaagcccgugggcagcuucuggaccaccauggccgaggaggacgagcagagacuguucaccgagaaggugaacaacaccuucagcgagugccugaaccugaucaacgagggcugccccaaggaggacauccuggugacccugaacgaccugaucaagaacauccccgacgccaagaagcuggugaaguacuggaucugccuggcccugaucgagcccaucaccagccccaucgagaacaucaucgccaucuacgagaaggccauccuggccggcgcccagcccaucgaggagaugagacacaccaucguggacauccugaccaugaagagccaggagaaggccaaccugggcgagaacauggagaagagcugcgccagcaaggaggaggugaaggaggugagcaucgaggacaccggcguggacguggaccccgagaagcuggagauggagagcaagcugcacagaaaccugcuguuccaggacugcgagaaggagcaggacaacaagaccaaggaccccacccacgacgugaagacccccaacaccgagaccagaaccagcugccugaucaaguacaacgugagcaccacccccuaccugcagagcgugaagaagaaggugcaguucgacggcaccaacagcgccuucaaggagcugaaguuccugacccccgugagaagaagcagaagacugcaggagaagaccagcaagcugcccgacaugcugaaggaccacuaccccugcgugagcagccuggagcagcugaccgagcugggcagagagaccgacgccuucgugugcagacccaacgccgcccugugcagaguguacuacgaggccgacaccaccuaa

SEQ ID NO: 15273 - RNA, 2238 nt, Artificial Sequence
  CKAP2L__Homo_sapiens__NP_689728
auggugggccccggccccaccgccgccgccgccguggaggagagacagagaaagcugcaggaguaccuggccgccaagggcaagcugaagagccagaacaccaagcccuaccugaagagcaagaacaacugccagaaccagccccccagcaagagcaccaucagacccaagaacgacgugaccaaccacguggugcugcccgugaagcccaagagaagcaucagcaucaagcugcagcccagaccccccaacaccgccggcagccagaagcccaagcuggagccccccaagcugcugggcaagagacugaccagcgagugcgugagcagcaaccccuacagcaagcccagcagcaagagcuuccagcagugcgaggccggcagcagcaccaccggcgagcugagcagaaagcccgugggcagccugaacaucgagcagcugaagaccaccaagcagcagcugaccgaccagggcaacggcaagugcaucgacuucaugaacaacauccacguggagaacgagagccuggacaacuuccugaaggagaccaacaaggagaaccugcuggacauccugaccgagcccgagagaaagcccgaccccaagcuguacaccagaagcaagcccaagaccgacagcuacaaccagaccaagaacagccuggugcccaagcaggcccugggcaagagcagcgugaacagcgccgugcugaaggacagagugaacaagcaguucgugggcgagacccagagcagaaccuuccccgugaagagccagcagcugagcagaggcgccgaccuggccagacccggcgugaagcccagcagaaccgugcccagccacuucaucagaacccugagcaaggugcagagcagcaagaagcccguggugaagaacaucaaggacaucaaggugaacagaagccaguacgagagacccaacgagaccaagaucagaagcuaccccgugaccgagcagagagugaagcacaccaagcccagaaccuaccccagccugcugcagggcgaguacaacaacagacaccccaacaucaagcaggaccagaagagcagccaggugugcaucccccagaccagcugcgugcugcagaagagcaaggccaucagccagagacccaaccugaccgugggcagauucaacagcgccauccccagcacccccagcaucagacccaacggcaccagcggcaacaagcacaacaacaacggcuuccagcagaaggcccagacccuggacagcaagcugaagaaggccgugccccagaaccacuuccugaacaagaccgcccccaagacccaggccgacgugaccaccgugaacggcacccagaccaaccccaacaucaagaagaaggccaccgccgaggacagaagaaagcagcuggaggaguggcagaagagcaagggcaagaccuacaagagaccccccauggagcugaagaccaagagaaaggugaucaaggagaugaacaucagcuucuggaagagcaucgagaaggaggaggaggagaagaaggcccagcuggagcugagcagcaagaucaacaacacccugaccgagugccugaaccugaucgagggcggcgugcccagcaacgagauccugaacauccugagcagcauccccgaggccgagaaguucgccaaguucuggaucugcaaggccaagcugcuggccagcaagggcaccuucgacgugaucggccuguacgaggaggccaucaagaacggcgccacccccauccaggagcugagaaagguggugcugaacauccugcaggacagcaacagaaccaccgagggcaucaccagcgacagccugguggccgagaccagcaucaccagcguggaggagcuggccaagaagauggagagcgugaagagcugccugagccccaaggagagagagcaggugaccgccacccccagaaucgccaaggccgagcagcacaacuaccccggcaucaagcugcagaucggccccauccccagaaucaacggcaugcccgaggugcaggacaugaaguucaucacccccgugagaagaagcagcagaaucgagagagccgugagcagauaccccgagaugcugcaggagcacgaccuggugguggccagccuggacgagcugcuggagguggaggagaccaagugcuucaucuucagaagaaacgaggcccugcccgugacccugggcuuccagacccccgagagcuaa

SEQ ID NO: 15274 - RNA, 1809 nt, Artificial Sequence
  CKAP4__Homo_sapiens__NP_006816
augcccagcgccaagcagagaggcagcaagggcggccacggcgccgccagccccagcgagaagggcgcccaccccagcggcggcgccgacgacguggccaagaagcccccccccgccccccagcagcccccccccccccccgccccccacccccagcagcacccccagcagcacccccagaaccaggcccacggcaagggcggccacagaggcggcggcggcggcggcggcaagagcagcagcagcagcagcgccagcgccgccgccgccgccgccgccgccagcagcagcgccagcugcagcagaagacugggcagagcccugaacuuccuguucuaccuggcccugguggccgccgccgccuucagcggcuggugcgugcaccacgugcuggaggaggugcagcaggugagaagaagccaccaggacuucagcagacagagagaggagcugggccagggccugcagggcguggagcagaaggugcagagccugcaggccaccuucggcaccuucgagagcauccugagaagcagccagcacaagcaggaccugaccgagaaggccgugaagcagggcgagagcgaggugagcagaaucagcgaggugcugcagaagcugcagaacgagauccugaaggaccugagcgacggcauccacguggugaaggacgccagagagagagacuucaccagccuggagaacaccguggaggagagacugaccgagcugaccaagagcaucaacgacaacaucgccaucuucaccgaggugcagaagagaagccagaaggagaucaacgacaugaaggccaagguggccagccuggaggagagcgagggcaacaagcaggaccugaaggcccugaaggaggccgugaaggagauccagaccagcgccaagagcagagagugggacauggaggcccugagaagcacccugcagaccauggagagcgacaucuacaccgaggugagagagcuggugagccugaagcaggagcagcaggccuucaaggaggccgccgacaccgagagacuggcccugcaggcccugaccgagaagcugcugagaagcgaggagagcgugagcagacugcccgaggagaucagaagacuggaggaggagcugagacagcugaagagcgacagccacggccccaaggaggacggcggcuucagacacagcgaggccuucgaggcccugcagcagaagagccagggccuggacagcagacugcagcacguggaggacggcgugcugagcaugcagguggccagcgccagacagaccgagagccuggagagccugcugagcaagagccaggagcacgagcagagacuggccgcccugcagggcagacuggagggccugggcagcagcgaggccgaccaggacggccuggccagcaccgugagaagccugggcgagacccagcuggugcuguacggcgacguggaggagcugaagagaagcgugggcgagcugcccagcaccguggagagccugcagaaggugcaggagcaggugcacacccugcugagccaggaccaggcccaggccgccagacugcccccccaggacuuccuggacagacugagcagccuggacaaccugaaggccagcgugagccagguggaggccgaccugaagaugcugagaaccgccguggacagccugguggccuacagcgugaagaucgagaccaacgagaacaaccuggagagcgccaagggccugcuggacgaccugagaaacgaccuggacagacuguucgugaagguggagaagauccacgagaagguguaa

SEQ ID NO: 15275 - RNA, 6099 nt, Artificial Sequence
  CKAP5__Homo_sapiens__NP_001008938
augggcgacgacagcgaguggcugaagcugcccguggaccagaagugcgagcacaagcuguggaaggccagacugagcggcuacgaggaggcccugaagaucuuccagaagaucaaggacgagaagagccccgaguggagcaaguuccugggccugaucaagaaguucgugaccgacagcaacgccguggugcagcugaagggccuggaggccgcccugguguacguggagaacgcccacguggccggcaagaccaccggcgagguggugagcggcguggugagcaagguguucaaccagcccaaggccaaggccaaggagcugggcaucgagaucugccugauguacaucgagaucgagaagggcgaggccgugcaggaggagcugcugaagggccuggacaacaagaaccccaagaucaucguggccugcaucgagacccugagaaaggcccugagcgaguucggcagcaagaucauccugcugaagcccaucaucaaggugcugcccaagcuguucgagagcagagagaaggccgugagagacgaggccaagcugaucgccguggagaucuacagauggaucagagacgcccugagacccccccugcagaacaucaacagcgugcagcugaaggagcuggaggaggagugggugaagcugcccaccagcgcccccagacccaccagauuccugagaagccagcaggagcuggaggccaagcuggagcagcagcagagcgccggcggcgacgccgagggcggcggcgacgacggcgacgaggugccccagaucgacgccuacgagcugcuggaggccguggagauccugagcaagcugcccaaggacuucuacgacaagaucgaggccaagaaguggcaggagagaaaggaggcccuggagagcguggaggugcugaucaagaaccccaagcuggaggccggcgacuacgccgaccuggugaaggcccugaagaagguggugggcaaggacaccaacgugaugcugguggcccuggccgccaagugccugaccggccuggccgugggccugagaaagaaguucggccaguacgccggccacguggugcccaccauccuggagaaguucaaggagaagaagccccagguggugcaggcccugcaggaggccaucgacgccaucuuccugaccaccacccugcagaacaucagcgaggacgugcuggccgugauggacaacaagaaccccaccaucaagcagcagaccagccuguucaucgccagaagcuucagacacugcaccgccagcacccugcccaagagccugcugaagcccuucugcgccgcccugcugaagcacaucaacgacagcgcccccgaggugagagacgccgccuucgaggcccugggcaccgcccugaagguggugggcgagaaggccgugaaccccuuccuggccgacguggacaagcugaagcuggacaagaucaaggagugcagcgagaagguggagcugauccacggcaagaaggccggccuggccgccgacaagaaggaguucaagccccugcccggcagaaccgccgccagcggcgccgccggcgacaaggacaccaaggacaucagcgcccccaagcccggcccccugaagaaggcccccgccgccaaggccggcggcccccccaagaagggcaagcccgccgcccccggcggcgccggcaacaccggcaccaagaacaagaagggccuggagaccaaggagaucguggagcccgagcugagcaucgaggugugcgaggagaaggccagcgccgugcugccccccaccugcauccagcugcuggacagcagcaacuggaaggagagacuggccugcauggaggaguuccagaaggccguggagcugauggacagaaccgagaugcccugccaggcccuggugagaaugcuggccaagaagcccggcuggaaggagaccaacuuccaggugaugcagaugaagcugcacaucguggcccugaucgcccagaagggcaacuucagcaagaccagcgcccagguggugcuggacggccugguggacaagaucggcgacgugaagugcggcaacaacgccaaggaggccaugaccgccaucgccgaggccugcaugcugcccuggaccgccgagcagguggugagcauggccuucagccagaagaaccccaagaaccagagcgagacccugaacuggcugagcaacgccaucaaggaguucggcuucagcggccugaacgugaaggccuucaucagcaacgugaagaccgcccuggccgccaccaaccccgccgugagaaccgccgccaucacccugcugggcgugauguaccuguacgugggccccagccugagaauguucuucgaggacgagaagcccgcccugcugagccagaucgacgccgaguucgagaagaugcagggccagagcccccccgcccccaccagaggcaucagcaagcacagcaccagcggcaccgacgagggcgaggacggcgacgagcccgacgacggcagcaacgacgugguggaccugcugcccagaaccgagaucagcgacaagaucaccagcgagcuggugagcaagaucggcgacaagaacuggaagaucagaaaggagggccuggacgagguggccggcaucaucaacgacgccaaguucauccagcccaacaucggcgagcugcccaccgcccugaagggcagacugaacgacagcaacaagauccuggugcagcagacccugaacauccugcagcagcuggccguggccaugggccccaacaucaagcagcacgugaagaaccugggcauccccaucaucaccgugcugggcgacagcaagaacaacgugagagccgccgcccuggccaccgugaacgccugggccgagcagaccggcaugaaggaguggcuggagggcgaggaccugagcgaggagcugaagaaggagaaccccuuccugagacaggagcugcugggcuggcuggccgagaagcugcccacccugagaagcacccccaccgaccugauccugugcgugccccaccuguacagcugccuggaggacagaaacggcgacgugagaaagaaggcccaggacgcccugcccuucuucaugaugcaccugggcuacgagaagauggccaaggccaccggcaagcugaagcccaccagcaaggaccaggugcuggccaugcuggagaaggccaaggugaacaugcccgccaagcccgccccccccaccaaggccaccagcaagcccaugggcggcagcgcccccgccaaguuccagcccgccagcgcccccgccgaggacugcaucagcagcagcaccgagcccaagcccgaccccaagaaggccaaggcccccggccugagcagcaaggccaagagcgcccagggcaagaagaugcccagcaagaccagccugaaggaggacgaggacaagagcggccccaucuucaucguggugcccaacggcaaggagcagagaaugaaggacgagaagggccugaaggugcugaaguggaacuucaccacccccagagacgaguacaucgagcagcugaagacccagaugagcagcugcguggccaaguggcugcaggacgagauguuccacagcgacuuccagcaccacaacaaggcccuggccgugaugguggaccaccuggagagcgagaaggagggcgugaucggcugccuggaccugauccugaaguggcugacccugagauucuucgacaccaacaccagcgugcugaugaaggcccuggaguaccugaagcugcuguucacccugcugagcgaggaggaguaccaccugaccgagaacgaggccagcagcuucauccccuaccugguggugaaggugggcgagcccaaggacgugaucagaaaggacgugagagccauccugaacagaaugugccugguguaccccgccagcaagauguuccccuucaucauggagggcaccaagagcaagaacagcaagcagagagccgagugccuggaggagcugggcugccugguggagagcuacggcaugaacgugugccagcccacccccggcaaggcccugaaggagaucgccgugcacaucggcgacagagacaacgccgugagaaacgccgcccugaacaccaucgugaccguguacaacgugcacggcgaccagguguucaagcugaucggcaaccugagcgagaaggacaugagcaugcuggaggagagaaucaagagaagcgccaagagacccagcgccgcccccaucaagcagguggaggagaagccccagagagcccagaacaucagcagcaacgccaacaugcugagaaagggccccgccgaggacaugagcagcaagcugaaccaggccagaagcaugagcggccaccccgaggccgcccagauggugagaagagaguuccagcuggaccuggacgagaucgagaacgacaacggcaccgugagaugcgagaugcccgagcuggugcagcacaagcuggacgacaucuucgagcccgugcugauccccgagcccaagaucagagccgugagcccccacuucgacgacaugcacagcaacaccgccagcaccaucaacuucaucaucagccagguggccagcggcgacaucaacaccagcauccaggcccugacccagaucgacgaggugcugagacaggaggacaaggccgaggccaugagcggccacaucgaccaguuccugaucgccaccuucaugcagcugagacugaucuacaacacccacauggccgacgagaagcuggagaaggacgagaucaucaagcuguacagcugcaucaucggcaacaugaucagccuguuccagaucgagagccuggccagagaggccagcaccggcgugcugaaggaccugaugcacggccugaucacccugaugcuggacagcagaaucgaggaccuggaggagggccagcaggugaucagaagcgugaaccugcugguggugaaggugcuggagaagagcgaccagaccaacauccugagcgcccugcuggugcugcugcaggacagccugcuggccaccgccagcagccccaaguucagcgagcuggugaugaagugccuguggagaauggugagacugcugcccgacaccaucaacagcaucaaccuggacagaauccugcuggacauccacaucuucaugaagguguuccccaaggagaagcugaagcagugcaagagcgaguuccccaucagaacccugaagacccugcugcacacccugugcaagcugaagggccccaagauccuggaccaccugaccaugaucgacaacaagaacgagagcgagcuggaggcccaccugugcagaaugaugaagcacagcauggaccagaccggcagcaagagcgacaaggagaccgagaagggcgccagcagaaucgacgagaagagcagcaaggccaaggugaacgacuuccuggccgagaucuucaagaagaucggcagcaaggagaacaccaaggagggccuggccgagcuguacgaguacaagaagaaguacagcgacgccgacaucgagcccuuccugaagaacagcagccaguucuuccagagcuacguggagagaggccugagagugaucgagauggagagagagggcaagggcagaaucagcaccagcaccggcaucagcccccagauggaggugaccugcgugcccacccccaccagcaccgugagcagcaucggcaacaccaacggcgaggaggugggccccagcguguaccuggagagacugaagauccugagacagagaugcggccuggacaacaccaagcaggacgacagacccccccugaccagccugcugagcaagcccgccgugcccaccguggccagcagcaccgacaugcugcacagcaagcugagccagcugagagagagcagagagcagcaccagcacagcgaccuggacagcaaccagacccacagcagcggcaccgugaccagcagcagcagcaccgccaacaucgacgaccugaagaagagacuggagagaaucaagagcagcagaaaguaa

SEQ ID NO: 15276 - RNA, 1146 nt, Artificial Sequence
  CKB__Homo_sapiens__NP_001814
augcccuucagcaacagccacaacgcccugaagcugagauuccccgccgaggacgaguuccccgaccugagcgcccacaacaaccacauggccaaggugcugacccccgagcuguacgccgagcugagagccaagagcacccccagcggcuucacccuggacgacgugauccagaccggcguggacaaccccggccaccccuacaucaugaccgugggcugcguggccggcgacgaggagagcuacgagguguucaaggaccuguucgaccccaucaucgaggacagacacggcggcuacaagcccagcgacgagcacaagaccgaccugaaccccgacaaccugcagggcggcgacgaccuggaccccaacuacgugcugagcagcagagugagaaccggcagaagcaucagaggcuucugccugcccccccacugcagcagaggcgagagaagagccaucgagaagcuggccguggaggcccugagcagccuggacggcgaccuggccggcagauacuacgcccugaagagcaugaccgaggccgagcagcagcagcugaucgacgaccacuuccuguucgacaagcccgugagcccccugcugcuggccagcggcauggccagagacuggcccgacgccagaggcaucuggcacaacgacaacaagaccuuccuggugugggugaacgaggaggaccaccugagagugaucagcaugcagaagggcggcaacaugaaggagguguucaccagauucugcaccggccugacccagaucgagacccuguucaagagcaaggacuacgaguucauguggaacccccaccugggcuacauccugaccugccccagcaaccugggcaccggccugagagccggcgugcacaucaagcugcccaaccugggcaagcacgagaaguucagcgaggugcugaagagacugagacugcagaagagaggcaccggcggcguggacaccgccgccgugggcggcguguucgacgugagcaacgccgacagacugggcuucagcgagguggagcuggugcagauggugguggacggcgugaagcugcugaucgagauggagcagagacuggagcagggccaggccaucgacgaccugaugcccgcccagaaguaa

SEQ ID NO: 15277 - RNA, 342 nt, Artificial Sequence
  CKLF__Homo_sapiens__NP_001035228
auggacaacgugcagcccaagaucaagcacagacccuucugcuucagcgugaagggccacgugaagaugcugagacuggcccugaccgugaccagcaugaccuucuucaucaucgcccaggcccccgagcccuacaucgugaucaccggcuucgaggugaccgugauccuguucuucauccugcuguacgugcugagacuggacagacugaugaaguggcuguucuggccccugcuggacaucaucaacagccuggugaccaccguguucaugcugaucgugagcgugcuggcccugauccccgagaccaccacccugaccgugggcggcggccuguucuaa

SEQ ID NO: 15278 - RNA, 1146 nt, Artificial Sequence
  CKM__Homo_sapiens__NP_001815
augcccuucggcaacacccacaacaaguucaagcugaacuacaagcccgaggaggaguaccccgaccugagcaagcacaacaaccacauggccaaggugcugacccuggagcuguacaagaagcugagagacaaggagacccccagcggcuucaccguggacgacgugauccagaccggcguggacaaccccggccaccccuucaucaugaccgugggcugcguggccggcgacgaggagagcuacgagguguucaaggagcuguucgaccccaucaucagcgacagacacggcggcuacaagcccaccgacaagcacaagaccgaccugaaccacgagaaccugaagggcggcgacgaccuggaccccaacuacgugcugagcagcagagugagaaccggcagaagcaucaagggcuacacccugcccccccacugcagcagaggcgagagaagagccguggagaagcugagcguggaggcccugaacagccugaccggcgaguucaagggcaaguacuacccccugaagagcaugaccgagaaggagcagcagcagcugaucgacgaccacuuccuguucgacaagcccgugagcccccugcugcuggccagcggcauggccagagacuggcccgacgccagaggcaucuggcacaacgacaacaagagcuuccuggugugggugaacgaggaggaccaccugagagugaucagcauggagaagggcggcaacaugaaggagguguucagaagauucugcgugggccugcagaagaucgaggagaucuucaagaaggccggccaccccuucauguggaaccagcaccugggcuacgugcugaccugccccagcaaccugggcaccggccugagaggcggcgugcacgugaagcuggcccaccugagcaagcaccccaaguucgaggagauccugaccagacugagacugcagaagagaggcaccggcggcguggacaccgccgccgugggcagcguguucgacgugagcaacgccgacagacugggcagcagcgagguggagcaggugcagcuggugguggacggcgugaagcugaugguggagauggagaagaagcuggagaagggccagagcaucgacgacaugauccccgcccagaaguaa

SEQ ID NO: 15279 - RNA, 777 nt, Artificial Sequence
  CKMT1A__Homo_sapiens__XP_005254555
augcccgugaaggugagaaccggcagaagcaucagaggccugagccugccccccgccugcaccagagccgagagaagagagguggagagaguggugguggacgcccugagcggccugaagggcgaccuggccggcagauacuacagacugagcgagaugaccgaggccgagcagcagcagcugaucgacgaccacuuccuguucgacaagcccgugagcccccugcugaccgccgccggcauggccagagacuggcccgacgccagaggcaucuggcacaacaacgagaagagcuuccugaucugggugaacgaggaggaccacaccagagugaucagcauggagaagggcggcaacaugaagagaguguucgagagauucugcagaggccugaaggagguggagagacugauccaggagagaggcugggaguucauguggaacgagagacugggcuacauccugaccugccccagcaaccugggcaccggccugagagccggcgugcacaucaagcugccccugcugagcaaggacagcagauuccccaagauccuggagaaccugagacugcagaagagaggcaccggcggcguggacaccgccgccaccggcggcguguucgacaucagcaaccuggacagacugggcaagagcgagguggagcuggugcagcuggugaucgacggcgugaacuaccugaucgacugcgagagaagacuggagagaggccaggacaucagaauccccacccccgugauccacaccaagcacuaa

SEQ ID NO: 15280 - RNA, 1347 nt, Artificial Sequence
  CKMT1B__Homo_sapiens__XP_011519498
auggccggccccuucagcagacugcugagcgccagacccggccugagacugcuggcccuggccggcgccggcagccuggccgccggcuuccugcugagacccgagcccgugagagccgccagcgagagaagaagacuguacccccccagccagaccuggcccaccggccagcugcccggcaacugcaccagaagcagaagacugugcccccccagcauggugaccggcuacccccugcccagcgccgaguaccccgaccugagaaagcacaacaacugcauggccagccaccugacccccgccguguacgccagacugugcgacaagaccacccccaccggcuggacccuggaccagugcauccagaccggcguggacaaccccggccaccccuucaucaagaccgugggcaugguggccggcgacgaggagaccuacgagguguucgccgaccuguucgaccccgugauccaggagagacacaacggcuacgaccccagaaccaugaagcacaccaccgaccuggacgccagcaagaucagaagcggcuacuucgacgagagauacgugcugagcagcagagugagaaccggcagaagcaucagaggccugagccugccccccgccugcaccagagccgagagaagagagguggagagaguggugguggacgcccugagcggccugaagggcgaccuggccggcagauacuacagacugagcgagaugaccgaggccgagcagcagcagcugaucgacgaccacuuccuguucgacaagcccgugagcccccugcugaccgccgccggcauggccagagacuggcccgacgccagaggcaucuggcacaacaacgagaagagcuuccugaucugggugaacgaggaggaccacaccagagugaucagcauggagaagggcggcaacaugaagagaguguucgagagauucugcagaggccugaaggagguggagagacugauccaggagagaggcugggaguucauguggaacgagagacugggcuacauccugaccugccccagcaaccugggcaccggccugagagccggcgugcacaucaagcugccccugcugagcaaggacagcagauuccccaagauccuggagaaccugagacugcagaagagaggcaccggcggcguggacaccgccgccaccggcggcguguucgacaucagcaaccuggacagacugggcaagagcgagguggagcuggugcagcuggugaucgacggcgugaacuaccugaucgacugcgagagaagacuggagagaggccaggacaucagaauccccacccccgugauccacaccaagcacuaa

SEQ ID NO: 15281 - RNA, 1260 nt, Artificial Sequence
  CKMT2__Homo_sapiens__NP_001093206
auggccagcaucuucagcaagcugcugaccggcagaaacgccagccugcuguucgccaccaugggcaccagcgugcugaccaccggcuaccugcugaacagacagaaggugugcgccgaggugagagagcagcccagacuguucccccccagcgccgacuaccccgaccugagaaagcacaacaacugcauggccgagugccugacccccgccaucuacgccaagcugagaaacaaggugacccccaacggcuacacccuggaccagugcauccagaccggcguggacaaccccggccaccccuucaucaagaccgugggcaugguggccggcgacgaggagagcuacgagguguucgccgaccuguucgaccccgugaucaagcugagacacaacggcuacgaccccagagugaugaagcacaccaccgaccuggacgccagcaagaucacccagggccaguucgacgagcacuacgugcugagcagcagagugagaaccggcagaagcaucagaggccugagccugccccccgccugcaccagagccgagagaagagagguggagaacguggccaucaccgcccuggagggccugaagggcgaccuggccggcagauacuacaagcugagcgagaugaccgagcaggaccagcagagacugaucgacgaccacuuccuguucgacaagcccgugagcccccugcugaccugcgccggcauggccagagacuggcccgacgccagaggcaucuggcacaacuacgacaagaccuuccugaucuggaucaacgaggaggaccacaccagagugaucagcauggagaagggcggcaacaugaagagaguguucgagagauucugcagaggccugaaggagguggagagacugauccaggagagaggcugggaguucauguggaacgagagacugggcuacauccugaccugccccagcaaccugggcaccggccugagagccggcgugcacgugagaauccccaagcugagcaaggaccccagauucagcaagauccuggagaaccugagacugcagaagagaggcaccggcggcguggacaccgccgccguggccgacguguacgacaucagcaacaucgacagaaucggcagaagcgagguggagcuggugcagaucgugaucgacggcgugaacuaccugguggacugcgagaagaagcuggagagaggccaggacaucaaggugccccccccccugccccaguucggcaagaaguaa

SEQ ID NO: 15282 - RNA, 240 nt, Artificial Sequence
  CKS1B__Homo_sapiens__NP_001817
augagccacaagcagaucuacuacagcgacaaguacgacgacgaggaguucgaguacagacacgugaugcugcccaaggacaucgccaagcuggugcccaagacccaccugaugagcgagagcgaguggagaaaccugggcgugcagcagagccagggcugggugcacuacaugauccacgagcccgagccccacauccugcuguucagaagaccccugcccaagaagcccaagaaguaa

SEQ ID NO: 15283 - RNA, 240 nt, Artificial Sequence
  CKS2__Homo_sapiens__NP_001818
auggcccacaagcagaucuacuacagcgacaaguacuucgacgagcacuacgaguacagacacgugaugcugcccagagagcugagcaagcaggugcccaagacccaccugaugagcgaggaggaguggagaagacugggcgugcagcagagccugggcugggugcacuacaugauccacgagcccgagccccacauccugcuguucagaagaccccugcccaaggaccagcagaaguaa

SEQ ID NO: 15284 - RNA, 4440 nt, Artificial Sequence
  CLASP1__Homo_sapiens__NP_001135745
auggagcccagaauggagagcugccuggcccaggugcugcagaaggacgugggcaagagacugcaggugggccaggagcugaucgacuacuucagcgacaagcagaagagcgccgaccuggagcacgaccagaccaugcuggacaagcugguggacggccuggccaccagcugggugaacagcagcaacuacaagguggugcugcugggcauggacauccugagcgcccuggugaccagacugcaggacagauucaaggcccagaucggcaccgugcugcccagccugaucgacagacugggcgacgccaaggacagcgugagagagcaggaccagacccugcugcugaagaucauggaccaggccgccaacccccaguacgugugggacagaaugcugggcggcuucaagcacaagaacuucagaaccagagagggcaucugccugugccugaucgccacccugaacgccagcggcgcccagacccugacccugagcaagaucgugccccacaucugcaaccugcugggcgaccccaacagccaggugagagacgccgccaucaacagccugguggagaucuacagacacgugggcgagagagugagagccgaccugagcaagaagggccugccccagagcagacugaacgugaucuucaccaaguucgacgaggugcagaagagcggcaacaugauccagagcgccaacgacaagaacuucgacgacgaggacagcguggacggcaacagacccagcagcgccagcagcaccagcagcaaggccccccccagcagcagaagaaacgugggcaugggcaccaccagaagacugggcagcagcacccugggcagcaagagcagcgccgccaaggagggcgccggcgccguggacgaggaggacuucaucaaggccuucgacgacgugcccguggugcagaucuacagcagcagagaccuggaggagagcaucaacaagaucagagagauccugagcgacgacaagcacgacugggagcagagagugaacgcccugaagaagaucagaagccugcugcuggccggcgccgccgaguacgacaacuucuuccagcaccugagacugcuggacggcgccuucaagcugagcgccaaggaccugagaagccagguggugagagaggccugcaucacccugggccaccugagcagcgugcugggcaacaaguucgaccacggcgccgaggccaucaugcccaccaucuucaaccugauccccaacagcgccaagaucauggccaccagcggcgugguggccgugagacugaucaucagacacacccacauccccagacugauccccgugaucaccagcaacugcaccagcaagagcguggccgugagaagaagaugcuucgaguuccuggaccugcugcugcaggaguggcagacccacagccuggagagacacaucagcgugcuggccgagaccaucaagaagggcauccacgacgccgacagcgaggccagaaucgaggccagaaagugcuacuggggcuuccacagccacuucagcagagaggccgagcaccuguaccacacccuggagagcagcuaccagaaggcccugcagagccaccugaagaacagcgacagcaucgugagccugccccagagcgacagaagcagcagcagcagccaggagagccugaacagaccccugagcgccaagagaagccccaccggcagcaccaccagcagagccagcaccgugagcaccaagagcgugagcaccaccggcagccugcagagaagcagaagcgacaucgacgugaacgccgccgccagcgccaagagcaaggugagcagcagcagcggcaccacccccuucagcagcgccgccgcccugccccccggcagcuacgccagccuggacggcaccaccaccaaggccgagggcagaaucagaaccagaagacagagcagcggcagcgccaccaacguggccagcacccccgacaacagaggcagaagcagagccaagguggugagccagagccagagaagcagaagcgccaaccccgccggcgccggcagcagaagcagcagccccggcaagcugcugggcagcggcuacggcggccugaccggcggcagcagcagaggcccccccgugacccccagcagcgagaagagaagcaagauccccagaagccagggcugcagcagagagaccagccccaacagaaucggccuggacagauucggccugggccagcccggcagaauccccggcagcgugaacgccaugagagugcugagcaccagcaccgaccuggaggccgccguggccgacgcccugcugcugggcgacagcagaagcaagaagaagcccgugagaagaagauacgagcccuacggcauguacagcgacgacgacgccaacagcgacgccagcagcgugugcagcgagagaagcuacggcagcagaaacggcggcaucccccacuaccugagacagaccgaggacguggccgaggugcugaaccacugcgccagcagcaacuggagcgagagaaaggagggccugcugggccugcagaaccugcugaagagccagagaacccugagcagaguggagcugaagagacugugcgagaucuucaccagaauguucgccgacccccacagcaagagaguguucagcauguuccuggagacccugguggacuucaucaucauccacaaggacgaccugcaggacuggcuguucgugcugcugacccagcugcugaagaagaugggcgccgaccugcugggcagcgugcaggccaaggugcagaaggcccuggacgugaccagagacagcuuccccuucgaccagcaguucaacauccugaugagauucaucguggaccagacccagacccccaaccugaaggugaagguggccauccugaaguacaucgagagccuggccagacagauggaccccaccgacuucgugaacagcagcgagaccagacuggccgugagcagaaucaucaccuggaccaccgagcccaagagcagcgacgugagaaaggccgcccagaucgugcugaucagccuguucgagcugaacacccccgaguucaccaugcugcugggcgcccugcccaagaccuuccaggacggcgccaccaagcugcugcacaaccaccugaagaacagcagcaacaccagcgugggcagccccagcaacaccaucggcagaacccccagcagacacaccagcagcagaaccagcccccugaccagccccaccaacugcagccacggcggccugagccccagcaugcuggacuacgacaccgagaaccugaacagcgaggagaucuacagcagccugagaggcgugaccgaggccaucgagaaguucagcuucagaagccaggaggaccugaacgagcccaucaagagagacggcaagaaggagugcgacaucgugagcagagacggcggcgccgccagccccgccaccgagggcagaggcggcagcgagguggagggcggcagaaccgcccuggacaacaagaccagccugcugaacacccagccccccagagccuuccccggccccagagccagagacuacaaccccuaccccuacagcgacgccaucaacaccuacgacaagaccgcccugaaggaggccguguucgacgacgacauggagcagcugagagacgugcccaucgaccacagcgaccugguggccgaccugcugaaggagcugagcaaccacaacgagagaguggaggagagaaagggcgcccugcuggagcugcugaagaucaccagagaggacagccugggcgugugggaggagcacuucaagaccauccugcugcugcugcuggagacccugggcgacaaggaccacagcaucagagcccuggcccugagagugcugagagagauccugagaaaccagcccgccagauucaagaacuacgccgagcugaccaucaugaagacccuggaggcccacaaggacagccacaaggagguggugagagccgccgaggaggccgccagcacccuggccagcagcauccaccccgagcagugcaucaaggugcugugccccaucauccagaccgccgacuaccccaucaaccuggccgccaucaagaugcagaccaaggugguggagagaaucgccaaggagagccugcugcagcugcugguggacaucauccccggccugcugcagggcuacgacaacaccgagagcagcgugagaaaggccagcguguucugccugguggccaucuacagcgugaucggcgaggaccugaagccccaccuggcccagcugaccggcagcaagaugaagcugcugaaccuguacaucaagagagcccagaccaccaacagcaacagcagcagcagcagcgacgugagcacccacagcuaa

SEQ ID NO: 15285 - RNA, 3885 nt, Artificial Sequence
  CLASP2__Homo_sapiens__NP_001193973
auggccaugggcgacgacaagagcuucgacgacgaggagagcguggacggcaacagacccagcagcgccgccagcgccuucaaggugcccgcccccaagaccagcggcaaccccgccaacagcgccagaaagcccggcagcgccggcggccccaaggugggcggcgccagcaaggagggcggcgccggcgccguggacgaggacgacuucaucaaggccuucaccgacgugcccagcauccagaucuacagcagcagagagcuggaggagacccugaacaagaucagagagauccugagcgacgacaagcacgacugggaccagagagccaacgcccugaagaagaucagaagccugcugguggccggcgccgcccaguacgacugcuucuuccagcaccugagacugcuggacggcgcccugaagcugagcgccaaggaccugagaagccagguggugagagaggccugcaucaccguggcccaccugagcaccgugcugggcaacaaguucgaccacggcgccgaggccaucgugcccacccuguucaaccuggugcccaacagcgccaaggugauggccaccagcggcugcgccgccaucagauucaucaucagacacacccacgugcccagacugaucccccugaucaccagcaacugcaccagcaagagcgugcccgugagaagaagaagcuucgaguuccuggaccugcugcugcaggaguggcagacccacagccuggagagacacgccgccgugcugguggagaccaucaagaagggcauccacgacgccgacgccgaggccagaguggaggccagaaagaccuacaugggccugagaaaccacuuccccggcgaggccgagacccuguacaacagccuggagcccagcuaccagaagagccugcagaccuaccugaagagcagcggcagcguggccagccugccccagagcgacagaagcagcagcagcagccaggagagccugaacagacccuucagcagcaaguggagcaccgccaaccccagcaccguggccggcagagugagcgccggcagcagcaaggccagcagccugcccggcagccugcagagaagcagaagcgacaucgacgugaacgccgccgccggcgccaaggcccaccacgccgccggccagagcgugagaagcggcagacugggcgccggcgcccugaacgccggcagcuacgccagccuggaggacaccagcgacaagcuggacggcaccgccagcgaggacggcagagugagagccaagcugagcgccccccuggccggcaugggcaacgccaaggccgacagcagaggcagaagcagaaccaagauggugagccagagccagcccggcagcagaagcggcagccccggcagagugcugaccaccaccgcccugagcaccgugagcagcggcgugcagagagugcuggugaacagcgccagcgcccagaagagaagcaagauccccagaagccagggcugcagcagagaggccagccccagcagacugagcguggccagaagcagcagaauccccagacccagcgugagccagggcugcagcagagaggccagcagagagagcagcagagacaccagccccgugagaagcuuccagccccuggccagcagacaccacagcagaagcaccggcgcccuguacgcccccgagguguacggcgccagcggccccggcuacggcaucagccagagcagcagacugagcagcagcgugagcgccaugagagugcugaacaccggcagcgacguggaggaggccguggccgacgcccugaagaagcccgccagaagaagauacgagagcuacggcaugcacagcgacgacgacgccaacagcgacgccagcagcgccugcagcgagagaagcuacagcagcagaaacggcagcauccccaccuacaugagacagaccgaggacguggccgaggugcugaacagaugcgccagcagcaacuggagcgagagaaaggagggccugcugggccugcagaaccugcugaagaaccagagaacccugagcagaguggagcugaagagacugugcgagaucuucaccagaauguucgccgacccccacggcaagagaguguucagcauguuccuggagacccugguggacuucauccaggugcacaaggacgaccugcaggacuggcuguucgugcugcugacccagcugcugaagaagaugggcgccgaccugcugggcagcgugcaggccaaggugcagaaggcccuggacgugaccagagagagcuuccccaacgaccugcaguucaacauccugaugagauucaccguggaccagacccagacccccagccugaaggugaagguggccauccugaaguacaucgagacccuggccaagcagauggaccccggcgacuucaucaacagcagcgagaccagacuggccgugagcagagugaucaccuggaccaccgagcccaagagcagcgacgugagaaaggccgcccagagcgugcugaucagccuguucgagcugaacacccccgaguucaccaugcugcugggcgcccugcccaagaccuuccaggacggcgccaccaagcugcugcacaaccaccugagaaacaccggcaacggcacccagagcagcaugggcagcccccugaccagacccacccccagaagccccgccaacuggagcagcccccugaccagccccaccaacaccagccagaacacccugagccccagcgccuucgacuacgacaccgagaacaugaacagcgaggacaucuacagcagccugagaggcgugaccgaggccauccagaacuucagcuucagaagccaggaggacaugaacgagccccugaagagagacagcaagaaggacgacggcgacagcaugugcggcggccccggcaugagcgaccccagagccggcggcgacgccaccgacagcagccagaccgcccuggacaacaaggccagccugcugcacagcaugcccacccacagcagccccagaagcagagacuacaaccccuacaacuacagcgacagcaucagccccuucaacaagagcgcccugaaggaggccauguucgacgacgacgccgaccaguuccccgacgaccugagccuggaccacagcgaccugguggccgagcugcugaaggagcugagcaaccacaacgagagaguggaggagagaaagaucgcccuguacgagcugaugaagcugacccaggaggagagcuucagcgugugggacgagcacuucaagaccauccugcugcugcugcuggagacccugggcgacaaggagcccaccaucagagcccuggcccugaaggugcugagagagauccugagacaccagcccgccagauucaagaacuacgccgagcugaccgugaugaagacccuggaggcccacaaggacccccacaaggagguggugagaagcgccgaggaggccgccagcgugcuggccaccagcaucagccccgagcagugcaucaaggugcugugccccaucauccagaccgccgacuaccccaucaaccuggccgccaucaagaugcagaccaaggugaucgagagagugagcaaggagacccugaaccugcugcugcccgagaucaugcccggccugauccagggcuacgacaacagcgagagcagcgugagaaaggccugcguguucugccugguggccgugcacgccgugaucggcgacgagcugaagccccaccugagccagcugaccggcagcaagaugaagcugcugaaccuguacaucaagagagcccagaccggcagcggcggcgccgaccccaccaccgacgugagcggccagagcuaa

SEQ ID NO: 15286 - RNA, 1851 nt, Artificial Sequence
  CLCA2__Homo_sapiens__XP_011540750
augacccagagaagcaucgccggccccaucugcaaccugaaguucgugacccugcugguggcccugagcagcgagcugcccuuccugggcgccggcgugcagcugcaggacaacggcuacaacggccugcugaucgccaucaacccccaggugcccgagaaccagaaccugaucagcaacaucaaggagaugaucaccgaggccagcuucuaccuguucaacgccaccaagagaagaguguucuucagaaacaucaagauccugauccccgccaccuggaaggccaacaacaacagcaagaucaagcaggagagcuacgagaaggccaacgugaucgugaccgacugguacggcgcccacggcgacgaccccuacacccugcaguacagaggcugcggcaaggagggcaaguacauccacuucacccccaacuuccugcugaacgacaaccugaccgccggcuacggcagcagaggcagaguguucgugcacgagugggcccaccugagauggggcguguucgacgaguacaacaacgacaagcccuucuacaucaacggccagaaccagaucaaggugaccagaugcagcagcgacaucaccggcaucuucgugugcgagaagggccccugcccccaggagaacugcaucaucagcaagcuguucaaggagggcugcaccuucaucuacaacagcacccagaacgccaccgccagcaucauguucaugcagagccugagcagcgugguggaguucugcaacgccagcacccacaaccaggaggcccccaaccugcagaaccagaugugcagccugagaagcgccugggacgugaucaccgacagcgccgacuuccaccacagcuuccccaugaacggcaccgagcugccccccccccccaccuucagccuggugcaggccggcgacaagguggugugccuggugcuggacgugagcagcaagauggccgaggccgacagacugcugcagcugcagcaggccgccgaguucuaccugaugcagaucguggagauccacaccuucgugggcaucgccagcuucgacagcaagggcgagaucagagcccagcugcaccagaucaacagcaacgacgacagaaagcugcuggugagcuaccugcccaccaccgugagcgccaagaccgacaucagcaucugcagcggccugaagaagggcuucgaggugguggagaagcugaacggcaaggccuacggcagcgugaugauccuggugaccagcggcgacgacaagcugcugggcaacugccugcccaccgugcugagcagcggcagcaccauccacagcaucgcccugggcagcagcgccgcccccaaccuggaggagcugagcagacugaccggcggccugaaguucuucgugcccgacaucagcaacagcaacagcaugaucgacgccuucagcagaaucagcagcggcaccggcgacaucuuccagcagcacauccagcuggagagcaccggcgagaacgugaagccccaccaccagcugaagaacaccgugaccguggacaacaccgugggcaacgacaccauguuccuggugaccuggcaggccagcggcccccccgagaucauccuguucgaccccgacggcagaaaguacuacaccaacaacuucaucaccaaccugaccuucagaaccgccagccuguggauccccggcaccgccaagcugagaagauucgccuucauccccgacggcagacugaaccugagcgugguggacuucgacacccuggcccuguuccuguuccugaucuacugccugggccacaaggugaagggcaacaacaagguguacuuccacuaa

SEQ ID NO: 15287 - RNA, 2607 nt, Artificial Sequence
  CLCA4__Homo_sapiens__XP_011539317
auggaggacauggugaccaccgccagcaccuaccuguucgaggccaccgagaagagauucuucuucaagaacgugagcauccugauccccgagaacuggaaggagaacccccaguacaagagacccaagcacgagaaccacaagcacgccgacgugaucguggccccccccacccugcccggcagagacgagcccuacaccaagcaguucaccgagugcggcgagaagggcgaguacauccacuucacccccgaccugcugcugggcaagaagcagaacgaguacggcccccccggcaagcuguucgugcacgagugggcccaccugagauggggcguguucgacgaguacaacgaggaccagcccuucuacagagccaagagcaagaagaucgaggccaccagaugcagcgccggcaucagcggcagaaacagaguguacaagugccagggcggcagcugccugagcagagccugcagaaucgacagcaccaccaagcuguacggcaaggacugccaguucuuccccgacaaggugcagaccgagaaggccagcaucauguucaugcagagcaucgacagcgugguggaguucugcaacgagaagacccacaaccaggaggcccccagccugcagaacaucaagugcaacuucagaagcaccugggaggugaucagcaacagcgaggacuucaagaacaccauccccauggugacccccccccccccccccguguucagccugcugaagaucagccagagaaucgugugccuggugcuggacaagagcggcagcaugggcggcaaggacagacugaacagaaugaaccaggccgccaagcacuuccugcugcagaccguggagaacggcagcugggugggcauggugcacuucgacagcaccgccaccaucgugaacaagcugauccagaucaagagcagcgacgagagaaacacccugauggccggccugcccaccuacccccugggcggcaccagcaucugcagcggcaucaaguacgccuuccaggugaucggcgagcugcacagccagcuggacggcagcgaggugcugcugcugaccgacggcgaggacaacaccgccagcagcugcaucgacgaggugaagcagagcggcgccaucgugcacuucaucgcccugggcagagccgccgacgaggccgugaucgagaugagcaagaucaccggcggcagccacuucuacgugagcgacgaggcccagaacaacggccugaucgacgccuucggcgcccugaccagcggcaacaccgaccugagccagaagagccugcagcuggagagcaagggccugacccugaacagcaacgccuggaugaacgacaccgugaucaucgacagcaccgugggcaaggacaccuucuuccugaucaccuggaacagccugccccccagcaucagccugugggaccccagcggcaccaucauggagaacuucaccguggacgccaccagcaagauggccuaccugagcauccccggcaccgccaaggugggcaccugggccuacaaccugcaggccaaggccaaccccgagacccugaccaucaccgugaccagcagagccgccaacagcagcgugccccccaucaccgugaacgccaagaugaacaaggacgugaacagcuuccccagccccaugaucguguacgccgagauccugcagggcuacgugcccgugcugggcgccaacgugaccgccuucaucgagagccagaacggccacaccgaggugcuggagcugcuggacaacggcgccggcgccgacagcuucaagaacgacggcguguacagcagauacuucaccgccuacaccgagaacggcagauacagccugaaggugagagcccacggcggcgccaacaccgccagacugaagcugagacccccccugaacagagccgccuacauccccggcuggguggugaacggcgagaucgaggccaacccccccagacccgagaucgacgaggacacccagaccacccuggaggacuucagcagaaccgccagcggcggcgccuucguggugagccaggugcccagccugccccugcccgaccaguacccccccagccagaucaccgaccuggacgccaccgugcacgaggacaagaucauccugaccuggaccgcccccggcgacaacuucgacgugggcaaggugcagagauacaucaucagaaucagcgccagcauccuggaccugagagacagcuucgacgacgcccugcaggugaacaccaccgaccugagccccaaggaggccaacagcaaggagagcuucgccuucaagcccgagaacaucagcgaggagaacgccacccacaucuucaucgccaucaagagcaucgacaagagcaaccugaccagcaaggugagcaacaucgcccaggugacccuguucaucccccaggccaaccccgacgacaucgaccccacccccacccccacccccacccccacccccgacaagagccacaacagcggcgugaacaucagcacccuggugcugagcgugaucggcagcguggugaucgugaacuucauccugagcaccaccaucuaa

SEQ ID NO: 15288 - RNA, 648 nt, Artificial Sequence
  CLCF1__Homo_sapiens__NP_001159684
augcuggccugccugugcaccgugcuguggcaccugcccgccgugcccgcccugaacagaaccggcgaccccggccccggccccagcauccagaagaccuacgaccugaccagauaccuggagcaccagcugagaagccuggccggcaccuaccugaacuaccugggcccccccuucaacgagcccgacuucaacccccccagacugggcgccgagacccugcccagagccaccguggaccuggagguguggagaagccugaacgacaagcugagacugacccagaacuacgaggccuacagccaccugcugugcuaccugagaggccugaacagacaggccgccaccgccgagcugagaagaagccuggcccacuucugcaccagccugcagggccugcugggcagcaucgccggcgugauggccgcccugggcuacccccugccccagccccugcccggcaccgagcccaccuggacccccggccccgcccacagcgacuuccugcagaagauggacgacuucuggcugcugaaggagcugcagaccuggcuguggagaagcgccaaggacuucaacagacugaagaagaagaugcagccccccgccgccgccgugacccugcaccugggcgcccacggcuucuaa

SEQ ID NO: 15289 - RNA, 429 nt, Artificial Sequence
  CLC__Homo_sapiens__NP_001819
augagccugcugcccgugcccuacaccgaggccgccagccugagcaccggcagcaccgugaccaucaagggcagaccccuggccugcuuccugaacgagcccuaccugcagguggacuuccacaccgagaugaaggaggagagcgacaucguguuccacuuccaggugugcuucggcagaagaguggugaugaacagcagagaguacggcgccuggaagcagcagguggagagcaagaacaugcccuuccaggacggccaggaguucgagcugagcaucagcgugcugcccgacaaguaccaggugauggugaacggccagagcagcuacaccuucgaccacagaaucaagcccgaggccgugaagauggugcagguguggagagacaucagccugaccaaguucaacgugagcuaccugaagagauaa

SEQ ID NO: 15290 - RNA, 2967 nt, Artificial Sequence
  CLCN1__Homo_sapiens__NP_000074
auggagcagagcagaagccagcagagaggcggcgagcagagcugguggggcagcgacccccaguaccaguacaugcccuucgagcacugcaccagcuacggccugcccagcgagaacggcggccugcagcacagacugagaaaggacgccggccccagacacaacgugcaccccacccagaucuacggccaccacaaggagcaguucagcgacagagagcaggacaucggcaugcccaagaagaccggcagcagcagcaccguggacagcaaggacgaggaccacuacagcaagugccaggacugcauccacagacugggccagguggugagaagaaagcugggcgaggacuggaucuuccuggugcugcugggccugcugauggcccuggugagcuggagcauggacuacgugagcgccaagagccugcaggccuacaaguggagcuacgcccagaugcagcccagccugccccugcaguuccuggugugggugaccuucccccuggugcugauccuguucagcgcccuguucugccaccugaucagcccccaggccgugggcagcggcauccccgagaugaagaccauccugagaggcguggugcugaaggaguaccugaccaugaaggccuucguggccaaggugguggcccugaccgccggccugggcagcggcauccccgugggcaaggagggccccuucgugcacaucgccagcaucugcgccgccgugcugagcaaguucaugagcguguucugcggcguguacgagcagcccuacuacuacagcgacauccugaccgugggcugcgccgugggcgugggcugcugcuucggcaccccccugggcggcgugcuguucagcaucgaggugaccagcaccuacuucgccgugagaaacuacuggagaggcuucuucgccgccaccuucagcgccuucguguucagagugcuggccguguggaacaaggacgccgugaccaucaccgcccuguucagaaccaacuucagaauggacuuccccuucgaccugaaggagcugcccgccuucgccgccaucggcaucugcugcggccugcugggcgccguguucguguaccugcacagacaggugaugcugggcgugagaaagcacaaggcccugagccaguuccuggccaagcacagacugcuguaccccggcaucgugaccuucgugaucgccagcuucaccuucccccccggcaugggccaguucauggccggcgagcugaugcccagagaggccaucagcacccuguucgacaacaacaccugggugaagcacgccggcgaccccgagagccugggccagagcgccguguggauccaccccagagugaacguggugaucaucaucuuccuguucuucgugaugaaguucuggaugagcaucguggccaccaccaugcccauccccugcggcggcuucaugcccguguucgugcugggcgccgccuucggcagacuggugggcgagaucauggccaugcuguuccccgacggcauccuguucgacgacaucaucuacaagauccugcccggcggcuacgccgugaucggcgccgccgcccugaccggcgccgugagccacaccgugagcaccgccgugaucugcuucgagcugaccggccagaucgcccacauccugcccaugaugguggccgugauccuggccaacaugguggcccagagccugcagcccagccuguacgacagcaucauccaggugaagaagcugcccuaccugcccgaccugggcuggaaccagcugagcaaguacaccaucuucguggaggacaucauggugagagacgugaaguucgugagcgccagcuacaccuacggcgagcugagaacccugcugcagaccaccaccgugaagacccugccccugguggacagcaaggacagcaugauccugcugggcagcguggagagaagcgagcugcaggcccugcugcagagacaccugugccccgagagaagacugagagccgcccaggagauggccagaaagcugagcgagcugcccuacgacggcaaggccagacuggccggcgagggccugcccggcgccccccccggcagacccgagagcuucgccuucguggacgaggacgaggacgaggaccugagcggcaagagcgagcugccccccagccuggcccugcaccccagcaccaccgccccccugagccccgaggagcccaacggcccccugcccggccacaagcagcagcccgaggcccccgagcccgccggccagagacccagcaucuuccagagccugcugcacugccugcugggcagagccagacccaccaagaagaagaccacccaggacagcaccgaccugguggacaacaugagccccgaggagaucgaggccugggagcaggagcagcugagccagcccgugugcuucgacagcugcugcaucgaccagagccccuuccagcugguggagcagaccacccugcacaagacccacacccuguucagccugcugggccugcaccuggccuacgugaccagcaugggcaagcugagaggcgugcuggcccuggaggagcugcagaaggccaucgagggccacaccaagagcggcgugcagcugagacccccccuggccagcuucagaaacaccaccagcaccagaaagagcaccggcgccccccccagcagcgccgagaacuggaaccugcccgaggacagacccggcgccaccggcaccggcgacgugaucgccgccagccccgagacccccgugcccagccccagccccgagcccccccugagccuggcccccggcaagguggagggcgagcuggaggagcuggagcugguggagagccccggccuggaggaggagcuggccgacauccugcagggccccagccugagaagcaccgacgaggaggacgaggacgagcugauccuguaa

SEQ ID NO: 15291 - RNA, 2646 nt, Artificial Sequence
  CLCN2__Homo_sapiens__NP_001164558
auggccgccgccgccgccgaggagggcauggagcccagagcccugcaguacgagcagacccugauguacggcagauacacccaggaccugggcgccuucgccaaggaggaggccgccagaaucagacugggcggccccgagcccuggaagggcccccccagcagcagagccgcccccgagcugcuggaguacggcagaagcagaugcgccagaugcagagugugcagcgugagaugccacaaguuccuggugagcagagugggcgaggacuggaucuuccuggugcugcugggccugcugauggcccuggugagcugggugauggacuacgccaucgccgccugccugcaggcccagcaguggaugagcagaggccugaacaccagcauccugcugcaguaccuggccugggugaccuaccccguggugcugaucaccuucagcgccggcuucacccagauccuggccccccaggccgugggcagcggcauccccgagaugaagaccauccugagaggcguggugcugaaggaguaccugacccugaagaccuucaucgccaaggugaucggccugaccugcgcccugggcagcggcaugccccugggcaaggagggccccuucgugcacaucgccagcaugugcgccgcccugcugagcaaguuccugagccuguucggcggcaucuacgagaacgagagcagaaacaccgagaugcuggccgccgccugcgccgugggcgugggcugcugcuucgccgcccccaucggcggcgugcuguucagcaucgaggugaccagcaccuucuucgccgugagaaacuacuggagaggcuucuucgccgccaccuucagcgccuucaucuucagagugcuggccguguggaacagagacgaggagaccaucaccgcccuguucaagaccagauucagacuggacuuccccuucgaccugcaggagcugcccgccuucgccgugaucggcaucgccagcggcuucggcggcgcccuguucguguaccugaacagaaagaucgugcaggugaugagaaagcagaagaccaucaacagauuccugaugagaaagagacugcuguuccccgcccuggugacccugcugaucagcacccugaccuucccccccggcuucggccaguucauggccggccagcugagccagaaggagacccuggugacccuguucgacaacagaaccugggugagacagggccugguggaggagcuggagccccccagcaccagccaggccuggaacccccccagagccaacguguuccugacccuggugaucuucauccugaugaaguucuggaugagcgcccuggccaccaccauccccgugcccugcggcgccuucaugcccguguucgugaucgacggcauccacaccgacagcagcaccuacagaaucgugcccggcggcuacgccguggugggcgccgccgcccuggccggcgccgugacccacaccgugagcaccgccgugaucguguucgagcugaccggccagaucgcccacauccugcccgugaugaucgccgugauccuggccaacgccguggcccagagccugcagcccagccuguacgacagcaucaucagaaucaagaagcugcccuaccugcccgagcugggcuggggcagacaccagcaguacagagugagaguggaggacaucauggugagagacgugccccacguggcccugagcugcaccuucagagaccugagacuggcccugcacagaaccaagggcagaaugcuggcccugguggagagccccgagagcaugauccugcugggcagcaucgagagaagccaggugguggcccugcugggcgcccagcugagccccgccagaagaagacagcacaugcaggagagaagagccacccagaccagcccccugagcgaccaggagggcccccccacccccgaggccagcgugugcuuccaggugaacaccgaggacagcgccuuccccgccgccagaggcgagacccacaagccccugaagcccgcccugaagagaggccccagcgugaccagaaaccugggcgagagccccaccggcagcgccgagagcgccggcaucgcccugagaagccuguucugcggcagccccccccccgaggccgccagcgagaagcuggagagcugcgagaagagaaagcugaagagagugagaaucagccuggccagcgacgccgaccuggagggcgagaugagccccgaggagauccuggagugggaggagcagcagcuggacgagcccgugaacuucagcgacugcaagaucgaccccgcccccuuccagcugguggagagaaccagccugcacaagacccacaccaucuucagccugcugggcguggaccacgccuacgugaccagcaucggcagacugaucggcaucgugacccugaaggagcugagaaaggccaucgagggcagcgugaccgcccagggcgugaaggugagacccccccuggccagcuucagagacagcgccaccagcagcagcgacaccgagaccaccgaggugcacgcccuguggggcccccacagcagacacggccugcccagagagggcagccccagcgacagcgacgacaagugccaguaa

SEQ ID NO: 15292 - RNA, 2376 nt, Artificial Sequence
  CLCN3__Homo_sapiens__NP_001230301
auggagagcgagcagcuguuccacagaggcuacuacagaaacagcuacaacagcaucaccagcgccagcagcgacgaggagcugcuggacggcgccggcgugaucauggacuuccagaccagcgaggacgacaaccugcuggacggcgacaccgccgugggcacccacuacaccaugaccaacggcggcagcaucaacagcagcacccaccugcuggaccugcuggacgagcccauccccggcgugggcaccuacgacgacuuccacaccaucgacugggugagagagaagugcaaggacagagagagacacagaagaaucaacagcaagaagaaggagagcgccugggagaugaccaagagccuguacgacgccuggagcggcuggcugguggugacccugaccggccuggccagcggcgcccuggccggccugaucgacaucgccgccgacuggaugaccgaccugaaggagggcaucugccugagcgcccugugguacaaccacgagcagugcugcuggggcagcaacgagaccaccuucgaggagagagacaagugcccccaguggaagaccugggccgagcugaucaucggccaggccgagggccccggcagcuacaucaugaacuacaucauguacaucuucugggcccugagcuucgccuuccuggccgugagccuggugaagguguucgcccccuacgccugcggcagcggcauccccgagaucaagaccauccugagcggcuucaucaucagaggcuaccugggcaaguggacccugaugaucaagaccaucacccuggugcuggccguggccagcggccugagccugggcaaggagggcccccuggugcacguggccugcugcugcggcaacaucuucagcuaccuguuccccaaguacagcaccaacgaggccaagaagagagaggugagcuacuacuucccccugaagacccuguggagaagcuucuucgccgcccugguggccgccuucgugcugagaagcaucaaccccuucggcaacagcagacuggugcuguucuacguggaguaccacacccccugguaccuguucgagcuguuccccuucauccugcugggcguguucggcggccuguggggcgccuucuucaucagagccaacaucgccuggugcagaagaagaaagagcaccaaguucggcaaguaccccgugcuggaggugaucaucguggccgccaucaccgccgugaucgccuuccccaaccccuacaccagacugaacaccagcgagcugaucaaggagcuguucaccgacugcggcccccuggagagcagcagccugugcgacuacagaaacgacaugaacgccagcaagaucguggacgacauccccgacagacccgccggcaucggcguguacagcgccaucuggcagcugugccuggcccugaucuucaagaucaucaugaccguguucaccuucggcaucaaggugcccagcggccuguucauccccagcauggccaucggcgccaucgccggcagaaucgugggcaucgccguggagcagcuggccuacuaccaccacgacugguucaucuucaaggaguggugcgaggugggcgccgacugcaucacccccggccuguacgccauggugggcgccgccgccugccugggcggcgugaccagaaugaccgugagccugguggugaucguguucgagcugaccggcggccuggaguacaucgugccccugauggccgccgugaugaccagcaagugggugggcgacgccuucggcagagagggcaucuacgaggcccacaucagacugaacggcuaccccuuccuggacgccaaggaggaguucacccacaccacccuggccgccgacgugaugagacccagaagaaacgaccccccccuggccgugcugacccaggacaacaugaccguggacgacaucgagaacaugaucaacgagaccagcuacaacggcuuccccgugaucaugagcaaggagagccagagacuggugggcuucgcccugagaagagaccugaccaucgccaucgagagcgccagaaagaagcaggagggcaucgugggcagcagcagagugugcuucgcccagcacacccccagccugcccgccgagagccccagaccccugaagcugagaagcauccuggacaugagccccuucaccgugaccgaccacacccccauggagaucgugguggacaucuucagaaagcugggccugagacagugccuggugacccacaacggcagacugcugggcaucaucaccaagaaggacauccugagacacauggcccagaccgccaaccaggaccccgccagcaucauguucaacuaa

SEQ ID NO: 15293 - RNA, 2001 nt, Artificial Sequence
  CLCN4__Homo_sapiens__NP_001243873
augaccgaccugaaggagggcgugugccugagcgccuucugguacagccacgagcagugcugcuggaccagcaacgagaccaccuucgaggacagagacaagugcccccuguggcagaaguggagcgagcugcuggugaaccagagcgagggcgccagcgccuacauccugaacuaccugauguacauccugugggcccugcuguucgccuuccuggccgugagccuggugagaguguucgcccccuacgccugcggcagcggcauccccgagaucaagaccauccugagcggcuucaucaucagaggcuaccugggcaaguggacccugcugaucaagaccgugacccuggugcugguggugagcagcggccugagccugggcaaggagggcccccuggugcacguggccugcugcugcggcaacuucuucagcagccuguucagcaaguacagcaagaacgagggcaagagaagagaggugcugagcgccgccgccgccgccggcgugagcguggccuucggcgcccccaucggcggcgugcuguucagccuggaggaggugagcuacuacuucccccugaagacccuguggagaagcuucuucgccgcccugguggccgccuucacccugagaagcaucaaccccuucggcaacagcagacuggugcuguucuacguggaguaccacacccccugguacauggccgagcuguuccccuucauccugcugggcguguucggcggccuguggggcacccuguucaucagaugcaacaucgccuggugcagaagaagaaagaccaccagacugggcaaguaccccgugcuggaggugaucguggugaccgccaucaccgccaucaucgccuaccccaaccccuacaccagacagagcaccagcgagcugaucagcgagcuguucaacgacugcggcgcccuggagagcagccagcugugcgacuacaucaacgaccccaacaugaccagacccguggacgacauccccgacagacccgccggcgugggcguguacaccgccauguggcagcuggcccuggcccugaucuucaagaucguggugaccaucuucaccuucggcaugaagauccccagcggccuguucauccccagcauggccgugggcgccaucgccggcagaauggugggcaucggcguggagcagcuggccuaccaccaccacgacuggaucaucuucagaaacuggugcagacccggcgccgacugcgugacccccggccuguacgccauggugggcgccgccgccugccugggcggcgugaccagaaugaccgugagccugguggugaucauguucgagcugaccggcggccuggaguacaucgugccccugauggccgccgccgugaccagcaaguggguggccgacgccuucggcaaggagggcaucuacgaggcccacauccaccugaacggcuaccccuuccuggacgugaaggacgaguucacccacagaacccuggccaccgacgugaugagacccagaagaggcgagcccccccugagcgugcugacccaggacagcaugaccguggaggacguggagacccugaucaaggagaccgacuacaacggcuuccccgugguggugagcagagacagcgagagacugaucggcuucgcccagagaagagagcugauccuggccaucaagaacgccagacagagacaggagggcaucgugagcaacagcaucauguacuucaccgaggagccccccgagcugcccgccaacagcccccacccccugaagcugagaagaauccugaaccugagccccuucaccgugaccgaccacacccccauggagaccgugguggacaucuucagaaagcugggccugagacagugccuggugaccagaagcggcagacugcugggcaucaucaccaagaaggacgugcugagacacauggcccagauggccaaccaggaccccgagagcaucauguucaacuaa

SEQ ID NO: 15294 - RNA, 2451 nt, Artificial Sequence
  CLCN5__Homo_sapiens__NP_001121370
auggccauguggcagggcgccauggacaacagaggcuuccagcagggcagcuucagcagcuuccagaacagcagcagcgacgaggaccugauggacauccccgccaccgccauggacuucagcaugagagacgacgugcccccccuggacagagaggugggcgaggacaagagcuacaacggcggcggcaucggcagcagcaacagaaucauggacuuccuggaggagcccauccccggcgugggcaccuacgacgacuucaacaccaucgacugggugagagagaagagcagagacagagacagacacagagagaucaccaacaagagcaaggagagcaccugggcccugauccacagcgugagcgacgccuucagcggcuggcugcugaugcugcugaucggccugcugagcggcagccuggccggccugaucgacaucagcgcccacuggaugaccgaccugaaggagggcaucugcaccggcggcuucugguucaaccacgagcacugcugcuggaacagcgagcacgugaccuucgaggagagagacaagugccccgaguggaacagcuggagccagcugaucaucagcaccgacgagggcgccuucgccuacaucgugaacuacuucauguacgugcugugggcccugcuguucgccuuccuggccgugagccuggugaagguguucgcccccuacgccugcggcagcggcauccccgagaucaagaccauccugagcggcuucaucaucagaggcuaccugggcaaguggacccuggugaucaagaccaucacccuggugcuggccgugagcagcggccugagccugggcaaggagggcccccuggugcacguggccugcugcugcggcaacauccugugccacugcuucaacaaguacagaaagaacgaggccaagagaagagaggugcugagcgccgccgccgccgccggcgugagcguggccuucggcgcccccaucggcggcgugcuguucagccuggaggaggugagcuacuacuucccccugaagacccuguggagaagcuucuucgccgcccugguggccgccuucacccugagaagcaucaaccccuucggcaacagcagacuggugcuguucuacguggaguuccacacccccuggcaccuguucgagcuggugcccuucauccugcugggcaucuucggcggccuguggggcgcccuguucaucagaaccaacaucgccuggugcagaaagagaaagaccacccagcugggcaaguaccccgugaucgaggugcugguggugaccgccaucaccgccauccuggccuuccccaacgaguacaccagaaugagcaccagcgagcugaucagcgagcuguucaacgacugcggccugcuggacagcagcaagcugugcgacuacgagaacagauucaacaccagcaagggcggcgagcugcccgacagacccgccggcgugggcguguacagcgccauguggcagcuggcccugacccugauccugaagaucgugaucaccaucuucaccuucggcaugaagauccccagcggccuguucauccccagcauggccgugggcgccaucgccggcagacugcugggcgugggcauggagcagcuggccuacuaccaccaggaguggaccguguucaacagcuggugcagccagggcgccgacugcaucacccccggccuguacgccauggugggcgccgccgccugccugggcggcgugaccagaaugaccgugagccugguggugaucauguucgagcugaccggcggccuggaguacaucgugccccugauggccgccgccaugaccagcaaguggguggccgacgcccugggcagagagggcaucuacgacgcccacaucagacugaacggcuaccccuuccuggaggccaaggaggaguucgcccacaagacccuggccauggacgugaugaagcccagaagaaacgacccccugcugaccgugcugacccaggacagcaugaccguggaggacguggagaccaucaucagcgagaccaccuacagcggcuuccccgugguggugagcagagagagccagagacuggugggcuucgugcugagaagagaccugaucaucagcaucgagaacgccagaaagaagcaggacggcguggugagcaccagcaucaucuacuucaccgagcacagccccccccugccccccuacaccccccccacccugaagcugagaaacauccuggaccugagccccuucaccgugaccgaccugacccccauggagaucgugguggacaucuucagaaagcugggccugagacagugccuggugacccacaacggcagacugcugggcaucaucaccaagaaggacgugcugaagcacaucgcccagauggccaaccaggaccccgacagcauccuguucaacuaa

SEQ ID NO: 15295 - RNA, 2610 nt, Artificial Sequence
  CLCN6__Homo_sapiens__NP_001277
auggccggcugcagaggcagccugugcugcugcugcagauggugcugcugcugcggcgagagagagaccagaacccccgaggagcugaccauccugggcgagacccaggaggaggaggacgagauccugcccagaaaggacuacgagagccuggacuacgacagaugcaucaacgaccccuaccuggaggugcuggagaccauggacaacaagaagggcagaagauacgaggccgugaaguggauggugguguucgccaucggcgugugcaccggccuggugggccuguucguggacuucuucgugagacuguucacccagcugaaguucggcguggugcagaccagcguggaggagugcagccagaagggcugccuggcccugagccugcuggagcugcugggcuucaaccugaccuucguguuccuggccagccugcuggugcugaucgagcccguggccgccggcagcggcauccccgaggugaagugcuaccugaacggcgugaaggugcccggcaucgugagacugagaacccugcugugcaaggugcugggcgugcuguucagcguggccggcggccuguucgugggcaaggagggccccaugauccacagcggcagcguggugggcgccggccugccccaguuccagagcaucagccugagaaagauccaguucaacuuccccuacuucagaagcgacagagacaagagagacuucgugagcgccggcgccgccgccggcguggccgccgccuucggcgcccccaucggcggcacccuguucagccuggaggagggcagcagcuucuggaaccagggccugaccuggaaggugcuguucugcagcaugagcgccaccuucacccugaacuucuucagaagcggcauccaguucggcagcuggggcagcuuccagcugcccggccugcugaacuucggcgaguucaagugcagcgacagcgacaagaagugccaccuguggaccgccauggaccugggcuucuucguggugaugggcgugaucggcggccugcugggcgccaccuucaacugccugaacaagagacuggccaaguacagaaugagaaacgugcaccccaagcccaagcuggugagagugcuggagagccugcuggugagccuggugaccaccguggugguguucguggccagcauggugcugggcgagugcagacagaugagcagcagcagccagaucggcaacgacagcuuccagcugcaggugaccgaggacgugaacagcagcaucaagaccuucuucugccccaacgacaccuacaacgacauggccacccuguucuucaacccccaggagagcgccauccugcagcuguuccaccaggacggcaccuucagccccgugacccuggcccuguucuucgugcuguacuuccugcuggccugcuggaccuacggcaucagcgugcccagcggccuguucgugcccagccugcugugcggcgccgccuucggcagacugguggccaacgugcugaagagcuacaucggccugggccacaucuacagcggcaccuucgcccugaucggcgccgccgccuuccugggcggcguggugagaaugaccaucagccugaccgugauccugaucgagagcaccaacgagaucaccuacggccugcccaucauggugacccugaugguggccaaguggaccggcgacuucuucaacaagggcaucuacgacauccacgugggccugagaggcgugccccugcuggagugggagaccgagguggagauggacaagcugagagccagcgacaucauggagcccaaccugaccuacguguacccccacaccagaauccagagccuggugagcauccugagaaccaccgugcaccacgccuuccccguggugaccgagaacagaggcaacgagaaggaguucaugaagggcaaccagcugaucagcaacaacaucaaguucaagaagagcagcauccugaccagagccggcgagcagagaaagagaagccagagcaugaagagcuaccccagcagcgagcugagaaacaugugcgacgagcacaucgccagcgaggagcccgccgagaaggaggaccugcugcagcagaugcuggagagaagauacacccccuaccccaaccuguaccccgaccagagccccagcgaggacuggaccauggaggagagauucagaccccugaccuuccacggccugauccugagaagccagcuggugacccugcuggugagaggcgugugcuacagcgagagccagagcagcgccagccagcccagacugagcuacgccgagauggccgaggacuaccccagauaccccgacauccacgaccuggaccugacccugcugaaccccagaaugaucguggacgugacccccuacaugaaccccagccccuucaccgugagccccaacacccacgugagccagguguucaaccuguucagaaccaugggccugagacaccugcccguggugaacgccgugggcgagaucgugggcaucaucaccagacacaaccugaccuacgaguuccugcaggccagacugagacagcacuaccagaccaucuaa

SEQ ID NO: 15296 - RNA, 2346 nt, Artificial Sequence
  CLCN7__Homo_sapiens__NP_001107803
auggccaacgugagcaagaaggugagcuggagcggcagagacagagacgacgaggaggccgccccccugcugagaagaaccgccagacccggcggcggcaccccccugcugaacggcgccggccccggcgccgccagacaggacauggaccccccccaccccuuccccaaggagaucccccacaacgagaagcugcugagccugaaguacgagagccuggacuacgacaacagcgagaaccagcuguuccuggaggaggagagaagaaucaaccacaccgccuucagaaccguggagaucaagagaugggugaucugcgcccugaucggcauccugaccggccugguggccugcuucaucgacaucgugguggagaaccuggccggccugaaguacagagugaucaagggcaacaucgacaaguucaccgagaagggcggccugagcuucagccugcugcugugggccacccugaacgccgccuucgugcuggugggcagcgugaucguggccuucaucgagcccguggccgccggcagcggcaucccccagaucaagugcuuccugaacggcgugaagaucccccacguggugagacugaagacccuggugaucaaggugagcggcgugauccugagcguggugggcggccuggccgugggcaaggagggccccaugauccacagcggcagcgugaucgccgccggcaucagccagggcagaagcaccagccugaagagagacuucaagaucuucgaguacuucagaagagacaccgagaagagagacuucgugagcgccggcgccgccgccggcgugagcgccgccuucggcgcccccgugggcggcgugcuguucagccuggaggagggcgccagcuucuggaaccaguuccugaccuggagaaucuucuucgccagcaugaucagcaccuucacccugaacuucgugcugagcaucuaccacggcaacaugugggaccugagcagccccggccugaucaacuucggcagauucgacagcgagaagauggccuacaccauccacgagauccccguguucaucgccaugggcguggugggcggcgugcugggcgccguguucaacgcccugaacuacuggcugaccauguucagaaucagauacauccacagacccugccugcaggugaucgaggccgugcugguggccgccgugaccgccaccguggccuucgugcugaucuacagcagcagagacugccagccccugcagggcggcagcaugagcuacccccugcagcuguucugcgccgacggcgaguacaacagcauggccgccgccuucuucaacacccccgagaagagcguggugagccuguuccacgacccccccggcagcuacaacccccugacccugggccuguucacccugguguacuucuuccuggccugcuggaccuacggccugaccgugagcgccggcguguucauccccagccugcugaucggcgccgccuggggcagacuguucggcaucagccugagcuaccugaccggcgccgccaucugggccgaccccggcaaguacgcccugaugggcgccgccgcccagcugggcggcaucgugagaaugacccugagccugaccgugaucaugauggaggccaccagcaacgugaccuacggcuuccccaucaugcuggugcugaugaccgccaagaucgugggcgacguguucaucgagggccuguacgacaugcacauccagcugcagagcgugcccuuccugcacugggaggcccccgugaccagccacagccugaccgccagagaggugaugagcacccccgugaccugccugagaagaagagagaaggugggcgugaucguggacgugcugagcgacaccgccagcaaccacaacggcuuccccgugguggagcacgccgacgacacccagcccgccagacugcagggccugauccugagaagccagcugaucgugcugcugaagcacaagguguucguggagagaagcaaccugggccuggugcagagaagacugagacugaaggacuucagagacgccuaccccagauucccccccauccagagcauccacgugagccaggacgagagagagugcaccauggaccugagcgaguucaugaaccccagccccuacaccgugccccaggaggccagccugcccagaguguucaagcuguucagagcccugggccugagacaccugguggugguggacaacagaaaccagguggugggccuggugaccagaaaggaccuggccagauacagacugggcaagagaggccuggaggagcugagccuggcccagaccuaa

SEQ ID NO: 15297 - RNA, 1905 nt, Artificial Sequence
  CLCNKB__Homo_sapiens__XP_011538921
augacccugggcgugcugauggcccuggugagcugcgccauggaccuggccguggagagcguggugagagcccaccaguggcuguacagagagaucggcgacagccaccugcugagauaccugagcuggaccguguaccccguggcccuggugagcuucagcagcggcuucagccagagcaucacccccagcagcggcggcagcggcauccccgaggugaagaccaugcuggccggcguggugcuggaggacuaccuggacaucaagaacuucggcgccaagguggugggccugagcugcacccuggccugcggcagcacccuguuccugggcaaggugggccccuucgugcaccugagcgugaugauggccgccuaccugggcagagugagaaccaccaccaucggcgagcccgagaacaagagcaagcagaacgagaugcugguggccgccgccgccgugggcguggccaccguguucgccgcccccuucagcggcgugcuguucagcaucgaggugaugagcagccacuucagcgugugggacuacuggagaggcuucuucgccgccaccugcggcgccuucauguucagacugcuggccguguucaacagcgagcaggagaccaucaccagccuguacaagaccagcuucagaguggacgugcccuucgaccugcccgagaucuucuucuucguggcccugggcggccugugcggcauccugggcagcgccuaccuguucugccagagaaucuucuucggcuucaucagaaacaacagauucagcagcaagcugcuggccaccagcaagcccguguacagcgcccuggccacccuggugcuggccagcaucaccuacccccccagcgccggcagauuccuggccagcagacugagcaugaagcagcaccuggacagccuguucgacaaccacagcugggcccugaugacccagaacagcagcccccccuggcccgaggagcuggacccccagcaccuguggugggagugguaccaccccagauucaccaucuucggcacccuggccuucuuccuggugaugaaguucuggaugcugauccuggccaccaccauccccaugcccgccggcuacuucaugcccaucuucguguacggcgccgccaucggcagacuguucggcgagacccugagcuucaucuuccccgagggcaucguggccggcggcaucaccaaccccaucaugcccggcggcuacgcccuggccggcgccgccgccuucagcggcgccgugacccacaccaucagcaccgcccugcuggccuucgaggugaccggccagaucgugcacgcccugcccgugcugauggccgugcuggccgccaacgccaucgcccagagcugccagcccagcuucuacgacggcaccgugaucgugaagaagcugcccuaccugcccagaauccugggcagaaacaucggcagccacagagugagaguggagcacuucaugaaccacagcaucaccacccuggccaaggacaugccccuggaggagguggugaagguggugaccagcaccgacguggccaaguacccccugguggagagcaccgagagccagauccuggugggcaucgugagaagagcccagcuggugcaggcccugaaggccgagccccccagcugggcccccggccaccagcagugccugcaggacauccuggccgccggcugccccaccgagcccgugacccugaagcugagccccgagaccagccugcacgaggcccacaaccuguucgagcugcugaaccugcacagccuguucgugaccagcagaggcagagccgugggcugcgugagcuggguggagaugaagaaggccaucagcaaccugaccaacccccccgcccccaaguaa

SEQ ID NO: 15298 - RNA, 624 nt, Artificial Sequence
  CLDN10__Homo_sapiens__NP_001153572
augagcagagcccagaucugggcccuggugagcggcgugggcggcuucggcgcccugguggccgccaccaccagcaacgaguggaaggugaccaccagagccagcagcgugaucaccgccaccuggguguaccagggccuguggaugaacugcgccggcuacauccaggccugcagaggccugaugaucgccgccgugagccugggcuucuucggcagcaucuucgcccuguucggcaugaagugcaccaaggugggcggcagcgacaaggccaaggccaagaucgccugccuggccggcaucguguucauccugagcggccugugcagcaugaccggcugcagccuguacgccaacaagaucaccaccgaguucuucgacccccuguucguggagcagaaguacgagcugggcgccgcccuguucaucggcugggccggcgccagccugugcaucaucggcggcgugaucuucugcuucagcaucagcgacaacaacaagacccccagauacaccuacaacggcgccaccagcgugaugagcagcagaaccaaguaccacggcggcgaggacuucaagaccaccaaccccagcaagcaguucgacaagaacgccuacguguaa

SEQ ID NO: 15299 - RNA, 624 nt, Artificial Sequence
  CLDN11__Homo_sapiens__NP_005593
augguggccaccugccugcagguggugggcuucgugaccagcuucgugggcuggaucggcgugaucgugaccaccagcaccaacgacuggguggugaccugcggcuacaccauccccaccugcagaaagcuggacgagcugggcagcaagggccugugggccgacugcgugauggccaccggccuguaccacugcaagccccugguggacauccugauccugcccggcuacgugcaggccugcagagcccugaugaucgccgccagcgugcugggccugcccgccauccugcugcugcugaccgugcugcccugcaucagaaugggccaggagcccggcguggccaaguacagaagagcccagcuggccggcgugcugcugauccugcuggcccugugcgcccugguggccaccaucugguuccccgugugcgcccacagagagaccaccaucgugagcuucggcuacagccuguacgccggcuggaucggcgccgugcugugccuggugggcggcugcgugauccugugcugcgccggcgacgcccaggccuucggcgagaacagauucuacuacaccgccggcagcagcagccccacccacgccaagagcgcccacguguaa

SEQ ID NO: 15300 - RNA, 720 nt, Artificial Sequence
  CLDN14__Homo_sapiens__NP_036262
auggccagcaccgccgugcagcugcugggcuuccugcugagcuuccugggcauggugggcacccugaucaccaccauccugccccacuggagaagaaccgcccacgugggcaccaacauccugaccgccgugagcuaccugaagggccuguggauggagugcguguggcacagcaccggcaucuaccagugccagaucuacagaagccugcuggcccugccccaggaccugcaggccgccagagcccugauggugaucagcugccugcugagcggcaucgccugcgccugcgccgugaucggcaugaagugcaccagaugcgccaagggcacccccgccaagaccaccuucgccauccugggcggcacccuguucauccuggccggccugcugugcaugguggccgugagcuggaccaccaacgacguggugcagaacuucuacaacccccugcugcccagcggcaugaaguucgagaucggccaggcccuguaccugggcuucaucagcagcagccugagccugaucggcggcacccugcugugccugagcugccaggacgaggcccccuacagacccuaccaggccccccccagagccaccaccaccaccgccaacaccgcccccgccuaccagccccccgccgccuacaaggacaacagagcccccagcgugaccagcgccacccacagcggcuacagacugaacgacuacguguaa

SEQ ID NO: 15301 - RNA, 687 nt, Artificial Sequence
  CLDN15__Homo_sapiens__NP_001172009
augagcauggccguggagaccuucggcuucuucauggccaccgugggccugcugaugcugggcgugacccugcccaacagcuacuggagagugagcaccgugcacggcaacgugaucaccaccaacaccaucuucgagaaccugugguucagcugcgccaccgacagccugggcguguacaacugcugggaguuccccagcaugcuggcccugagcggcuacauccaggccugcagagcccugaugaucaccgccauccugcugggcuuccugggccugcugcugggcaucgccggccugagaugcaccaacaucggcggccuggagcugagcagaaaggccaagcuggccgccaccgccggcgcccugcacauccuggccggcaucugcggcaugguggccaucagcugguacgccuucaacaucaccagagacuucuucgacccccuguaccccggcaccaaguacgagcugggccccgcccuguaccugggcuggagcgccagccugaucagcauccugggcggccugugccugugcagcgccugcugcugcggcagcgacgaggaccccgccgccagcgccagaagacccuaccaggcccccgugagcgugaugcccguggccaccagcgaccaggagggcgacagcagcuucggcaaguacggcagaaacgccuacguguaa

SEQ ID NO: 15302 - RNA, 918 nt, Artificial Sequence
  CLDN16__Homo_sapiens__NP_006571
augaccagcagaaccccccugcuggugaccgccugccuguacuacagcuacugcaacagcagacaccugcagcagggcgugagaaagagcaagagacccguguucagccacugccaggugcccgagacccagaagaccgacaccagacaccugagcggcgccagagccggcgugugccccugcugccaccccgacggccugcuggccaccaugagagaccugcugcaguacaucgccugcuucuucgccuucuucagcgccggcuuccugaucguggccaccuggaccgacugcuggauggugaacgccgacgacagccuggaggugagcaccaagugcagaggccuguggugggagugcgugaccaacgccuucgacggcaucagaaccugcgacgaguacgacagcauccuggccgagcacccccugaagcugguggugaccagagcccugaugaucaccgccgacauccuggccggcuucggcuuccugacccugcugcugggccuggacugcgugaaguuccugcccgacgagcccuacaucaaggugagaaucugcuucguggccggcgccacccugcugaucgccggcacccccggcaucaucggcagcgugugguacgccguggacguguacguggagagaagcacccuggugcugcacaacaucuuccugggcauccaguacaaguucggcuggagcugcuggcugggcauggccggcagccugggcugcuuccuggccggcgccgugcugaccugcugccuguaccuguucaaggacgugggccccgagagaaacuaccccuacagccugagaaaggccuacagcgccgccggcgugagcauggccaagagcuacagcgcccccagaaccgagaccgccaagauguacgccguggacaccagaguguaa

SEQ ID NO: 15303 - RNA, 786 nt, Artificial Sequence
  CLDN18__Homo_sapiens__NP_001002026
auggccgugaccgccugccagggccugggcuucguggugagccugaucggcaucgccggcaucaucgccgccaccugcauggaccaguggagcacccaggaccuguacaacaaccccgugaccgccguguucaacuaccagggccuguggagaagcugcgugagagagagcagcggcuucaccgagugcagaggcuacuucacccugcugggccugcccgccaugcugcaggccgugagagcccugaugaucgugggcaucgugcugggcgccaucggccugcuggugagcaucuucgcccugaagugcaucagaaucggcagcauggaggacagcgccaaggccaacaugacccugaccagcggcaucauguucaucgugagcggccugugcgccaucgccggcgugagcguguucgccaacaugcuggugaccaacuucuggaugagcaccgccaacauguacaccggcaugggcggcauggugcagaccgugcagaccagauacaccuucggcgccgcccuguucgugggcuggguggccggcggccugacccugaucggcggcgugaugaugugcaucgccugcagaggccuggcccccgaggagaccaacuacaaggccgugagcuaccacgccagcggccacagcguggccuacaagcccggcggcuucaaggccagcaccggcuucggcagcaacaccaagaacaagaagaucuacgacggcggcgccagaaccgaggacgaggugcagagcuaccccagcaagcacgacuacguguaa

SEQ ID NO: 15304 - RNA, 636 nt, Artificial Sequence
  CLDN1__Homo_sapiens__NP_066924
auggccaacgccggccugcagcugcugggcuucauccuggccuuccugggcuggaucggcgccaucgugagcaccgcccugccccaguggagaaucuacagcuacgccggcgacaacaucgugaccgcccaggccauguacgagggccuguggaugagcugcgugagccagagcaccggccagauccagugcaagguguucgacagccugcugaaccugagcagcacccugcaggccaccagagcccugaugguggugggcauccugcugggcgugaucgccaucuucguggccaccgugggcaugaagugcaugaagugccuggaggacgacgaggugcagaagaugagaauggccgugaucggcggcgccaucuuccugcuggccggccuggccauccugguggccaccgccugguacggcaacagaaucgugcaggaguucuacgaccccaugacccccgugaacgccagauacgaguucggccaggcccuguucaccggcugggccgccgccagccugugccugcugggcggcgcccugcugugcugcagcugccccagaaagaccaccagcuaccccacccccagacccuaccccaagcccgcccccagcagcggcaaggacuacguguaa

SEQ ID NO: 15305 - RNA, 879 nt, Artificial Sequence
  CLDN23__Homo_sapiens__NP_919260
augagaacccccguggugaugacccugggcauggugcuggcccccugcggccugcugcugaaccugaccggcacccuggcccccggcuggagacuggugaagggcuuccugaaccagcccguggacguggagcuguaccagggccugugggacaugugcagagagcagagcagcagagagagagagugcggccagaccgaccaguggggcuacuucgaggcccagcccgugcugguggccagagcccugauggugaccagccuggccgccaccgugcugggccugcugcuggccagccugggcgugagaugcuggcaggacgagcccaacuucgugcuggccggccugagcggcguggugcuguucguggccggccugcugggccugauccccgugagcugguacaaccacuuccugggcgacagagacgugcugcccgcccccgccagccccgugaccgugcaggugagcuacagccuggugcugggcuaccugggcagcugccugcugcugcugggcggcuucagccuggcccugagcuucgcccccuggugcgacgagagaugcagaagaagaagaaagggccccagcgccggccccagaagaagcagcgugagcaccauccagguggaguggcccgagcccgaccuggcccccgccaucaaguacuacagcgacggccagcacagacccccccccgcccagcacagaaagcccaagcccaagcccaaggugggcuuccccaugcccagacccagacccaaggccuacaccaacagcguggacgugcuggacggcgagggcugggagagccaggacgcccccagcugcagcacccaccccugcgacagcagccugcccugcgacagcgaccuguaa

SEQ ID NO: 15306 - RNA, 693 nt, Artificial Sequence
  CLDN2__Homo_sapiens__NP_001164566
auggccagccugggccugcagcuggugggcuacauccugggccugcugggccugcugggcacccugguggccaugcugcugcccagcuggaagaccagcagcuacgugggcgccagcaucgugaccgccgugggcuucagcaagggccuguggauggagugcgccacccacagcaccggcaucacccagugcgacaucuacagcacccugcugggccugcccgccgacauccaggccgcccaggccaugauggugaccagcagcgccaucagcagccuggccugcaucaucagcguggugggcaugagaugcaccguguucugccaggagagcagagccaaggacagaguggccguggccggcggcguguucuucauccugggcggccugcugggcuucauccccguggccuggaaccugcacggcauccugagagacuucuacagcccccuggugcccgacagcaugaaguucgagaucggcgaggcccuguaccugggcaucaucagcagccuguucagccugaucgccggcaucauccugugcuucagcugcagcagccagagaaacagaagcaacuacuacgacgccuaccaggcccagccccuggccaccagaagcagccccagacccggccagccccccaaggugaagagcgaguucaacagcuacagccugaccggcuacguguaa

SEQ ID NO: 15307 - RNA, 912 nt, Artificial Sequence
  CLDN5__Homo_sapiens__NP_001124333
augaccagagccagaaucggcugcuucggccccggcggcagagccagaggcaccgagagcgcccccgagcccagcaagagagugccccccggcagaagcuggcagacccaggaggugagacagaccagaggcgccaacggccugggccccagagccggcagcgccggcgccaaggcccccggccccgcccagggcgccgcccagcacggccugggcggcagcgccggccugagagugagagugagcccccuggccaugggcagcgccgcccuggagauccugggccuggugcugugccuggugggcuggggcggccugauccuggccugcggccugcccauguggcaggugaccgccuuccuggaccacaacaucgugaccgcccagaccaccuggaagggccuguggaugagcugcguggugcagagcaccggccacaugcagugcaagguguacgacagcgugcuggcccugagcaccgaggugcaggccgccagagcccugaccgugagcgccgugcugcuggccuucguggcccuguucgugacccuggccggcgcccagugcaccaccugcguggcccccggccccgccaaggccagaguggcccugaccggcggcgugcuguaccuguucugcggccugcuggcccuggugccccugugcugguucgccaacaucguggugagagaguucuacgaccccagcgugcccgugagccagaaguacgagcugggcgccgcccuguacaucggcugggccgccaccgcccugcugauggugggcggcugccugcugugcugcggcgccugggugugcaccggcagacccgaccugagcuuccccgugaaguacagcgcccccagaagacccaccgccaccggcgacuacgacaagaagaacuacguguaa

SEQ ID NO: 15308 - RNA, 663 nt, Artificial Sequence
  CLDN6__Homo_sapiens__NP_067018
auggccagcgccggcaugcagauccugggcguggugcugacccugcugggcugggugaacggccuggugagcugcgcccugcccauguggaaggugaccgccuucaucggcaacagcaucgugguggcccagguggugugggagggccuguggaugagcugcguggugcagagcaccggccagaugcagugcaagguguacgacagccugcuggcccugccccaggaccugcaggccgccagagcccugugcgugaucgcccugcugguggcccuguucggccugcugguguaccuggccggcgccaagugcaccaccugcguggaggagaaggacagcaaggccagacuggugcugaccagcggcaucguguucgugaucagcggcgugcugacccugauccccgugugcuggaccgcccacgccaucaucagagacuucuacaacccccugguggccgaggcccagaagagagagcugggcgccagccuguaccugggcugggccgccagcggccugcugcugcugggcggcggccugcugugcugcaccugccccagcggcggcagccagggccccagccacuacauggccagauacagcaccagcgcccccgccaucagcagaggccccagcgaguaccccaccaagaacuacguguaa

SEQ ID NO: 15309 - RNA, 438 nt, Artificial Sequence
  CLDN7__Homo_sapiens__NP_001171952
auggccaacagcggccugcagcugcugggcuucagcauggcccugcugggcugggugggccugguggccugcaccgccaucccccaguggcagaugagcagcuacgccggcgacaacaucaucaccgcccaggccauguacaagggccuguggauggacugcgugacccagagcaccggcaugaugagcugcaagauguacgacagcgugcuggcccugagcgccgcccugcaggccaccagagcccugaugguggugagccuggugcugggcuuccuggccauguucguggccaccaugggcaugaagugcaccagaugcggcggcgacgacaaggugaagaaggccagaaucgccaugggcggcggcaucaucuucaucguggccggcaugagccuggcccugcccagccugcuggccggccagggccugcccuaa

SEQ ID NO: 15310 - RNA, 678 nt, Artificial Sequence
  CLDN8__Homo_sapiens__NP_955360
auggccacccacgcccuggagaucgccggccuguuccugggcggcgugggcauggugggcaccguggccgugaccgugaugccccaguggagagugagcgccuucaucgagaacaacaucgugguguucgagaacuucugggagggccuguggaugaacugcgugagacaggccaacaucagaaugcagugcaagaucuacgacagccugcuggcccugagccccgaccugcaggccgccagaggccugaugugcgccgccagcgugaugagcuuccuggccuucaugauggccauccugggcaugaagugcaccagaugcaccggcgacaacgagaaggugaaggcccacauccugcugaccgccggcaucaucuucaucaucaccggcaugguggugcugauccccgugagcuggguggccaacgccaucaucagagacuucuacaacagcaucgugaacguggcccagaagagagagcugggcgaggcccuguaccugggcuggaccaccgcccuggugcugaucgugggcggcgcccuguucugcugcguguucugcugcaacgagaagagcagcagcuacagauacagcauccccagccacagaaccacccagaagagcuaccacaccggcaagaagagccccagcguguacagcagaagccaguacguguaa

SEQ ID NO: 15311 - RNA, 654 nt, Artificial Sequence
  CLDN9__Homo_sapiens__NP_066192
auggccagcaccggccuggagcugcugggcaugacccuggccgugcugggcuggcugggcacccuggugagcugcgcccugccccuguggaaggugaccgccuucaucggcaacagcaucgugguggcccagguggugugggagggccuguggaugagcugcguggugcagagcaccggccagaugcagugcaagguguacgacagccugcuggcccugccccaggaccugcaggccgccagagcccugugcgugaucgcccugcugcuggcccugcugggccugcugguggccaucaccggcgcccagugcaccaccugcguggaggacgagggcgccaaggccagaaucgugcugaccgccggcgugauccugcugcuggccggcauccuggugcugauccccgugugcuggaccgcccacgccaucauccaggacuucuacaacccccugguggccgaggcccugaagagagagcugggcgccagccuguaccugggcugggccgccgccgcccugcugaugcugggcggcggccugcugugcugcaccugcccccccccccagguggagagacccagaggccccagacugggcuacagcauccccagcagaagcggcgccagcggccuggacaagagagacuacguguaa

SEQ ID NO: 15312 - RNA, 879 nt, Artificial Sequence
  CLEC10A__Homo_sapiens__NP_006335
augaccagaaccuacgagaacuuccaguaccuggagaacaaggugaaggugcagggcuucaagaacggcccccugccccugcagagccugcugcagagacugugcagcggccccugccaccugcugcugagccugggccugggccugcugcugcuggugaucaucugcguggugggcuuccagaacagcaaguuccagagagaccuggugacccugagaaccgacuucagcaacuucaccagcaacaccguggccgagauccaggcccugaccagccagggcagcagccuggaggagaccaucgccagccugaaggccgagguggagggcuucaagcaggagagacaggccgugcacagcgagaugcugcugagagugcagcagcuggugcaggaccugaagaagcugaccugccagguggccacccugaacaacaacggcgaggaggccagcaccgagggcaccugcugccccgugaacuggguggagcaccaggacagcugcuacugguucagccacagcggcaugagcugggccgaggccgagaaguacugccagcugaagaacgcccaccugguggugaucaacagcagagaggagcagaacuucgugcagaaguaccugggcagcgccuacaccuggaugggccugagcgaccccgagggcgccuggaaguggguggacggcaccgacuacgccaccggcuuccagaacuggaagcccggccagcccgacgacuggcagggccacggccugggcggcggcgaggacugcgcccacuuccaccccgacggcagauggaacgacgacgugugccagagacccuaccacugggugugcgaggccggccugggccagaccagccaggagagccacuaa

SEQ ID NO: 15313 - RNA, 972 nt, Artificial Sequence
  CLEC11A__Homo_sapiens__NP_002966
augcaggccgccuggcugcugggcgcccugguggugccccagcugcugggcuucggccacggcgccagaggcgccgagagagagugggagggcggcuggggcggcgcccaggaggaggagagagagagagaggcccugaugcugaagcaccugcaggaggcccugggccugcccgccggcagaggcgacgagaaccccgccggcaccguggagggcaaggaggacugggagauggaggaggaccagggcgaggaggaggaggaggaggccacccccacccccagcagcggccccagccccagccccacccccgaggacaucgugaccuacauccugggcagacuggccggccuggacgccggccugcaccagcugcacgugagacugcacgcccuggacaccagagugguggagcugacccagggccugagacagcugagaaacgccgccggcgacaccagagacgccgugcaggcccugcaggaggcccagggcagagccgagagagagcacggcagacuggagggcugccugaagggccugagacugggccacaagugcuuccugcugagcagagacuucgaggcccaggccgccgcccaggccagaugcaccgccagaggcggcagccuggcccagcccgccgacagacagcagauggaggcccugaccagauaccugagagccgcccuggcccccuacaacuggcccguguggcugggcgugcacgacagaagagccgagggccuguaccuguucgagaacggccagagagugagcuucuucgccuggcacagaagccccagacccgagcugggcgcccagcccagcgccagcccccacccccugagccccgaccagcccaacggcggcacccuggagaacugcguggcccaggccagcgacgacggcagcuggugggaccacgacugccagagaagacuguacuacgugugcgaguuccccuucuaa

SEQ ID NO: 15314 - RNA, 828 nt, Artificial Sequence
  CLEC12A__Homo_sapiens__NP_001193939
auguggaucgacuucuucaccuacagcagcaugagcgaggaggugaccuacgccgaccugcaguuccagaacagcagcgagauggagaagauccccgagaucggcaaguucggcgagaaggccccccccgcccccagccacguguggagacccgccgcccuguuccugacccugcugugccugcugcugcugaucggccugggcgugcuggccagcauguuccacgugacccugaagaucgagaugaagaagaugaacaagcugcagaacaucagcgaggagcugcagagaaacaucagccugcagcugaugagcaacaugaacaucagcaacaagaucagaaaccugagcaccacccugcagaccaucgccaccaagcugugcagagagcuguacagcaaggagcaggagcacaagugcaagcccugccccagaagauggaucuggcacaaggacagcugcuacuuccugagcgacgacgugcagaccuggcaggagagcaagauggccugcgccgcccagaacgccagccugcugaagaucaacaacaagaacgcccuggaguucaucaagagccagagcagaagcuacgacuacuggcugggccugagccccgaggaggacagcaccagaggcaugagaguggacaacaucaucaacagcagcgccugggugaucagaaacgcccccgaccugaacaacauguacugcggcuacaucaacagacuguacgugcaguacuaccacugcaccuacaagaagagaaugaucugcgagaagauggccaaccccgugcagcugggcagcaccuacuucagagaggccuaa

SEQ ID NO: 15315 - RNA, 1473 nt, Artificial Sequence
  CLEC14A__Homo_sapiens__NP_778230
augagacccgccuucgcccugugccugcuguggcaggcccuguggcccggccccggcggcggcgagcaccccaccgccgacagagccggcugcagcgccagcggcgccugcuacagccugcaccacgccaccaugaagagacaggccgccgaggaggccugcauccugagaggcggcgcccugagcaccgugagagccggcgccgagcugagagccgugcuggcccugcugagagccggccccggccccggcggcggcagcaaggaccugcuguucuggguggcccuggagagaagaagaagccacugcacccuggagaacgagccccugagaggcuucagcuggcugagcagcgaccccggcggccuggagagcgacacccugcaguggguggaggagccccagagaagcugcaccgccagaagaugcgccgugcugcaggccaccggcggcguggagcccgccggcuggaaggagaugagaugccaccugagagccaacggcuaccugugcaaguaccaguucgaggugcugugccccgcccccagacccggcgccgccagcaaccugagcuacagagcccccuuccagcugcacagcgccgcccuggacuucagcccccccggcaccgaggugagcgcccugugcagaggccagcugcccaucagcgugaccugcaucgccgacgagaucggcgccagaugggacaagcugagcggcgacgugcugugccccugccccggcagauaccugagagccggcaagugcgccgagcugcccaacugccuggacgaccugggcggcuucgccugcgagugcgccaccggcuucgagcugggcaaggacggcagaagcugcgugaccagcggcgagggccagcccacccugggcggcaccggcgugcccaccagaagaccccccgccaccgccaccagccccgugccccagagaaccuggcccaucagaguggacgagaagcugggcgagaccccccuggugcccgagcaggacaacagcgugaccagcauccccgagauccccagauggggcagccagagcaccaugagcacccugcagaugagccugcaggccgagagcaaggccaccaucacccccagcggcagcgugaucagcaaguucaacagcaccaccagcagcgccaccccccaggccuucgacagcagcagcgccgugguguucaucuucgugagcaccgccgugguggugcuggugauccugaccaugaccgugcugggccuggugaagcugugcuuccacgagagccccagcagccagcccagaaaggagagcaugggcccccccggccuggagagcgaccccgagcccgccgcccugggcagcagcagcgcccacugcaccaacaacggcgugaaggugggcgacugcgaccugagagacagagccgagggcgcccugcuggccgagagcccccugggcagcagcgacgccuaa

SEQ ID NO: 15316 - RNA, 2721 nt, Artificial Sequence
  CLEC16A__Homo_sapiens__NP_001230332
auguucggcagaagcagaagcugggugggcggcggccacggcaagaccagcagaaacauccacagccuggaccaccugaaguaccuguaccacgugcugaccaagaacaccaccgugaccgagcagaacagaaaccugcugguggagaccaucagaagcaucaccgagauccugaucuggggcgaccagaacgacagcagcguguucgacuucuuccuggagaagaacauguucguguucuuccugaacauccugagacagaagagcggcagauacgugugcgugcagcugcugcagacccugaacauccuguucgagaacaucagccacgagaccagccuguacuaccugcugagcaacaacuacgugaacagcaucaucgugcacaaguucgacuucagcgacgaggagaucauggccuacuacaucagcuuccugaagacccugagccugaagcugaacaaccacaccgugcacuucuucuacaacgagcacaccaacgacuucgcccuguacaccgaggccaucaaguucuucaaccaccccgagagcauggugagaaucgccgugagaaccaucacccugaacguguacaagguggacaaccaggccaugcugcacuacaucagagacaagaccgccgugcccuacuucagcaaccuggugugguucaucggcagccacgugaucgagcuggacgacugcgugcagaccgacgaggagcacagaaacagaggcaagcugagcgaccugguggccgagcaccuggaccaccugcacuaccugaacgacauccugaucaucaacugcgaguuccugaacgacgugcugaccgaccaccugcugaacagacuguuccugccccuguacguguacagccuggagaaccaggacaagggcggcgagagacccaagaucagccugcccgugagccuguaccugcugagccagguguuccugaucauccaccacgccccccuggugaacagccuggccgaggugauccugaacggcgaccugagcgagauguacgccaagaccgagcaggacauccagagaagcagcgccaagcccagcaucagaugcuucaucaagcccaccgagacccuggagagaagccuggagaugaacaagcacaagggcaagagaagagugcagaagagacccaacuacaagaacgugggcgaggaggaggacgaggagaagggccccaccgaggacgcccaggaggacgccgagaaggccaaggagaucgagauggugaucauggagagaagcaagcugagcgagcuggccgccagcaccagcgugcaggagcagaacaccaccgacgaggagaagagcgccgccgccaccugcagcgagagcacccaguggagcagacccuuccuggacaugguguaccacgcccuggacagccccgacgacgacuaccacgcccuguucgugcugugccugcuguacgccaugagccacaacaagggcauggaccccgagaagcuggagagaauccagcugcccgugcccaacgccgccgagaagaccaccuacaaccacccccuggccgagagacugaucagaaucaugaacaacgccgcccagcccgacggcaagaucagacuggccacccuggagcugagcugccugcugcugaagcagcaggugcugaugagcgccggcugcaucaugaaggacgugcaccuggccugccuggagggcgccagagaggagagcgugcaccuggugagacacuucuacaagggcgaggacaucuuccuggacauguucgaggacgaguacagaagcaugaccaugaagcccaugaacguggaguaccugaugauggacgccagcauccugcugccccccaccggcaccccccugaccggcaucgacuucgugaagagacugcccugcggcgacguggagaagaccagaagagccaucagaguguucuucaugcugagaagccugagccugcagcugagaggcgagcccgagacccagcugccccugaccagagaggaggaccugaucaagaccgacgacgugcuggaccugaacaacagcgaccugaucgccugcaccgugaucaccaaggacggcggcauggugcagagauuccuggccguggacaucuaccagaugagccugguggagcccgacgugagcagacugggcuggggcguggugaaguucgccggccugcugcaggacaugcaggugaccggcguggaggacgacagcagagcccugaacaucaccauccacaagcccgccagcagcccccacagcaagcccuuccccauccugcaggccaccuucaucuucagcgaccacaucagaugcaucaucgccaagcagagacuggccaagggcagaauccaggccagaagaaugaagaugcagagaaucgccgcccugcuggaccugcccauccagcccaccaccgaggugcugggcuucggccugggcagcagcaccagcacccagcaccugcccuucagauucuacgaccagggcagaagaggcagcagcgaccccaccgugcagagaagcguguucgccagcguggacaaggugcccggcgagcccgcccccagacccgccccccagcuggugcaccacggcggcagaagcagaagcuucagccuguggagccugugcgagcugcccuuccugagccagaagcccagaagacuggccgcccccgccagcuaa

SEQ ID NO: 15317 - RNA, 591 nt, Artificial Sequence
  CLEC1B__Homo_sapiens__NP_001092901
augcaggacgaggacggcuacaucacccugaacaucaagaccagaaagcccgcccugaucagcgccgugaugcagagaaacuaccugcagggcgagaacgagaacagaaccggcacccugcagcagcuggccaagagauucugccaguacguggugaagcagagcgagcugaagggcaccuucaagggccacaagugcagccccugcgacaccaacuggagauacuacggcgacagcugcuacggcuucuucagacacaaccugaccugggaggagagcaagcaguacugcaccgacaugaacgccacccugcugaagaucgacaacagaaacaucguggaguacaucaaggccagaacccaccugaucagaugggugggccugagcagacagaagagcaacgagguguggaagugggaggacggcagcgugaucagcgagaacauguucgaguuccuggaggacggcaagggcaacaugaacugcgccuacuuccacaacggcaagaugcaccccaccuucugcgagaacaagcacuaccugaugugcgagagaaaggccggcaugaccaagguggaccagcugcccuaa

SEQ ID NO: 15318 - RNA, 525 nt, Artificial Sequence
  CLEC2A__Homo_sapiens__NP_001124183
augaucaaccccgagcugagagacggcagagccgacggcuucauccacagaaucgugcccaagcugauccagaacuggaagaucggccugaugugcuuccugagcaucaucaucaccaccgugugcaucaucaugaucgccaccuggagcaagcacgccaagcccguggccugcagcggcgacuggcugggcgugagagacaagugcuucuacuucagcgacgacaccagaaacuggaccgccagcaagaucuucugcagccugcagaaggccgagcuggcccagaucgacacccaggaggacauggaguuccugaagagauacgccggcaccgacaugcacuggaucggccugagcagaaagcagggcgacagcuggaaguggaccaacggcaccaccuucaacggcugguucgagaucaucggcaacggcagcuucgccuuccugagcgccgacggcgugcacagcagcagaggcuucaucgacaucaaguggaucugcagcaagcccaaguacuuccuguaa

SEQ ID NO: 15319 - RNA, 450 nt, Artificial Sequence
  CLEC2B__Homo_sapiens__NP_005118
augaugaccaagcacaagaagugcuucaucaucgugggcgugcugaucaccaccaacaucaucacccugaucgugaagcugaccagagacagccagagccugugccccuacgacuggaucggcuuccagaacaagugcuacuacuucagcaaggaggagggcgacuggaacagcagcaaguacaacugcagcacccagcacgccgaccugaccaucaucgacaacaucgaggagaugaacuuccugagaagauacaagugcagcagcgaccacuggaucggccugaagauggccaagaacagaaccggccaguggguggacggcgccaccuucaccaagagcuucggcaugagaggcagcgagggcugcgccuaccugagcgacgacggcgccgccaccgccagaugcuacaccgagagaaaguggaucugcagaaagagaauccacuaa

SEQ ID NO: 15320 - RNA, 585 nt, Artificial Sequence
  CLEC2D__Homo_sapiens__NP_001004419
augcacgacagcaacaacguggagaaggacaucacccccagcgagcugcccgccaaccccggcugccugcacagcaaggagcacagcaucaaggccacccugaucuggagacuguucuuccugaucauguuccugaccaucaucgugugcggcaugguggccgcccugagcgccaucagagccaacugccaccaggagcccagcgugugccugcaggccgccugccccgagagcuggaucggcuuccagagaaagugcuucuacuucagcgacgacaccaagaacuggaccagcagccagagauucugcgacagccaggacgccgaccuggcccagguggagagcuuccaggagcugaacuuccugcugagauacaagggccccagcgaccacuggaucggccugagcagagagcagggccagcccuggaaguggaucaacggcaccgaguggaccagacagcuggugaugaaggaggacggcgccaaccuguacguggccaaggugagccaggugcccagaaugaaccccagacccgugauggugagcuaccccggcagcagaagagugugccuguucgaguaa

SEQ ID NO: 15321 - RNA, 645 nt, Artificial Sequence
  CLEC2L__Homo_sapiens__NP_001073980
auggagcccgccagagagccccccagcagagccagacccccccccccccuggccgccagacccgcccccgcccccgccgcccccagacccagaagccccgccgaggccgaggccagaggccccgagggccugcugagaagaagcggcagcggcuacgagggcagcaccagcuggaaggccgcccuggaggacaccaccaccagacugcugcugggcgccaucgccgugcugcuguucgccauccugguggugaugagcauccuggccagcaagggcugcaucaagugcgaggcccccugccccgaggacuggcugcuguacggcagaaagugcuacuucuucagcgaggagcccagagacuggaacaccggcagacaguacugccacacccacgaggccgugcuggccgugauccagagccagaaggagcuggaguucauguucaaguucaccagaagagagcccuggaucggccugagaagagugggcgacgaguuccacugggugaacggcgaccccuucgaccccgacaccuucaccaucgccggccccggcgagugcguguucguggagcccaccagacuggugagcaccgagugccugaugaccagacccugggugugcagcaagauggccuacaccuaa

SEQ ID NO: 15322 - RNA, 609 nt, Artificial Sequence
  CLEC3B__Homo_sapiens__NP_003269
auggagcuguggggcgccuaccugcugcugugccuguucagccugcugacccaggugaccaccgagccccccacccagaagcccaagaagaucgugaacgccaagaaggacguggugaacaccaagauguucgaggagcugaagagcagacuggacacccuggcccaggagguggcccugcugaaggagcagcaggcccugcagaccgugugccugaagggcaccaaggugcacaugaagugcuuccuggccuucacccagaccaagaccuuccacgaggccagcgaggacugcaucagcagaggcggcacccugggcaccccccagaccggcagcgagaacgacgcccuguacgaguaccugagacagagcgugggcaacgaggccgagaucuggcugggccugaacgacauggccgccgagggcaccuggguggacaugaccggcgccagaaucgccuacaagaacugggagaccgagaucaccgcccagcccgacggcggcaagaccgagaacugcgccgugcugagcggcgccgccaacggcaagugguucgacaagagaugcagagaccagcugcccuacaucugccaguucggcaucguguaa

SEQ ID NO: 15323 - RNA, 714 nt, Artificial Sequence
  CLEC4A__Homo_sapiens__NP_057268
augaccagcgagaucaccuacgccgaggugagauucaagaacgaguucaagagcagcggcaucaacaccgccagcagcgccgccagcaaggagagaaccgccccccacaagagcaacaccggcuuccccaagcugcugugcgccagccugcugaucuucuuccugcugcuggccaucagcuucuucaucgccuucgugaucuucuuccagaaguacagccagcugcuggagaagaagaccaccaaggagcuggugcacaccacccuggagugcgugaagaagaacaugcccguggaggagaccgccuggagcugcugccccaagaacuggaagagcuucagcagcaacugcuacuucaucagcaccgagagcgccagcuggcaggacagcgagaaggacugcgccagaauggaggcccaccugcuggugaucaacacccaggaggagcaggacuucaucuuccagaaccugcaggaggagagcgccuacuucgugggccugagcgaccccgagggccagagacacuggcaguggguggaccagacccccuacaacgagagcagcaccuucuggcaccccagagagcccagcgaccccaacgagagaugcguggugcugaacuucagaaagagccccaagagauggggcuggaacgacgugaacugccugggcccccagagaagcgugugcgagaugaugaagauccaccuguaa

SEQ ID NO: 15324 - RNA, 642 nt, Artificial Sequence
  CLEC4C__Homo_sapiens__NP_569708
auggugcccgaggaggagccccaggacagagagaagggccuguggugguuccagcugaagguguggagcauggccguggugagcauccugcugcugagcgugugcuucaccgugagcagcguggugccccacaacuucauguacagcaagaccgugaagagacugagcaagcugagagaguaccagcaguaccaccccagccugaccugcgugauggagggcaaggacaucgaggacuggagcugcugccccacccccuggaccagcuuccagagcagcugcuacuucaucagcaccggcaugcagagcuggaccaagagccagaagaacugcagcgugaugggcgccgaccugguggugaucaacaccagagaggagcaggacuucaucauccagaaccugaagagaaacagcagcuacuuccugggccugagcgaccccggcggcagaagacacuggcaguggguggaccagacccccuacaacgagaacgugaccuucuggcacagcggcgagcccaacaaccuggacgagagaugcgccaucaucaacuucagaagcagcgaggaguggggcuggaacgacauccacugccacgugccccagaagagcaucugcaagaugaagaagaucuacaucuaa

SEQ ID NO: 15325 - RNA, 648 nt, Artificial Sequence
  CLEC4D__Homo_sapiens__NP_525126
augggccuggagaagccccagagcaagcuggagggcggcaugcacccccagcugauccccagcgugaucgccgugguguucauccugcugcugagcgugugcuucaucgccagcugccuggugacccaccacaacuucagcagaugcaagagaggcaccggcgugcacaagcuggagcaccacgccaagcugaagugcaucaaggagaagagcgagcugaagagcgccgagggcagcaccuggaacugcugccccaucgacuggagagccuuccagagcaacugcuacuucccccugaccgacaacaagaccugggccgagagcgagagaaacugcagcggcaugggcgcccaccugaugaccaucagcaccgaggccgagcagaacuucaucauccaguuccuggacagaagacugagcuacuuccugggccugagagacgagaacgccaagggccaguggagauggguggaccagacccccuucaaccccagaagaguguucuggcacaagaacgagcccgacaacagccagggcgagaacugcguggugcugguguacaaccaggacaagugggccuggaacgacgugcccugcaacuucgaggccagcagaaucugcaagauccccggcaccacccugaacuaa

SEQ ID NO: 15326 - RNA, 660 nt, Artificial Sequence
  CLEC4E__Homo_sapiens__NP_055173
augaacagcagcaagagcagcgagacccagugcaccgagagaggcugcuucagcagccagauguuccuguggaccguggccggcauccccauccuguuccugagcgccugcuucaucaccagaugcguggugaccuucagaaucuuccagaccugcgacgagaagaaguuccagcugcccgagaacuucaccgagcugagcugcuacaacuacggcagcggcagcgugaagaacugcugcccccugaacugggaguacuuccagagcagcugcuacuucuucagcaccgacaccaucagcugggcccugagccugaagaacugcagcgccaugggcgcccaccugguggugaucaacagccaggaggagcaggaguuccugagcuacaagaagcccaagaugagagaguucuucaucggccugagcgaccaggugguggagggccaguggcaguggguggacggcaccccccugaccaagagccugagcuucugggacgugggcgagcccaacaacaucgccacccuggaggacugcgccaccaugagagacagcagcaaccccagacagaacuggaacgacgugaccugcuuccugaacuacuucagaaucugcgagauggugggcaucaacccccugaacaagggcaagagccuguaa

SEQ ID NO: 15327 - RNA, 846 nt, Artificial Sequence
  CLEC4G__Homo_sapiens__NP_001231785
auggacaccaccagauacagacccuggggcagaugggugcacuggagcagaagaccccuguuccuggcccuggccgugcuggugaccaccgugcugugggccgugauccugagcauccugcugagcaaggccagcaccgagagagccgcccugcuggacggccacgaccugcugagaaccaacgccagcaagcagaccgccgcccugggcgcccugaaggaggaggugggcgacugccacagcugcugcagcggcacccaggcccagcugcagaccaccagagccgagcugggcgaggcccaggccaagcugauggagcaggagagcgcccugagagagcugagagagagagugacccagggccuggccgaggccggcagaggcagagaggacgugagaaccgagcuguucagagcccuggaggccgugagacugcagaacaacagcugcgagcccugccccaccagcuggcugagcuucgagggcagcugcuacuucuucagcgugcccaagaccaccugggccgccgcccaggaccacugcgccgacgccagcgcccaccuggugaucgugggcggccuggacgagcagggcuuccugaccagaaacaccagaggcagaggcuacuggcugggccugagagccgugagacaccugggcaaggugcagggcuaccaguggguggacggcgugagccugagcuucagccacuggaaccagggcgagcccaacgacgccuggggcagagagaacugcgugaugaugcugcacaccggccuguggaacgacgcccccugcgacagcgagaaggacggcuggaucugcgagaagagacacaacugcuaa

SEQ ID NO: 15328 - RNA, 1047 nt, Artificial Sequence
  CLEC4M__Homo_sapiens__NP_001138376
augagcgacagcaaggagcccagagugcagcagcugggccugcugggcugccugggccacggcgcccuggugcugcagcugcugagcuucaugcugcuggccggcgugcugguggccauccuggugcaggugagcaaggugcccagcagccugagccaggagcagagcgagcaggacgccaucuaccagaaccugacccagcugaaggccgccgugggcgagcugagcgagaagagcaagcugcaggagaucuaccaggagcugacccagcugaaggccgccgugggcgagcugcccgagaagagcaagcugcaggagaucuaccaggagcugaccagacugaaggccgccgugggcgagcugcccgagaagagcaagcugcaggagaucuaccaggagcugaccagacugaaggccgccgugggcgagcugcccgagaagagcaagcugcaggagaucuaccaggagcugaccgagcugaaggccgccgugggcgagcugcccgagaagagcaagcugcaggagaucuaccaggagcugacccagcugaaggccgccgugggcgagcugcccgaccagagcaagcagcagcagaucuaccaggagcugaccgaccugaagaccgccuucgagagacugugcagacacugccccaaggacuggaccuucuuccagggcaacugcuacuucaugagcaacagccagagaaacuggcacgacagcgugaccgccugccaggaggugagagcccagcugguggugaucaagaccgccgaggagcagaacuuccugcagcugcagaccagcagaagcaacagauucagcuggaugggccugagcgaccugaaccaggagggcaccuggcaguggguggacggcagcccccugagccccagcuuccagagauacuggaacagcggcgagcccaacaacagcggcaacgaggacugcgccgaguucagcggcagcggcuggaacgacaacagaugcgacguggacaacuacuggaucugcaagaagcccgccgccugcuucagagacgaguaa

SEQ ID NO: 15329 - RNA, 567 nt, Artificial Sequence
  CLEC5A__Homo_sapiens__NP_037384
augaacuggcacaugaucaucagcggccugaucgugguggugcugaagguggugggcaugacccuguuccugcuguacuucccccagaucuucaacaagagcaacgacggcuucaccaccaccagaagcuacggcaccgugagccagaucuucggcagcagcagccccagccccaacggcuucaucaccaccagaagcuacggcaccgugugccccaaggacugggaguucuaccaggccagaugcuucuuccugagcaccagcgagagcagcuggaacgagagcagagacuucugcaagggcaagggcagcacccuggccaucgugaacacccccgagaagcugaaguuccugcaggacaucaccgacgccgagaaguacuucaucggccugaucuaccacagagaggagaagagauggagauggaucaacaacagcguguucaacggcaacgugaccaaccagaaccagaacuucaacugcgccaccaucggccugaccaagaccuucgacgccgccagcugcgacaucagcuacagaagaaucugcgagaagaacgccaaguaa

SEQ ID NO: 15330 - RNA, 630 nt, Artificial Sequence
  CLEC6A__Homo_sapiens__NP_001007034
augaugcaggagcagcagccccagagcaccgagaagagaggcuggcugagccugagacuguggagcguggccggcaucagcaucgcccugcugagcgccugcuucaucgugagcugcguggugaccuaccacuucaccuacggcgagaccggcaagagacugagcgagcugcacagcuaccacagcagccugaccugcuucagcgagggcaccaaggugcccgccuggggcugcugccccgccagcuggaagagcuucggcagcagcugcuacuucaucagcagcgaggagaagguguggagcaagagcgagcagaacugcguggagaugggcgcccaccuggugguguucaacaccgaggccgagcagaacuucaucgugcagcagcugaacgagagcuucagcuacuuccugggccugagcgacccccagggcaacaacaacuggcaguggaucgacaagacccccuacgagaagaacgugagauucuggcaccugggcgagcccaaccacagcgccgagcagugcgccagcaucguguucuggaagcccaccggcuggggcuggaacgacgugaucugcgagaccagaagaaacagcaucugcgagaugaacaagaucuaccuguaa

SEQ ID NO: 15331 - RNA, 606 nt, Artificial Sequence
  CLEC7A__Homo_sapiens__NP_072092
auggaguaccaccccgaccuggagaaccuggacgaggacggcuacacccagcugcacuucgacagccagagcaacaccagaaucgccguggugagcgagaagggcagcugcgccgccagcccccccuggagacugaucgccgugauccugggcauccugugccuggugauccuggugaucgccguggugcugggcaccaugggcgugcugagcagccccugcccccccaacuggaucaucuacgagaagagcugcuaccuguucagcaugagccugaacagcugggacggcagcaagagacagugcuggcagcugggcagcaaccugcugaagaucgacagcagcaacgagcugggcuucaucgugaagcaggugagcagccagcccgacaacagcuucuggaucggccugagcagaccccagaccgaggugcccuggcugugggaggacggcagcaccuucagcagcaaccuguuccagaucagaaccaccgccacccaggagaaccccagccccaacugcguguggauccacgugagcgugaucuacgaccagcugugcagcgugcccagcuacagcaucugcgagaagaaguucagcauguaa

SEQ ID NO: 15332 - RNA, 726 nt, Artificial Sequence
  CLEC9A__Homo_sapiens__NP_997228
augcacgaggaggagaucuacaccagccugcagugggacagccccgcccccgacaccuaccagaagugccugagcagcaacaagugcagcggcgccugcugccuggugauggugaucagcugcguguucugcaugggccugcugaccgccagcaucuuccugggcgugaagcugcugcaggugagcaccaucgccaugcagcagcaggagaagcugauccagcaggagagagcccugcugaacuucaccgaguggaagagaagcugcgcccugcagaugaaguacugccaggccuucaugcagaacagccugagcagcgcccacaacagcagccccugccccaacaacuggauccagaacagagagagcugcuacuacgugagcgagaucuggagcaucuggcacaccagccaggagaacugccugaaggagggcagcacccugcugcagaucgagagcaaggaggagauggacuucaucaccggcagccugagaaagaucaagggcagcuacgacuacugggugggccugagccaggacggccacagcggcagauggcuguggcaggacggcagcagccccagccccggccugcugcccgccgagagaagccagagcgccaaccaggugugcggcuacgugaagagcaacagccugcugagcagcaacugcagcaccuggaaguacuucaucugcgagaaguacgcccugagaagcagcguguaa

SEQ ID NO: 15333 - RNA, 576 nt, Artificial Sequence
  CLECL1__Homo_sapiens__NP_001240679
auggugagcaacuucuuccacgugauccagguguucgagaagagcgccacccugaucagcaagaccgagcacaucggcuucgugaucuacagcuggagaaagagcaccacccaccugggcagcagaagaaaguucgccaucagcaucuaccugagcgaggugagccugcagaaguacgacugccccuucagcggcaccagcuucgugguguucagccuguuccugaucugcgccauggccggcgacgugguguacgccgacaucaagaccgugagaaccagcccccuggagcuggccuucccccugcagagaagcgugagcuucaacuucagcaccgugcacaagagcugccccgccaaggacuggaaggugcacaagggcaagugcuacuggaucgccgagaccaagaagagcuggaacaagagccagaacgacugcgccaucaacaacagcuaccugauggugauccaggacaucaccgccaugcugaucaccuuccugcuguaccugcagauggccuuccugcagugcguguacaucagcgacgugagcguguaccccaacuucuuccuguaa

SEQ ID NO: 15334 - RNA, 1833 nt, Artificial Sequence
  CLGN__Homo_sapiens__NP_004353
augcacuuccaggccuucuggcugugccugggccugcuguucaucagcaucaacgccgaguucauggacgacgacguggagaccgaggacuucgaggagaacagcgaggagaucgacgugaacgagagcgagcugagcagcgagaucaaguacaagaccccccagcccaucggcgagguguacuucgccgagaccuucgacagcggcagacuggccggcugggugcugagcaaggccaagaaggacgacauggacgaggagaucagcaucuacgacggcagaugggagaucgaggagcugaaggagaaccaggugcccggcgacagaggccuggugcugaagagcagagccaagcaccacgccaucagcgccgugcuggccaagcccuucaucuucgccgacaagccccugaucgugcaguacgaggugaacuuccaggacggcaucgacugcggcggcgccuacaucaagcugcuggccgacaccgacgaccugauccuggagaacuucuacgacaagaccagcuacaucaucauguucggccccgacaagugcggcgaggacuacaagcugcacuucaucuucagacacaagcaccccaagaccggcguguucgaggagaagcacgccaagccccccgacguggaccugaagaaguucuucaccgacagaaagacccaccuguacacccuggugaugaaccccgacgacaccuucgaggugcugguggaccagaccguggugaacaagggcagccugcuggaggacguggugccccccaucaagccccccaaggagaucgaggaccccaacgacaagaagcccgaggagugggacgagagagccaagauccccgaccccagcgccgugaagcccgaggacugggacgagagcgagcccgcccagaucgaggacagcagcguggugaagcccgccggcuggcuggacgacgagcccaaguucauccccgaccccaacgccgagaagcccgacgacuggaacgaggacaccgacggcgagugggaggccccccagauccugaaccccgccugcagaaucggcugcggcgaguggaagccccccaugaucgacaaccccaaguacaagggcguguggagacccccccugguggacaaccccaacuaccagggcaucuggagccccagaaagauccccaaccccgacuacuucgaggacgaccaccccuuccugcugaccagcuucagcgcccugggccuggagcuguggagcaugaccagcgacaucuacuucgacaacuucaucaucugcagcgagaaggagguggccgaccacugggccgccgacggcuggagauggaagaucaugaucgccaacgccaacaagcccggcgugcugaagcagcugauggccgccgccgagggccaccccuggcuguggcugaucuaccuggugaccgccggcgugcccaucgcccugaucaccagcuucugcuggcccagaaaggugaagaagaagcacaaggacaccgaguacaagaagaccgacaucugcaucccccagaccaagggcgugcuggagcaggaggagaaggaggagaaggccgcccuggagaagcccauggaccuggaggaggagaagaagcagaacgacggcgagaugcuggagaaggaggaggagagcgagcccgaggagaagagcgaggaggagaucgagaucaucgagggccaggaggagagcaaccagagcaacaagagcggcagcgaggacgagaugaaggaggccgacgagagcaccggcagcggcgacggccccaucaagagcgugagaaagagaagagugagaaaggacuaa

SEQ ID NO: 15335 - RNA, 726 nt, Artificial Sequence
  CLIC1__Homo_sapiens__NP_001279
auggccgaggagcagccccagguggagcuguucgugaaggccggcagcgacggcgccaagaucggcaacugccccuucagccagagacuguucauggugcuguggcugaagggcgugaccuucaacgugaccaccguggacaccaagagaagaaccgagaccgugcagaagcugugccccggcggccagcugcccuuccugcuguacggcaccgaggugcacaccgacaccaacaagaucgaggaguuccuggaggccgugcugugcccccccagauaccccaagcuggccgcccugaaccccgagagcaacaccgccggccuggacaucuucgccaaguucagcgccuacaucaagaacagcaaccccgcccugaacgacaaccuggagaagggccugcugaaggcccugaaggugcuggacaacuaccugaccagcccccugcccgaggagguggacgagaccagcgccgaggacgagggcgugagccagagaaaguuccuggacggcaacgagcugacccuggccgacugcaaccugcugcccaagcugcacaucgugcagguggugugcaagaaguacagaggcuucaccauccccgaggccuucagaggcgugcacagauaccugagcaacgccuacgccagagaggaguucgccagcaccugccccgacgacgaggagaucgagcuggccuacgagcagguggccaaggcccugaaguaa

SEQ ID NO: 15336 - RNA, 711 nt, Artificial Sequence
  CLIC3__Homo_sapiens__NP_004660
auggccgagaccaagcugcagcuguucgugaaggccagcgaggacggcgagagcgugggccacugccccagcugccagagacuguucauggugcugcugcugaagggcgugcccuucacccugaccaccguggacaccagaagaagccccgacgugcugaaggacuucgcccccggcagccagcugcccauccugcuguacgacagcgacgccaagaccgacacccugcagaucgaggacuuccuggaggagacccugggcccccccgacuuccccagccuggcccccagauacagagagagcaacaccgccggcaacgacguguuccacaaguucagcgccuucaucaagaaccccgugcccgcccaggacgaggcccuguaccagcagcugcugagagcccuggccagacuggacagcuaccugagagccccccuggagcacgagcuggccggcgagccccagcugagagagagcagaagaagauuccuggacggcgacagacugacccuggccgacugcagccugcugcccaagcugcacaucguggacaccgugugcgcccacuucagacaggcccccauccccgccgagcugagaggcgugagaagauaccuggacagcgccaugcaggagaaggaguucaaguacaccugcccccacagcgccgagauccuggccgccuacagacccgccgugcaccccagauaa

SEQ ID NO: 15337 - RNA, 1233 nt, Artificial Sequence
  CLIC5__Homo_sapiens__NP_001107558
augaacgacgaggacuacagcaccaucuacgacaccauccagaacgagagaaccuacgaggugcccgaccagcccgaggagaacgagagcccccacuacgacgacgugcacgaguaccugagacccgagaacgaccuguacgccacccagcugaacacccacgaguacgacuucgugagcguguacaccaucaagggcgaggagaccagccuggccagcgugcagagcgaggacagaggcuaccugcugcccgacgagaucuacagcgagcugcaggaggcccaccccggcgagccccaggaggacagaggcaucagcauggagggccuguacagcagcacccaggaccagcagcugugcgccgccgagcugcaggagaacggcagcgugaugaaggaggaccugcccagccccagcagcuucaccauccagcacagcaaggccuucagcaccaccaaguacagcugcuacagcgacgccgagggccuggaggagaaggagggcgcccacaugaaccccgagaucuaccuguucgugaaggccggcaucgacggcgagagcaucggcaacugccccuucagccagagacuguucaugauccuguggcugaagggcgugguguucaacgugaccaccguggaccugaagagaaagcccgccgaccugcacaaccuggcccccggcacccacccccccuuccugaccuucaacggcgacgugaagaccgacgugaacaagaucgaggaguuccuggaggagacccugacccccgagaaguaccccaagcuggccgccaagcacagagagagcaacaccgccggcaucgacaucuucagcaaguucagcgccuacaucaagaacaccaagcagcagaacaacgccgcccuggagagaggccugaccaaggcccugaagaagcuggacgacuaccugaacaccccccugcccgaggagaucgacgccaacaccugcggcgaggacaagggcagcagaagaaaguuccuggacggcgacgagcugacccuggccgacugcaaccugcugcccaagcugcacguggugaagaucguggccaagaaguacagaaacuacgacauccccgccgagaugaccggccuguggagauaccugaagaacgccuacgccagagacgaguucaccaacaccugcgccgccgacagcgagaucgagcuggccuacgccgacguggccaagagacugagcagaagcuaa

SEQ ID NO: 15338 - RNA, 2061 nt, Artificial Sequence
  CLIC6__Homo_sapiens__NP_444507
auggccgaggccgccgagcccgagggcguggcccccggcccccagggcccccccgaggugcccgccccccuggccgagagacccggcgagcccggcgccgccggcggcgaggccgagggccccgagggcagcgagggcgccgaggaggcccccagaggcgccgccgccgugaaggaggccggcggcggcggccccgacagaggccccgaggccgaggccagaggcaccagaggcgcccacggcgagaccgaggccgaggagggcgcccccgagggcgccgaggugccccagggcggcgaggagaccagcggcgcccagcagguggagggcgccagccccggcagaggcgcccagggcgagcccagaggcgaggcccagagagagcccgaggacagcgccgcccccgagagacaggaggaggccgagcagagacccgaggugcccgagggcagcgccagcggcgaggccggcgacagcguggacgccgagggcccccugggcgacaacaucgaggccgagggccccgccggcgacagcguggaggccgagggcagagugggcgacagcguggacgccgagggccccgccggcgacagcguggacgccgagggcccccugggcgacaacauccaggccgagggccccgccggcgacagcguggacgccgagggcagagugggcgacagcguggacgccgagggccccgccggcgacagcguggacgccgagggcagagugggcgacagcguggaggccggcgaccccgccggcgacggcguggaggccggcgugcccgccggcgacagcguggaggccgagggccccgccggcgacagcauggacgccgagggccccgccggcagagccagaagagugagcggcgagccccagcagagcggcgacggcagccugagcccccaggccgaggccaucgagguggccgccggcgagagcgccggcagaagccccggcgagcuggccugggacgccgccgaggaggccgaggugcccggcgugaagggcagcgaggaggccgcccccggcgacgccagagccgacgccggcgaggacagagugggcgacggcccccagcaggagcccggcgaggacgaggagagaagagagagaagccccgagggccccagagaggaggaggccgccggcggcgaggaggagagccccgacagcagcccccacggcgaggccagcagaggcgccgccgagcccgaggcccagcugagcaaccaccuggccgaggagggccccgccgagggcagcggcgaggccgccagagugaacggcagaagagaggacggcgaggccagcgagcccagagcccugggccaggagcacgacaucacccuguucgugaaggccggcuacgacggcgagagcaucggcaacugccccuucagccagagacuguucaugauccuguggcugaagggcgugaucuucaacgugaccaccguggaccugaagagaaagcccgccgaccugcagaaccuggcccccggcaccaacccccccuucaugaccuucgacggcgaggugaagaccgacgugaacaagaucgaggaguuccuggaggagaagcuggccccccccagauaccccaagcugggcacccagcaccccgagagcaacagcgccggcaacgacguguucgccaaguucagcgccuucaucaagaacaccaagaaggacgccaacgagauccacgagaagaaccugcugaaggcccugagaaagcuggacaacuaccugaacagcccccugcccgacgagaucgacgccuacagcaccgaggacgugaccgugagcggcagaaaguuccuggacggcgacgagcugacccuggccgacugcaaccugcugcccaagcugcacaucaucaagaucguggccaagaaguacagagacuucgaguuccccagcgagaugaccggcaucuggagauaccugaacaacgccuacgccagagacgaguucaccaacaccugccccgccgaccaggagaucgagcacgccuacagcgacguggccaagagaaugaaguaa

SEQ ID NO: 15339 - RNA, 1932 nt, Artificial Sequence
  CLINT1__Homo_sapiens__NP_001182484
augcugaacauguggaaggugagagagcugguggacaaggccaccaacguggugaugaacuacagcgagaucgagagcaaggugagagaggccaccaacgacgaccccuggggccccagcggccagcugaugggcgagaucgccaaggccaccuucauguacgagcaguuccccgagcugaugaacaugcuguggagcagaaugcugaaggacaacaagaagaacuggagaagaguguacaagagccugcugcugcuggccuaccugaucagaaacggcagcgagagaguggugaccagcgccagagagcacaucuacgaccugagaagccuggagaacuaccacuucguggacgagcacggcaaggaccagggcaucaacaucagacagaaggugaaggagcugguggaguucgcccaggacgacgacagacugagagaggagagaaagaaggccaagaagaacaaggacaaguacgugggcgugagcagcgacagcgugggcggcuucagauacagcgagagauacgaccccgagcccaagagcaagugggacgaggagugggacaagaacaagagcgccuuccccuucagcgacaagcugggcgagcugagcgacaagaucggcagcaccaucgacgacaccaucagcaaguucagaagaaaggacagagaggacagccccgagagaugcagcgacagcgacgaggagaagaaggccagaagaggcagaagccccaagggcgaguucaaggacgaggaggagaccgugaccaccaagcacauccacaucacccaggccaccgagaccaccaccaccagacacaagagaaccgccaaccccagcaagaccaucgaccugggcgccgccgcccacuacaccggcgacaaggccagccccgaccagaacgccagcacccacaccccccagagcagcgugaagaccagcgugcccagcagcaagagcagcggcgaccugguggaccuguucgacggcaccagccagagcaccggcggcagcgccgaccuguucggcggcuucgccgacuucggcagcgccgccgccagcggcagcuuccccagccaggugaccgccaccagcggcaacggcgacuucggcgacuggagcgccuucaaccaggcccccagcggccccguggccagcagcggcgaguucuucggcagcgccagccagcccgccguggagcuggugagcggcagccagagcgcccugggccccccccccgccgccagcaacagcagcgaccuguucgaccugaugggcagcagccaggccaccaugaccagcagccagagcaugaacuucagcaugaugagcaccaacaccgugggccugggccugcccaugagcagaagccagccccugcagaacgugagcaccgugcugcagaagcccaacccccuguacaaccagaacaccgacauggugcagaagagcgugagcaagacccugcccagcaccuggagcgaccccagcgugaacaucagccuggacaaccugcugcccggcaugcagcccagcaagccccagcagcccagccugaacaccaugauccagcagcagaacaugcagcagcccaugaacgugaugacccagagcuucggcgccgugaaccugagcagccccagcaacaugcugcccgugagaccccagaccaacgcccugaucggcggccccaugcccaugagcaugcccaacgugaugaccggcaccaugggcauggccccccugggcaacacccccaugaugaaccagagcaugaugggcaugaacaugaacaucggcaugagcgccgccggcaugggccugaccggcaccaugggcaugggcaugcccaacaucgccaugaccagcggcaccgugcagcccaagcaggacgccuucgccaacuucgccaacuucagcaaguaa

SEQ ID NO: 15340 - RNA, 4317 nt, Artificial Sequence
  CLIP1__Homo_sapiens__NP_001234926
augagcaugcugaagcccagcggccugaaggcccccaccaagauccugaagcccggcagcaccgcccugaagacccccaccgccgugguggcccccguggagaagaccaucagcagcgagaaggccagcagcacccccagcagcgagacccaggaggaguucguggacgacuucagagugggcgagagagugugggugaacggcaacaagcccggcuucauccaguuccugggcgagacccaguucgcccccggccagugggccggcaucgugcuggacgagcccaucggcaagaacgacggcagcguggccggcgugagauacuuccagugcgagccccugaagggcaucuucaccagacccagcaagcugaccagaaaggugcaggccgaggacgaggccaacggccugcagaccacccccgccagcagagccaccagcccccugugcaccagcaccgccagcauggugagcagcagccccagcacccccagcaacaucccccagaagcccagccagcccgccgccaaggagcccagcgccaccccccccaucagcaaccugaccaagaccgccagcgagagcaucagcaaccugagcgaggccggcagcaucaagaagggcgagagagagcugaagaucggcgacagagugcuggugggcggcaccaaggccggcguggugagauuccugggcgagaccgacuucgccaagggcgaguggugcggcguggagcuggacgagccccugggcaagaacgacggcgccguggccggcaccagauacuuccagugccagcccaaguacggccuguucgcccccgugcacaaggugaccaagaucggcuuccccagcaccacccccgccaaggccaaggccaacgccgugagaagagugauggccaccaccagcgccagccugaagagaagccccagcgccagcagccugagcagcaugagcagcguggccagcagcgugagcagcagacccagcagaaccggccugcugaccgagaccagcagcagauacgccagaaagaucagcggcaccaccgcccugcaggaggcccugaaggagaagcagcagcacaucgagcagcugcuggccgagagagaccuggagagagccgagguggccaaggccaccagccacgugggcgagaucgagcaggagcuggcccuggccagagacggccacgaccagcacgugcuggagcuggaggccaagauggaccagcugagaaccaugguggaggccgccgacagagagaagguggagcugcugaaccagcuggaggaggagaagagaaagguggaggaccugcaguucagaguggaggaggagagcaucaccaagggcgaccuggagcagaagagccagaucagcgaggaccccgagaacacccagaccaagcuggagcacgccagaaucaaggagcuggagcagagccugcuguucgagaagaccaaggccgacaagcugcagagagagcuggaggacaccagaguggccaccgugagcgagaagagcagaaucauggagcuggagaaggaccuggcccugagagugcaggagguggccgagcugagaagaagacuggagagcaacaagcccgccggcgacguggacaugagccugagccugcugcaggagaucagcagccugcaggagaagcuggaggugaccagaaccgaccaccagagagagaucaccagccugaaggagcacuucggcgccagagaggagacccaccagaaggagaucaaggcccuguacaccgccaccgagaagcugagcaaggagaacgagagccugaagagcaagcuggagcacgccaacaaggagaacagcgacgugaucgcccuguggaagagcaagcuggagaccgccaucgccagccaccagcaggccauggaggagcugaaggugagcuucagcaagggccugggcaccgagaccgccgaguucgccgagcugaagacccagaucgagaagaugagacuggacuaccagcacgagaucgagaaccugcagaaccagcaggacagcgagagagccgcccacgccaaggagauggaggcccugagagccaagcugaugaaggugaucaaggagaaggagaacagccuggaggccaucagaagcaagcuggacaaggccgaggaccagcaccugguggagauggaggacacccugaacaagcugcaggaggccgagaucaaggugaaggagcuggaggugcugcaggccaagugcaacgagcagaccaaggugaucgacaacuucaccagccagcugaaggccaccgaggagaagcugcuggaccuggacgcccugagaaaggccagcagcgagggcaagagcgagaugaagaagcugagacagcagcuggaggccgccgagaagcagaucaagcaccuggagaucgagaagaacgccgagagcagcaaggccagcagcaucaccagagagcugcagggcagagagcugaagcugaccaaccugcaggagaaccugagcgaggugagccaggugaaggagacccuggagaaggagcugcagauccugaaggagaaguucgccgaggccagcgaggaggccgugagcgugcagagaagcaugcaggagaccgugaacaagcugcaccagaaggaggagcaguucaacaugcugagcagcgaccuggagaagcugagagagaaccuggccgacauggaggccaaguucagagagaaggacgagagagaggagcagcugaucaaggccaaggagaagcuggagaacgacaucgccgagaucaugaagaugagcggcgacaacagcagccagcugaccaagaugaacgacgagcugagacugaaggagagagacguggaggagcugcagcugaagcugaccaaggccaacgagaacgccagcuuccugcagaagagcaucgaggacaugaccgugaaggccgagcagagccagcaggaggccgccaagaagcacgaggaggagaagaaggagcuggagagaaagcugagcgaccuggagaagaagauggagaccagccacaaccagugccaggagcugaaggccagauacgagagagccaccagcgagaccaagaccaagcacgaggagauccugcagaaccugcagaagacccugcuggacaccgaggacaagcugaagggcgccagagaggagaacagcggccugcugcaggagcuggaggagcugagaaagcaggccgacaaggccaaggccgcccagaccgccgaggacgccaugcagaucauggagcagaugaccaaggagaagaccgagacccuggccagccuggaggacaccaagcagaccaacgccaagcugcagaacgagcuggacacccugaaggagaacaaccugaagaacguggaggagcugaacaagagcaaggagcugcugaccguggagaaccagaagauggaggaguucagaaaggagaucgagacccugaagcaggccgccgcccagaagagccagcagcugagcgcccugcaggaggagaacgugaagcuggccgaggagcugggcagaagcagagacgaggugaccagccaccagaagcuggaggaggagagaagcgugcugaacaaccagcugcuggagaugaagaagagagagagcaaguucaucaaggacgccgacgaggagaaggccagccugcagaagagcaucagcaucaccagcgcccugcugaccgagaaggacgccgagcuggagaagcugagaaacgaggugaccgugcugagaggcgagaacgccagcgccaagagccugcacagcguggugcagacccuggagagcgacaaggugaagcuggagcugaaggugaagaaccuggagcugcagcugaaggagaacaagagacagcugagcagcagcagcggcaacaccgacacccaggccgacgaggacgagagagcccaggagagccagaucgacuuccugaacagcgugaucguggaccugcagagaaagaaccaggaccugaagaugaagguggagaugaugagcgaggccgcccugaacggcaacggcgacgaccugaacaacuacgacagcgacgaccaggagaagcagagcaagaagaagcccagacuguucugcgacaucugcgacugcuucgaccugcacgacaccgaggacugccccacccaggcccagaugagcgaggaccccccccacagcacccaccacggcagcagaggcgaggagagacccuacugcgagaucugcgagauguucggccacugggccaccaacugcaacgacgacgagaccuucuaa

SEQ ID NO: 15341 - RNA, 3141 nt, Artificial Sequence
  CLIP2__Homo_sapiens__NP_003379
augcagaagcccagcggccugaagccccccggcagaggcggcaagcacagcagccccaugggcagaaccagcaccggcagcgccagcagcagcgccgccguggccgccagcagcaaggagggcagcccccugcacaagcagagcagcggccccagcagcagccccgccgccgccgccgcccccgagaagcccggccccaaggccgccgaggugggcgacgacuuccugggcgacuucguggugggcgagagagugugggugaacggcgugaagcccggcguggugcaguaccugggcgagacccaguucgcccccggccagugggccggcguggugcuggacgaccccgugggcaagaacgacggcgccgugggcggcgugagauacuucgagugccccgcccugcagggcaucuucaccagacccagcaagcugaccagacagcccaccgccgagggcagcggcagcgacgcccacagcguggagagccugaccgcccagaaccugagccugcacagcggcaccgccacccccccccugaccagcagagugaucccccugagagagagcgugcugaacagcagcgugaagaccggcaacgagagcggcagcaaccugagcgacagcggcagcgugaagagaggcgagaaggaccugagacugggcgacagagugcuggugggcggcaccaagaccggcguggugagauacgugggcgagaccgacuucgccaagggcgaguggugcggcguggagcuggacgagccccugggcaagaacgacggcgccguggccggcaccagauacuuccagugcccccccaaguucggccuguucgcccccauccacaaggugaucagaaucggcuuccccagcaccagccccgccaaggccaagaagaccaagagaauggccaugggcgugagcgcccugacccacagccccagcagcagcagcaucagcagcgugagcagcguggccagcagcgugggcggcagacccagcagaagcggccugcugaccgagaccagcagcagauacgccagaaagaucagcggcaccaccgcccugcaggaggcccugaaggagaagcagcagcacaucgagcagcugcuggccgagagagaccuggagagagccgagguggccaaggccaccagccacaucugcgagguggagaaggagaucgcccugcugaaggcccagcacgagcaguacguggccgaggccgaggagaagcugcagagagccagacugcugguggagagcgugagaaaggagaagguggaccugagcaaccagcuggaggaggagagaagaaagguggaggaccugcaguucagaguggaggaggagagcaucaccaagggcgaccuggagacccagacccagcuggagcacgccagaaucggcgagcuggagcagagccugcugcuggagaaggcccaggccgagagacugcugagagagcuggccgacaacagacugaccaccguggccgagaagagcagagugcugcagcuggaggaggagcugacccugagaagaggcgagaucgaggagcugcagcagugccugcugcacagcggcccccccccccccgaccaccccgacgccgccgagauccugagacugagagagagacugcugagcgccagcaaggagcaccagagagagagcggcgugcugagagacaaguacgagaaggcccugaaggccuaccaggccgagguggacaagcugagagccgccaacgagaaguacgcccaggagguggccggccugaaggacaaggugcagcaggccaccagcgagaacaugggccugauggacaacuggaagagcaagcuggacagccuggccagcgaccaccagaagagccuggaggaccugaaggccacccugaacagcggccccggcgcccagcagaaggagaucggcgagcugaaggccgugauggagggcaucaagauggagcaccagcuggagcugggcaaccugcaggccaagcacgaccuggagaccgccaugcacgugaaggagaaggaggcccugagagagaagcugcaggaggcccaggaggagcuggccggccugcagagacacuggagagcccagcuggaggugcaggccagccagcacagacuggagcugcaggaggcccaggaccagagaagagacgccgagcugagagugcacgagcuggagaagcuggacguggaguacagaggccaggcccaggccaucgaguuccugaaggagcagaucagccuggccgagaagaagaugcuggacuacgagagacugcagagagccgaggcccagggcaagcaggagguggagagccugagagagaagcugcugguggccgagaacagacugcaggccguggaggcccugugcagcagccagcacacccacaugaucgagagcaacgacaucagcgaggagaccaucagaaccaaggagaccguggagggccugcaggacaagcugaacaagagagacaaggaggugaccgcccugaccagccagaccgagaugcugagagcccaggugagcgcccuggagagcaagugcaagagcggcgagaagaagguggacgcccugcugaaggagaagagaagacuggaggccgagcuggagaccgugagcagaaagacccacgacgccagcggccagcuggugcugaucagccaggagcugcugagaaaggagagaagccugaacgagcugagagugcugcugcuggaggccaacagacacagccccggccccgagagagaccugagcagagaggugcacaaggccgaguggagaaucaaggagcagaagcugaaggacgacaucagaggccugagagagaagcugaccggccuggacaaggagaagagccugagcgaccagagaagauacagccugaucgaccccagcagcgcccccgagcugcugagacugcagcaccagcugaugagcaccgaggacgcccugagagacgcccuggaccaggcccagcagguggagaagcugauggaggccaugagaagcugccccgacaaggcccagaccaucggcaacagcggcagcgccaacggcauccaccagcaggacaaggcccagaagcaggaggacaagcacuaa

SEQ ID NO: 15342 - RNA, 1581 nt, Artificial Sequence
  CLK1__Homo_sapiens__NP_001155879
auggccgccggcagaagacccgccagcgcccuguggcccgagagaagaggcagcccccugagaggcgaccugcugggcuuccagaacgugagagagcccagcagcugcggcgagacccugagcggcaugagacacagcaagagaaccuacugccccgacugggacgacaaggacugggacuacggcaaguggagaagcagcagcagccacaagagaagaaagagaagccacagcagcgcccaggagaacaagagaugcaaguacaaccacagcaagaugugcgacagccacuaccuggagagcagaagcaucaacgagaaggacuaccacagcagaagauacaucgacgaguacagaaacgacuacacccagggcugcgagcccggccacagacagagagaccacgagagcagauaccagaaccacagcagcaagagcagcggcagaagcggcagaagcagcuacaagagcaagcacagaauccaccacagcaccagccacagaagaagccacggcaagagccacagaagaaagagaaccagaagcguggaggacgacgaggagggccaccugaucugccagagcggcgacgugcugagcgccagauacgagaucguggacacccugggcgagggcgccuucggcaaggugguggagugcaucgaccacaaggccggcggcagacacguggccgugaagaucgugaagaacguggacagauacugcgaggccgccagaagcgagauccaggugcuggagcaccugaacaccaccgaccccaacagcaccuucagaugcgugcagaugcuggagugguucgagcaccacggccacaucugcaucguguucgagcugcugggccugagcaccuacgacuucaucaaggagaacggcuuccugcccuucagacuggaccacaucagaaagauggccuaccagaucugcaagagcgugaacuuccugcacagcaacaagcugacccacaccgaccugaagcccgagaacauccuguucgugcagagcgacuacaccgaggccuacaaccccaagaucaagagagacgagagaacccugaucaaccccgacaucaaggugguggacuucggcagcgccaccuacgacgacgagcaccacagcacccuggugagcaccagacacuacagagcccccgaggugauccuggcccugggcuggagccagcccugcgacguguggagcaucggcugcauccugaucgaguacuaccugggcuucaccguguuccccacccacgacagcaaggagcaccuggccaugauggagagaauccugggcccccugcccaagcacaugauccagaagaccagaaagagaaaguacuuccaccacgacagacuggacugggacgagcacagcagcgccggcagauacgugagcagaagaugcaagccccugaaggaguucaugcugagccaggacguggagcacgagagacuguucgaccugauccagaagaugcuggaguacgaccccgccaagagaaucacccugagagaggcccugaagcaccccuucuucgaccugcugaagaagagcaucuaa

SEQ ID NO: 15343 - RNA, 1500 nt, Artificial Sequence
  CLK2__Homo_sapiens__NP_001281267
augccccaccccagaagauaccacagcagcgagagaggcagcagaggcagcuacagagagcacuacagaagcagaaagcacaagagaagaagaagcagaagcuggagcagcagcagcgacagaaccagaagaagaagaagagaggacagcuaccacgugagaagcagaagcagcuacgacgacagaagcagcgacagaagaguguacgacagaagauacugcggcagcuacagaagaaacgacuacagcagagacagaggcgacgccuacuacgacaccgacuacagacacagcuacgaguaccagagagagaacagcagcuacagaagccagagaagcagcagaagaaagcacagaagaagaagaagaagaagcagaaccuucagcagaagcagcagccagcacagcagcagaagagccaagagcguggaggacgacgccgagggccaccugaucuaccacgugggcgacuggcugcaggagagauacgagaucgugagcacccugggcgagggcaccuucggcagaguggugcagugcguggaccacagaagaggcggcgccagaguggcccugaagaucaucaagaacguggagaaguacaaggaggccgccagacuggagaucaacgugcuggagaagaucaacgagaaggaccccgacaacaagaaccugugcgugcagauguucgacugguucgacuaccacggccacaugugcaucagcuucgagcugcugggccugagcaccuucgacuuccugaaggacaacaacuaccugcccuaccccauccaccaggugagacacauggccuuccagcugugccaggccgugaaguuccugcacgacaacaagcugacccacaccgaccugaagcccgagaacauccuguucgugaacagcgacuacgagcugaccuacaaccuggagaagaagagagacgagagaagcgugaagagcaccgccgugagagugguggacuucggcagcgccaccuucgaccacgagcaccacagcaccaucgugagcaccagacacuacagagcccccgaggugauccuggagcugggcuggagccagcccugcgacguguggagcaucggcugcaucaucuucgaguacuacgugggcuucacccuguuccagacccacgacaacagagagcaccuggccaugauggagagaauccugggccccauccccagcagaaugaucagaaagaccagaaagcagaaguacuucuacagaggcagacuggacugggacgagaacaccagcgccggcagauacgugagagagaacugcaagccccugagaagauaccugaccagcgaggccgaggagcaccaccagcuguucgaccugaucgagagcaugcuggaguacgagcccgccaagagacugacccugggcgaggcccugcagcaccccuucuucgccagacugagagccgagccccccaacaagcugugggacagcagcagagacaucagcagauaa

SEQ ID NO: 15344 - RNA, 366 nt, Artificial Sequence
  CLLU1__Homo_sapiens__NP_001020404
auguucaacaagugcagcuuccacagcagcaucuacagacccgccgccgacaacagcgccagcagccugugcgccaucaucugcuuccugaaccuggugaucgagugcgaccuggagaccaacagcgagaucaacaagcugaucaucuaccuguucagccagaacaacagaaucagauucagcaagcugcugcugaagauccuguucuacaucagcaucuucagcuaccccgagcugaugugcgagcaguacgugaccuucaucaagcccggcauccacuacggccaggugagcaagaagcacaucaucuacagcaccuuccugagcaagaacuucaaguuccagcugcugagagugugcugguaa

SEQ ID NO: 15345 - RNA, 3009 nt, Artificial Sequence
  CLMN__Homo_sapiens__NP_079010
auggccgcccacgagugggacugguuccagagagaggagcugaucggccagaucagcgacaucagagugcagaaccugcagguggagagagagaacgugcagaagagaaccuucaccagauggaucaaccugcaccuggagaagugcaaccccccccuggaggugaaggaccuguucguggacauccaggacggcaagauccugauggcccugcuggaggugcugagcggcagaaaccugcugcacgaguacaagagcagcagccacagaaucuucagacugaacaacaucgccaaggcccugaaguuccuggaggacagcaacgugaagcuggugagcaucgacgccgccgagaucgccgacggcaaccccagccuggugcugggccugaucuggaacaucauccuguucuuccagaucaaggagcugaccggcaaccugagcagaaacagccccagcagcagccugagccccggcagcggcggcaccgacagcgacagcagcuucccccccacccccaccgccgagagaagcguggccaucagcgugaaggaccagagaaaggccaucaaggcccugcuggccugggugcagagaaagaccagaaaguacggcguggccgugcaggacuucgccggcagcuggagaagcggccuggccuuccuggccgugaucaaggccaucgaccccagccugguggacaugaagcaggcccuggagaacagcaccagagagaaccuggagaaggccuucagcaucgcccaggacgcccugcacauccccagacugcuggagcccgaggacaucaugguggacacccccgacgagcagagcaucaugaccuacguggcccaguuccuggagagauuccccgagcuggaggccgaggacaucuucgacagcgacaaggaggugcccaucgagagcaccuucgugagaaucaaggagacccccagcgagcaggagagcaagguguucgugcugaccgagaacggcgagagaaccuacaccgugaaccacgagaccagccaccccccccccagcaagguguucgugugcgacaagcccgagagcaugaaggaguucagacuggacggcgugagcagccacgcccugagcgacagcagcaccgaguucaugcaccagaucaucgaccaggugcugcagggcggccccggcaagaccagcgacaucagcgagcccagccccgagagcagcauccugagcagcagaaaggagaacggcagaagcaacagccugcccaucaagaagaccgugcacuucgaggccgacaccuacaaggaccccuucugcagcaagaaccugagccugugcuucgagggcagccccagaguggccaaggagagccugagacaggacggccacgugcuggccguggagguggccgaggagaaggagcagaagcaggagagcagcaagauccccgagagcagcagcgacaagguggccggcgacaucuuccugguggagggcaccaacaacaacagccagagcagcagcugcaacggcgcccuggagagcaccgccagacacgacgaggagagccacagccugagcccccccggcgagaacaccgugauggccgacagcuuccagaucaaggugaaccugaugaccguggaggcccuggaggagggcgacuacuucgaggccaucccccugaaggccagcaaguucaacagcgaccugaucgacuucgccagcaccagccaggccuucaacaaggugcccagcccccacgagaccaagcccgacgaggacgccgaggccuucgagaaccacgccgagaagcugggcaagagaagcaucaagagcgcccacaagaagaaggacagccccgagccccaggugaagauggacaagcacgagccccaccaggacagcggcgaggaggccgagggcugccccagcgcccccgaggagacccccguggacaagaagcccgaggugcacgagaaggccaagagaaagagcaccagaccccacuacgaggaggagggcgaggacgacgaccugcagggcgugggcgaggagcugagcagcagcccccccagcagcugcgugagccuggagacccugggcagccacagcgaggagggccuggacuucaagcccagccccccccugagcaaggugagcgugaucccccacgaccuguucuacuucccccacuacgaggugccccuggccgccgugcuggaggccuacguggaggaccccgaggaccugaagaacgaggagauggaccuggaggagcccgagggcuacaugcccgaccuggacagcagagaggaggaggccgacggcagccagagcagcagcagcagcagcgugcccggcgagagccugcccagcgccagcgaccaggugcuguaccugagcagaggcggcgugggcaccacccccgccagcgagcccgccccccuggccccccacgaggaccaccagcagagagagaccaaggagaacgaccccauggacagccaccagagccaggagagccccaaccuggagaacaucgccaacccccuggaggagaacgugaccaaggagagcaucagcagcaagaagaaggagaagagaaagcacguggaccacguggagagcagccuguucguggcccccggcagcgugcagagcagcgacgaccuggaggaggacagcagcgacuacagcauccccagcagaaccagccacagcgacagcagcaucuaccugagaagacacacccacagaagcagcgagagcgaccacuucagcuacgugcagcugagaaacgccgccgaccuggacgacagaagaaacagaauccugaccagaaaggccaacagcagcggcgaggccaugagccugggcagccacagcccccagagcgacagccugacccagcuggugcagcagcccgacaugauguacuucauccuguuccuguggcugcugguguacugccugcugcuguucccccagcuggacgugagcagacuguaa

SEQ ID NO: 15346 - RNA, 1122 nt, Artificial Sequence
  CLMP__Homo_sapiens__NP_079045
augagccugcugcugcugcugcugcuggugagcuacuacgugggcacccugggcacccacaccgagaucaagagaguggccgaggagaaggugacccugcccugccaccaccagcugggccugcccgagaaggacacccuggacaucgaguggcugcugaccgacaacgagggcaaccagaagguggugaucaccuacagcagcagacacguguacaacaaccugaccgaggagcagaagggcagaguggccuucgccagcaacuuccuggccggcgacgccagccugcagaucgagccccugaagcccagcgacgagggcagauacaccugcaaggugaagaacagcggcagauacguguggagccacgugauccugaaggugcuggugagacccagcaagcccaagugcgagcuggagggcgagcugaccgagggcagcgaccugacccugcagugcgagagcagcagcggcaccgagcccaucguguacuacuggcagagaaucagagagaaggagggcgaggacgagagacugccccccaagagcagaaucgacuacaaccaccccggcagagugcugcugcagaaccugaccaugagcuacagcggccuguaccagugcaccgccggcaacgaggccggcaaggagagcugcguggugagagugaccgugcaguacgugcagagcaucggcaugguggccggcgccgugaccggcaucguggccggcgcccugcugaucuuccugcugguguggcugcugaucagaagaaaggacaaggagagauacgaggaggaggagagacccaacgagaucagagaggacgccgaggcccccaaggccagacuggugaagcccagcagcagcagcagcggcagcagaagcagcagaagcggcagcagcagcaccagaagcaccgccaacagcgccagcagaagccagagaacccugagcaccgacgccgccccccagcccggccuggccacccaggccuacagccuggugggccccgaggugagaggcagcgagcccaagaaggugcaccacgccaaccugaccaaggccgagaccacccccagcaugauccccagccagagcagagccuuccagaccguguaa

SEQ ID NO: 15347 - RNA, 1317 nt, Artificial Sequence
  CLN3__Homo_sapiens__NP_000077
augggcggcugcgccggcagcagaagaagauucagcgacagcgagggcgaggagaccgugcccgagcccagacugccccugcuggaccaccagggcgcccacuggaagaacgccgugggcuucuggcugcugggccugugcaacaacuucagcuacguggugaugcugagcgccgcccacgacauccugagccacaagagaaccagcggcaaccagagccacguggaccccggccccacccccaucccccacaacagcagcagcagauucgacugcaacagcgugagcaccgccgccgugcugcuggccgacauccugcccacccuggugaucaagcugcuggccccccugggccugcaccugcugcccuacagccccagagugcuggugagcggcaucugcgccgccggcagcuucgugcugguggccuucagccacagcgugggcaccagccugugcggcgugguguucgccagcaucagcagcggccugggcgaggugaccuuccugagccugaccgccuucuaccccagagccgugaucagcugguggagcagcggcaccggcggcgccggccugcugggcgcccugagcuaccugggccugacccaggccggccugagcccccagcagacccugcugagcaugcugggcauccccgcccugcugcuggccagcuacuuccugcugcugaccagccccgaggcccaggaccccggcggcgaggaggaggccgagagcgccgccagacagccccugaucagaaccgaggcccccgagagcaagcccggcagcagcagcagccugagccugagagagagauggaccguguucaagggccugcugugguacaucgugccccugguggugguguacuucgccgaguacuucaucaaccagggccuguucgagcugcuguucuucuggaacaccagccugagccacgcccagcaguacagaugguaccagaugcuguaccaggccggcguguucgccagcagaagcagccugagaugcugcagaaucagauucaccugggcccuggcccugcugcagugccugaaccugguguuccugcuggccgacgugugguucggcuuccugcccagcaucuaccugguguuccugaucauccuguacgagggccugcugggcggcgccgccuacgugaacaccuuccacaacaucgcccuggagaccagcgacgagcacagagaguucgccauggccgccaccugcaucagcgacacccugggcaucagccugagcggccugcuggcccugccccugcacgacuuccugugccagcugagcuaa

SEQ ID NO: 15348 - RNA, 1224 nt, Artificial Sequence
  CLN5__Homo_sapiens__NP_006484
augagaagaaaccugagacugggccccagcagcggcgccgacgcccagggccagggcgcccccagacccggccuggccgcccccagaaugcugcugccccccgccagccaggccagcagaggcagcggcagcaccggcugcagccugauggcccaggagguggacaccgcccagggcgccgagaugagaagaggcgccggcgccgccagaggcagagccagcuggugcugggcccuggcccugcuguggcuggccguggugcccggcuggagcagagugagcggcauccccagcagaagacacuggcccgugcccuacaagagauucgacuucagacccaagcccgaccccuacugccaggccaaguacaccuucugccccaccggcagccccauccccgugauggagggcgacgacgacaucgagguguucagacugcaggcccccgugugggaguucaaguacggcgaccugcugggccaccugaagaucaugcacgacgccaucggcuucagaagcacccugaccggcaagaacuacaccauggagugguacgagcuguuccagcugggcaacugcaccuucccccaccugagacccgagauggacgcccccuucuggugcaaccagggcgccgccugcuucuucgagggcaucgacgacgugcacuggaaggagaacggcacccuggugcagguggccaccaucagcggcaacauguucaaccagauggccaagugggugaagcaggacaacgagaccggcaucuacuacgagaccuggaacgugaaggccagccccgagaagggcgccgagaccugguucgacagcuacgacugcagcaaguucgugcugagaaccuucaacaagcuggccgaguucggcgccgaguucaagaacaucgagaccaacuacaccagaaucuuccuguacagcggcgagcccaccuaccugggcaacgagaccagcguguucggccccaccggcaacaagacccugggccuggccaucaagagauucuacuaccccuucaagccccaccugcccaccaaggaguuccugcugagccugcugcagaucuucgacgccgugaucgugcacaagcaguucuaccuguucuacaacuucgaguacugguuccugcccaugaaguuccccuucaucaagaucaccuacgaggagaucccccugcccaucagaaacaagacccugagcggccuguaa

SEQ ID NO: 15349 - RNA, 936 nt, Artificial Sequence
  CLN6__Homo_sapiens__NP_060352
auggaggccaccagaagaagacagcaccugggcgccaccggcggccccggcgcccagcugggcgccagcuuccugcaggccagacacggcagcgugagcgccgacgaggccgccagaaccgcccccuuccaccuggaccugugguucuacuucacccugcagaacugggugcuggacuucggcagacccaucgccaugcugguguucccccuggagugguucccccugaacaagcccagcgugggcgacuacuuccacauggccuacaacgugaucacccccuuccugcugcugaagcugaucgagagaagccccagaacccugcccagaagcaucaccuacgugagcaucaucaucuucaucaugggcgccagcauccaccuggugggcgacagcgugaaccacagacugcuguucagcggcuaccagcaccaccugagcgugagagagaaccccaucaucaagaaccugaagcccgagacccugaucgacagcuucgagcugcuguacuacuacgacgaguaccugggccacugcaugugguacauccccuucuuccugauccuguucauguacuucagcggcugcuucaccgccagcaaggccgagagccugauccccggccccgcccugcugcugguggcccccagcggccuguacuacugguaccuggugaccgagggccagaucuucauccuguucaucuucaccuucuucgccaugcuggcccuggugcugcaccagaagagaaagagacuguuccuggacagcaacggccuguuccuguucagcagcuucgcccugacccugcugcugguggcccuguggguggccuggcuguggaacgaccccgugcugagaaagaaguaccccggcgugaucuacgugcccgagcccugggccuucuacacccugcacgugagcagcagacacuaa

SEQ ID NO: 15350 - RNA, 861 nt, Artificial Sequence
  CLN8__Homo_sapiens__NP_061764
augaaccccgccagcgacggcggcaccagcgagagcaucuucgaccuggacuacgccagcuggggcaucagaagcacccugaugguggccggcuucguguucuaccugggcguguucguggugugccaccagcugagcagcagccugaacgccaccuacagaagccugguggccagagagaagguguucugggaccuggccgccaccagagccguguucggcgugcagagcaccgccgccggccugugggcccugcugggcgaccccgugcugcacgccgacaaggccagaggccagcagaacuggugcugguuccacaucaccaccgccaccggcuucuucugcuucgagaacguggccgugcaccugagcaaccugaucuucagaaccuucgaccuguuccuggugauccaccaccuguucgccuuccugggcuuccugggcugccuggugaaccugcaggccggccacuaccuggccaugaccacccugcugcuggagaugagcacccccuucaccugcgugagcuggaugcugcugaaggccggcuggagcgagagccuguucuggaagcugaaccaguggcugaugauccacauguuccacugcagaauggugcugaccuaccacauguggugggugugcuucuggcacugggacggccuggugagcagccuguaccugccccaccugacccuguuccuggugggccuggcccugcugacccugaucaucaaccccuacuggacccacaagaagacccagcagcugcugaaccccguggacuggaacuucgcccagcccgaggccaagagcagacccgagggcaacggccagcugcugagaaagaagagacccuaa

SEQ ID NO: 15351 - RNA, 1287 nt, Artificial Sequence
  CLNK__Homo_sapiens__NP_443196
augaacagacagggcaacagaaagaccaccaaggagggcagcaacgaccugaaguuccagaacuucagccugcccaagaacagaagcuggcccagaaucaacagcgccaccggccaguaccagagaaugaacaagccccugcuggacugggagagaaacuucgccgccgugcuggacggcgccaagggccacagcgacgacgacuacgacgaccccgagcugagaauggaggagaccuggcagagcaucaagauccugcccgccagacccaucaaggagagcgaguacgccgacacccacuacuucaagguggccauggacaccccccugccccuggacaccagaaccagcaucagcaucggccagcccaccuggaacacccagaccagacuggagagaguggacaagcccaucagcaaggacgugagaagccagaacaucaagggcgacgccagcgugagaaagaacaagaucccccugcccccccccagaccccugaucacccugcccaagaaguaccagccccugccccccgagcccgagagcagcagacccccccugagccagagacacaccuuccccgaggugcagagaaugcccagccagaucagccugagagaccugagcgaggugcuggaggccgagaaggugccccacaaccagagaaagcccgagagcacccaccugcuggagaaccagaacacccaggagaucccccuggccaucagcagcagcagcuucaccaccagcaaccacagcgugcagaacagagaccacagaggcggcaugcagcccugcagcccccagagaugccagccccccgccagcugcagcccccacgagaacauccugcccuacaaguacaccagcuggagaccccccuuccccaagagaagcgacagaaaggacgugcagcacaacgagugguacaucggcgaguacagcagacaggccguggaggaggccuucaugaaggagaacaaggacggcagcuuccuggugagagacugcagcaccaagagcaaggaggagcccuacgugcuggccguguucuacgagaacaagguguacaacgugaagaucagauuccuggagagaaaccagcaguucgcccugggcaccggccugagaggcgacgagaaguucgacagcguggaggacaucaucgagcacuacaagaacuuccccaucauccugaucgacggcaaggacaagaccggcgugcacagaaagcagugccaccugacccagccccugccccugaccagacaccugcugccccuguaa

SEQ ID NO: 15352 - RNA, 714 nt, Artificial Sequence
  CLNS1A__Homo_sapiens__NP_001284
augagcuuccugaagagcuuccccccccccggccccgccgagggccugcugagacagcagcccgacaccgaggccgugcugaacggcaagggccugggcaccggcacccuguacaucgccgagagcagacugagcuggcuggacggcagcggccugggcuucagccuggaguaccccaccaucagccugcacgcccugagcagagacagaagcgacugccugggcgagcaccuguacgugauggugaacgccaaguucgaggaggagagcaaggagcccguggccgacgaggaggaggaggacagcgacgacgacguggagcccaucaccgaguucagauucgugcccagcgacaagagcgcccuggaggccauguucaccgccaugugcgagugccaggcccugcaccccgaccccgaggacgaggacagcgacgacuacgacggcgaggaguacgacguggaggcccacgagcagggccagggcgacauccccaccuucuacaccuacgaggagggccugagccaccugaccgccgagggccaggccacccuggagagacuggagggcaugcugagccagagcgugagcagccaguacaacauggccggcgugagaaccgaggacagcaucagagacuacgaggacggcauggagguggacaccacccccaccguggccggccaguucgaggacgccgacguggaccacuaa

SEQ ID NO: 15353 - RNA, 2541 nt, Artificial Sequence
  CLOCK__Homo_sapiens__NP_004889
augcuguucaccgugagcugcagcaagaugagcagcaucguggacagagacgacagcagcaucuucgacggccugguggaggaggacgacaaggacaaggccaagagagugagcagaaacaagagcgagaagaagagaagagaccaguucaacgugcugaucaaggagcugggcagcaugcugcccggcaacgccagaaagauggacaagagcaccgugcugcagaagagcaucgacuuccugagaaagcacaaggagaucaccgcccagagcgacgccagcgagaucagacaggacuggaagcccaccuuccugagcaacgaggaguucacccagcugaugcuggaggcccuggacggcuucuuccuggccaucaugaccgacggcagcaucaucuacgugagcgagagcgugaccagccugcuggagcaccugcccagcgaccugguggaccagagcaucuucaacuucauccccgagggcgagcacagcgagguguacaagauccugagcacccaccugcuggagagcgacagccugacccccgaguaccugaagagcaagaaccagcuggaguucugcugccacaugcugagaggcaccaucgaccccaaggagcccagcaccuacgaguacgugaaguucaucggcaacuucaagagccugaacagcgugagcagcagcgcccacaacggcuucgagggcaccauccagagaacccacagacccagcuacgaggacagagugugcuucguggccaccgugagacuggccaccccccaguucaucaaggagaugugcaccguggaggagcccaacgaggaguucaccagcagacacagccuggaguggaaguuccuguuccuggaccacagagccccccccaucaucggcuaccugcccuucgaggugcugggcaccagcggcuacgacuacuaccacguggacgaccuggagaaccuggccaagugccacgagcaccugaugcaguacggcaagggcaagagcugcuacuacagauuccugaccaagggccagcaguggaucuggcugcagacccacuacuacaucaccuaccaccaguggaacagcagacccgaguucaucgugugcacccacaccguggugagcuacgccgaggugagagccgagagaagaagagagcugggcaucgaggagagccugcccgagaccgccgccgacaagagccaggacagcggcagcgacaacagaaucaacaccgugagccugaaggaggcccuggagagauucgaccacagccccacccccagcgccagcagcagaagcagcagaaagagcagccacaccgccgugagcgaccccagcagcacccccaccaagauccccaccgacaccagcaccccccccagacagcaccugcccgcccacgagaagauggugcagagaagaagcagcuucagcagccagagcaucaacagccagagcgugggcagcagccugacccagcccgugaugagccaggccaccaaccugcccaucccccagggcaugagccaguuccaguucagcgcccagcugggcgccaugcagcaccugaaggaccagcuggagcagagaaccagaaugaucgaggccaacauccacagacagcaggaggagcugagaaagauccaggagcagcugcagauggugcacggccagggccugcagauguuccugcagcagagcaaccccggccugaacuucggcagcgugcagcugagcagcggcaacagcagcaacauccagcagcuggcccccaucaacaugcagggccagguggugcccaccaaccagauccagagcggcaugaacaccggccacaucggcaccacccagcacaugauccagcagcagacccugcagagcaccagcacccagagccagcagaacgugcugagcggccacagccagcagaccagccugcccagccagacccagagcacccugaccgccccccuguacaacaccauggugaucagccagcccgccgccggcagcauggugcagauccccagcagcaugccccagaacagcacccagagcgccgccgugaccaccuucacccaggacagacagaucagauucagccagggccagcagcuggugaccaagcuggugaccgcccccguggccugcggcgccgugauggugcccagcaccaugcugaugggccagguggugaccgccuaccccaccuucgccacccagcagcagcagagccagacccugagcgugacccagcagcagcagcagcagagcagccaggagcagcagcugaccagcgugcagcagcccagccaggcccagcugacccagcccccccagcaguuccugcagaccagcagacugcugcacggcaaccccagcacccagcugauccugagcgccgccuucccccugcagcagagcaccuucccccagagccaccaccagcagcaccagagccagcagcagcagcagcugagcagacacagaaccgacagccugcccgaccccagcaaggugcagccccaguaa

SEQ ID NO: 15354 - RNA, 1086 nt, Artificial Sequence
  CLP1__Homo_sapiens__NP_001136069
augggcgaggaggccaacgacgacaagaagcccaccaccaaguucgagcuggagagagagaccgagcugagauucgagguggaggccagccagagcgugcagcuggagcugcugaccggcauggccgagaucuucggcaccgagcugaccagaaacaagaaguucaccuucgacgccggcgccaagguggccguguucaccuggcacggcugcagcgugcagcugagcggcagaaccgagguggccuacgugagcaaggacacccccaugcugcuguaccugaacacccacaccgcccuggagcagaugagaagacaggccgagaaggaggaggagagaggccccagagugaugguggugggccccaccgacgugggcaagagcaccgugugcagacugcugcugaacuacgccaucaccagcagacuggccgacguguucaaccagagaugcgaggugaacagaagagccagcgugagcggcugcgugaucaacaccugcggcugggugaagggcagcggcuaccaggcccuggugcacgccgccagcgccuucgagguggacguggugguggugcuggaccaggagagacuguacaacgagcugaagagagaccugccccacuucgugagaaccgugcugcugcccaagagcggcggcgugguggagagaagcaaggacuucagaagagagugcagagacgagagaaucagagaguacuucuacggcuucagaggcugcuucuacccccacgccuucaacgugaaguucagcgacgugaagaucuacaaggugggcgcccccaccauccccgacagcugccugccccugggcaugagccaggaggacaaccagcugaagcuggugcccgugacccccggcagagacauggugcaccaccugcugagcgugagcaccgccgagggcaccgaggagaaccugagcgagaccagcguggccggcuucaucguggugaccagcguggaccuggagcaccagguguucaccgugcugagccccgcccccagaccccugcccaagaacuuccugcugaucauggacaucagauucauggaccugaaguaa

SEQ ID NO: 15355 - RNA, 834 nt, Artificial Sequence
  CLPP__Homo_sapiens__NP_006003
auguggcccggcauccuggugggcggcgccagaguggccagcugcagauaccccgcccugggccccagacuggccgcccacuuccccgcccagagacccccccagagaacccugcagaacggccuggcccugcagagaugccugcacgccaccgccaccagagcccugccccugauccccaucgugguggagcagaccggcagaggcgagagagccuacgacaucuacagcagacugcugagagagagaaucgugugcgugaugggccccaucgacgacagcguggccagccuggugaucgcccagcugcuguuccugcagagcgagagcaacaagaagcccauccacauguacaucaacagccccggcggcguggugaccgccggccuggccaucuacgacaccaugcaguacauccugaaccccaucugcaccuggugcgugggccaggccgccagcaugggcagccugcugcuggccgccggcacccccggcaugagacacagccugcccaacagcagaaucaugauccaccagcccagcggcggcgccagaggccaggccaccgacaucgccauccaggccgaggagaucaugaagcugaagaagcagcuguacaacaucuacgccaagcacaccaagcagagccugcaggugaucgagagcgccauggagagagacagauacaugagccccauggaggcccaggaguucggcauccuggacaaggugcuggugcaccccccccaggacggcgaggacgagcccacccuggugcagaaggagcccguggaggccgcccccgccgccgagcccgugcccgccagcaccuaa

SEQ ID NO: 15356 - RNA, 216 nt, Artificial Sequence
  CLPS__Homo_sapiens__NP_001239527
auggagaagauccugauccugcugcugguggcccugagcguggccuacgccgcccccggccccagaggcaucaucaucaaccugacccuguacggcaucuacuacaagugccccugcgagagaggccugaccugcgagggcgacaagaccaucgugggcagcaucaccaacaccaacuucggcaucugccacgacgccggcagaagcaagcaguaa

SEQ ID NO: 15357 - RNA, 1968 nt, Artificial Sequence
  CLPTM1__Homo_sapiens__NP_001269104
augagcagaaaggcccacaucaccgagaaggugaccagcaacggcagcaucggcagagacccccccgccgagacccagccccagaacccccccgcccagcccgcccccaacgccuggcaggugaucaagggcgugcuguucagaaucuucaucaucugggccaucagcagcugguucagaagaggccccgccccccaggaccaggccggccccggcggcgcccccagaguggccagcagaaaccuguuccccaaggacacccugaugaaccugcacguguacaucagcgagcacgagcacuucaccgacuucaacgccaccagcgcccuguucugggagcagcacgaccugguguacggcgacuggaccagcggcgagaacagcgacggcugcuacgagcacuucgccgagcuggacaucccccagagcgugcagcagaacggcagcaucuacauccacguguacuucaccaagagcggcuuccaccccgaccccagacagaaggcccuguacagaagacuggccaccgugcacaugagcagaaugaucaacaaguacaagagaagaagauuccagaagaccaagaaccugcugaccggcgagaccgaggccgaccccgagaugaucaagagagccgaggacuacggccccguggaggugaucagccacuggcaccccaacaucaccaucaacaucguggacgaccacacccccugggugaagggcagcgugccccccccccuggaccaguacgugaaguucgacgccgugagcggcgacuacuaccccaucaucuacuucaacgacuacuggaaccugcagaaggacuacuaccccaucaacgagagccuggccagccugccccugagagugagcuucugcccccugagccuguggagauggcagcuguacgccgcccagagcaccaagagccccuggaacuuccugggcgacgagcuguacgagcagagcgacgaggagcaggacagcgugaagguggcccugcuggagaccaaccccuaccugcuggcccugaccaucaucgugagcaucgugcacagcguguucgaguuccuggccuucaagaacgacauccaguucuggaacagcagacagagccuggagggccugagcgugagaagcguguucuucggcguguuccagagcuucguggugcugcuguacauccuggacaacgagaccaacuucguggugcaggugagcguguucaucggcgugcugaucgaccuguggaagaucaccaaggugauggacgugagacuggacagagagcacagaguggccggcaucuuccccagacugagcuucaaggacaagagcaccuacaucgagagcagcaccaagguguacgacgacauggccuucagauaccugagcuggauccuguucccccugcugggcugcuacgccguguacagccugcuguaccuggagcacaagggcugguacagcugggugcugagcaugcuguacggcuuccugcugaccuucggcuucaucaccaugaccccccagcuguucaucaacuacaagcugaagagcguggcccaccugcccuggagaaugcugaccuacaaggcccugaacaccuucaucgacgaccuguucgccuucgugaucaagaugcccgugauguacagaaucggcugccugagagacgacgugguguucuucaucuaccuguaccagagauggaucuacagaguggaccccaccagagugaacgaguucggcaugagcggcgaggaccccaccgccgccgcccccguggccgaggugcccaccgccgccggcgcccugacccccacccccgcccccaccaccaccaccgccaccagagaggaggccagcaccagccugcccaccaagcccacccagggcgccagcagcgccagcgagccccaggaggccccccccaagcccgccgaggacaagaagaaggacuaa

SEQ ID NO: 15358 - RNA, 1617 nt, Artificial Sequence
  CLPTM1L__Homo_sapiens__NP_110409
auguggagcggcagaagcagcuucaccagccugguggugggcguguucgugguguacguggugcacaccugcugggugauguacggcaucguguacaccagacccugcagcggcgacgccaacugcauccagcccuaccuggccagaagacccaagcugcagcugagcguguacaccaccaccagaagccaccugggcgccgagaacaacaucgaccuggugcugaacguggaggacuucgacguggagagcaaguucgagagaaccgugaacgugagcgugcccaagaagaccagaaacaacggcacccuguacgccuacaucuuccugcaccacgccggcgugcugcccuggcacgacggcaagcaggugcaccuggugagcccccugaccaccuacauggugcccaagcccgaggagaucaaccugcugaccggcgagagcgacacccagcagaucgaggccgagaagaagcccaccagcgcccuggacgagcccgugagccacuggagacccagacuggcccugaacgugauggccgacaacuucguguucgacggcagcagccugcccgccgacgugcacagauacaugaagaugauccagcugggcaagaccgugcacuaccugcccauccuguucaucgaccagcugagcaacagagugaaggaccugauggugaucaacagaagcaccaccgagcugccccugaccgugagcuacgacaaggugagccugggcagacugagauucuggauccacaugcaggacgccguguacagccugcagcaguucggcuucagcgagaaggacgccgacgaggugaagggcaucuucguggacaccaaccuguacuuccuggcccugaccuucuucguggccgccuuccaccugcuguucgacuuccuggccuucaagaacgacaucagcuucuggaagaagaagaagagcaugaucggcaugagcaccaaggccgugcuguggagaugcuucagcaccguggugaucuuccuguuccugcuggacgagcagaccagccugcuggugcuggugcccgccggcgugggcgccgccaucgagcuguggaaggugaagaaggcccugaagaugaccaucuucuggagaggccugaugcccgaguuccaguucggcaccuacagcgagagcgagagaaagaccgaggaguacgacacccaggccaugaaguaccugagcuaccugcuguacccccugugcgugggcggcgccguguacagccugcugaacaucaaguacaagagcugguacagcuggcugaucaacagcuucgugaacggcguguacgccuucggcuuccuguucaugcugccccagcuguucgugaacuacaagcugaagagcguggcccaccugcccuggaaggccuucaccuacaaggccuucaacaccuucaucgacgacguguucgccuucaucaucaccaugcccaccagccacagacuggccugcuucagagacgacgugguguuccugguguaccuguaccagagauggcuguaccccguggacaagagaagagugaacgaguucggcgagagcuacgaggagaaggccaccagagccccccacaccgacuaa

SEQ ID NO: 15359 - RNA, 738 nt, Artificial Sequence
  CLRN1__Homo_sapiens__NP_001182723
augcccagccagcagaagaagaucaucuucugcauggccggcguguucagcuucgccugcgcccugggcguggugaccgcccugggcaccccccuguggaucaaggccaccgugcugugcaagaccggcgcccugcuggugaacgccagcggccaggagcuggacaaguucaugggcgagaugcaguacggccuguuccacggcgagggcgugagacagugcggccugggcgccagacccuucagauucagcuucuuccccgaccugcugaaggccauccccgugagcauccacgugaacgugauccuguucagcgccauccugaucgugcugaccauggugggcaccgccuucuucauguacaacgccuucggcaagcccuucgagacccugcacggcccccugggccuguaccugcugagcuucaucagcguggcccuguggcugcccgccaccagacaccaggcccagggcagcugcggcugccuggugaugauccuguucgccagcgaggugaagauccaccaccugagcgagaagaucgccaacuacaaggagggcaccuacguguacaagacccagagcgagaaguacaccaccagcuucugggugaucuucuucugcuucuucgugcacuuccugaacggccugcugaucagacuggccggcuuccaguuccccuucgccaagagcaaggacgccgagaccaccaacguggccgccgaccugauguacuaa

SEQ ID NO: 15360 - RNA, 3999 nt, Artificial Sequence
  CLSPN__Homo_sapiens__XP_011540241
augaccggcgaggugggcagcgaggugcaccuggagaucaacgaccccaacgugaucagccaggaggaggccgacagccccagcgacagcggccagggcagcuacgagaccaucggcccccugagcgagggcgacagcgacgaggagaucuucgugagcaagaagcugaagaacagaaaggugcugcaggacagcgacagcgagaccgaggacaccaacgccagccccgagaagaccaccuacgacagcgccgaggaggagaacaaggagaaccuguacgccggcaagaacaccaagaucaagagaaucuacaagaccguggccgacagcgacgagagcuacauggagaagagccuguaccaggagaaccuggaggcccaggugaagcccugccuggagcugagccugcagagcggcaacagcaccgacuucaccaccgacagaaagagcagcaagaagcacauccacgacaaggagggcaccgccggcaaggccaaggugaagagcaagagaagacuggagaaggaggagagaaagauggagaagaucagacagcugaagaagaaggagaccaagaaccaggaggacgacguggagcagcccuucaacgacagcggcugccugcugguggacaaggaccuguucgagaccggccuggaggacgagaacaacagcccccuggaggacgaggagagccuggagagcaucagagccgccgugaagaacaaggugaagaagcacaagaagaaggagcccagccuggagagcggcgugcacagcuucgaggagggcagcgagcugagcaagggcaccaccagaaaggagagaaaggccgccagacugagcaaggaggcccugaagcagcugcacagcgagacccagagacugaucagagagagcgcccugaaccugcccuaccacaugcccgagaacaagaccauccacgacuucuucaagagaaagcccagacccaccugccacggcaacgccauggcccugcugaagagcagcaaguaccagagcagccaccacaaggagaucaucgacaccgccaacaccaccgagaugaacagcgaccaccacagcaagggcagcgagcagaccaccggcgccgagaacgagguggagaccaacgcccugcccguggugagcaaggagacccagaucaucaccggcagcgacgagagcugcagaaaggaccuggugaagaacgaggagcuggagauccaggagaagcagaagcagagcgacaucagacccagccccggcgacagcagcgugcugcagcaggagagcaacuuccugggcaacaaccacagcgaggagugccaggugggcggccugguggccuucgagccccacgcccuggagggcgagggcccccagaaccccgaggagaccgacgagaagguggaggagcccgagcagcagaacaagagcagcgccgugggcccccccgagaaggugagaagauucacccuggacagacugaagcagcugggcguggacgugagcaucaagcccagacugggcgccgacgaggacagcuucgugauccuggagcccgagaccaacagagagcuggaggcccugaagcagagauucuggaagcacgccaaccccgccgccaagcccagagccggccagaccgugaacgugaacgugaucgugaaggacaugggcaccgacggcaaggaggagcugaaggccgacguggugcccgugacccuggcccccaagaagcuggacggcgccagccacaccaagcccggcgagaagcugcaggugcugaaggccaagcugcaggaggccaugaagcugagaagauucgaggagagacagaagagacaggcccuguucaagcuggacaacgaggacggcuucgaggaggaggaggaggaggaggaggagaugaccgacgagagcgaggaggacggcgaggagaagguggagaaggaggagaaggaggaggagcuggaggaggaggaggagaaggaggaggaggaggaggaggagggcaaccaggagaccgccgaguuccugcugagcagcgaggagaucgagaccaaggacgagaaggagauggacaaggagaacaacgacggcagcagcgagaucggcaaggccgugggcuuccugagcgugcccaagagccugagcagcgacagcacccugcugcuguucaaggacagcagcagcaagaugggcuacuuccccaccgaggagaagagcgagaccgacgagaacagcggcaagcagcccagcaagcuggacgaggacgacagcugcagccugcugaccaaggagagcagccacaacagcagcuucgagcugaucggcagcaccauccccagcuaccagcccugcaacagacagaccggcagaggcaccagcuucuuccccaccgccggcggcuucagaagccccagccccggccuguucagagccagccuggugagcagcgccagcaagagcagcggcaagcugagcgagcccagccugcccaucgaggacagccaggaccuguacaacgccagccccgagcccaagacccuguuccugggcgccggcgacuuccaguucugccuggaggacgacacccagagccagcugcuggacgccgacggcuuccugaacgugagaaaccacagaaaccaguaccaggcccugaagcccagacugccccuggccagcauggacgagaacgccauggacgccaacauggacgagcugcuggaccugugcaccggcaaguucaccagccaggccgagaagcaccugcccagaaagagcgacaagaaggagaacauggaggagcugcugaaccugugcagcggcaaguucaccagccaggacgccagcacccccgccagcagcgagcugaacaagcaggagaaggagagcagcaugggcgaccccauggaggaggcccuggcccugugcagcggcagcuuccccaccgacaaggaggaggaggacgaggaggaggaguucggcgacuucagacuggugagcaacgacaacgaguucgacagcgacgaggacgagcacagcgacagcggcaacgaccuggcccuggaggaccacgaggacgacgacgaggaggagcugcugaagagaagcgagaagcugaagagacagaugagacugagaaaguaccuggaggacgaggccgaggugagcggcagcgacgugggcagcgaggacgaguacgacggcgaggagaucgacgaguacgaggaggacgugaucgacgaggugcugcccagcgacgaggagcugcagagccagaucaagaagauccacaugaagaccaugcuggacgacgacaagagacagcugagacuguaccaggagagauaccuggccgacggcgaccugcacagcgacggccccggcagaaugagaaaguucagauggaagaacaucgacgacgccagccagauggaccuguuccacagagacagcgacgacgaccagaccgaggagcagcuggacgagagcgaggccagauggagaaaggagagaaucgagagagagcaguggcugagagacauggcccagcagggcaagaucaccgccgaggaggaggaggagaucggcgaggacagccaguucaugauccuggccaagaaggugaccgccaaggcccugcagaagaacgccagcagacccauggugauccaggagagcaagagccugcugagaaaccccuucgaggccaucagacccggcagcgcccagcaggugaagaccggcagccugcugaaccagcccaaggccgugcugcagaagcuggccgcccugagcgaccacaaccccagcgcccccagaaacagcagaaacuucguguuccacacccugagccccgugaaggccgaggccgccaaggagagcagcaagagccagaagauccccgagaaggacagcgacuggcugaccuggagcggcgcccccauccccggcuucuucagacugagcuucgacccccacggcuaa

SEQ ID NO: 15361 - RNA, 2889 nt, Artificial Sequence
  CLSTN1__Homo_sapiens__NP_001289812
augcugagaagacccgcccccgcccuggcccccgccgccagacugcugcuggccggccugcugugcggcggcggcgugugggccgccagagugaacaagcacaagcccuggcuggagcccaccuaccacggcaucgugaccgagaacgacaacaccgugcugcuggaccccccccugaucgcccuggacaaggacgccccccugagauucgccgagagcuucgaggugaccgugaccaaggagggcgagaucugcggcuucaagauccacggccagaacgugcccuucgacgccguggugguggacaagagcaccggcgagggcgugaucagaagcaaggagaagcuggacugcgagcugcagaaggacuacagcuucaccauccaggccuacgacugcggcaagggccccgacggcaccaacgugaagaagagccacaaggccaccgugcacauccaggugaacgacgugaacgaguacgcccccguguucaaggagaagagcuacaaggccaccgugaucgagggcaagcaguacgacagcauccugagaguggaggccguggacgccgacugcagcccccaguucagccagaucugcagcuacgagaucaucacccccgacgugcccuucaccguggacaaggacggcuacaucaagaacaccgagaagcugaacuacggcaaggagcaccaguacaagcugaccgugaccgccuacgacugcggcaagaagagagccaccgaggacgugcuggugaagaucagcaucaagcccaccugcacccccggcuggcagggcuggaacaacagaaucgaguacgagcccggcaccggcgcccuggccguguuccccaacauccaccuggagaccugcgacgagcccguggccagcgugcaggccaccguggagcuggagaccagccacaucggcaagggcugcgacagagacaccuacagcgagaagagccugcacagacugugcggcgccgccgccggcaccgccgagcugcugcccagccccagcggcagccugaacuggaccaugggccugcccaccgacaacggccacgacagcgaccagguguucgaguucaacggcacccaggccgugagaauccccgacggcguggugagcgugagccccaaggagcccuucaccaucagcguguggaugagacacggccccuucggcagaaagaaggagaccauccugugcagcagcgacaagaccgacaugaacagacaccacuacagccuguacgugcacggcugcagacugaucuuccuguucagacaggaccccagcgaggagaagaaguacagacccgccgaguuccacuggaagcugaaccaggugugcgacgaggaguggcaccacuacgugcugaacguggaguuccccagcgugacccuguacguggacggcaccagccacgagcccuucagcgugaccgaggacuacccccugcaccccagcaagaucgagacccagcugguggugggcgccugcuggcagggcggcgaccugcacaugacccaguucuucagaggcaaccuggccggccugacccugagaagcggcaagcuggccgacaagaaggugaucgacugccuguacaccugcaaggagggccuggaccugcaggugcuggaggacagcggcagaggcgugcagauccaggcccaccccagccagcuggugcugacccuggagggcgaggaccugggcgagcuggacaaggccaugcagcacaucagcuaccugaacagcagacaguuccccacccccggcaucagaagacugaagaucaccagcaccaucaagugcuucaacgaggccaccugcaucagcgugccccccguggacggcuacgugauggugcugcagcccgaggagcccaagaucagccugagcggcgugcaccacuucgccagagccgccagcgaguucgagagcagcgagggcguguuccuguuccccgagcugagaaucaucagcaccaucaccagagagguggagcccgagggcgacggcgccgaggaccccaccgugcaggagagccuggugagcgaggagaucgugcacgaccuggacaccugcgaggugaccguggagggcgaggagcugaaccacgagcaggagagccuggagguggacauggccagacugcagcagaagggcaucgaggugagcagcagcgagcugggcaugaccuucaccggcguggacaccauggccagcuacgaggaggugcugcaccugcugagauacagaaacuggcacgccagaagccugcuggacagaaaguucaagcugaucugcagcgagcugaacggcagauacaucagcaacgaguucaagguggaggugaacgugauccacaccgccaaccccauggagcacgccaaccacauggccgcccagccccaguucgugcaccccgagcacagaagcuucguggaccugagcggccacaaccuggccaacccccaccccuucgccguggugcccagcaccgccaccguggugaucguggugugcgugagcuuccugguguucaugaucauccugggcguguucagaaucagagccgcccacagaagaaccaugagagaccaggacaccggcaaggagaacgagauggacugggacgacagcgcccugaccaucaccgugaaccccauggagaccuacgaggaccagcacagcagcgaggaggaggaggaggaggaggaggaggaggagagcgaggacggcgaggaggaggacgacaucaccagcgccgagagcgagagcagcgaggaggaggagggcgagcagggcgacccccagaacgccaccagacagcagcagcuggagugggacgacagcacccugagcuacuaa

SEQ ID NO: 15362 - RNA, 2868 nt, Artificial Sequence
  CLSTN2__Homo_sapiens__NP_071414
augcugcccggcagacugugcugggugccccugcugcuggcccugggcgugggcagcggcagcggcggcggcggcgacagcagacagagaagacugcuggccgccaaggugaacaagcacaagcccuggaucgagaccagcuaccacggcgugaucaccgagaacaacgacaccgugauccuggaccccccccugguggcccuggacaaggacgcccccgugcccuucgccggcgagaucugcgccuucaagauccacggccaggagcugcccuucgaggccguggugcugaacaagaccagcggcgagggcagacugagagccaagagccccaucgacugcgagcugcagaaggaguacaccuucaucauccaggccuacgacugcggcgccggcccccacgagaccgccuggaagaagagccacaaggccguggugcacauccaggugaaggacgugaacgaguucgcccccaccuucaaggagcccgccuacaaggccguggugaccgagggcaagaucuacgacagcauccugcagguggaggccaucgacgaggacugcagcccccaguacagccagaucugcaacuacgagaucgugaccaccgacgugcccuucgccaucgacagaaacggcaacaucagaaacaccgagaagcugagcuacgacaagcagcaccaguacgagauccuggugaccgccuacgacugcggccagaagcccgccgcccaggacacccuggugcagguggacgugaagcccgugugcaagcccggcuggcaggacuggaccaagagaaucgaguaccagcccggcagcggcagcaugccccuguuccccagcauccaccuggagaccugcgacggcgccgugagcagccugcagaucgugaccgagcugcagaccaacuacaucggcaagggcugcgacagagagaccuacagcgagaagagccugcagaagcugugcggcgccagcagcggcaucaucgaccugcugcccagccccagcgccgccaccaacuggaccgccggccugcugguggacagcagcgagaugaucuucaaguucgacggcagacagggcgccaaggugcccgacggcaucgugcccaagaaccugaccgaccaguucaccaucaccauguggaugaagcacggccccagccccggcgugagagccgagaaggagaccauccugugcaacagcgacaagaccgagaugaacagacaccacuacgcccuguacgugcacaacugcagacugguguuccugcugagaaaggacuucgaccaggccgacaccuucagacccgccgaguuccacuggaagcuggaccagaucugcgacaaggaguggcacuacuacgugaucaacguggaguuccccguggugacccuguacauggacggcgccaccuacgagcccuaccuggugaccaacgacuggcccauccaccccagccacaucgccaugcagcugaccgugggcgccugcuggcagggcggcgaggugaccaagccccaguucgcccaguucuuccacggcagccuggccagccugaccaucagacccggcaagauggagagccagaaggugaucagcugccugcaggccugcaaggagggccuggacaucaacagccuggagagccugggccagggcaucaaguaccacuucaaccccagccagagcauccuggugauggagggcgacgacaucggcaacaucaacagagcccugcagaaggugagcuacaucaacagcagacaguuccccaccgccggcgugagaagacugaaggugagcagcaaggugcagugcuucggcgaggacgugugcaucagcauccccgagguggacgccuacgugauggugcugcaggccaucgagcccagaaucacccugagaggcaccgaccacuucuggagacccgccgcccaguucgagagcgccagaggcgugacccuguuccccgacaucaagaucgugagcaccuucgccaagaccgaggcccccggcgacgugaagaccaccgaccccaagagcgaggugcuggaggagaugcugcacaaccuggacuucugcgacauccuggugaucggcggcgaccuggaccccagacaggagugccuggagcugaaccacagcgagcugcaccagagacaccuggacgccaccaacagcaccgccggcuacagcaucuacggcgugggcagcaugagcagauacgagcaggugcugcaccacaucagauacagaaacuggagacccgccagccuggaggccagaagauucagaaucaagugcagcgagcugaacggcagauacaccagcaacgaguucaaccuggaggugagcauccugcacgaggaccaggugagcgacaaggagcacgugaaccaccugaucgugcagccccccuuccugcagagcgugcaccaccccgagagcagaagcagcauccagcacagcagcguggugcccagcaucgccaccguggugaucaucaucagcgugugcaugcugguguucgugguggccaugggcguguacagagugagaaucgcccaccagcacuucauccaggagaccgaggccgccaaggagagcgagauggacugggacgacagcgcccugaccaucaccgugaaccccauggagaagcacgagggccccggccacggcgaggacgagaccgagggcgaggaggaggaggaggccgaggaggagaugagcagcagcagcggcagcgacgacagcgaggaggaggaggaggaggagggcaugggcagaggcagacacggccagaacggcgccagacaggcccagcuggagugggacgacagcacccugcccuacuaa

SEQ ID NO: 15363 - RNA, 711 nt, Artificial Sequence
  CLTA__Homo_sapiens__NP_001070145
auggccgagcuggaccccuucggcgcccccgccggcgcccccggcggccccgcccugggcaacggcguggccggcgccggcgaggaggaccccgccgccgccuuccuggcccagcaggagagcgagaucgccggcaucgagaacgacgaggccuucgccauccuggacggcggcgcccccggcccccagccccacggcgagccccccggcggccccgacgccguggacggcgugaugaacggcgaguacuaccaggagagcaacggccccaccgacagcuacgccgccaucagccagguggacagacugcagagcgagcccgagagcaucagaaaguggagagaggagcagauggagagacuggaggcccuggacgccaacagcagaaagcaggaggccgaguggaaggagaaggccaucaaggagcuggaggagugguacgccagacaggacgagcagcugcagaagaccaaggccaacaacagaguggccgacgaggccuucuacaagcagcccuucgccgacgugaucggcuacguggccgccgaggaggccuucgugaacgacaucgacgagagcagccccggcaccgagugggagagaguggccagacugugcgacuucaaccccaagagcagcaagcaggccaaggacgugagcagaaugagaagcgugcugaucagccugaagcaggccccccuggugcacuaa

SEQ ID NO: 15364 - RNA, 5028 nt, Artificial Sequence
  CLTC__Homo_sapiens__NP_004850
auggcccagauccugcccaucagauuccaggagcaccugcagcugcagaaccugggcaucaaccccgccaacaucggcuucagcacccugaccauggagagcgacaaguucaucugcaucagagagaaggugggcgagcaggcccagguggugaucaucgacaugaacgaccccagcaaccccaucagaagacccaucagcgccgacagcgccaucaugaaccccgccagcaaggugaucgcccugaaggccggcaagacccugcagaucuucaacaucgagaugaagagcaagaugaaggcccacaccaugaccgacgacgugaccuucuggaaguggaucagccugaacaccguggcccuggugaccgacaacgccguguaccacuggagcauggagggcgagagccagcccgugaagauguucgacagacacagcagccuggccggcugccagaucaucaacuacagaaccgacgccaagcagaaguggcugcugcugaccggcaucagcgcccagcagaacagaguggugggcgccaugcagcuguacagcguggacagaaaggugagccagcccaucgagggccacgccgccagcuucgcccaguucaagauggagggcaacgccgaggagagcacccuguucugcuucgccgugagaggccaggccggcggcaagcugcacaucaucgaggugggcaccccccccaccggcaaccagcccuuccccaagaaggccguggacguguucuucccccccgaggcccagaacgacuuccccguggccaugcagaucagcgagaagcacgacgugguguuccugaucaccaaguacggcuacauccaccuguacgaccuggagaccggcaccugcaucuacaugaacagaaucagcggcgagaccaucuucgugaccgccccccacgaggccaccgccggcaucaucggcgugaacagaaagggccaggugcugagcgugugcguggaggaggagaacaucauccccuacaucaccaacgugcugcagaaccccgaccuggcccugagaauggccgugagaaacaaccuggccggcgccgaggagcuguucgccagaaaguucaacgcccuguucgcccagggcaacuacagcgaggccgccaagguggccgccaacgcccccaagggcauccugagaacccccgacaccaucagaagauuccagagcgugcccgcccagcccggccagaccagcccccugcugcaguacuucggcauccugcuggaccagggccagcugaacaaguacgagagccuggagcugugcagacccgugcugcagcagggcagaaagcagcugcuggagaaguggcugaaggaggacaagcuggagugcagcgaggagcugggcgaccuggugaagagcguggaccccacccuggcccugagcguguaccugagagccaacgugcccaacaaggugauccagugcuucgccgagaccggccaggugcagaagaucgugcuguacgccaagaaggugggcuacacccccgacuggaucuuccugcugagaaacgugaugagaaucagccccgaccagggccagcaguucgcccagaugcuggugcaggacgaggagccccuggccgacaucacccagaucguggacguguucauggaguacaaccugauccagcagugcaccgccuuccugcuggacgcccugaagaacaacagacccagcgagggcccccugcagaccagacugcuggagaugaaccugaugcacgccccccagguggccgacgccauccugggcaaccagauguucacccacuacgacagagcccacaucgcccagcugugcgagaaggccggccugcugcagagagcccuggagcacuucaccgaccuguacgacaucaagagagccguggugcacacccaccugcugaaccccgaguggcuggugaacuacuucggcagccugagcguggaggacagccuggagugccugagagccaugcugagcgccaacaucagacagaaccugcagaucugcgugcagguggccagcaaguaccacgagcagcugagcacccagagccugaucgagcuguucgagagcuucaagagcuucgagggccuguucuacuuccugggcagcaucgugaacuucagccaggaccccgacgugcacuucaaguacauccaggccgccugcaagaccggccagaucaaggagguggagagaaucugcagagagagcaacugcuacgaccccgagagagugaagaacuuccugaaggaggccaagcugaccgaccagcugccccugaucaucgugugcgacagauucgacuucgugcacgaccuggugcuguaccuguacagaaacaaccugcagaaguacaucgagaucuacgugcagaaggugaaccccagcagacugcccguggugaucggcggccugcuggacguggacugcagcgaggacgugaucaagaaccugauccugguggugagaggccaguucagcaccgacgagcugguggccgagguggagaagagaaacagacugaagcugcugcugcccuggcuggaggccagaauccacgagggcugcgaggagcccgccacccacaacgcccuggccaagaucuacaucgacagcaacaacaaccccgagagauuccugagagagaaccccuacuacgacagcagaguggugggcaaguacugcgagaagagagacccccaccuggccugcguggccuacgagagaggccagugcgaccuggagcugaucaacgugugcaacgagaacagccuguucaagagccugagcagauaccuggugagaagaaaggaccccgagcuguggggcagcgugcugcuggagagcaaccccuacagaagaccccugaucgaccagguggugcagaccgcccugagcgagacccaggaccccgaggaggugagcgugaccgugaaggccuucaugaccgccgaccugcccaacgagcugaucgagcugcuggagaagaucgugcuggacaacagcguguucagcgagcacagaaaccugcagaaccugcugauccugaccgccaucaaggccgacagaaccagagugauggaguacaucaacagacuggacaacuacgacgcccccgacaucgccaacaucgccaucagcaacgagcuguucgaggaggccuucgccaucuucagaaaguucgacgugaacaccagcgccgugcaggugcugaucgagcacaucggcaaccuggacagagccuacgaguucgccgagagaugcaacgagcccgccguguggagccagcuggccaaggcccagcugcagaagggcauggugaaggaggccaucgacagcuacaucaaggccgacgaccccagcagcuacauggagguggugcaggccgccaacaccagcggcaacugggaggagcuggugaaguaccugcagauggccagaaagaaggccagagagagcuacguggagaccgagcugaucuucgcccuggccaagaccaacagacuggccgagcuggaggaguucaucaacggccccaacaacgcccacauccagcaggugggcgacagaugcuacgacgagaagauguacgacgccgccaagcugcuguacaacaacgugagcaacuucggcagacuggccagcacccuggugcaccugggcgaguaccaggccgccguggacggcgccagaaaggccaacagcaccagaaccuggaaggaggugugcuucgccugcguggacggcaaggaguucagacuggcccagaugugcggccugcacaucguggugcacgccgacgagcuggaggagcugaucaacuacuaccaggacagaggcuacuucgaggagcugaucaccaugcuggaggccgcccugggccuggagagagcccacaugggcauguucaccgagcuggccauccuguacagcaaguucaagccccagaagaugagagagcaccuggagcuguucuggagcagagugaacauccccaaggugcugagagccgccgagcaggcccaccugugggccgagcugguguuccuguacgacaaguacgaggaguacgacaacgccaucaucaccaugaugaaccaccccaccgacgccuggaaggagggccaguucaaggacaucaucaccaagguggccaacguggagcuguacuacagagccauccaguucuaccuggaguucaagccccugcugcugaacgaccugcugauggugcugagccccagacuggaccacaccagagccgugaacuacuucagcaaggugaagcagcugccccuggugaagcccuaccugagaagcgugcagaaccacaacaacaagagcgugaacgagagccugaacaaccuguucaucaccgaggaggacuaccaggcccugagaaccagcaucgacgccuacgacaacuucgacaacaucagccuggcccagagacuggagaagcacgagcugaucgaguucagaagaaucgccgccuaccuguucaagggcaacaacagauggaagcagagcguggagcugugcaagaaggacagccuguacaaggacgccaugcaguacgccagcgagagcaaggacaccgagcuggccgaggagcugcugcagugguuccugcaggaggagaagagagagugcuucggcgccugccuguucaccugcuacgaccugcugagacccgacguggugcuggagaccgccuggagacacaacaucauggacuucgccaugcccuacuucauccaggugaugaaggaguaccugaccaagguggacaagcuggacgccagcgagagccugagaaaggaggaggagcaggccaccgagacccagcccaucguguacggccagccccagcugaugcugaccgccggccccagcguggccgugcccccccaggcccccuucggcuacggcuacaccgccccccccuacggccagccccagcccggcuucggcuacagcauguaa

SEQ ID NO: 15365 - RNA, 4752 nt, Artificial Sequence
  CLTCL1__Homo_sapiens__NP_001826
auggcccagauccugcccgugagauuccaggagcacuuccagcugcagaaccugggcaucaaccccgccaacaucggcuucagcacccugaccauggagagcgacaaguucaucugcaucagagagaaggugggcgagcaggcccaggugaccaucaucgacaugagcgaccccauggcccccaucagaagacccaucagcgccgagagcgccaucaugaaccccgccagcaaggugaucgcccugaaggccggcaagacccugcagaucuucaacaucgagaugaagagcaagaugaaggcccacaccauggccgaggaggugaucuucuggaagugggugagcgugaacaccguggcccuggugaccgagaccgccguguaccacuggagcauggagggcgacagccagcccaugaagauguucgacagacacaccagccuggugggcugccaggugauccacuacagaaccgacgaguaccagaaguggcugcugcuggugggcaucagcgcccagcagaacagaguggugggcgccaugcagcuguacagcguggacagaaaggugagccagcccaucgagggccacgccgccgccuucgccgaguucaagauggagggcaacgccaagcccgccacccuguucugcuucgccgugagaaaccccaccggcggcaagcugcacaucaucgaggugggccagcccgccgccggcaaccagcccuucgugaagaaggccguggacguguucuucccccccgaggcccagaacgacuuccccguggccaugcagaucggcgccaagcacggcgugaucuaccugaucaccaaguacggcuaccugcaccuguacgaccuggagagcggcgugugcaucugcaugaacagaaucagcgccgacaccaucuucgugaccgccccccacaagcccaccagcggcaucaucggcgugaacaagaagggccaggugcugagcgugugcguggaggaggacaacaucgugaacuacgccaccaacgugcugcagaaccccgaccugggccugagacuggccgugagaagcaaccuggccggcgccgagaagcuguucgugagaaaguucaacacccuguucgcccagggcagcuacgccgaggccgccaagguggccgccagcgcccccaagggcauccugagaaccagagagaccgugcagaaguuccagagcauccccgcccagagcggccaggccagcccccugcugcaguacuucggcauccugcuggaccagggccagcugaacaagcuggagagccuggagcugugccaccuggugcugcagcagggcagaaagcagcugcuggagaaguggcugaaggaggacaagcuggagugcagcgaggagcugggcgaccuggugaagaccaccgaccccaugcuggcccugagcguguaccugagagccaacgugcccagcaaggugauccagugcuucgccgagaccggccaguuccagaagaucgugcuguacgccaagaaggugggcuacacccccgacuggaucuuccugcugagaggcgugaugaagaucagccccgagcagggccugcaguucagcagaaugcuggugcaggacgaggagccccuggccaacaucagccagaucguggacaucuucauggagaacagccugauccagcagugcaccagcuuccugcuggacgcccugaagaacaacagacccgccgagggccugcugcagaccuggcugcuggagaugaaccuggugcacgccccccagguggccgacgccauccugggcaacaagauguucacccacuacgacagagcccacaucgcccagcugugcgagaaggccggccugcugcagcaggcccuggagcacuacaccgaccuguacgacaucaagagagccguggugcacacccaccugcugaaccccgaguggcuggugaacuucuucggcagccugagcguggaggacagcguggagugccugcacgccaugcugagcgccaacaucagacagaaccugcagcugugcgugcagguggccagcaaguaccacgagcagcugggcacccaggcccugguggagcuguucgagagcuucaagagcuacaagggccuguucuacuuccugggcagcaucgugaacuucagccaggaccccgacgugcaccugaaguacauccaggccgccugcaagaccggccagaucaaggagguggagagaaucugcagagagagcagcugcuacaaccccgagagagugaagaacuuccugaaggaggccaagcugaccgaccagcugccccugaucaucgugugcgacagauucggcuucgugcacgaccuggugcuguaccuguacagaaacaaccugcagagauacaucgagaucuacgugcagaaggugaaccccagcagaacccccgccgugaucggcggccugcuggacguggacugcagcgaggaggugaucaagcaccugaucauggccgugagaggccaguucagcaccgacgagcugguggccgagguggagaagagaaacagacugaagcugcugcugcccuggcuggagagccagauccaggagggcugcgaggagcccgccacccacaacgcccuggccaagaucuacaucgacagcaacaacagccccgagugcuuccugagagagaacgccuacuacgacagcagcguggugggcagauacugcgagaagagagacccccaccuggccugcguggccuacgagagaggccagugcgaccuggagcugaucaaggugugcaacgagaacagccuguucaagagcgaggccagauaccuggugugcagaaaggaccccgagcugugggcccacgugcuggaggagaccaaccccagcagaagacagcugaucgaccagguggugcagaccgcccugagcgagaccagagaccccgaggagaucagcgugaccgugaaggccuucaugaccgccgaccugcccaacgagcugaucgagcugcuggagaagaucgugcuggacaacagcguguucagcgagcacagaaaccugcagaaccugcugauccugaccgccaucaaggccgacagaaccagagugauggaguacaucagcagacuggacaacuacgacgcccuggacaucgccagcaucgccgugagcagcgcccuguacgaggaggccuucaccguguuccacaaguucgacaugaacgccagcgccauccaggugcugaucgagcacaucggcaaccuggacagagccuacgaguucgccgagagaugcaacgagcccgccguguggagccagcuggcccaggcccagcugcagaaggaccuggugaaggaggccaucaacagcuacaucagaggcgacgaccccagcagcuaccuggagguggugcagagcgccagcagaagcaacaacugggaggaccuggugaaguuccugcagauggccagaaagaagggcagagagagcuacaucgagaccgagcugaucuucgcccuggccaagaccagcagagugagcgagcuggaggacuucaucaacggccccaacaacgcccacauccagcaggugggcgacagaugcuacgaggagggcauguacgaggccgccaagcugcuguacagcaacgugagcaacuucgccagacuggccagcacccuggugcaccugggcgaguaccaggccgccguggacaacagcagaaaggccagcagcaccagaaccuggaaggaggugugcuucgccugcauggacggccaggaguucagauucgcccagcugugcggccugcacaucgugauccacgccgacgagcuggaggagcugaugugcuacuaccaggacagaggcuacuucgaggagcugauccugcugcuggaggccgcccugggccuggagagagcccacaugggcauguucaccgagcuggccauccuguacagcaaguucaagccccagaagaugcuggagcaccuggagcuguucuggagcagagugaacauccccaaggugcugagagccgccgagcaggcccaccugugggccgagcugguguuccuguacgacaaguacgaggaguacgacaacgccgugcugaccaugaugagccaccccaccgaggccuggaaggagggccaguucaaggacaucaucaccaagguggccaacguggagcugugcuacagagcccugcaguucuaccuggacuacaagccccugcugaucaacgaccugcugcuggugcugagccccagacuggaccacaccuggaccgugagcuucuucagcaaggccggccagcugccccuggugaagcccuaccugagaagcgugcagagccacaacaacaagagcgugaacgaggcccugaaccaccugcugaccgaggaggaggacuaccaggacgccaugcagcacgccgccgagagcagagacgccgagcuggcccagaagcugcugcagugguuccuggaggagggcaagagagagugcuucgccgccugccuguucaccugcuacgaccugcugagacccgacauggugcuggagcuggccuggagacacaaccugguggaccuggccaugcccuacuucauccaggugaugagagaguaccugagcaagguggacaagcuggacgcccuggagagccugagaaagcaggaggagcacgugaccgagcccgccccccugguguucgacuucgacggccacgaguaa

SEQ ID NO: 15366 - RNA, 1242 nt, Artificial Sequence
  CLUAP1__Homo_sapiens__NP_055856
augagcuucagagaccugagaaacuucaccgagaugaugagagcccugggcuaccccagacacaucagcauggagaacuucagaacccccaacuucggccuggugagcgaggugcugcuguggcuggugaagagauacgagccccagaccgacaucccccccgacguggacaccgagcaggacagaguguucuucaucaaggccaucgcccaguucauggccaccaaggcccacaucaagcugaacaccaagaagcuguaccaggccgacggcuacgccgugaaggagcugcugaagaucaccagcgugcuguacaacgccaugaagaccaagggcauggagggcagcgagaucguggaggaggacgugaacaaguucaaguucgaccugggcagcaagaucgccgaccugaaggccgccagacagcuggccagcgagaucaccagcaagggcgccagccuguacgaccugcugggcauggagguggagcugagagagaugagaaccgaggccaucgccagaccccuggagaucaacgagaccgagaaggugaugagaaucgccaucaaggagauccugacccaggugcagaagaccaaggaccugcugaacaacguggccagcgacgaggccaaccuggaggccaagaucgagaagagaaagcuggagcuggagagaaacagaaagagacuggagacccugcagagcgugagacccugcuucauggacgaguacgagaagaccgaggaggagcugcagaagcaguacgacaccuaccuggagaaguuccagaaccugaccuaccuggagcagcagcuggaggaccaccacagaauggagcaggagagauucgaggaggccaagaacacccugugccugauccagaacaagcugaaggaggaggagaagagacugcugaagagcggcagcaacgacgacagcgacaucgacauccaggaggacgacgagagcgacagcgagcuggaggagagaagacugcccaagccccagaccgccauggagaugcugaugcagggcagacccggcaagagaaucgugggcaccaugcagggcggcgacagcgacgacaacgaggacagcgaggagagcgagaucgacauggaggacgacgacgacgaggacgacgaccuggaggacgagagcaucagccugagccccaccaagcccaacagaagagugagaaagagcgagccccuggacgagagcgacaacgacuucuaa

SEQ ID NO: 15367 - RNA, 1350 nt, Artificial Sequence
  CLU__Homo_sapiens__NP_001822
augaugaagacccugcugcuguucgugggccugcugcugaccugggagagcggccaggugcugggcgaccagaccgugagcgacaacgagcugcaggagaugagcaaccagggcagcaaguacgugaacaaggagauccagaacgccgugaacggcgugaagcagaucaagacccugaucgagaagaccaacgaggagagaaagacccugcugagcaaccuggaggaggccaagaagaagaaggaggacgcccugaacgagaccagagagagcgagaccaagcugaaggagcugcccggcgugugcaacgagaccaugauggcccugugggaggagugcaagcccugccugaagcagaccugcaugaaguucuacgccagagugugcagaagcggcagcggccuggugggcagacagcuggaggaguuccugaaccagagcagccccuucuacuucuggaugaacggcgacagaaucgacagccugcuggagaacgacagacagcagacccacaugcuggacgugaugcaggaccacuucagcagagccagcagcaucaucgacgagcuguuccaggacagauucuucaccagagagccccaggacaccuaccacuaccugcccuucagccugccccacagaagaccccacuucuucuuccccaagagcagaaucgugagaagccugaugcccuucagccccuacgagccccugaacuuccacgccauguuccagcccuuccuggagaugauccacgaggcccagcaggccauggacauccacuuccacagccccgccuuccagcacccccccaccgaguucaucagagagggcgacgacgacagaaccgugugcagagagaucagacacaacagcaccggcugccugagaaugaaggaccagugcgacaagugcagagagauccugagcguggacugcagcaccaacaaccccagccaggccaagcugagaagagagcuggacgagagccugcagguggccgagagacugaccagaaaguacaacgagcugcugaagagcuaccaguggaagaugcugaacaccagcagccugcuggagcagcugaacgagcaguucaacugggugagcagacuggccaaccugacccagggcgaggaccaguacuaccugagagugaccaccguggccagccacaccagcgacagcgacgugcccagcggcgugaccgaggugguggugaagcuguucgacagcgaccccaucaccgugaccgugcccguggaggugagcagaaagaaccccaaguucauggagaccguggccgagaaggcccugcaggaguacagaaagaagcacagagaggaguaa

SEQ ID NO: 15368 - RNA, 1557 nt, Artificial Sequence
  CLUL1__Homo_sapiens__NP_001275965
augagaaccugggacuacagauggagccuggcccugguggcccagaccggcgugcacugcugcaaccugagcagccugcagccccugccccccagauucaagagauucagcugccugagccugagcagcggcugggacuacagcaacagcggcaacaugaagcccccccugcugguguucaucgugugccugcuguggcugaaggacagccacugcgcccccaccuggaaggacaagaccgccaucagcgagaaccugaagagcuucagcgaggugggcgagaucgacgccgacgaggaggugaagaaggcccugaccggcaucaagcagaugaagaucaugauggagagaaaggagaaggagcacaccaaccugaugagcacccugaagaagugcagagaggagaagcaggaggcccugaagcugcugaacgaggugcaggagcaccuggaggaggaggagagacugugcagagagagccuggccgacagcuggggcgagugcagaagcugccuggagaacaacugcaugagaaucuacaccaccugccagcccagcuggagcagcgugaagaacaagaucgagagauucuucagaaagaucuaccaguuccuguuccccuuccacgaggacaacgagaaggaccugcccaucagcgagaagcugaucgaggaggacgcccagcugacccagauggaggacguguucagccagcugaccguggacgugaacagccuguucaacagaagcuucaacguguucagacagaugcagcaggaguucgaccagaccuuccagagccacuucaucagcgacaccgaccugaccgagcccuacuucuuccccgccuucagcaaggagcccaugaccaaggccgaccuggagcagugcugggacauccccaacuucuuccagcuguucugcaacuucagcgugagcaucuacgagagcgugagcgagaccaucaccaagaugcugaaggccaucgaggaccugcccaagcaggacaaggcccccgaccacggcggccugaucagcaagaugcugcccggccaggacagaggccugugcggcgagcuggaccagaaccugagcagaugcuucaaguuccacgagaagugccagaagugccaggcccaccugagcgaggacugccccgacgugcccgcccugcacaccgagcuggacgaggccaucagacuggugaacgugagcaaccagcaguacggccagauccugcagaugaccagaaagcaccuggaggacaccgccuaccugguggagaagaugagaggccaguucggcugggugagcgagcuggccaaccaggcccccgagaccgagaucaucuucaacagcauccagguggugcccagaauccacgagggcaacaucagcaagcaggacgagaccaugaugaccgaccugagcauccugcccagcagcaacuucacccugaagaucccccuggaggagagcgccgagagcagcaacuucaucggcuacgugguggccaaggcccugcagcacuucaaggagcacuucaagaccugguaa

SEQ ID NO: 15369 - RNA, 1065 nt, Artificial Sequence
  CLVS1__Homo_sapiens__NP_775790
augggccccgugagccugcugcccaaguaccagaagcugaacaccuggaacggcgaccuggccaagaugacccaccugcaggccggccugagccccgagaccaucgagaaggccagacuggagcugaacgagaaccccgacgugcugcaccaggacauccagcaggugagagacaugaucaucaccagacccgacaucggcuuccugagaaccgacgacgccuucauccugagauuccugagagccagaaaguuccaccaggccgacgccuucagacugcuggcccaguacuuccaguacagacagcugaaccuggacauguucaagaacuucaaggccgacgaccccggcaucaagagagcccugaucgacggcuuccccggcgugcuggagaacagagaccacuacggcagaaagauccugcugcuguucgccgccaacugggaccagagcagaaacagcuucaccgacauccugagagccauccugcugagccuggaggugcugaucgaggaccccgagcugcagaucaacggcuucauccugaucaucgacuggagcaacuucagcuucaagcaggccagcaagcugacccccagcauccugaagcuggccaucgagggccugcaggacagcuuccccgccagauucggcggcgugcacuucgugaaccagcccugguacauccacgcccuguacacccugaucaagcccuuccugaaggacaagaccagaaagagaaucuuccugcacggcaacaaccugaacagccugcaccagcugauccaccccgaguuccugcccagcgaguucggcggcacccugccccccuacgacaugggcaccugggccagaacccugcugggccccgacuacagcgacgagaacgacuacacccacaccagcuacaacgccaugcacgugaagcacaccagcagcaaccuggagagagagugcagccccaagcugaugaagagaagccagagcgugguggaggccggcacccugaagcacgaggagaagggcgagaacgagaacacccagccccugcuggcccuggacuaa

SEQ ID NO: 15370 - RNA, 1023 nt, Artificial Sequence
  CLYBL__Homo_sapiens__NP_996531
auggcccugagacugcugagaagagccgccagaggcgccgccgccgccgcccugcugagacugaaggccagccuggccgccgacauccccagacugggcuacagcagcagcagccaccacaaguacauccccagaagagccgugcuguacgugcccggcaacgacgagaagaagaucaagaagauccccagccugaacguggacugcgccgugcuggacugcgaggacggcguggccgccaacaagaagaacgaggccagacugagaaucgugaagacccuggaggacaucgaccugggccccaccgagaagugcgugagagugaacagcgugagcagcggccuggccgaggaggaccuggagacccugcugcagagcagagugcugcccagcagccugaugcugcccaagguggagagccccgaggagauccagugguucgccgacaaguucagcuuccaccugaagggcagaaagcuggagcagcccaugaaccugauccccuucguggagaccgccaugggccugcugaacuucaaggccgugugcgaggagacccugaaggugggcccccaggugggccuguuccuggacgccgugguguucggcggcgaggacuucagagccagcaucggcgccaccagcagcaaggagacccuggacauccuguacgccagacagaagaucguggugaucgccaaggccuucggccugcaggccaucgaccugguguacaucgacuucagagacggcgccggccugcugagacagagcagagagggcgccgccaugggcuucaccggcaagcaggugauccaccccaaccagaucgccguggugcaggagcaguucagccccagccccgagaagaucaagugggccgaggagcugaucgccgccuucaaggagcaccagcagcugggcaagggcgccuucaccuuccagggcagcaugaucgacaugccccugcugaagcaggcccagaacaccgugacccuggccaccagcaucaaggagaaguaa

SEQ ID NO: 15371 - RNA, 744 nt, Artificial Sequence
  CMA1__Homo_sapiens__NP_001827
augcugcugcugccccugccccugcugcuguuccugcugugcagcagagccgaggccggcgagaucaucggcggcaccgagugcaagccccacagcagacccuacauggccuaccuggagaucgugaccagcaacggccccagcaaguucugcggcggcuuccugaucagaagaaacuucgugcugaccgccgcccacugcgccggcagaagcaucaccgugacccugggcgcccacaacaucaccgaggaggaggacaccuggcagaagcuggaggugaucaagcaguucagacaccccaaguacaacaccagcacccugcaccacgacaucaugcugcugaagcugaaggagaaggccagccugacccuggccgugggcacccugcccuuccccagccaguucaacuucgugccccccggcagaaugugcagaguggccggcuggggcagaaccggcgugcugaagcccggcagcgacacccugcaggaggugaagcugagacugauggacccccaggccugcagccacuucagagacuucgaccacaaccugcagcugugcgugggcaaccccagaaagaccaagagcgccuucaagggcgacagcggcggcccccugcugugcgccggcguggcccagggcaucgugagcuacggcagaagcgacgccaagccccccgccguguucaccagaaucagccacuacagacccuggaucaaccagauccugcaggccaacuaa

SEQ ID NO: 15372 - RNA, 1305 nt, Artificial Sequence
  CMAS__Homo_sapiens__NP_061156
auggacagcguggagaagggcgccgccaccagcgugagcaaccccagaggcagacccagcagaggcagaccccccaagcugcagagaaacagcagaggcggccagggcagaggcguggagaagcccccccaccuggccgcccugauccuggccagaggcggcagcaagggcaucccccugaagaacaucaagcaccuggccggcgugccccugaucggcugggugcugagagccgcccuggacagcggcgccuuccagagcgugugggugagcaccgaccacgacgagaucgagaacguggccaagcaguucggcgcccaggugcacagaagaagcagcgaggugagcaaggacagcagcaccagccuggacgccaucaucgaguuccugaacuaccacaacgagguggacaucgugggcaacauccaggccaccagccccugccugcaccccaccgaccugcagaagguggccgagaugaucagagaggagggcuacgacagcguguucagcguggugagaagacaccaguucagauggagcgagauccagaagggcgugagagaggugaccgagccccugaaccugaaccccgccaagagacccagaagacaggacugggacggcgagcuguacgagaacggcagcuucuacuucgccaagagacaccugaucgagaugggcuaccugcagggcggcaagauggccuacuacgagaugagagccgagcacagcguggacaucgacguggacaucgacuggcccaucgccgagcagagagugcugagauacggcuacuucggcaaggagaagcugaaggagaucaagcugcuggugugcaacaucgacggcugccugaccaacggccacaucuacgugagcggcgaccagaaggagaucaucagcuacgacgugaaggacgccaucggcaucagccugcugaagaagagcggcaucgaggugagacugaucagcgagagagccugcagcaagcagacccugagcagccugaagcuggacugcaagauggaggugagcgugagcgacaagcuggccgugguggacgaguggagaaaggagaugggccugugcuggaaggagguggccuaccugggcaacgaggugagcgacgaggagugccugaagagagugggccugagcggcgcccccgccgacgccugcagcaccgcccagaaggccgugggcuacaucugcaagugcaacggcggcagaggcgccaucagagaguucgccgagcacaucugccugcugauggagaaggugaacaacagcugccagaaguaa

SEQ ID NO: 15373 - RNA, 321 nt, Artificial Sequence
  CMC1__Homo_sapiens__NP_872329
auggcccuggaccccgccgaccagcaccugagacacguggagaaggacgugcugauccccaagaucaugagagagaaggccaaggagagaugcagcgagcaggugcaggacuucaccaagugcugcaagaacagcggcgugcugaugguggugaagugcagaaaggagaacagcgcccugaaggagugccugaccgccuacuacaacgaccccgccuucuacgaggagugcaagauggaguaccugaaggagagagaggaguucagaaagaccggcauccccaccaagaagagacugcagaagcugcccaccagcauguaa

SEQ ID NO: 15374 - RNA, 240 nt, Artificial Sequence
  CMC2__Homo_sapiens__NP_064573
augcaccccgaccugagcccccaccugcacaccgaggagugcaacgugcugaucaaccugcugaaggagugccacaagaaccacaacauccugaaguucuucggcuacugcaacgacguggacagagagcugagaaagugccugaagaacgaguacguggagaacagaaccaagagcagagagcacggcaucgccaugagaaagaagcuguucaacccccccgaggagagcgagaaguaa

SEQ ID NO: 15375 - RNA, 207 nt, Artificial Sequence
  CMC4__Homo_sapiens__NP_001018024
augccccagaaggaccccugccagaagcaggccugcgagauccagaagugccugcaggccaacagcuacauggagagcaagugccaggccgugauccaggagcugagaaagugcugcgcccaguaccccaagggcagaagcguggugugcagcggcuucgagaaggaggaggaggagaaccugaccagaaagagcgccagcaaguaa

SEQ ID NO: 15376 - RNA, 2040 nt, Artificial Sequence
  CMIP__Homo_sapiens__NP_085132
augggccaggccgccgagcccaccggcuacauggagaacagcgugagcuacagcgccaucgaggacgugcagcugcugagcugggagaacgcccccaaguacugccugcagcugaccauccccggcggcaccgugcugcugcaggccgccaacagcuaccugagagaccagugguuccacagccugcaguggaagaagaagaucuacaaguacaagaaggugcugagcaaccccagcagaugggagguggugcugaaggagaucagaacccugguggacauggcccugaccagcccccugcaggacgacagcaucaaccaggccccccuggagaucgugagcaagcugcugagcgagaacaccaaccugaccacccaggagcacgagaacaucaucguggccaucgccccccugcuggagaacaaccaccccccccccgaccugugcgaguucuucugcaagcacugcagagagagacccagaagcaugguggugaucgagguguucacccccguggugcagagaauccugaagcacaacauggacuucggcaagugccccagacugagacuguucacccaggaguacauccuggcccugaacgagcugaacgccggcauggagguggugaagaaguucauccagagcaugcacggccccaccggccacugcccccaccccagagugcugcccaaccugguggccgugugccuggccgccaucuacagcugcuacgaggaguucaucaacagcagagacaacagccccagccugaaggagaucagaaacggcugccagcagcccugcgacagaaagcccacccugccccugagacugcugcaccccagccccgaccuggugagccaggaggccacccugagcgaggccagacugaagagcguggugguggccagcagcgagauccacguggagguggagagaaccagcaccgccaagcccgcccugaccgccagcgccggcaacgacagcgagcccaaccugaucgacugccugauggugagccccgccugcagcaccaugagcaucgagcugggcccccaggccgacagaacccugggcugcuacguggagauccugaagcugcugagcgacuacgacgacuggagacccagccuggccagccugcugcagcccauccccuuccccaaggaggcccuggcccacgagaaguucaccaaggagcugaaguacgugauccagagauucgccgaggaccccagacaggaggugcacagcugccugcugagcgugagagccggcaaggacggcugguuccagcuguacagccccggcggcguggccugcgacgacgacggcgagcuguucgccagcauggugcacauccugaugggcagcugcuacaagaccaagaaguuccugcugagccuggccgagaacaagcugggccccugcaugcugcuggcccugagaggcaaccagaccaugguggagauccugugccugaugcuggaguacaacaucaucgacaacaacgacacccagcugcagaucaucagcacccuggagagcaccgacgugggcaagagaauguacgagcagcugugcgacagacagagagagcugaaggagcugcagagaaagggcggccccaccagacugacccugcccagcaagagcaccgacgccgaccuggccagacugcugagcagcggcagcuucggcaaccuggagaaccugagccuggccuucaccaacgugaccagcgccugcgccgagcaccugaucaagcugcccagccugaagcagcugaaccuguggagcacccaguucggcgacgccggccugagacugcugagcgagcaccugaccaugcugcaggugcugaaccugugcgagacccccgugaccgacgccggccugcuggcccugagcagcaugaagagccugugcagccugaacaugaacagcaccaagcugagcgccgacaccuacgaggaccugaaggccaagcugcccaaccugaaggagguggacgugagauacaccgaggccugguaa

SEQ ID NO: 15377 - RNA, 1122 nt, Artificial Sequence
  CMKLR1__Homo_sapiens__NP_001135815
augagaauggaggacgaggacuacaacaccagcaucagcuacggcgacgaguaccccgacuaccuggacagcaucguggugcuggaggaccugagcccccuggaggccagagugaccagaaucuuccugguggugguguacagcaucgugugcuuccugggcauccugggcaacggccuggugaucaucaucgccaccuucaagaugaagaagaccgugaacauggugugguuccugaaccuggccguggccgacuuccuguucaacguguuccugcccauccacaucaccuacgccgccauggacuaccacuggguguucggcaccgccaugugcaagaucagcaacuuccugcugauccacaacauguucaccagcguguuccugcugaccaucaucagcagcgacagaugcaucagcgugcugcugcccguguggagccagaaccacagaagcgugagacuggccuacauggccugcauggugaucugggugcuggccuucuuccugagcagccccagccugguguucagagacaccgccaaccugcacggcaagaucagcugcuucaacaacuucagccugagcacccccggcagcagcagcuggcccacccacagccagauggaccccgugggcuacagcagacacaugguggugaccgugaccagauuccugugcggcuuccuggugcccgugcugaucaucaccgccugcuaccugaccaucgugugcaagcugcagagaaacagacuggccaagaccaagaagcccuucaagaucaucgugaccaucaucaucaccuucuuccugugcuggugccccuaccacacccugaaccugcuggagcugcaccacaccgccaugcccggcagcguguucagccugggccugccccuggccaccgcccuggccaucgccaacagcugcaugaaccccauccuguacguguucaugggccaggacuucaagaaguucaagguggcccuguucagcagacuggugaacgcccugagcgaggacaccggccacagcagcuaccccagccacagaagcuucaccaagaugagcagcaugaacgagagaaccagcaugaacgagagagagaccggcaugcuguaa

SEQ ID NO: 15378 - RNA, 1230 nt, Artificial Sequence
  CMPK2__Homo_sapiens__NP_001243406
auggccuucgccagaagacugcugagaggcccccugagcggcccccugcugggcagaagaggcgugugcgccggcgccauggccccccccagaagauucgugcuggagcugcccgacugcacccuggcccacuucgcccugggcgccgacgcccccggcgacgccgacgcccccgaccccagacuggccgcccugcugggcccccccgagagaagcuacagccugugcgugcccgugacccccgacgccggcugcggcgccagagugagagccgccagacugcaccagagacugcugcaccagcugagaagaggccccuuccagagaugccagcugcugagacugcugugcuacugccccggcggccaggccggcggcgcccagcagggcuuccugcugagagacccccuggacgaccccgacaccagacaggcccugcuggagcugcugggcgccugccaggaggcccccagaccccaccugggcgaguucgaggccgaccccagaggccagcuguggcagagacugugggaggugcaggacggcagaagacugcaggugggcugcgcccagguggugcccgugcccgagcccccccugcaccccguggugcccgaccugcccagcagcgugguguuccccgacagagaggccgccagagccgugcuggaggagugcaccagcuucauccccgaggccagagccgugcuggaccugguggaccagugccccaagcagauccagaagggcaaguuccaggugguggccaucgagggccuggacgccaccggcaagaccaccgugacccagagcguggccgacagccugaaggccgugcugcugaagagcccccccagcugcaucggccaguggagaaagaucuucgacgacgagcccaccaucaucagaagagccuucuacagccugggcaacuacaucguggccagcgagaucgccaaggagagcgccaagagccccgugaucguggacagauacuggcacagcaccgccaccuacgccaucgccaccgaggugagcggcggccugcagcaccugccccccgcccaccaccccguguaccaguggcccgaggaccugcugaagcccgaccugauccugcugcugaccgugagccccgaggagagacugcagagacugcagggcagaggcauggagaagaccagagaggaggccgagcuggaggccaacagcguguucagacagaaguaa

SEQ ID NO: 15379 - RNA, 786 nt, Artificial Sequence
  CMSS1__Homo_sapiens__NP_001161396
augcacggcgaggccagcgacggcgagggcgagggcgacaccgaggugaugcagcaggagaccgugcccgugcccgugcccagcgagaagaccaagcagcccaaggagugcuuccugauccagcccaaggagagaaaggagaacaccaccaagaccagaaagagaagaaagaagaagaucaccgacgugcuggccaagagcgagcccaagcccggccugcccgaggaccugcagaagcugaugaaggacuacuacagcagcagaagacuggugaucgagcuggaggagcugaaccugcccgacagcugcuuccugaaggccaacgaccugacccacagccugagcagcuaccugaaggagaucugccccaagugggugaagcugagaaagaaccacagcgagaagaagagcgugcugaugcugaucaucugcagcagcgccgugagagcccuggagcugaucagaagcaugaccgccuucagaggcgacggcaaggugaucaagcuguucgccaagcacaucaaggugcaggcccaggugaagcugcuggagaagagaguggugcaccugggcgugggcacccccggcagaaucaaggagcuggugaagcagggcggccugaaccugagcccccugaaguuccugguguucgacuggaacuggagagaccagaagcugagaagaaugauggacauccccgagaucagaaaggagguguucgagcugcuggagaugggcgugcugagccugugcaagagcgagagccugaagcugggccuguucuaa

SEQ ID NO: 15380 - RNA, 549 nt, Artificial Sequence
  CMTM3__Homo_sapiens__NP_853531
auguggccccccgaccccgaccccgaccccgaccccgagcccgccggcggcagcagacccggccccgccgugcccggccugagagcccugcugcccgccagagccuuccugugcagccugaagggcagacugcugcuggccgagagcggccugagcuucaucaccuucaucugcuacguggccagcagcgccagcgccuuccugaccgccccccugcuggaguuccugcuggcccuguacuuccuguucgccgacgccaugcagcugaacgacaaguggcagggccugugcuggcccaugauggacuuccugagaugcgugaccgccgcccugaucuacuucgccaucagcaucaccgccaucgccaaguacagcgacggcgccagcaaggccgccggcguguucggcuucuucgccaccaucguguucgccaccgacuucuaccugaucuucaacgacguggccaaguuccugaagcagggcgacagcgccgacgagaccaccgcccacaagaccgaggaggagaacagcgacagcgacagcgacuaa

SEQ ID NO: 15381 - RNA, 378 nt, Artificial Sequence
  CMTM5__Homo_sapiens__NP_001032365
augcugagcgccagagacagaagagacagacaccccgaggagggcgugguggccgagcugcagggcuucgccguggacaaggccuuccugaccagccacaagggcauccugcuggagaccgagcuggcccugacccugaucaucuucaucugcuucaccgccagcaucagcgccuacauggccgccgcccugcuggaguucuucaucacccuggccuuccuguuccuguacgccacccaguacuaccagagauucgacagaaucaacuggcccugccugguguucggcaucauccuggugagcaucuucgccuacgacgccuucaagaucuacagaaccgagauggcccccggcgccagccagggcgaccagcaguaa

SEQ ID NO: 15382 - RNA, 528 nt, Artificial Sequence
  CMTM7__Homo_sapiens__NP_612419
augagccacggcgccggccuggugagaaccaccugcagcagcggcagcgcccugggccccggcgccggcgccgcccagcccagcgccagcccccuggagggccugcuggaccugagcuaccccagaacccacgccgcccugcugaagguggcccagauggugacccugcugaucgccuucaucugcgugagaagcagccuguggaccaacuacagcgccuacagcuacuucgagguggugaccaucugcgaccugaucaugauccuggccuucuaccuggugcaccuguucagauucuacagagugcugaccugcaucagcuggccccugagcgagcugcugcacuaccugaucggcacccugcugcugcugaucgccagcaucguggccgccagcaagagcuacaaccagagcggccugguggccggcgccaucuucggcuucauggccaccuuccugugcauggccagcaucuggcugagcuacaagaucagcugcgugacccagagcaccgacgccgccguguaa

SEQ ID NO: 15383 - RNA, 522 nt, Artificial Sequence
  CMTM8__Homo_sapiens__NP_849199
auggaggagccccagagagccagaagccacaccgugaccaccaccgccagcagcuucgccgagaacuucagcaccagcagcagcagcuucgccuacgacagagaguuccugagaacccugcccggcuuccugaucguggccgagaucgugcugggccugcugguguggacccugaucgccggcaccgaguacuucagagugcccgccuucggcugggugauguucguggccguguucuacugggugcugaccguguucuuccugaucaucuacaucaccaugaccuacaccagaaucccccaggugcccuggaccaccgugggccugugcuucaacggcagcgccuucgugcuguaccugagcgccgccgugguggacgccagcagcgugagccccgagagagacagccacaacuucaacagcugggccgccagcagcuucuucgccuuccuggugaccaucugcuacgccggcaacaccuacuucagcuucaucgccuggagaagcagaaccauccaguaa

SEQ ID NO: 15384 - RNA, 2508 nt, Artificial Sequence
  CMTR1__Homo_sapiens__NP_055865
augaagagaagaaccgaccccgagugcaccgcccccaucaagaagcagaagaagagaguggccgagcuggcccugagccugagcagcaccagcgacgacgagccccccagcagcgugagccacggcgccaaggccagcaccaccagccugagcggcagcgacagcgagaccgagggcaagcagcacagcagcgacagcuucgacgacgccuucaaggccgacagccugguggagggcaccagcagcagauacagcauguacaacagcgugagccagaagcugauggccaagaugggcuucagagagggcgagggccugggcaaguacagccagggcagaaaggacaucguggaggccagcagccagaagggcagaagaggccugggccugacccugagaggcuucgaccaggagcugaacguggacuggagagacgagcccgagcccagcgccugcgagcaggugagcugguuccccgagugcaccaccgagauccccgacacccaggagaugagcgacuggaugguggugggcaagagaaagaugaucaucgaggacgagaccgaguucugcggcgaggagcugcugcacagcgugcugcagugcaagagcguguucgacgugcuggacggcgaggagaugagaagagccagaaccagagccaaccccuacgagaugaucagaggcguguucuuccugaacagagccgccaugaagauggccaacauggacuucguguucgacagaauguucaccaaccccagagacagcuacggcaagccccuggugaaggacagagaggccgagcugcuguacuucgccgacgugugcgccggccccggcggcuucagcgaguacgugcuguggagaaagaaguggcacgccaagggcuucggcaugacccugaagggccccaacgacuucaagcuggaggacuucuacagcgccagcagcgagcuguucgagcccuacuacggcgagggcggcaucgacggcgacggcgacaucaccagacccgagaacaucagcgccuucagaaacuucgugcuggacaacaccgacagaaagggcgugcacuuccugauggccgacggcggcuucagcguggagggccaggagaaccugcaggagauccugagcaagcagcugcugcugugccaguuccugauggcccugagcaucgugagaaccggcggccacuucaucugcaagaccuucgaccuguucacccccuucagcgugggccugguguaccugcuguacugcugcuucgagagagugugccuguucaagcccaucaccagcagacccgccaacagcgagagauacguggugugcaagggccugaaggugggcaucgacgacgugagagacuaccuguucgccgugaacaucaagcugaaccagcugagaaacaccgacagcgacgugaaccugguggugccccuggaggugaucaagggcgaccacgaguucaccgacuacaugaucagaagcaacgagagccacugcagccugcagaucaaggcccuggccaagauccacgccuucgugcaggacaccacccugagcgagcccagacaggccgagaucagaaaggagugccugagacuguggggcauccccgaccaggccagaguggcccccagcagcagcgaccccaagagcaaguucuucgagcugauccagggcaccgagaucgacaucuucagcuacaagcccacccugcugaccagcaagacccuggagaagaucagacccguguucgacuacagaugcauggugagcggcagcgagcagaaguuccugaucggccugggcaagagccagaucuacaccugggacggcagacagagcgacagauggaucaagcuggaccugaagaccgagcugcccagagacacccugcugagcguggagaucgugcacgagcugaagggcgagggcaaggcccagagaaagaucagcgccauccacauccuggacgugcuggugcugaacggcaccgacgugagagagcagcacuucaaccagagaauccagcuggccgagaaguucgugaaggccgugagcaagcccagcagacccgacaugaaccccaucagagugaaggagguguacagacuggaggagauggagaagaucuucgugagacuggagaugaagaucaucaagggcagcagcggcacccccaagcugagcuacaccggcagagacgacagacacuucgugcccaugggccuguacaucgugagaaccgugaacgagcccuggaccaugggcuucagcaagagcuucaagaagaaguucuucuacaacaagaagaccaaggacagcaccuucgaccugcccgccgacagcaucgcccccuuccacaucugcuacuacggcagacuguucugggaguggggcgacggcaucagagugcacgacagccagaagccccaggaccaggacaagcugagcaaggaggacgugcugagcuucauccagaugcacagagccuaa

SEQ ID NO: 15385 - RNA, 2313 nt, Artificial Sequence
  CMTR2__Homo_sapiens__NP_060818
augagcaagugcagaaagacccccgugcagcagcuggccagccccgccagcuucagccccgacauccuggccgacaucuucgagcuguucgccaagaacuucagcuacggcaagccccugaacaacgaguggcagcugcccgaccccagcgagaucuucaccugcgaccacaccgagcugaacgccuuccuggaccugaagaacagccugaacgaggugaagaaccugcugagcgacaagaagcuggacgaguggcacgagcacaccgccuucaccaacaaggccggcaagaucaucagccacgugagaaagagcgugaacgccgagcugugcacccaggccuggugcaaguuccacgagauccugugcagcuucccccugaucccccaggaggccuuccagaacggcaagcugaacagccugcaccugugcgaggcccccggcgccuucaucgccagccugaaccacuaccugaagagccacagauuccccugccacuggagcuggguggccaacacccugaaccccuaccacgaggccaacgacgaccugaugaugaucauggacgacagacugaucgccaacacccugcacuggugguacuucggccccgacaacaccggcgacaucaugacccugaaguuccugaccggccugcagaacuucaucagcagcauggccaccgugcaccuggugaccgccgacggcagcuucgacugccagggcaaccccggcgagcaggaggcccuggugagcagccugcacuacugcgagguggugaccgcccugaccacccugggcaacggcggcagcuucgugcugaagauguucaccauguucgagcacugcagcaucaaccugauguaccugcugaacugcugcuucgaccaggugcacguguucaagcccgccaccagcaaggccggcaacagcgagguguacguggugugccugcacuacaagggcagagaggccauccacccccugcugagcaagaugacccugaacuucggcaccgagaugaagagaaaggcccuguucccccaccacgugauccccgacagcuuccugaagagacacgaggagugcugcguguucuuccacaaguaccagcuggagaccaucagcgagaacaucagacuguucgagugcaugggcaaggccgagcaggagaagcugaacaaccugagagacugcgccauccaguacuucaugcagaaguuccagcugaagcaccugagcagaaacaacuggcuggugaagaagagcagcaucggcugcagcaccaacaccaagugguucggccagagaaacaaguacuucaagaccuacaacgagagaaagaugcuggaggcccugagcuggaaggacaagguggccaagggcuacuucaacagcugggccgaggagcacggcguguaccaccccggccagagcagcauccuggagggcaccgccagcaaccuggagugccaccuguggcacauccuggagggcaagaagcugcccaaggugaagugcagccccuucugcaacggcgagauccugaagacccugaacgaggccaucgagaagagccugggcggcgccuucaaccuggacagcaaguucagacccaagcagcaguacagcugcagcugccacguguucagcgaggagcugaucuucagcgagcugugcagccugaccgagugccugcaggacgagcaggugguggugcccagcaaccagaucaagugccugcuggugggcuucagcacccugagaaacaucaagaugcacaucccccuggaggugagacugcuggagagcgccgagcugaccaccuucagcugcagccugcugcacgacggcgaccccaccuaccagagacuguuccuggacugccugcugcacagccugagagagcugcacaccggcgacgugaugauccugcccgugcugagcugcuucaccagauucauggccggccugaucuucgugcugcacagcugcuucagauucaucaccuucgugugccccaccagcagcgacccccugagaaccugcgccgugcugcugugcgugggcuaccaggaccugcccaaccccguguucagauaccugcagagcgugaacgagcugcugagcacccugcugaacagcgacagcccccagcaggugcugcaguucgugcccauggaggugcugcugaagggcgcccugcuggacuuccugugggaccugaacgccgccaucgccaagagacaccugcacuucaucauccagagagagagagaggagaucaucaacagccugcagcugcagaacuaa

SEQ ID NO: 15386 - RNA, 12210 nt, Artificial Sequence
  CMYA5__Homo_sapiens__NP_705838
auggccagcagagacagcaaccacgccggcgagagcuuccugggcagcgacggcgacgaggaggccaccagagagcuggagaccgaggaggagagcgagggcgaggaggacgagaccgccgccgagagcgaggaggagcccgacagcagacugagcgaccaggacgaggagggcaagaucaagcaggaguacaucaucagcgaccccagcuucagcauggugaccgugcagagagaggacagcggcaucaccugggagaccaacagcagcagaagcagcacccccugggccagcgaggagagccagaccagcggcgugugcagcagagagggcagcaccgugaacagcccccccggcaacgugagcuucaucguggacgaggugaagaaggugagaaagagaacccacaagagcaagcacggcagccccagccugagaagaaagggcaacagaaagagaaacagcuucgagagccaggacgugcccaccaacaagaagggcagcccccugaccagcgccagccaggugcugaccaccgagaaggagaagagcuacaccggcaucuacgacaaggccagaaagaagaagaccaccagcaacaccccccccaucaccggcgccaucuacaaggagcacaagccccuggugcugagacccguguacaucggcaccgugcaguacaagaucaagauguucaacagcgugaaggaggagcugaucccccugcaguucuacggcacccugcccaagggcuacgugaucaaggagauccacuacagaaagggcaaggacgccagcaucagccuggagcccgaccuggacaacagcggcagcaacaccgugagcaagaccagaaagcugguggcccagagcaucgaggacaaggugaaggagguguucccccccuggagaggcgcccugagcaagggcagcgagagccugacccugauguucagccacgaggaccagaagaagaucuacgccgacagcccccugaacgccaccagcgcccuggagcacaccgugcccagcuacagcagcagcggcagagccgagcagggcauccagcugagacacagccagagcgugccccagcagcccgaggacgaggccaagccccacgagguggagccccccagcgugacccccgacacccccgccaccauguuccugagaaccaccaaggaggagugcgagcuggccagccccggcaccgccgccagcgagaacgacagcagcgugagccccagcuucgccaacgaggugaagaaggaggacguguacagcgcccaccacagcaucagccuggaggccgccagccccggccuggccgccagcacccaggacggccuggaccccgaccaggagcagcccgaccugaccagcaucgagagagccgagcccgugagcgccaagcugacccccacccaccccagcgugaagggcgagaaggaggagaacaugcuggagcccagcaucagccugagcgagccccugaugcuggaggagcccgagaaggaggagaucgagaccagccugcccaucgccaucacccccgagcccgaggacagcaaccugguggaggaggagaucguggagcuggacuaccccgagagcccccuggugagcgagaagcccuuccccccccacaugagccccgagguggagcacaaggaggaggagcugauccugccccugcuggccgccagcagccccgagcacguggcccugagcgaggaggagagagaggagaucgccagcgugagcaccggcagcgccuucgugagcgaguacagcgugccccaggaccugaaccacgagcugcaggagcaggagggcgagcccgugccccccagcaacguggaggccaucgccgagcacgccgugcugagcgaggaggagaacgaggaguucgaggccuacagccccgccgccgcccccaccagcgagagcagccugagccccagcaccaccgagaagaccagcgagaaccagagcccccuguucagcaccgugacccccgaguacauggugcugagcggcgacgaggccagcgagagcggcugcuacacccccgacagcaccagcgccagcgaguacagcgugcccagccuggccaccaaggagagccugaagaagaccaucgacagaaagagcccccugauccugaagggcgugagcgaguacaugauccccagcgaggagaaggaggacaccggcagcuucacccccgccguggcccccgccagcgagcccagccugagccccagcaccaccgagaagaccagcgagugccagagcccccugcccagcaccgccaccagcgagcacguggugcccagcgagggcgaggaccugggcagcgagagauucacccccgacagcaagcugaucagcaaguacgccgccccccugaacgccacccaggagagccagaagaagaucaucaacgaggccagccaguucaagcccaagggcaucagcgagcacaccgugcugagcguggacggcaaggaggugaucggccccagcagccccgaccuggugguggccagcgagcacagcuuccccccccacaccaccgagaugaccagcgagugccaggcccccccccugagcgccacccccagcgaguacguggugcugagcgacgaggaggccguggagcuggagagauacacccccagcagcaccagcgccagcgaguucagcgugccccccuacgccacccccgaggcccaggaggaggagaucgugcacagaagccugaaccugaagggcgccagcagccccaugaaccugagcgaggaggaccaggaggacaucggccccuucagccccgacagcgccuucgugagcgaguucagcuucccccccuacgccacccaggaggccgagaagagagaguucgagugcgacagccccaucugccugaccagccccagcgagcacaccauccugagcgacgaggacaccgaggaggccgagcuguucagccccgacagcgccagccaggugagcaucccccccuucagaaucagcgagaccgagaagaacgagcuggagcccgacagccugcugaccgccgugagcgccagcggcuacagcugcuucagcgaggccgacgaggaggacaucggcagcaccgccgccacccccgugagcgagcaguucagcagcagccagaagcagaaggccgagaccuucccccugaugagcccccuggaggaccugagccugccccccagcaccgacaagagcgagaaggccgagaucaagcccgagauccccaccaccagcaccagcgugagcgaguaccugauccuggcccagaagcagaagacccaggccuaccuggagcccgagagcgaggaccugauccccagccaccugaccagcgagguggagaagggcgagagagaggccagcagcagcguggccgccauccccgccgcccugcccgcccagagcagcaucgugaaggaggagaccaagcccgccagcccccacagcgugcugcccgacagcgugcccgccaucaagaaggagcaggagcccaccgccgcccugacccugaaggccgccgacgagcagauggcccugagcaaggugagaaaggaggagaucgugcccgacagccaggaggccaccgcccacgugagccaggaccagaagauggagccccagccccccaacgugcccgagagcgagaugaaguacagcgugcugcccgacaugguggacgagcccaagaagggcgugaagcccaagcuggugcugaacgugaccagcgagcuggagcagagaaagcugagcaagaacgagcccgaggugaucaagcccuacagcccccugaaggagaccagccugagcggccccgaggcccugagcgccgugaagauggagaugaagcacgacagcaagaucaccaccacccccaucgugcugcacagcgccagcagcggcguggagaagcagguggagcacggcccccccgcccuggccuucagcgcccugagcgaggagaucaagaaggagaucgagcccagcagcagcaccaccaccgccagcgugaccaagcuggacagcaaccugaccagagccgugaaggaggagauccccaccgacagcagccugaucacccccguggacagacccgugcugaccaaggugggcaagggcgagcugggcagcggccugcccccccuggugaccagcgccgacgagcacagcgugcuggccgaggaggacaagguggccaucaagggcgccagccccaucgagaccagcagcaagcaccuggccuggagcgaggccgagaaggagaucaaguucgacagccugcccagcgugagcagcaucgccgagcacagcgugcugagcgagguggaggccaaggaggugaaggccggccugcccgugaucaagaccagcagcagccagcacagcgacaagagcgaggaggccagaguggaggacaagcaggaccugcuguucagcaccgugugcgacagcgagagacuggugagcagccagaagaagagccugaugagcaccagcgaggugcuggagcccgagcacgagcugccccugagccuguggggcgagaucaagaagaaggagaccgagcugcccagcagccagaacgugagccccgccagcaagcacaucauccccaagggcaaggacgaggagaccgccagcagcagccccgagcuggagaaccuggccagcggccuggcccccacccugcugcugcugagcgacgacaagaacaagcccgccguggaggugagcagcaccgcccagggcgacuuccccagcgagaagcaggacguggcccuggccgagcugagccuggagcccgagaagaaggacaagccccaccagccccuggagcugcccaacgccggcagcgaguucagcagcgaccugggcagacagagcggcagcaucggcaccaagcaggccaagagccccaucaccgagaccgaggacagcgugcuggagaagggccccgccgagcugagaagcagagagggcaaggaggagaacagagagcugugcgccagcagcaccaugcccgccaucagcgagcugagcagccugcugagagaggagagccagaacgaggagaucaagcccuucagccccaagaucaucagccuggagagcaaggagccccccgccagcguggccgagggcggcaaccccgaggaguuccagcccuucaccuucagccugaagggccugagcgaggaggugagccaccccgccgacuucaagaagggcggcaaccaggagaucggcccccugccccccaccggcaaccugaaggcccaggugaugggcgacauccuggacaagcugagcgaggagaccggccaccccaacagcagccaggugcugcagagcaucaccgagcccagcaagaucgcccccagcgaccugcugguggagcagaagaagaccgagaaggcccugcacagcgaccagaccgugaagcugcccgacgugagcaccagcagcgaggacaagcaggaccugggcaucaagcaguucagccugaugagagagaaccugccccuggagcagagcaagagcuucaugaccaccaagcccgccgacgugaaggagaccaagauggaggaguucuucaucagccccaaggacgagaacuggaugcugggcaagcccgagaacguggccagccagcacgagcagagaaucgccggcagcgugcagcuggacagcagcagcagcaacgagcugagacccggccagcugaaggccgccgugagcagcaaggaccacaccugcgaggugagaaagcaggugcugccccacagcgccgaggagagccaccugagcagccaggaggccgugagcgcccuggacaccagcagcggcaacaccgagacccugagcagcaagagcuacagcagcgaggaggugaagcuggccgaggagcccaagagccuggugcuggccggcaacguggagagaaacaucgccgagggcaaggagauccacagccugauggagagcgagagccugcugcuggagaaggccaacaccgagcugagcuggcccagcaaggaggacagccaggagaagaucaagcugccccccgagagauucuuccagaagcccgugagcggccugagcguggagcaggugaagagcgagaccaucagcagcagcgugaagaccgcccacuuccccgccgagggcguggagcccgcccugggcaacgagaaggaggcccacagaagcaccccccccuuccccgaggagaagccccuggaggagagcaagauggugcagagcaaggugaucgacgacgccgacgagggcaagaagcccagccccgaggugaagauccccacccagagaaagcccaucagcagcauccacgccagagagccccagagccccgagagccccgaggugacccagaacccccccacccagcccaagguggccaagcccgaccugcccgaggagaagggcaagaagggcaucagcagcuucaagagcuggaugagcagccuguucuucggcagcagcacccccgacaacaagguggccgagcaggaggaccuggagacccagcccagccccagcguggagaaggccgugaccgugaucgaccccgagggcaccauccccaccaacuucaacguggccgagaagcccgccgaccacagccugagcgaggugaagcugaagaccgccgacgagcccagaggcacccuggugaagagcggcgacggccagaacgugaaggagaagagcaugauccugagcaacguggaggaccugcagcagcccaaguucaucagcgaggugagcagagaggacuacggcaagaaggagaucagcggcgacagcgaggagaugaacaucaacagcguggugaccagcgccgacggcgagaaccuggagauccagagcuacagccugaucggcgagaagcuggugauggaggaggccaagaccaucgugcccccccacgugaccgacagcaagagagugcagaagcccgccaucgccccccccagcaaguggaacaucagcaucuucaaggaggagcccagaagcgaccagaagcagaagagccugcugagcuucgacgugguggacaaggugccccagcagcccaagagcgccagcagcaacuucgccagcaagaacaucaccaaggagagcgagaagcccgagagcaucauccugcccguggaggagagcaagggcagccugaucgacuucagcgaggacagacugaagaaggagaugcagaaccccaccagccugaagaucagcgaggaggagaccaagcugagaagcgugagccccaccgagaagaaggacaaccuggagaacagaagcuacacccuggccgagaagaaggugcuggccgagaagcagaacagcguggccccccuggagcugagagacagcaacgagaucggcaagacccagaucacccugggcagcagaagcaccgagcugaaggagagcaaggccgacgccaugccccagcacuucuaccagaacgaggacuacaacgagagacccaagaucaucgugggcagcgagaaggagaagggcgaggagaaggagaaccagguguacgugcugagcgagggcaagaagcagcaggagcaccagcccuacagcgugaacguggccgagagcaugagcagagagagcgacaucagccugggccacagccugggcgagacccagagcuucagccuggugaaggccaccagcgugaccgagaagagcgaggccaugcuggccgaggcccaccccgagaucagagaggccaaggccgugggcacccagccccacccccuggaggagagcaaggugcugguggagaagaccaagaccuuccugcccguggcccugagcugcagagacgagaucgagaaccacagccugagccaggagggcaaccuggugcuggagaagagcagcagagacaugcccgaccacagcgaggagaaggagcaguucagagagagcgagcugagcaagggcggcagcguggacaucaccaaggagaccgugaagcagggcuuccaggagaaggccgugggcacccagcccagaccccuggaggagagcaaggugcugguggagaagaccaagaccuuccugcccguggugcugagcugccacgacgagaucgagaaccacagccugagccaggagggcaaccuggugcuggagaagagcagcagagacaugcccgaccacagcgaggagaaggagcaguucaaggagagcgagcuguggaagggcggcagcguggacaucaccaaggagagcaugaaggagggcuuccccagcaaggagagcgagagaacccuggccagacccuucgacgagaccaagagcagcgagaccccccccuaccugcugagccccgugaagccccagacccuggccagcggcgccagccccgagaucaacgccgugaagaagaaggagaugcccagaagcgagcugacccccgagagacacaccgugcacaccauccagaccagcaaggacgacaccagcgacgugcccaagcagagcgugcuggugagcaagcaccaccuggaggccgccgaggacaccagagugaaggagccccugagcagcgccaagagcaacuacgcccaguucaucagcaacaccagcgccagcaacgccgacaagauggugagcaacaaggagaugcccaaggagcccgaggacaccuacgccaagggcgaggacuucaccgugaccagcaagcccgccggccugagcgaggaccagaagaccgccuucagcaucaucagcgagggcugcgagauccugaacauccacgcccccgccuucaucagcagcaucgaccaggaggagagcgagcagaugcaggacaagcuggaguaccuggaggagaaggccagcuucaagaccaucccccugcccgacgacagcgagaccguggccugccacaagacccugaagagcagacuggaggacgagaaggugaccccccugaaggagaacaagcagaaggagacccacaagaccaaggaggagaucagcaccgacagcgagaccgaccugagcuucauccagcccaccauccccagcgaggaggacuacuucgagaaguacacccugaucgacuacaacaucagccccgaccccgagaagcagaaggccccccagaagcugaacguggaggagaagcugagcaaggaggugaccgaggagaccaucagcuuccccgugagcagcguggagagcgcccuggagcacgaguacgaccuggugaagcuggacgagagcuucuacggccccgagaagggccacaacauccugagccaccccgagacccagagccagaacagcgccgacagaaacgugagcaaggacaccaagagagacguggacagcaagagccccggcaugccccuguucgaggccgaggagggcgugcugagcagaacccagaucuuccccaccaccaucaaggugaucgaccccgaguuccuggaggagccccccgcccuggccuuccuguacaaggaccuguacgaggaggccgugggcgagaagaagaaggaggaggagaccgccagcgagggcgacagcgugaacagcgaggccagcuuccccagcagaaacagcgacaccgacgacggcaccggcaucuacuucgagaaguacauccugaaggacgacauccugcacgacaccagccugacccagaaggaccagggccagggccuggaggagaagagagugggcaaggacgacagcuaccagcccaucgccgccgagggcgagaucuggggcaaguucggcaccaucugcagagagaagagccuggaggagcagaagggcguguacggcgagggcgagagcguggaccacguggagaccgugggcaacguggccaugcagaagaaggcccccaucaccgaggacgugagaguggccacccagaagaucagcuacgccgugcccuucgaggacacccaccacgugcuggagagagccgacgaggccggcagccacggcaacgaggugggcaacgccagccccgaggugaaccugaacgugcccgugcaggugagcuuccccgaggaggaguucgccagcggcgccacccacgugcaggagaccagccuggaggagcccaagauccuggugccccccgagcccagcgaggagagacugagaaacagccccgugcaggacgaguacgaguucaccgagagccugcacaacgagguggugccccaggacauccugagcgaggagcugagcagcgagagcacccccgaggacgugcugagccagggcaaggagagcuucgagcacaucagcgagaacgaguucgccagcgaggccgagcagagcacccccgccgagcagaaggagcugggcagcgagagaaaggaggaggaccagcugagcagcgagguggugaccgagaaggcccagaaggagcugaagaagagccagaucgacaccuacugcuacaccugcaagugccccaucagcgccaccgacaagguguucggcacccacaaggaccacgaggugagcacccuggacaccgccaucagcgccgugaaggugcagcuggccgaguuccuggagaaccugcaggagaagagccugagaaucgaggccuucgugagcgagaucgagagcuucuucaacaccaucgaggagaacugcagcaagaacgagaagagacuggaggagcagaacgaggagaugaugaagaaggugcuggcccaguacgacgagaaggcccagagcuucgaggaggugaagaagaagaagauggaguuccugcacgagcagauggugcacuuccugcagagcauggacaccgccaaggacacccuggagaccaucgugagagaggccgaggagcuggacgaggccguguuccugaccagcuucgaggagaucaacgagagacugcugagcgccauggagagcaccgccagccuggagaagaugcccgccgccuucagccuguucgagcacuacgacgacagcagcgccagaagcgaccagaugcugaagcagguggccgugccccagccccccagacuggagccccaggagcccaacagcgccaccagcaccaccaucgccguguacuggagcaugaacaaggaggacgugaucgacagcuuccagguguacugcauggaggagccccaggacgaccaggaggugaacgagcugguggaggaguacagacugaccgugaaggagagcuacugcaucuucgaggaccuggagcccgacagaugcuaccaggugugggugauggccgugaacuucaccggcugcagccugcccagcgagagagccaucuucagaaccgcccccagcacccccgugaucagagccgaggacugcaccgugugcuggaacaccgccaccaucagauggagacccaccacccccgaggccaccgagaccuacacccuggaguacugcagacagcacagccccgagggcgagggccugagaagcuucagcggcaucaagggccugcagcugaaggugaaccugcagcccaacgacaacuacuucuucuacgugagagccaucaacgccuucggcaccagcgagcagagcgaggccgcccugaucagcaccagaggcaccagauuccugcugcugagagagaccgcccaccccgcccugcacaucagcagcagcggcaccgugaucagcuucggcgagagaagaagacugaccgagauccccagcgugcugggcgaggagcugcccagcugcggccagcacuacugggagaccaccgugaccgacugccccgccuacagacugggcaucugcagcagcagcgccgugcaggccggcgcccugggccagggcgagaccagcugguacaugcacugcagcgagccccagagauacaccuucuucuacagcggcaucgugagcgacgugcacgugaccgagagacccgccagagugggcauccugcuggacuacaacaaccagagacugaucuucaucaacgccgagagcgagcagcugcuguucaucaucagacacagauucaacgagggcgugcaccccgccuucgcccuggagaagcccggcaagugcacccugcaccugggcaucgagccccccgacagcgugagacacaaguaa

SEQ ID NO: 15387 - RNA, 1311 nt, Artificial Sequence
  CNBD1__Homo_sapiens__NP_775809
augcccaugagcagccugcccgccgccauccugagccacaugaccgccaucaacaacgugcccccccccccccugcacagcauccccaaccugaagaagagcaagcacaucaacuacggccagcugaacgcccugugccacaucagaggccagcacagcagaagcaugagcaacauccugagcgcccacgacaccuucaugaagcaguaccccaagguguuccugcaccagaagcccagacugcccaagcuguucaagcaggaggagcagagagagcugaacgagggcaaggaggagagccagcaccagcagcccgacgacagcaacaacaucgccgugcacgugcagagagcccacggcggccacauccuguacagacccaagagagccaccgagaaguucgaggaguuccuggccauccugaagaagcugcccauccacagaacccccuacgagcacaagaccguguggaaguuccugaagaccauccccgaccugaccuuccagcugaacgacaagcaccugaagacccugagcaagaccguguucagcgagaccuggcugaagggcagcaccgugguggccaacgacggcuucuacgugauccugaagggccuggccagaccccagaccaacguguacaagaaccugaucgagggcagcgacagccccgacagcuucaucagccagagcuuccacagcuucaucuggagcgaggaguucaagaacagcacccuggccgagauguaccugcccagcuacgacagcaugcugagcaaguggagcaccuucggcacccuggaggugaugccccagaacgagagcgagacccagauguucagcguggugaccgaggacgacugcgagauccugaagauccccgccaagggcuacgccaagaucaaggaggagaagaucaagcuggagaacaugcagaagcugaagcugaucagaaugugccccuacuacgaggaguggcccacccugagcaucuacgagcugaucgcccugcugaaguggaagaaguucccccccggccacgugaucguggagagcggcaacaucaucagcuucgugggcuacaucaacagcggcugcugcaacaucuacagaagcaucaucggcuucgugaagcugagaagcaacaaggugaagagaagccagaagcugguguacaugggcaagcugaaggagaaggagagcuucggcgagaucagcgugcugcugcaggugcccuucaccugcaccaucaucaccaagaaggagguggagauggccaucaucgaggacaaggaccuguucguggccuaa

SEQ ID NO: 15388 - RNA, 540 nt, Artificial Sequence
  CNBP__Homo_sapiens__NP_001120664
augagcagcaacgagugcuucaagugcggcagaagcggccacugggccagagagugccccaccggcggcggcagaggcagaggcaugagaagcagaggcagaggcggcuucaccagcgacagaggcuuccaguucgugagcagcagccugcccgacaucugcuacagaugcggcgagagcggccaccuggccaaggacugcgaccugcaggaggacguggaggccugcuacaacugcggcagaggcggccacaucgccaaggacugcaaggagcccaagagagagagagagcagugcugcuacaacugcggcaagcccggccaccuggccagagacugcgaccacgccgacgagcagaagugcuacagcugcggcgaguucggccacauccagaaggacugcaccaaggugaagugcuacagaugcggcgagaccggccacguggccaucaacugcagcaagaccagcgaggugaacugcuacagaugcggcgagagcggccaccuggccagagagugcaccaucgaggccaccgccuaa

SEQ ID NO: 15389 - RNA, 1524 nt, Artificial Sequence
  CNDP1__Homo_sapiens__NP_116038
auggaccccaagcugggcagaauggccgccagccugcuggccgugcugcugcugcugcuggagagaggcauguucagcagccccagccccccccccgcccugcuggagaagguguuccaguacaucgaccugcaccaggacgaguucgugcagacccugaaggaguggguggccaucgagagcgacagcgugcagcccgugcccagauucagacaggagcuguucagaaugauggccguggccgccgacacccugcagagacugggcgccagaguggccagcguggacaugggcccccagcagcugcccgacggccagagccugcccaucccccccgugauccuggccgagcugggcagcgaccccaccaagggcaccgugugcuucuacggccaccuggacgugcagcccgccgacagaggcgacggcuggcugaccgaccccuacgugcugaccgagguggacggcaagcuguacggcagaggcgccaccgacaacaagggccccgugcuggccuggaucaacgccgugagcgccuucagagcccuggagcaggaccugcccgugaacaucaaguucaucaucgagggcauggaggaggccggcagcguggcccuggaggagcugguggagaaggagaaggacagauucuucagcggcguggacuacaucgugaucagcgacaaccuguggaucagccagagaaagcccgccaucaccuacggcaccagaggcaacagcuacuucaugguggaggugaagugcagagaccaggacuuccacagcggcaccuucggcggcauccugcacgagcccauggccgaccugguggcccugcugggcagccugguggacagcagcggccacauccuggugcccggcaucuacgacgagguggugccccugaccgaggaggagaucaacaccuacaaggccauccaccuggaccuggaggaguacagaaacagcagcagaguggagaaguuccuguucgacaccaaggaggagauccugaugcaccuguggagauaccccagccugagcauccacggcaucgagggcgccuucgacgagcccggcaccaagaccgugauccccggcagagugaucggcaaguucagcaucagacuggugccccacaugaacgugagcgccguggagaagcaggugaccagacaccuggaggacguguucagcaagagaaacagcagcaacaagaugguggugagcaugacccugggccugcaccccuggaucgccaacaucgacgacacccaguaccuggccgccaagagagccaucagaaccguguucggcaccgagcccgacaugaucagagacggcagcaccauccccaucgccaagauguuccaggagaucgugcacaagagcguggugcugaucccccugggcgccguggacgacggcgagcacagccagaacgagaagaucaacagauggaacuacaucgagggcaccaagcuguucgccgccuucuuccuggagauggcccagcugcacuaa

SEQ ID NO: 15390 - RNA, 1176 nt, Artificial Sequence
  CNDP2__Homo_sapiens__NP_001161971
auggccgcccugaccacccuguucaaguacaucgacgagaaccaggacagauacaucaagaagcuggccaaguggguggccauccagagcgugagcgccuggcccgagaagagaggcgagaucagaagaaugauggagguggccgccgccgacgugaagcagcugggcggcagcguggagcugguggacaucggcaagcagaaggagauccccgugaacgugagauucugccuggagggcauggaggagagcggcagcgagggccuggacgagcugaucuucgccagaaaggacaccuucuucaaggacguggacuacgugugcaucagcgacaacuacuggcugggcaagaagaagcccugcaucaccuacggccugagaggcaucugcuacuucuucaucgagguggagugcagcaacaaggaccugcacagcggcguguacggcggcagcgugcacgaggccaugaccgaccugauccugcugaugggcagccugguggacaagagaggcaacauccugauccccggcaucaacgaggccguggccgccgugaccgaggaggagcacaagcuguacgacgacaucgacuucgacaucgaggaguucgccaaggacgugggcgcccagauccugcugcacagccacaagaaggacauccugaugcacagauggagauaccccagccugagccugcacggcaucgagggcgccuucagcggcagcggcgccaagaccgugauccccagaaagguggugggcaaguucagcaucagacuggugcccaacaugacccccgagguggugggcgagcaggugaccagcuaccugaccaagaaguucgccgagcugagaagccccaacgaguucaagguguacaugggccacggcggcaagcccugggugagcgacuucagccacccccacuaccuggccggcagaagagccaugaagaccguguucggcguggagcccgaccugaccagagagggcggcagcauccccgugacccugaccuuccaggaggccaccggcaagaacgugaugcugcugcccgugggcagcgccgacgacggcgcccacagccagaacgagaagcugaacagauacaacuacaucgagggcaccaagaugcuggccgccuaccuguacgaggugagccagcugaaggacuaa

SEQ ID NO: 15391 - RNA, 2280 nt, Artificial Sequence
  CNGA1__Homo_sapiens__NP_001136036
auggagagcagaagcagccccagacuggagugcagcggcgccaucagcgcccacugcagccugcaccugcccgacagcagcgacuuccagcugaucuucguguuccugguggagaugggcuuccaccacgugggccaggccggccuggagcugcugaucagcagcgaccugcccaccagcgccagccagagcgccggcaucaccgacaugaagcugagcaugaagaacaacaucaucaacacccagcagagcuucgugaccaugcccaacgugaucgugcccgacaucgagaaggagaucagaagaauggagaacggcgccugcagcagcuucagcgaggacgacgacagcgccagcaccagcgaggagagcgagaacgagaacccccacgccagaggcagcuucagcuacaagagccugagaaagggcggccccagccagagagagcaguaccugcccggcgccaucgcccuguucaacgugaacaacagcagcaacaaggaccaggagcccgaggagaagaagaagaagaagaaggagaagaagagcaagagcgacgacaagaacgagaacaagaacgaccccgagaagaagaagaagaagaaggacaaggagaagaagaagaaggaggagaagagcaaggacaagaaggaggaggagaagaaggaggugguggugaucgaccccagcggcaacaccuacuacaacuggcuguucugcaucacccugcccgugauguacaacuggaccauggugaucgccagagccugcuucgacgagcugcagagcgacuaccuggaguacuggcugauccuggacuacgugagcgacaucguguaccugaucgacauguucgugagaaccagaaccggcuaccuggagcagggccugcuggugaaggaggagcugaagcugaucaacaaguacaagagcaaccugcaguucaagcuggacgugcugagccugauccccaccgaccugcuguacuucaagcugggcuggaacuaccccgagaucagacugaacagacugcugagauucagcagaauguucgaguucuuccagagaaccgagaccagaaccaacuaccccaacaucuucagaaucagcaaccuggugauguacaucgugaucaucauccacuggaacgccugcguguucuacagcaucagcaaggccaucggcuucggcaacgacaccuggguguaccccgacaucaacgaccccgaguucggcagacuggccagaaaguacguguacagccuguacuggagcacccugacccugaccaccaucggcgagacccccccccccgugagagacagcgaguacguguucguggugguggacuuccugaucggcgugcugaucuucgccaccaucgugggcaacaucggcagcaugaucagcaacaugaacgccgccagagccgaguuccaggccagaaucgacgccaucaagcaguacaugcacuucagaaacgugagcaaggacauggagaagagagugaucaagugguucgacuaccuguggaccaacaagaagaccguggacgagaaggaggugcugaaguaccugcccgacaagcugagagccgagaucgccaucaacgugcaccuggacacccugaagaaggugagaaucuucgccgacugcgaggccggccugcugguggagcuggugcugaagcugcagccccagguguacagccccggcgacuacaucugcaagaagggcgacaucggcagagagauguacaucaucaaggagggcaagcuggccgugguggccgacgacggcgugacccaguucguggugcugagcgacggcagcuacuucggcgagaucagcauccugaacaucaagggcagcaaggccggcaacagaagaaccgccaacaucaagagcaucggcuacagcgaccuguucugccugagcaaggacgaccugauggaggcccugaccgaguaccccgacgccaagaccaugcuggaggagaagggcaagcagauccugaugaaggacggccugcuggaccugaacaucgccaacgccggcagcgaccccaaggaccuggaggagaaggugaccagaauggagggcagcguggaccugcugcagaccagauucgccagaauccuggccgaguacgagagcaugcagcagaagcugaagcagagacugaccaagguggagaaguuccugaagccccugaucgacaccgaguucagcagcaucgagggccccggcgccgagagcggccccaucgacagcaccuaa

SEQ ID NO: 15392 - RNA, 2031 nt, Artificial Sequence
  CNGA3__Homo_sapiens__NP_001073347
auggccaagaucaacacccaguacagccaccccagcagaacccaccugaaggugaagaccagcgacagagaccugaacagagccgagaacggccugagcagagcccacagcagcagcgaggagaccagcagcgugcugcagcccggcaucgccauggagaccagaggccuggccgacagcggccagggcagcuucaccggccagggcaucgccagacugagcagacugaucuuccugcugagaagaugggccgccagacacgugcaccaccaggaccagggccccgacagcuuccccgacagauucagaggcgccgagcugaaggaggugagcagccaggagagcaacgcccaggccaacgugggcagccaggagcccgccgacagaggcagaagaaagaagaccaagaagaaggacgccaucgugguggaccccagcagcaaccuguacuacagauggcugaccgccaucgcccugcccguguucuacaacugguaccugcugaucugcagagccugcuucgacgagcugcagagcgaguaccugaugcuguggcuggugcuggacuacagcgccgacgugcuguacgugcuggacgugcuggugagagccagaaccggcuuccuggagcagggccugauggugagcgacaccaacagacuguggcagcacuacaagaccaccacccaguucaagcuggacgugcugagccuggugcccaccgaccuggccuaccugaaggugggcaccaacuaccccgaggugagauucaacagacugcugaaguucagcagacuguucgaguucuucgacagaaccgagaccagaaccaacuaccccaacauguucagaaucggcaaccuggugcuguacauccugaucaucauccacuggaacgccugcaucuacuucgccaucagcaaguucaucggcuucggcaccgacagcuggguguaccccaacaucagcauccccgagcacggcagacugagcagaaaguacaucuacagccuguacuggagcacccugacccugaccaccaucggcgagacccccccccccgugaaggacgaggaguaccuguucguggugguggacuuccuggugggcgugcugaucuucgccaccaucgugggcaacgugggcagcaugaucagcaacaugaacgccagcagagccgaguuccaggccaagaucgacagcaucaagcaguacaugcaguucagaaaggugaccaaggaccuggagaccagagugaucagaugguucgacuaccugugggccaacaagaagaccguggacgagaaggaggugcugaagagccugcccgacaagcugaaggccgagaucgccaucaacgugcaccuggacacccugaagaaggugagaaucuuccaggacugcgaggccggccugcugguggagcuggugcugaagcugagacccaccguguucagccccggcgacuacaucugcaagaagggcgacaucggcaaggagauguacaucaucaacgagggcaagcuggccgugguggccgacgacggcgugacccaguucguggugcugagcgacggcagcuacuucggcgagaucagcauccugaacaucaagggcagcaagagcggcaacagaagaaccgccaacaucagaagcaucggcuacagcgaccuguucugccugagcaaggacgaccugauggaggcccugaccgaguaccccgaggccaagaaggcccuggaggagaagggcagacagauccugaugaaggacaaccugaucgacgaggagcuggccagagccggcgccgaccccaaggaccuggaggagaagguggagcagcugggcagcagccuggacacccugcagaccagauucgccagacugcuggccgaguacaacgccacccagaugaagaugaagcagagacugagccagcuggagagccaggugaagggcggcggcgacaagccccuggccgacggcgaggugcccggcgacgccaccaagaccgaggacaagcagcaguaa

SEQ ID NO: 15393 - RNA, 900 nt, Artificial Sequence
  CNGB1__Homo_sapiens__NP_001129111
augcugggcugggugcagagagugcugccccagccccccggcacccccagaaagaccaagaugcaggaggaggaggagguggagcccgagcccgagauggaggccgagguggagcccgagcccaaccccgaggaggccgagaccgagagcgagagcaugccccccgaggagagcuucaaggaggaggagguggccguggccgaccccagcccccaggagaccaaggaggccgcccugaccagcaccaucagccugagagcccagggcgccgagaucagcgagaugaacagccccagcagaagagugcugaccuggcugaugaagggcguggagaaggugaucccccagcccgugcacagcaucaccgaggaccccgcccagauccugggccacggcagcaccggcgacaccggcugcaccgacgagcccaacgaggcccuggaggcccaggacaccagacccggccugagacugcugcuguggcuggagcagaaccuggagagagugcugccccagccccccaagagcagcgagguguggagagacgagcccgccguggccaccggcgccgccagcgaccccgccccccccggcagaccccaggagaugggccccaagcugcaggccagagagacccccagccugcccacccccaucccccugcagcccaaggaggagcccaaggaggcccccgcccccgagccccagcccggcagccaggcccagaccagcagccugccccccaccagagaccccgccagacugguggccugggugcugcacagacuggagauggcccugccccagcccgugcugcacggcaagaucggcgagcaggagcccgacagccccggcaucugcgacgugcagaccagagugaugggcgccggcggccuguaa

SEQ ID NO: 15394 - RNA, 2430 nt, Artificial Sequence
  CNGB3__Homo_sapiens__NP_061971
auguucaagagccugaccaaggugaacaaggugaagcccaucggcgagaacaacgagaacgagcagagcagcagaagaaacgaggagggcagccaccccagcaaccagagccagcagaccaccgcccaggaggagaacaagggcgaggagaagagccugaagaccaagagcacccccgugaccagcgaggagccccacaccaacauccaggacaagcugagcaagaagaacagcagcggcgaccugaccaccaaccccgacccccagaacgccgccgagcccaccggcaccgugcccgagcagaaggagauggaccccggcaaggagggccccaacagcccccagaacaagccccccgccgcccccgugaucaacgaguacgccgacgcccagcugcacaaccuggugaagagaaugagacagagaaccgcccuguacaagaagaagcugguggagggcgaccugagcagccccgaggccagcccccagaccgccaagcccaccgccgugccccccgugaaggagagcgacgacaagcccaccgagcacuacuacagacugcugugguucaaggugaagaagaugccccugaccgaguaccugaagagaaucaagcugcccaacagcaucgacagcuacaccgacagacuguaccugcuguggcugcugcuggugacccuggccuacaacuggaacugcugcuucaucccccugagacugguguuccccuaccagaccgccgacaacauccacuacuggcugaucgccgacaucaucugcgacaucaucuaccuguacgacaugcuguucauccagcccagacugcaguucgugagaggcggcgacaucaucguggacagcaacgagcugagaaagcacuacagaaccagcaccaaguuccagcuggacguggccagcaucauccccuucgacaucugcuaccuguucuucggcuucaaccccauguucagagccaacagaaugcugaaguacaccagcuucuucgaguucaaccaccaccuggagagcaucauggacaaggccuacaucuacagagugaucagaaccaccggcuaccugcuguucauccugcacaucaacgccugcguguacuacugggccagcaacuacgagggcaucggcaccaccagauggguguacgacggcgagggcaacgaguaccugagaugcuacuacugggccgugagaacccugaucaccaucggcggccugcccgagccccagacccuguucgagaucguguuccagcugcugaacuucuucagcggcguguucguguucagcagccugaucggccagaugagagacgugaucggcgccgccaccgccaaccagaacuacuucagagccugcauggacgacaccaucgccuacaugaacaacuacagcauccccaagcuggugcagaagagagugagaaccugguacgaguacaccugggacagccagagaaugcuggacgagagcgaccugcugaagacccugcccaccaccgugcagcuggcccuggccaucgacgugaacuucagcaucaucagcaagguggaccuguucaagggcugcgacacccagaugaucuacgacaugcugcugagacugaagagcgugcuguaccugcccggcgacuucgugugcaagaagggcgagaucggcaaggagauguacaucaucaagcacggcgaggugcaggugcugggcggccccgacggcaccaaggugcuggugacccugaaggccggcagcguguucggcgagaucagccugcuggccgccggcggcggcaacagaagaaccgccaacgugguggcccacggcuucgccaaccugcugacccuggacaagaagacccugcaggagauccuggugcacuaccccgacagcgagagaauccugaugaagaaggccagagugcugcugaagcagaaggccaagaccgccgaggccaccccccccagaaaggaccuggcccugcuguucccccccaaggaggagacccccaagcuguucaagacccugcugggcggcaccggcaaggccagccuggccagacugcugaagcugaagagagagcaggccgcccagaagaaggagaacagcgagggcggcgaggaggagggcaaggagaacgaggacaagcagaaggagaacgaggacaagcagaaggagaacgaggacaagggcaaggagaacgaggacaaggacaagggcagagagcccgaggagaagccccuggacagacccgagugcaccgccagccccaucgccguggaggaggagccccacagcgugagaagaaccgugcugcccagaggcaccagcagacagagccugaucaucagcauggcccccagcgccgagggcggcgaggaggugcugaccaucgaggugaaggagaaggccaagcaguaa

SEQ ID NO: 15395 - RNA, 483 nt, Artificial Sequence
  CNIH3__Homo_sapiens__NP_689708
auggccuucaccuucgccgccuucugcuacaugcugagccuggugcugugcgccgcccugaucuucuucgccaucuggcacaucaucgccuucgacgagcugagaaccgacuucaagagccccaucgaccagugcaaccccgugcacgccagagagagacugagaaacaucgagagaaucugcuuccugcugagaaagcuggugcugcccgaguacagcauccacagccuguucugcaucauguuccugugcgcccaggaguggcugacccugggccugaacgugccccugcuguucuaccacuucuggagauacuuccacugccccgccgacagcagcgagcuggccuacgacccccccguggugaugaacgccgacacccugagcuacugccagaaggaggccuggugcaagcuggccuucuaccugcugagcuucuucuacuaccuguacugcaugaucuacacccuggugagcagcuaa

SEQ ID NO: 15396 - RNA, 2163 nt, Artificial Sequence
  CNKSR1__Homo_sapiens__NP_001284576
auggagcccguggagaccuggacccccggcaagguggccaccuggcugagaggccuggacgacagccugcaggacuaccccuucgaggacuggcagcugcccggcaagaaccugcugcagcugugcccccagagccuggaggcccuggccgugagaagccugggccaccaggagcugauccugggcggcguggagcagcugcaggcccugagcagcagacugcagaccgagaaccugcagagccugaccgagggccugcugggcgccacccacgacuuccagagcaucgugcagggcugccugggcgacugcgccaagacccccaucgacgugcugugcgccgccguggagcugcugcacgaggccgacgcccugcuguucuggcugagcagauaccuguucagccaccugaacgacuucagcgccugccaggagaucagagaccugcuggaggagcugagccaggugcugcacgaggacggccccgccgccgagaaggagggcaccgugcugagaaucugcagccacguggccggcaucugccacaacauccuggugugcugccccaaggagcugcuggagcagaaggccgugcuggagcaggugcagcuggacagcccccugggccuggagauccacaccaccagcaacugccagcacuucgugagccagguggacacccaggugcccaccgacagcagacugcagauccagcccggcgacgagguggugcagaucaacgagcaggugguggugagagaggagagagacauggugggcuggcccagaaagaacauggugagagagcugcugagagagcccgccggccugagccuggugcugaagaagauccccauccccgagacccccccccagacccccccccaggugcuggacagcccccaccagagaagccccagccugagccuggccccccugagccccagagcccccagcgaggacguguucgccuucgaccugagcagcaaccccagccccggccccagccccgccuggaccgacagcgccagccugggccccgagccccugcccaucccccccgagccccccgccauccugcccgccggcguggccggcacccccggccugcccgagagccccgacaagagccccgugggcagaaagaagagcaagggccuggccaccagacugagcagaagaagagugagcugcagagagcugggcagacccgacugcgacggcuggcugcugcugagaaaggcccccggcggcuucaugggccccagauggagaagaagaugguucgugcugaagggccacacccuguacugguacagacagccccaggacgagaaggccgagggccugaucaacgugagcaacuacagccuggagagcggccacgaccagaagaagaaguacguguuccagcugacccacgacguguacaagcccuucaucuucgccgccgacacccugaccgaccugagcaugugggugagacaccugaucaccugcaucagcaaguaccagagccccggcagagcccccccccccagagaggaggacugcuacagcgagaccgaggccgaggaccccgacgacgaggccggcagccacagcgccagccccagccccgcccaggccggcagcccccugcacggcgacaccagccccgccgccacccccacccagagaagccccagaaccagcuucggcagccugaccgacagcagcgaggaggcccuggagggcauggugagaggccugagacagggcggcgugagccugcugggccagccccagccccugacccaggagcaguggagaagcagcuucaugagaagaaacagagacccccagcugaacgagagagugcacagagugagagcccugcagagcacccugaaggccaagcugcaggagcugcaggugcuggaggaggugcugggcgaccccgagcugaccggcgagaaguucagacaguggaaggagcagaacagagagcuguacagcgagggccugggcgccuggggcguggcccaggccgagggcagcagccacauccugaccagcgacagcaccgagcagagcccccacagccugcccagcgaccccgaggagcacagccaccugugcccccugaccagcgagagcagccugagaccccccgaccuguaa

SEQ ID NO: 15397 - RNA, 3015 nt, Artificial Sequence
  CNKSR2__Homo_sapiens__NP_001162118
auggcccugaucauggagcccgugagcaaguggagccccagccaggugguggacuggaugaagggccuggacgacugccugcagcaguacaucaagaacuucgagagagagaagaucagcggcgaccagcugcugagaaucacccaccaggagcuggaggaccugggcgugagcagaaucggccaccaggagcugauccuggaggccguggaccugcugugcgcccugaacuacggccuggagaccgagaaccugaagacccugagccacaagcugaacgccagcgccaagaaccugcagaacuucaucaccggcagaagaagaagcggccacuacgacggcagaaccagcagaaagcugcccaacgacuuccugaccagcgugguggaccugaucggcgccgccaagagccugcuggccuggcuggacagaagccccuucgccgccgugaccgacuacagcgugaccagaaacaacgugauccagcugugccuggagcugaccaccaucgugcagcaggacugcaccguguacgagaccgagaacaagauccugcacgugugcaagacccugagcggcgugugcgaccacaucaucagccugagcagcgacccccuggugagccagagcgcccaccuggaggugauccagcuggccaacaucaagcccagcgagggccugggcauguacaucaagagcaccuacgacggccugcacgugaucaccggcaccaccgagaacagccccgccgacagaugcaagaagauccacgccggcgacgaggugauccaggugaaccaccagaccguggugggcuggcagcugaagaaccuggugaacgcccugagagaggaccccagcggcgugauccugacccugaagaagagaccccagagcaugcugaccagcgcccccgcccugcugaagaacaugagauggaagccccuggcccugcagccccugauccccagaagccccaccagcagcguggccacccccagcagcaccaucagcacccccaccaagagagacagcagcgcccugcaggaccuguacaucccccccccccccgccgagcccuacauccccagagacgagaagggcaaccugcccugcgaggaccugagaggccacauggugggcaagcccgugcacaagggcagcgagagccccaacagcuuccuggaccaggaguacagaaagagauucaacaucguggaggaggacaccgugcuguacugcuacgaguacgagaagggcagaagcagcagccagggcagaagagagagcacccccaccuacgagaacagccugcugagauacaugagcaacgagaagaucgcccaggaggaguacauguuccagagaaacagcaagaaggacaccggcaagaagagcaagaagaagggcgacaagagcaacagccccacccacuacagccugcugcccagccugcagauggacgcccugagacaggacaucaugggcacccccgugcccgagaccacccuguaccacaccuuccagcagagcagccugcagcacaagagcaagaagaagaacaagggccccaucgccggcaagagcaagagaagaaucagcugcaaggaccugggcagaggcgacugcgagggcuggcuguggaagaagaaggacgccaagagcuacuucagccagaaguggaagaaguacugguucgugcugaaggacgccagccuguacugguacaucaacgaggaggacgagaaggccgagggcuucaucagccugcccgaguucaagaucgacagagccagcgagugcagaaagaaguacgccuucaaggccugccaccccaagaucaagagcuucuacuucgccgccgagcaccuggacgacaugaacagauggcugaacagaaucaacaugcugaccgccggcuacgccgagagagagagaaucaagcaggagcaggacuacuggagcgagagcgacaaggaggaggccgacacccccagcacccccaagcaggacagcccccccccccccuacgacaccuaccccagaccccccagcaugagcugcgccagccccuacguggaggccaagcacagcagacugagcagcaccgagaccagccagagccagagcagccacgaggaguucagacaggaggugaccggcagcagcgccgugagccccaucagaaagaccgccagccagagaagaagcuggcaggaccugaucgagaccccccugaccagcagcggccugcacuaccugcagacccugccccuggaggacagcguguucagcgacagcgccgccaucagccccgagcacagaagacagagcacccugcccacccagaagugccaccugcaggaccacuacggccccuacccccuggccgagagcgagagaaugcaggugcugaacggcaacggcggcaagcccagaagcuucacccugcccagagacagcggcuucaaccacugcugccugaacgcccccgugagcgccugcgacccccaggacgacgugcagccccccgagguggaggaggaggaggaggaggaggaggaggagggcgaggccgccggcgagaacaucggcgagaagagcgagagcagagaggagaagcugggcgacagccugcaggaccuguacagagcccuggagcaggccagccugagcccccugggcgagcacagaaucagcaccaagauggaguacaagcugagcuucaucaagagaugcaacgaccccgugaugaacgagaagcugcacagacugagaauccugaagagcacccugaaggccagagagggcgagguggccaucaucgacaaggugcuggacaaccccgaccugaccagcaaggaguuccagcaguggaagcagauguaccuggaccuguuccuggacaucugccagaacaccaccagcaacgacccccugagcaucagcagcgagguggacgugaucaccagcagccuggcccacacccacagcuacaucgagacccacguguaa

SEQ ID NO: 15398 - RNA, 1668 nt, Artificial Sequence
  CNKSR3__Homo_sapiens__NP_775786
auggagcccgugaccaaguggagccccaagcaggugguggacuggaccagaggccuggacgacugccugcagcaguacgugcacaaguucgagagagagaagaucaacggcgagcagcugcugcagaucagccaccaggaccuggaggagcugggcgugaccagaaucggccaccaggagcuggugcuggaggccguggaccugcugugcgcccugaacuacggccuggagaccgacaacaugaagaaccuggugcugaagcugagagccagcagccacaaccugcagaacuacaucagcagcagaagaaagagccccgccuacgacggcaacaccagcagaaaggcccccaacgaguuccugaccagcgugguggagcugaucggcgccgccaaggcccugcuggccuggcuggacagagcccccuucaccggcaucaccgacuucagcgugaccaagaacaagaucauccagcugugccuggaccugaccaccaccgugcagaaggacugcuucguggccgagauggaggacaaggugcugaccguggugaaggugcugaacggcaucugcgacaagaccaucagaagcaccaccgaccccgugaugagccagugcgccugccuggaggaggugcaccugcccaacaucaagcccggcgagggccugggcauguacaucaagagcaccuacgacggccugcacgugaucaccggcaccaccgagaacagccccgccgacagaagccagaagauccacgccggcgacgaggugauccaggugaaccagcagaccguggugggcuggcagcugaagaaccuggugaagaagcugagagagaaccccaccggcguggugcugcugcugaagaagagacccaccggcagcuucaacuucacccccgccccccugaagaaccugagauggaagcccccccuggugcagaccagccccccccccgccaccacccagagccccgagagcaccauggacaccagccugaagaaggagaagagcgccauccuggaccuguacaucccccccccccccgccgugcccuacagccccagagacgagaacggcagcuucguguacggcggcagcagcaagugcaagcagccccugcccggccccaagggcagcgagagccccaacagcuuccuggaccaggagagcagaagaagaagauucaccaucgccgacagcgaccagcugcccggcuacagcguggagaccaacauccugcccaccaagaugagagagaagacccccagcuacggcaagcccagaccccugagcaugcccgccgacggcaacuggaugggcaucguggaccccuucgccagacccagaggccacggcagaaagggcgaggacgcccugugcagauacuucagcaacgagagaaucccccccaucaucgaggagagcagcagcccccccuacagauucagcagacccaccaccgagagacaccuggugagaggcgccgacuacaucagaggcagcagaugcuacaucaacagcgaccugcacagcagcgccaccauccccuuccaggaggagggcaccaagaagaagagcggcagcagcgccaccaagagcagcagcaccgagcccagccugcuggugagcugguucaccagacugaagcugcugacccacuaa

SEQ ID NO: 15399 - RNA, 894 nt, Artificial Sequence
  CNN1__Homo_sapiens__NP_001290
augagcagcgcccacuucaacagaggccccgccuacggccugagcgccgaggugaagaacaagcuggcccagaaguacgaccaccagagagagcaggagcugagagaguggaucgagggcgugaccggcagaagaaucggcaacaacuucauggacggccugaaggacggcaucauccugugcgaguucaucaacaagcugcagcccggcagcgugaagaagaucaacgagagcacccagaacuggcaccagcuggagaacaucggcaacuucaucaaggccaucaccaaguacggcgugaagccccacgacaucuucgaggccaacgaccuguucgagaacaccaaccacacccaggugcagagcacccugcuggcccuggccagcauggccaagaccaagggcaacaaggugaacgugggcgugaaguacgccgagaagcaggagagaaaguucgagcccggcaagcugagagagggcagaaacaucaucggccugcagaugggcaccaacaaguucgccagccagcagggcaugaccgccuacggcaccagaagacaccuguacgaccccaagcugggcaccgaccagccccuggaccaggccaccaucagccugcagaugggcaccaacaagggcgccagccaggccggcaugaccgcccccggcaccaagagacagaucuucgagcccggccugggcauggagcacugcgacacccugaacgugagccugcagaugggcagcaacaagggcgccagccagagaggcaugaccguguacggccugcccagacagguguacgaccccaaguacugccugacccccgaguaccccgagcugggcgagcccgcccacaaccaccacgcccacaacuacuacaacagcgccuaa

SEQ ID NO: 15400 - RNA, 930 nt, Artificial Sequence
  CNN2__Homo_sapiens__NP_004359
augagcagcacccaguucaacaagggccccagcuacggccugagcgccgaggugaagaacagacugcugagcaaguacgacccccagaaggaggccgagcugagaaccuggaucgagggccugaccggccugagcaucggccccgacuuccagaagggccugaaggacggcaccauccugugcacccugaugaacaagcugcagcccggcagcgugcccaagaucaacagaagcaugcagaacuggcaccagcuggagaaccugagcaacuucaucaaggccauggugagcuacggcaugaaccccguggaccuguucgaggccaacgaccuguucgagagcggcaacaugacccaggugcaggugagccugcuggcccuggccggcaaggccaagaccaagggccugcagagcggcguggacaucggcgugaaguacagcgagaagcaggagagaaacuucgacgacgccaccaugaaggccggccagugcgugaucggccugcagaugggcaccaacaagugcgccagccagagcggcaugaccgccuacggcaccagaagacaccuguacgaccccaagaaccacauccugccccccauggaccacagcaccaucagccugcagaugggcaccaacaagugcgccagccaggugggcaugaccgcccccggcaccagaagacacaucuacgacaccaagcugggcaccgacaagugcgacaacagcagcaugagccugcagaugggcuacacccagggcgccaaccagagcggccagguguucggccugggcagacagaucuacgaccccaaguacugcccccagggcaccguggccgacggcgcccccagcggcaccggcgacugccccgaccccggcgaggugcccgaguacccccccuacuaccaggaggaggccggcuacuaa

SEQ ID NO: 15401 - RNA, 2856 nt, Artificial Sequence
  CNNM1__Homo_sapiens__NP_065081
auggccgccgccgccgccgccgccgccgccgugggcgugagacugagagacugcugcagcagaggcgccgugcugcugcuguucuucagccugagccccagaccccccgccgccgccgccuggcugcugggccugagacccgaggacaccgccggcggcagagugagccuggagggcggcacccugagagccgccgagggcaccagcuuccugcugagaguguacuuccagcccggcccccccgccaccgccgcccccgugcccagccccacccugaacagcggcgagaacggcaccggcgacugggcccccagacugguguucaucgaggagccccccggcggcggcggcguggcccccagcgccgugcccaccagaccccccggcccccagagaugcagagagcagagcgacugggccagcgacguggaggugcugggcccccugagacccggcggcguggccggcagcgcccuggugcaggugagagugagagagcugagaaagggcgaggccgagagaggcggcgccggcggcggcggcaagcuguucagccugugcgccugggacggcagagccuggcaccaccacggcgccgccggcggcuuccugcugagagugagacccagacuguacggccccggcggcgaccugcugccccccgccuggcugagagcccugggcgcccugcugcugcuggcccugagcgcccuguucagcggccugagacugagccugcugagccuggaccccguggagcugagagugcugagaaacagcggcagcgccgccgagcaggagcaggccagaagagugcaggccgugagaggcagaggcacccaccugcugugcacccugcugcugggccaggccggcgccaacgccgcccuggccggcuggcuguacaccagccugccccccggcuucggcggcaccggcgaggacuacagcgaggagggcauccacuuccccuggcugcccgcccuggugugcaccggcgccguguuccugggcgccgagaucugccccuacagcgugugcagcagacacggccuggccaucgccagccacagcgugugccugaccagacugcugauggccgccgccuuccccgugugcuacccccugggcagacugcuggacugggcccugagacaggagaucagcaccuucuacaccagagagaagcugcuggagacccugagagccgccgaccccuacagcgaccuggugaaggaggagcugaacaucauccagggcgcccuggagcugagaaccaaggugguggaggaggugcugaccccccugggcgacugcuucaugcugagaagcgacgccgugcuggacuucgccaccgugagcgagauccugagaagcggcuacaccagaauccccguguacgagggcgaccagagacacaacaucguggacauccuguucgugaaggaccuggccuucguggaccccgacgacugcaccccccugcugaccgugaccagauucuacaacagaccccugcacugcguguucaacgacaccagacuggacaccgugcuggaggaguucaagaagggcaagagccaccuggccaucgugcagagagugaacaacgagggcgagggcgaccccuucuacgaggugaugggcaucgugacccuggaggacaucaucgaggagaucaucaagagcgagauccuggacgagaccgaccuguacaccgacaacagaaagaagcagagagugccccagagagagagaaagagacacgacuucagccuguucaagcugagcgacaccgagaugagagugaagaucagcccccagcugcugcuggccacccacagauucauggccaccgagguggagcccuucaagagccuguaccugagcgagaagauccugcugagacugcugaagcaccccaacgugauccaggagcugaaguucgacgagaagaacaagaaggcccccgagcacuaccuguaccagagaaacagacccguggacuacuucgugcugcugcugcagggcaagguggagguggaggugggcaaggagggccugagauucgagaacggcgccuucaccuacuacggcgugcccgccaucaugaccaccgccugcagcgacaacgacgugagaaaggugggcagccuggccggcagcagcguguuccugaacagaagccccagcagaugcagcggccugaacagaagcgagagccccaacagagagagaagcgacuucggcggcagcaacacccagcuguacagcagcagcaacaaccuguacaugcccgacuacagcgugcacauccugagcgacgugcaguucgugaagaucaccagacagcaguaccagaacgcccugaccgccugccacauggacagcagcccccagagccccgacauggaggccuucaccgacggcgacagcaccaaggcccccaccaccagaggcaccccccagacccccaaggacgaccccgccaucacccugcugaacaacagaaacagccugcccugcagcagaagcgacggccugagaagccccagcgaggugguguaccugagaauggaggagcuggccuucacccaggaggagaugaccgacuucgaggagcacagcacccagcagcugacccugagccccgccgccgugcccaccagagccgccagcgacagcgagugcugcaacaucaaccuggacaccgagaccagccccugcagcagcgacuucgaggagaacgugggcaagaagcugcugagaacccugagcggccagaagagaaagagaagccccgagggcgagagaaccagcgaggacaacagcaaccugaccccccugaucaccuaa

SEQ ID NO: 15402 - RNA, 2628 nt, Artificial Sequence
  CNNM2__Homo_sapiens__NP_060119
augaucggcugcggcgccugcgagcccaaggugaagauggccggcggccaggccgccgccgcccugcccaccuggaagauggccgccagaagaagccugagcgccagaggcagaggcauccugcaggccgccgccggcagacugcugccccugcugcugcugagcugcugcugcggcgccggcggcugcgccgccgugggcgagaacgaggagaccgugaucaucggccugagacuggaggacaccaacgacgugagcuucauggagggcggcgcccugagagugagcgagagaaccagagugaagcugagaguguacggccagaacaucaacaacgagaccuggagcagaaucgccuucaccgagcacgagagaagaagacacagccccggcgagagaggccugggcggccccgccccccccgagcccgacagcggcccccagagaugcggcaucagaaccagcgacaucaucauccugccccacaucauccugaacagaagaaccagcggcaucaucgagaucgagaucaagccccugagaaagauggagaagagcaagagcuacuaccugugcaccagccugagcacccccgcccugggcgccggcggcagcggcagcaccggcggcgccgugggcggcaagggcggcagcggcguggccggccugccccccccccccugggccgagaccaccuggaucuaccacgacggcgaggacaccaagaugaucgugggcgaggagaagaaguuccugcugcccuucuggcugcaggugaucuucaucagccugcugcugugccugagcggcauguucagcggccugaaccugggccugauggcccuggaccccauggagcugagaaucgugcagaacugcggcaccgagaaggagaagaacuacgccaagagaaucgagcccgugagaagacagggcaacuaccugcugugcagccugcugcugggcaacgugcuggugaacaccacccugaccauccugcuggacgacaucgccggcagcggccugguggccgugguggugagcaccaucggcaucgugaucuucggcgagaucgugccccaggccaucugcagcagacacggccuggccgugggcgccaacaccaucuuccugaccaaguucuucaugaugaugaccuuccccgccagcuaccccgugagcaagcugcuggacugcgugcugggccaggagaucggcaccguguacaacagagagaagcugcuggagaugcugagagugaccgaccccuacaacgaccuggugaaggaggagcugaacaucauccagggcgcccuggagcugagaaccaagaccguggaggacgugaugaccccccugagagacugcuucaugaucaccggcgaggccauccuggacuucaacaccaugagcgagaucauggagagcggcuacaccagaauccccguguucgagggcgagagaagcaacaucguggaccugcuguucgugaaggaccuggccuucguggaccccgacgacugcaccccccugaagaccaucaccaaguucuacaaccacccccugcacuucguguucaacgacaccaagcuggacgccaugcuggaggaguucaagaagggcaagagccaccuggccaucgugcagagagugaacaacgagggcgagggcgaccccuucuacgaggugcugggcaucgugacccuggaggacgugaucgaggagaucaucaagagcgagauccuggacgagaccgaccuguacaccgacaacagaaccaagaagaagguggcccacagagagagaaagcaggacuucagcgccuucaagcagaccgacagcgagaugaaggugaagaucagcccccagcugcugcuggccaugcacagauuccuggccaccgagguggaggccuucagccccagccagaugagcgagaagauccugcugagacugcugaagcaccccaacgugauccaggagcugaaguacgacgagaagaacaagaaggcccccgaguacuaccuguaccagagaaacaagcccguggacuacuucgugcugauccugcagggcaagguggagguggaggccggcaaggagggcaugaaguucgaggccagcgccuucagcuacuacggcgugauggcccugaccgccagccccgugccccugagccugagcagaaccuucguggugagcagaaccgagcugcuggccgccggcagccccggcgagaacaagagcccccccagacccugcggccugaaccacagcgacagccugagcagaagcgacagaaucgacgccgugacccccacccugggcagcagcaacaaccagcugaacagcagccugcugcagguguacauccccgacuacagcgugagagcccugagcgaccugcaguucgugaagaucagcagacagcaguaccagaacgcccugauggccagcagaauggacaagaccccccagagcagcgacagcgagaacaccaagaucgagcugacccugaccgagcugcacgacggccugcccgacgagaccgccaaccugcugaacgagcagaacugcgugacccacagcaaggccaaccacagccugcacaacgagggcgccaucuaa

SEQ ID NO: 15403 - RNA, 2328 nt, Artificial Sequence
  CNNM4__Homo_sapiens__NP_064569
auggcccccgugggcggcggcggcagacccgugggcggccccgccagaggcagacugcugcuggccgcccccgugcugcuggugcugcugugggcccugggcgccagaggccagggcagcccccagcagggcaccaucgugggcaugagacuggccagcugcaacaagagcugcggcaccaaccccgacggcaucaucuucgugagcgagggcagcaccgugaaccugagacuguacggcuacagccugggcaacaucagcagcaaccugaucagcuucaccgagguggacgacgccgagacccugcacaagagcaccagcugccuggagcugaccaaggaccugguggugcagcagcuggugaacgugagcagaggcaacaccagcggcgugcugguggugcugaccaaguuccugagaagaagcgagagcaugaagcuguacgcccugugcaccagagcccagcccgacggccccuggcugaaguggaccgacaaggacagccugcuguucaugguggaggagcccggcagauuccugccccuguggcugcacauccugcugaucaccgugcugcuggugcugagcggcaucuucagcggccugaaccugggccugauggcccuggaccccauggagcugagaaucgugcagaacugcggcaccgagaaggagagaagauacgccagaaagaucgagcccaucagaagaaagggcaacuaccugcugugcagccugcugcugggcaacgugcuggugaacaccagccugaccauccugcuggacaaccugaucggcagcggccugauggccguggccagcagcaccaucggcaucgugaucuucggcgagauccugccccaggcccugugcagcagacacggccuggccgugggcgccaacaccauccugcugaccaaguucuucaugcugcugaccuucccccugagcuuccccaucagcaagcugcuggacuucuuccugggccaggagaucagaaccguguacaacagagagaagcugauggagaugcugaaggugaccgagcccuacaacgaccuggugaaggaggagcugaacaugauccagggcgcccuggagcugagaaccaagaccguggaggacaucaugacccagcugcaggacugcuucaugaucagaagcgacgccauccuggacuucaacaccaugagcgagaucauggagagcggcuacaccagaauccccguguucgaggacgagcagagcaacaucguggacauccuguacgugaaggaccuggccuucguggaccccgacgacugcaccccccugaagaccaucaccagauucuacaaccaccccgugcacuucguguuccacgacaccaagcuggacgccaugcuggaggaguucaagaagggcaagagccaccuggccaucgugcagaaggugaacaacgagggcgagggcgaccccuucuacgaggugcugggccuggugacccuggaggacgugaucgaggagaucaucaagagcgagauccuggacgagagcgacauguacaccgacaacagaagcagaaagagagugagcgagaagaacaagagagacuucagcgccuucaaggacgccgacaacgagcugaaggugaagaucagcccccagcugcugcuggccgcccacagauuccuggccaccgaggugagccaguucagccccagccugaucagcgagaagauccugcugagacugcugaaguaccccgacgugauccaggagcugaaguucgacgagcacaacaaguacuacgccagacacuaccuguacaccagaaacaagcccgccgacuacuucauccugauccugcagggcaagguggagguggaggccggcaaggagaacaugaaguucgagaccggcgccuucagcuacuacggcaccauggcccugaccagcgugcccagcgacagaagccccgcccaccccaccccccugagcagaagcgccagccugagcuaccccgacagaaccgacgugagcaccgccgccacccuggccggcagcagcaaccaguucggcagcagcgugcugggccaguacaucagcgacuucagcgugagagcccugguggaccugcaguacaucaagaucaccagacagcaguaccagaacggccugcuggccagcagaauggagaacagcccccaguuccccaucgacggcugcaccacccacauggagaaccuggccgagaagagcgagcugcccgugguggacgagaccaccacccugcugaacgagagaaacagccugcugcacaaggccagccacgagaacgccaucuaa

SEQ ID NO: 15404 - RNA, 7116 nt, Artificial Sequence
  CNOT1__Homo_sapiens__NP_001252541
augaaccuggacagccugagccuggcccugagccagaucagcuaccugguggacaaccugaccaagaagaacuacagagccagccagcaggagauccagcacaucgugaacagacacggccccgaggccgacagacaccugcugagaugccuguucagccacguggacuucagcggcgacggcaagagcagcggcaaggacuuccaccagacccaguuccugauccaggagugcgcccugcugaucaccaagcccaacuucaucagcacccugagcuacgccaucgacaacccccugcacuaccagaagagccugaagcccgccccccaccuguucgcccagcugagcaaggugcugaagcugagcaaggugcaggaggugaucuucggccuggcccugcugaacagcagcagcagcgaccugagaggcuucgccgcccaguucaucaagcagaagcugcccgaccugcugagaagcuacaucgacgccgacgugagcggcaaccaggagggcggcuuccaggacaucgccaucgaggugcugcaccugcugcugagccaccugcuguucggccagaagggcgccuucggcgugggccaggagcagaucgacgccuuccugaagacccugagaagagacuucccccaggagagaugccccguggugcuggccccccugcuguaccccgagaagagagacauccugauggacagaauccugcccgacagcggcggcguggccaagaccaugauggagagcagccuggccgacuucaugcaggaggugggcuacggcuucugcgccagcaucgaggagugcagaaacaucaucgugcaguucggcgugagagaggugaccgccgcccagguggccagagugcugggcaugauggccagaacccacagcggccugaccgacggcaucccccugcagagcaucagcgcccccggcagcggcaucuggagcgacggcaaggacaagagcgacggcgcccaggcccacaccuggaacguggaggugcugaucgacgugcugaaggagcugaaccccagccugaacuucaaggaggugaccuacgagcuggaccaccccggcuuccagaucagagacagcaagggccugcacaacgugguguacggcauccagagaggccugggcauggagguguuccccguggaccugaucuacagacccuggaagcacgccgagggccagcugagcuucauccagcacagccugaucaaccccgagaucuucugcuucgccgacuaccccugccacaccguggccaccgacauccugaaggccccccccgaggacgacaacagagagaucgccaccuggaagagccuggaccugaucgagagccugcugagacuggccgaggugggccaguacgagcaggugaagcagcuguucagcuuccccaucaagcacugccccgacaugcuggugcuggcccugcugcagaucaacaccagcuggcacacccugagacacgagcugaucagcacccugaugcccaucuuccugggcaaccaccccaacagcgccaucauccugcacuacgccuggcacggccagggccagagccccagcaucagacagcugaucaugcacgccauggccgagugguacaugagaggcgagcaguacgaccaggccaagcugagcagaauccuggacguggcccaggaccugaaggcccugagcaugcugcugaacggcacccccuucgccuucgugaucgaccuggccgcccuggccagcagaagagaguaccugaagcuggacaaguggcugaccgacaagaucagagagcacggcgagcccuucauccaggccugcaugaccuuccugaagagaagaugccccagcauccugggcggccuggcccccgagaaggaccagcccaagagcgcccagcugccccccgagacccuggccaccaugcuggccugccugcaggccugcgccggcagcgugagccaggagcugagcgagaccauccugaccaugguggccaacugcagcaacgugaugaacaaggccagacagcccccccccggcgugaugcccaagggcagaccccccagcgccagcagccuggacgccaucagccccgugcagaucgacccccuggccggcaugaccagccugagcaucggcggcagcgccgccccccacacccagagcaugcagggcuucccccccaaccugggcagcgccuucagcaccccccagagccccgccaaggccuuccccccccugagcacccccaaccagaccaccgccuucagcggcaucggcggccugagcagccagcugcccgugggcggccugggcaccggcagccugaccggcaucggcaccggcgcccugggccugcccgccgugaacaacgaccccuucgugcagagaaagcugggcaccagcggccugaaccagcccaccuuccagcagaccgaccugagccagguguggcccgaggccaaccagcacuucagcaaggagaucgacgacgaggccaacagcuacuuccagagaaucuacaaccaccccccccaccccaccaugagcguggacgaggugcuggagaugcugcagagauucaaggacagcaccaucaagagagagagagagguguucaacugcaugcugagaaaccuguucgaggaguacagauucuucccccaguaccccgacaaggagcugcacaucaccgccugccuguucggcggcaucaucgagaagggccuggugaccuacauggcccugggccuggcccugagauacgugcuggaggcccugagaaagcccuucggcagcaagauguacuacuucggcaucgccgcccuggacagauucaagaacagacugaaggacuacccccaguacugccagcaccuggccagcaucagccacuucaugcaguucccccaccaccugcaggaguacaucgaguacggccagcagagcagagacccccccgugaagaugcagggcagcaucaccacccccggcagcaucgcccuggcccaggcccaggcccaggcccaggugcccgccaaggccccccuggccggccaggugagcaccauggugaccaccagcaccaccaccaccguggccaagaccgugaccgugaccagacccaccggcgugagcuucaagaaggacgugccccccagcaucaacaccaccaacaucgacacccugcugguggccaccgaccagaccgagagaaucguggagccccccgagaacauccaggagaagaucgccuucaucuucaacaaccugagccagagcaacaugacccagaagguggaggagcugaaggagaccgugaaggaggaguucaugcccugggugagccaguaccuggugaugaagagagugagcaucgagcccaacuuccacagccuguacagcaacuuccuggacacccugaagaaccccgaguucaacaagauggugcugaacgagaccuacagaaacaucaaggugcugcugaccagcgacaaggccgccgccaacuucagcgacagaagccugcugaagaaccugggccacuggcugggcaugaucacccuggccaagaacaagcccauccugcacaccgaccuggacgugaagagccugcugcuggaggccuacgugaagggccagcaggagcugcuguacguggugcccuucguggccaaggugcuggagagcagcaucagaagcgugguguucagaccccccaaccccuggaccauggccaucaugaacgugcuggccgagcugcaccaggagcacgaccugaagcugaaccugaaguucgagaucgaggugcugugcaagaaccuggcccuggacaucaacgagcugaagcccggcaaccugcugaaggacaaggacagacugaagaaccuggacgagcagcugagcgcccccaagaaggacgugaagcagcccgaggagcugccccccaucaccaccaccaccaccagcaccacccccgccaccaacaccaccugcaccgccaccgugcccccccagccccaguacagcuaccacgacaucaacguguacagccuggccggccuggccccccacaucacccugaaccccaccaucccccuguuccaggcccacccccagcugaagcagugcgugagacaggccaucgagagagccgugcaggagcuggugcaccccgugguggacagaagcaucaagaucgccaugaccaccugcgagcagaucgugagaaaggacuucgcccuggacagcgaggagagcagaaugagaaucgccgcccaccacaugaugagaaaccugaccgccggcauggccaugaucaccugcagagagccccugcugaugagcaucagcaccaaccugaagaacagcuucgccagcgcccugagaaccgccagcccccagcagagagagaugauggaccaggccgccgcccagcuggcccaggacaacugcgagcuggccugcugcuucauccagaagaccgccguggagaaggccggccccgagauggacaagagacuggccaccgaguucgagcugagaaagcacgccagacaggagggcagaagauacugcgaccccguggugcugaccuaccaggccgagagaaugcccgagcagaucagacugaaggugggcggcguggaccccaagcagcuggccguguacgaggaguucgccagaaacgugcccggcuuccugcccaccaacgaccugagccagcccaccggcuuccuggcccagcccaugaagcaggccugggccaccgacgacguggcccagaucuacgacaagugcaucaccgagcuggagcagcaccugcacgccaucccccccacccuggccaugaacccccaggcccaggcccugagaagccugcuggaggugguggugcugagcagaaacagcagagacgccaucgccgcccugggccugcugcagaaggccguggagggccugcuggacgccaccagcggcgccgacgccgaccugcugcugagauacagagagugccaccugcuggugcugaaggcccugcaggacggcagagccuacggcagccccuggugcaacaagcagaucaccagaugccugaucgagugcagagacgaguacaaguacaacguggaggccguggagcugcugaucagaaaccaccuggugaacaugcagcaguacgaccugcaccuggcccagagcauggagaacggccugaacuacauggccguggccuucgccaugcagcuggugaagauccugcugguggacgagagaagcguggcccacgugaccgaggccgaccuguuccacaccaucgagacccugaugagaaucaacgcccacagcagaggcaacgcccccgagggccugccccagcugauggagguggugagaagcaacuacgaggccaugaucgacagagcccacggcggccccaacuucaugaugcacagcggcaucagccaggccagcgaguacgacgacccccccggccugagagagaaggccgaguaccugcugagagagugggugaaccuguaccacagcgccgccgccggcagagacagcaccaaggccuucagcgccuucgugggccagaugcaccagcagggcauccugaagaccgacgaccugaucaccagauucuucagacugugcaccgagaugugcguggagaucagcuacagagcccaggccgagcagcagcacaaccccgccgccaaccccaccaugaucagagccaagugcuaccacaaccuggacgccuucgugagacugaucgcccugcuggugaagcacagcggcgaggccaccaacaccgugaccaagaucaaccugcugaacaaggugcugggcaucguggugggcgugcugcugcaggaccacgacgugagacagagcgaguuccagcagcugcccuaccacagaaucuucaucaugcugcugcuggagcugaacgcccccgagcacgugcuggagaccaucaacuuccagacccugaccgccuucugcaacaccuuccacauccugagacccaccaaggcccccggcuucguguacgccuggcuggagcugaucagccacagaaucuucaucgccagaaugcuggcccacaccccccagcagaagggcuggcccauguacgcccagcugcugaucgaccuguucaaguaccuggcccccuuccugagaaacguggagcugaccaagcccaugcagauccuguacaagggcacccugagagugcugcuggugcugcugcacgacuuccccgaguuccugugcgacuaccacuacggcuucugcgacgugaucccccccaacugcauccagcugagaaaccugauccugagcgccuuccccagaaacaugagacugcccgaccccuucacccccaaccugaagguggacaugcugagcgagaucaacaucgcccccagaauccugaccaacuucaccggcgugaugcccccccaguucaagaaggaccuggacagcuaccugaagaccagaagccccgugaccuuccugagcgaccugagaagcaaccugcaggugagcaacgagcccggcaacagauacaaccugcagcugaucaacgcccuggugcuguacgugggcacccaggccaucgcccacauccacaacaagggcagcacccccagcaugagcaccaucacccacagcgcccacauggacaucuuccagaaccuggccguggaccuggacaccgagggcagauaccuguuccugaacgccaucgccaaccagcugagauaccccaacagccacacccacuacuucagcugcaccaugcuguaccuguucgccgaggccaacaccgaggccauccaggagcagaucaccagagugcugcuggagagacugaucgugaacagaccccaccccuggggccugcugaucaccuucaucgagcugaucaagaaccccgccuucaaguucuggaaccacgaguucgugcacugcgcccccgagaucgagaagcuguuccagagcguggcccagugcugcaugggccagaagcaggcccagcaggugauggagggcaccggcgccagcuaa

SEQ ID NO: 15405 - RNA, 1623 nt, Artificial Sequence
  CNOT2__Homo_sapiens__NP_055330
auggugagaaccgacggccacacccugagcgagaagagaaacuaccaggugaccaacagcauguucggcgccagcagaaagaaguucguggagggcguggacagcgacuaccacgacgagaacauguacuacagccagagcagcauguucccccacagaagcgagaaggacaugcuggccagccccagcaccagcggccagcugagccaguucggcgccagccuguacggccagcagagcgcccugggccugcccaugagaggcaugagcaacaacaccccccagcugaacagaagccugagccagggcacccagcugcccagccacgugacccccaccaccggcgugcccaccaugagccugcacaccccccccagccccagcagaggcauccugcccaugaaccccagaaacaugaugaaccacagccaggugggccagggcaucggcauccccagcagaaccaacagcaugagcagcagcggccugggcagccccaacagaagcagccccagcaucaucugcaugcccaagcagcagcccagcagacagcccuucaccgugaacagcaugagcggcuucggcaugaacagaaaccaggccuucggcaugaacaacagccugagcagcaacaucuucaacggcaccgacggcagcgagaacgugaccggccuggaccugagcgacuuccccgcccuggccgacagaaacagaagagagggcagcggcaaccccaccccccugaucaacccccuggccggcagagcccccuacgugggcauggugaccaagcccgccaacgagcagagccaggacuucagcauccacaacgaggacuuccccgcccugcccggcagcagcuacaaggaccccaccagcagcaacgacgacagcaagagcaaccugaacaccagcggcaagaccaccagcagcaccgacggccccaaguuccccggcgacaagagcagcaccacccagaacaacaaccagcagaagaagggcauccaggugcugcccgacggcagagugaccaacaucccccagggcauggugaccgaccaguucggcaugaucggccugcugaccuucaucagagccgccgagaccgaccccggcauggugcaccuggcccugggcagcgaccugaccacccugggccugaaccugaacagccccgagaaccuguaccccaaguucgccagccccugggccagcagccccugcagaccccaggacaucgacuuccacgugcccagcgaguaccugaccaacauccacaucagagacaagcuggccgccaucaagcugggcagauacggcgaggaccugcuguucuaccuguacuacaugaacggcggcgacgugcugcagcugcuggccgccguggagcuguucaacagagacuggagauaccacaaggaggagagaguguggaucaccagagcccccggcauggagcccaccaugaagaccaacaccuacgagagaggcaccuacuacuucuucgacugccugaacuggagaaagguggccaaggaguuccaccuggaguacgacaagcuggaggagagaccccaccugcccagcaccuucaacuacaaccccgcccagcaggccuucuaa

SEQ ID NO: 15406 - RNA, 2262 nt, Artificial Sequence
  CNOT3__Homo_sapiens__NP_055331
auggccgacaagagaaagcugcagggcgagaucgacagaugccugaagaaggugagcgagggcguggagcaguucgaggacaucuggcagaagcugcacaacgccgccaacgccaaccagaaggagaaguacgaggccgaccugaagaaggagaucaagaagcugcagagacugagagaccagaucaagaccuggguggccagcaacgagaucaaggacaagagacagcugaucgacaacagaaagcugaucgagacccagauggagagauucaaggugguggagagagagaccaagaccaaggccuacagcaaggagggccugggccuggcccagaagguggaccccgcccagaaggagaaggaggaggugggccaguggcugaccaacaccaucgacacccugaacaugcagguggaccaguucgagagcgagguggagagccugagcgugcagaccagaaagaagaagggcgacaaggacaagcaggacagaaucgagggccugaagagacacaucgagaagcacagauaccacgugagaaugcuggagaccauccugagaaugcuggacaacgacagcauccugguggacgccaucagaaagaucaaggacgacguggaguacuacguggacagcagccaggaccccgacuucgaggagaacgaguuccuguacgacgaccuggaccuggaggacaucccccaggcccugguggccaccagcccccccagccacagccacauggaggacgagaucuucaaccagagcagcagcacccccaccagcaccaccagcagcagccccaucccccccagccccgccaacugcaccaccgagaacagcgaggacgacaagaagagaggcagaagcaccgacagcgaggugagccagagccccgccaagaacggcagcaagcccgugcacagcaaccagcacccccagagccccgccgugccccccaccuaccccagcggccccccccccgccgccagcgcccugagcaccacccccggcaacaacggcgugcccgcccccgccgccccccccagcgcccugggccccaaggccagccccgcccccagccacaacagcggcacccccgcccccuacgcccaggccguggccccccccgcccccagcggccccagcaccacccagcccagaccccccagcgugcagcccagcggcggcggcggcggcggcagcggcggcggcggcagcagcagcagcagcaacagcagcgccggcggcggcgccggcaagcagaacggcgccaccagcuacagcagcgugguggccgacagccccgccgagguggcccugagcagcagcggcggcaacaacgccagcagccaggcccugggcccccccagcggcccccacaaccccccccccagcaccagcaaggagcccagcgccgccgcccccaccggcgccggcggcguggcccccggcagcggcaacaacagcggcggccccagccugcuggugccccugcccgugaacccccccagcagccccacccccagcuucagcgacgccaaggccgccggcgcccugcugaacggccccccccaguucagcaccgcccccgagaucaaggcccccgagccccugagcagccugaagagcauggccgagagagccgccaucagcagcggcaucgaggaccccgugcccacccugcaccugaccgagagagacaucauccugagcagcaccagcgccccccccgccagcgcccagcccccccugcagcugagcgaggugaacaucccccugagccugggcgugugcccccugggccccgugccccugaccaaggagcagcuguaccagcaggccauggaggaggccgccuggcaccacaugccccaccccagcgacagcgagagaaucagacaguaccugcccagaaaccccugccccaccccccccuaccaccaccagaugccccccccccacagcgacaccguggaguucuaccagagacugagcaccgagacccuguucuucaucuucuacuaccuggagggcaccaaggcccaguaccuggccgccaaggcccugaagaagcagagcuggagauuccacaccaaguacaugaugugguuccagagacacgaggagcccaagaccaucaccgacgaguucgagcagggcaccuacaucuacuucgacuacgagaaguggggccagagaaagaaggagggcuucaccuucgaguacagauaccuggaggacagagaccugcaguaa

SEQ ID NO: 15407 - RNA, 1719 nt, Artificial Sequence
  CNOT4__Homo_sapiens__NP_001008226
augagcagaagccccgacgccaaggaggaccccguggagugcccccugugcauggagccccuggagaucgacgacaucaacuucuuccccugcaccugcggcuaccagaucugcagauucugcuggcacagaaucagaaccgacgagaacggccugugccccgccugcagaaagcccuaccccgaggaccccgccguguacaagccccugagccaggaggagcugcagagaaucaagaacgagaagaagcagaagcagaacgagagaaagcagaagaucagcgagaacagaaagcaccuggccagcgugagaguggugcagaagaaccugguguucguggugggccugagccagagacuggccgaccccgaggugcugaagagacccgaguacuucggcaaguucggcaagauccacaagguggugaucaacaacagcaccagcuacgccggcagccagggccccagcgccagcgccuacgugaccuacaucagaagcgaggacgcccugagagccauccagugcgugaacaacguggugguggacggcagaacccugaaggccagccugggcaccaccaaguacugcagcuacuuccugaagaacaugcagugccccaagcccgacugcauguaccugcacgagcugggcgacgaggccgccagcuucaccaaggaggagaugcaggccggcaagcaccaggaguacgagcagaagcugcugcaggagcuguacaagcugaaccccaacuuccugcagcugagcaccggcagcguggacaagaacaagaacaaggugaccccccugcagagccccaucgacaagcccagcgacagccugagcaucggcaacggcgacaacagccagcagaucagcaacagcgacacccccagccccccccccggccugagcaagagcaaccccgugauccccaucagcagcagcaaccacagcgccagaagccccuucgagggcgccgugaccgagagccagagccuguucagcgacaacuucagacaccccaaccccauccccagcggccugccccccuuccccagcagcccccagaccagcagcgacuggcccaccgcccccgagccccagagccuguucaccagcgagaccauccccgugagcagcagcaccgacuggcaggccgccuucggcuucggcagcagcaagcagcccgaggacgaccugggcuucgaccccuucgacgugaccagaaaggcccuggccgaccugaucgagaaggagcugagcgugcaggaccagcccagccugagccccaccagccugcagaacagcagcagccacaccaccaccgccaagggccccggcagcggcuuccugcaccccgccgccgccaccaacgccaacagccugaacagcaccuucagcgugcugccccagagauucccccaguuccagcagcacagagccguguacaacagcuucagcuuccccggccaggccgccagauaccccuggauggccuuccccagaaacagcaucaugcaccugaaccacaccgccaaccccaccagcaacagcaacuuccuggaccugaaccugcccccccagcacaacaccggccugggcggcauccccguggccggcgaggaggaggugaaggugagcaccaugccccugagcaccagcagccacagccugcagcagggccagcagcccaccagccugcacaccaccguggccuaa

SEQ ID NO: 15408 - RNA, 1674 nt, Artificial Sequence
  CNOT6__Homo_sapiens__NP_001290170
augcccaaggagaaguacgagccccccgaccccagaagaauguacaccaucaugagcagcgaggaggccgccaacggcaagaagagccacugggccgagcuggagaucagcggcaaggugagaagccugagcgccagccuguggagccugacccaccugaccgcccugcaccugagcgacaacagccugagcagaauccccagcgacaucgccaagcugcacaaccugguguaccuggaccugagcagcaacaagaucagaagccugcccgccgagcugggcaacauggugagccugagagagcugcaccugaacaacaaccugcugagagugcugcccuucgagcugggcaagcuguuccagcugcagacccugggccugaagggcaacccccugacccaggacauccugaaccuguaccaggagcccgacggcaccagaagacugcugaacuaccugcuggacaaccugagcggcaccgccaagagaaucaccaccgagcagcccccccccagaagcuggaucaugcugcaggagcccgacagaaccagacccaccgcccuguucagcgugaugugcuacaacgugcugugcgacaaguacgccaccagacagcuguacggcuacugccccagcugggcccugaacugggacuacagaaagaaggccaucauccaggagauccugagcugcaacgccgacaucgugagccugcaggagguggagaccgagcaguacuacagcuucuuccugguggagcugaaggagagaggcuacaacggcuucuucagccccaagagcagagccagaaccaugagcgagcaggagagaaagcacguggacggcugcgccaucuucuucaagaccgagaaguucacccuggugcagaagcacaccguggaguucaaccagcuggccauggccaacagcgagggcagcgaggccaugcugaacagagugaugaccaaggacaacaucggcguggccgugcugcuggagcugagaaaggagagcaucgagaugcccagcggcaagccccaccugggcaccgagaagcagcugauccugguggccaacgcccacaugcacugggaccccgaguacagcgacgugaagcuggugcagaccaugauguuccugagcgaggugaagaacaucaucgacaaggccagcagaaaccugaagagcagcgugcugggcgaguucggcaccaucccccuggugcugugcgccgaccugaacagccugcccgacagcggcgugguggaguaccugagcaccggcggcguggagaccaaccacaaggacuucaaggagcugagauacaacgagagccugaccaacuucagcugccacggcaagaacggcaccaccaacggcagaaucacccacggcuucaagcugcagagcgccuacgagagcggccugaugcccuacaccaacuacaccuucgacuucaagggcaucaucgacuacaucuucuacagcaagccccagcugaacacccugggcauccugggcccccuggaccaccacuggcugguggagaacaacaucagcggcugcccccacccccugauccccagcgaccacuucagccuguucgcccagcuggagcugcugcugcccuuccugccccaggugaacggcauccaccugcccggcagaagauaa

SEQ ID NO: 15409 - RNA, 1668 nt, Artificial Sequence
  CNOT6L__Homo_sapiens__NP_653172
augagacugaucggcaugcccaaggagaaguacgacccccccgaccccagaagaaucuacaccaucaugagcgccgaggagguggccaacggcaagaagagccacugggccgagcuggagaucagcggcagagugagaagccugagcaccagccuguggagccugacccaccugaccgcccugcaccugaacgacaacuaccugagcagaaucccccccgacaucgccaagcugcacaaccugguguaccuggaccugagcagcaacaagcugagaagccugcccgccgagcugggcaacauggugagccugagagagcugcugcugaacaacaaccugcugagagugcugcccuacgagcugggcagacuguuccagcugcagacccugggccugaagggcaacccccugagccaggacauccugaaccuguaccaggaccccgacggcaccagaaagcugcugaacuucaugcuggacaaccuggccgugcaccccgagcagcugccccccagacccuggaucacccugaaggagagagaccagauccugcccagcgccagcuucaccgugaugugcuacaacgugcugugcgacaaguacgccaccagacagcuguacggcuacugccccagcugggcccugaacugggaguacagaaagaagggcaucauggaggagaucgugaacugcgacgccgacaucaucagccugcaggagguggagaccgagcaguacuucacccuguuccugcccgcccugaaggagagaggcuacgacggcuucuucagccccaagagcagagccaagaucaugagcgagcaggagagaaagcacguggacggcugcgccaucuucuucaagaccgagaaguucacccuggugcagaagcacaccguggaguucaaccagguggccauggccaacagcgacggcagcgaggccaugcugaacagagugaugaccaaggacaacaucggcguggccguggugcuggaggugcacaaggagcuguucggcgccggcaugaagcccauccacgccgccgacaagcagcugcugaucguggccaacgcccacaugcacugggaccccgaguacagcgacgugaagcugauccagaccaugauguucgugagcgaggugaagaacauccuggagaaggccagcagcagacccggcagccccaccgccgaccccaacagcaucccccuggugcugugcgccgaccugaacagccugcccgacagcggcgugguggaguaccugagcaacggcggcguggccgacaaccacaaggacuucaaggagcugagauacaacgagugccugaugaacuucagcugcaacggcaagaacggcagcagcgagggcagaaucacccacggcuuccagcugaagagcgccuacgagaacaaccugaugcccuacaccaacuacaccuucgacuucaagggcgugaucgacuacaucuucuacagcaagacccacaugaacgugcugggcgugcugggcccccuggacccccaguggcugguggagaacaacaucaccggcugcccccacccccacauccccagcgaccacuucagccugcugacccagcuggagcugcaccccccccugcugccccuggugaacggcgugcaccugcccaacagaagauaa

SEQ ID NO: 15410 - RNA, 858 nt, Artificial Sequence
  CNOT7__Homo_sapiens__NP_037486
augcccgccgccaccguggaccacagccagagaaucugcgaggugugggccugcaaccuggacgaggagaugaagaagaucagacaggugaucagaaaguacaacuacguggccauggacaccgaguuccccggcgugguggccagacccaucggcgaguucagaagcaacgccgacuaccaguaccagcugcugagaugcaacguggaccugcugaagaucauccagcugggccugaccuucaugaacgagcagggcgaguacccccccggcaccagcaccuggcaguucaacuucaaguucaaccugaccgaggacauguacgcccaggacagcaucgagcugcugaccaccagcggcauccaguucaagaagcacgaggaggagggcaucgagacccaguacuucgccgagcugcugaugaccagcggcguggugcugugcgagggcgugaaguggcugagcuuccacagcggcuacgacuucggcuaccugaucaagauccugaccaacagcaaccugcccgaggaggagcuggacuucuucgagauccugagacuguucuuccccgugaucuacgacgugaaguaccugaugaagagcugcaagaaccugaagggcggccugcaggagguggccgagcagcuggagcuggagagaaucggcccccagcaccaggccggcagcgacagccugcugaccggcauggccuucuucaagaugagagagauguucuucgaggaccacaucgacgacgccaaguacugcggccaccuguacggccugggcagcggcagcagcuacgugcagaacggcaccggcaacgccuacgaggaggaggccaacaagcagagcuaa

SEQ ID NO: 15411 - RNA, 717 nt, Artificial Sequence
  CNOT8__Homo_sapiens__NP_001288003
augcccgccgcccugguggagaacagccaggugaucugcgaggugugggccagcaaccuggaggaggagaugagaaagaucagagagaucgugcugagcuacagcuacaucgccauggacaccgaguuccccggcgugguggugagacccaucggcgaguucagaagcagcaucgacuaccaguaccagcugcugagaugcaacguggaccugcugaagaucauccagcugggccugaccuucaccaacgagaagggcgaguaccccagcggcaucaacaccuggcaguucaacuucaaguucaaccugaccggcuacgacuucggcuacauggugaagcugcugaccgacagcagacugcccgaggaggagcacgaguucuuccacauccugaaccuguucuuccccagcaucuacgacgugaaguaccugaugaagagcugcaagaaccugaagggcggccugcaggagguggccgaccagcuggaccugcagagaaucggcagacagcaccaggccggcagcgacagccugcugaccggcauggccuucuucagaaugaaggagcuguucuucgaggacagcaucgacgacgccaaguacugcggcagacuguacggccugggcaccggcguggcccagaagcagaacgaggacguggacagcgcccaggagaagaugagcauccuggccaucaucaacaacaugcagcaguaa

SEQ ID NO: 15412 - RNA, 1266 nt, Artificial Sequence
  CNP__Homo_sapiens__NP_149124
augaacagaggcuucagcagaaagagccacaccuuccugcccaagaucuucuucagaaagaugagcagcagcggcgccaaggacaagcccgagcugcaguuccccuuccugcaggacgaggacaccguggccacccugcuggagugcaagacccuguucauccugagaggccugcccggcagcggcaagagcacccuggccagagugaucguggacaaguacagagacggcaccaagauggugagcgccgacgccuacaagaucacccccggcgccagaggcgccuucagcgaggaguacaagagacuggacgaggaccuggccgccuacugcagaagaagagacaucagaauccuggugcuggacgacaccaaccacgagagagagagacuggagcagcuguucgagauggccgaccaguaccaguaccagguggugcugguggagcccaagaccgccuggagacuggacugcgcccagcugaaggagaagaaccaguggcagcugagcgccgacgaccugaagaagcugaagcccggccuggagaaggacuuccugccccuguacuucggcugguuccugaccaagaagagcagcgagacccugagaaaggccggccagguguuccuggaggagcugggcaaccacaaggccuucaagaaggagcugagacaguucgugcccggcgacgagcccagagagaagauggaccuggugaccuacuucggcaagagaccccccggcgugcugcacugcaccaccaaguucugcgacuacggcaaggcccccggcgccgaggaguacgcccagcaggacgugcugaagaagagcuacagcaaggccuucacccugaccaucagcgcccuguucgugacccccaagaccaccggcgccagaguggagcugagcgagcagcagcugcagcuguggcccagcgacguggacaagcugagccccaccgacaaccugcccagaggcagcagagcccacaucacccugggcugcgccgccgacguggaggccgugcagaccggccuggaccugcuggagauccugagacaggagaagggcggcagcagaggcgaggaggugggcgagcugagcagaggcaagcuguacagccugggcaacggcagauggaugcugacccuggccaagaacauggaggugagagccaucuucaccggcuacuacggcaagggcaagcccgugcccacccagggcagcagaaagggcggcgcccugcagagcugcaccaucaucuaa

SEQ ID NO: 15413 - RNA, 549 nt, Artificial Sequence
  CNPY2__Homo_sapiens__NP_055070
augaagggcuggggcuggcuggcccugcugcugggcgcccugcugggcaccgccugggccagaagaagccaggaccugcacugcggcgccugcagagcccugguggacgagcuggagugggagaucgcccagguggaccccaagaagaccauccagaugggcagcuucagaaucaaccccgacggcagccagagcgugguggaggugcccuacgccagaagcgaggcccaccugaccgagcugcuggaggagaucugcgacagaaugaaggaguacggcgagcagaucgaccccagcacccacagaaagaacuacgugagaguggugggcagaaacggcgagagcagcgagcuggaccugcagggcaucagaaucgacagcgacaucagcggcacccugaaguucgccugcgagagcaucguggaggaguacgaggacgagcugaucgaguucuucagcagagaggccgacaacgugaaggacaagcugugcagcaagagaaccgaccugugcgaccacgcccugcacaucagccacgacgagcuguaa

SEQ ID NO: 15414 - RNA, 837 nt, Artificial Sequence
  CNPY3__Homo_sapiens__NP_006577
auggacagcaugcccgagcccgccagcagaugccugcugcugcugccccugcugcugcugcugcugcugcugcugcccgcccccgagcugggccccagccaggccggcgccgaggagaacgacugggugagacugcccagcaagugcgaggugugcaaguacguggccguggagcugaagagcgccuucgaggagaccggcaagaccaaggaggugaucggcaccggcuacggcauccuggaccagaaggccagcggcgugaaguacaccaagagcgaccugagacugaucgaggugaccgagaccaucugcaagagacugcuggacuacagccugcacaaggagagaaccggcagcaacagauucgccaagggcaugagcgagaccuucgagacccugcacaaccuggugcacaagggcgugaagguggugauggacauccccuacgagcuguggaacgagaccagcgccgagguggccgaccugaagaagcagugcgacgugcugguggaggaguucgaggaggugaucgaggacugguacagaaaccaccaggaggaggaccugaccgaguuccugugcgccaaccacgugcugaagggcaaggacaccagcugccuggccgagcaguggagcggcaagaagggcgacaccgccgcccugggcggcaagaagagcaagaagaagagcagcagagccaaggccgccggcggcagaagcagcagcagcaagcagagaaaggagcugggcggccuggagggcgaccccagccccgaggaggacgagggcauccagaaggccagcccccugacccacagcccccccgacgagcuguaa

SEQ ID NO: 15415 - RNA, 1419 nt, Artificial Sequence
  CNR1__Homo_sapiens__NP_001153731
augaagagcauccuggacggccuggccgacaccaccuucagaaccaucaccaccgaccugcuguacgugggcagcaacgacauccaguacgaggacaucaagggcgacauggccagcaagcugggcuacuucccccagaaguucccccugaccagcuucagaggcagccccuuccaggagaagaugaccgccggcgacaacccccagcuggugcccgccgaccaggugaacaucaccgaguucuacaacaagagccugagcagcuucaaggagaacgaggagaacauccagugcggcgagaacuucauggacaucgagugcuucauggugcugaaccccagccagcagcuggccaucgccgugcugagccugacccugggcaccuucaccgugcuggagaaccugcuggugcugugcgugauccugcacagcagaagccugagaugcagacccagcuaccacuucaucggcagccuggccguggccgaccugcugggcagcgugaucuucguguacagcuucaucgacuuccacguguuccacagaaaggacagcagaaacguguuccuguucaagcugggcggcgugaccgccagcuucaccgccagcgugggcagccuguuccugaccgccaucgacagauacaucagcauccacagaccccuggccuacaagagaaucgugaccagacccaaggccgugguggccuucugccugauguggaccaucgccaucgugaucgccgugcugccccugcugggcuggaacugcgagaagcugcagagcgugugcagcgacaucuucccccacaucgacgagaccuaccugauguucuggaucggcgugaccagcgugcugcugcuguucaucguguacgccuacauguacauccuguggaaggcccacagccacgccgugagaaugauccagagaggcacccagaagagcaucaucauccacaccagcgaggacggcaaggugcaggugaccagacccgaccaggccagaauggacaucagacuggccaagacccuggugcugauccugguggugcugaucaucugcuggggcccccugcuggccaucaugguguacgacguguucggcaagaugaacaagcugaucaagaccguguucgccuucugcagcaugcugugccugcugaacagcaccgugaaccccaucaucuacgcccugagaagcaaggaccugagacacgccuucagaagcauguuccccagcugcgagggcaccgcccagccccuggacaacagcaugggcgacagcgacugccugcacaagcacgccaacaacgccgccagcgugcacagagccgccgagagcugcaucaagagcaccgugaagaucgccaaggugaccaugagcgugagcaccgacaccagcgccgaggcccuguaa

SEQ ID NO: 15416 - RNA, 1083 nt, Artificial Sequence
  CNR2__Homo_sapiens__XP_011538931
auggaggagugcugggugaccgagaucgccaacggcagcaaggacggccuggacagcaaccccaugaaggacuacaugauccugagcggcccccagaagaccgccguggccgugcugugcacccugcugggccugcugagcgcccuggagaacguggccgugcuguaccugauccugagcagccaccagcugagaagaaagcccagcuaccuguucaucggcagccuggccggcgccgacuuccuggccagcgugguguucgccugcagcuucgugaacuuccacguguuccacggcguggacagcaaggccguguuccugcugaagaucggcagcgugaccaugaccuucaccgccagcgugggcagccugcugcugaccgccaucgacagauaccugugccugagauacccccccagcuacaaggcccugcugaccagaggcagagcccuggugacccugggcaucaugugggugcugagcgcccuggugagcuaccugccccugaugggcuggaccugcugccccagacccugcagcgagcuguucccccugauccccaacgacuaccugcugagcuggcugcuguucaucgccuuccuguucagcggcaucaucuacaccuacggccacgugcuguggaaggcccaccagcacguggccagccugagcggccaccaggacagacaggugcccggcauggccagaaugagacuggacgugagacuggccaagacccugggccuggugcuggccgugcugcugaucugcugguuccccgugcuggcccugauggcccacagccuggccaccacccugagcgaccaggugaagaaggccuucgccuucugcagcaugcugugccugaucaacagcauggugaaccccgugaucuacgcccugagaagcggcgagaucagaagcagcgcccaccacugccuggcccacuggaagaagugcgugagaggccugggcagcgaggccaaggaggaggcccccagaagcagcgugaccgagaccgaggccgacggcaagaucacccccuggcccgacagcagagaccuggaccugagcgacugcuaa

SEQ ID NO: 15417 - RNA, 387 nt, Artificial Sequence
  CNRIP1__Homo_sapiens__NP_001104571
augggcgaccugcccggccuggugagacugagcaucgcccugagaauccagcccaacgacggccccguguucuacaagguggacggccagagauucggccagaacagaaccaucaagcugcugaccggcagcagcuacaagguggaggugaagaucaagcccagcacccugcagguggagaacaucagcaucggcggcgugcuggugccccuggagcugaagagcaaggagcccgacggcgacagagugguguacaccggcaccuacgacaccgagggcgugacccccaccaagagcggcgagagacagcccauccagaucaccaugcccgagugccuggagcagagaccccaggagaucagccugaccuacgagugcgaggaguaa

SEQ ID NO: 15418 - RNA, 1851 nt, Artificial Sequence
  CNST__Homo_sapiens__NP_001132931
auggacgacagcgacacccccaccuacuaccugcagaucgagccccaggacggcugccaccccggcgacagcguggagagaagcgugaccugccugcccagcgccagcgacgagaacgagaaccagcuggacggcgacggccacgagcaccugaccagcagcgacagcgccaugggcaagccccaggugagcgagcaggacagccugaacaacaacgagagcugcacccugagcugcgagguggccgccggcgagaaccugcagaacacccugugcgaggccagcagagacgagcaggccuuccugggcaaggacaagaagauccccggcaagagaagccccagaagcaagaagggcaccgccaagaagaucccccccggccuguucagcggcgacaucgccccccugaugcaggagaaggugcugagcgccgugaccuacgccguggacgacgaggaggccgccgaggugaacgccaacgagcagcccgaggcccccaagcuggugcugcagagccuguucagccugaucagaggcgagguggagcagcuggacagcagagcccugccccugugccugcaccagaucgccgagagcuacuuccaggaggaggacuacgagaaggccaugaaguucauccagcuggagagacuguaccacgagcagcugcuggccaaccugagcgccauccaggagcagugggagaccaaguggaagaccgugcagccccacaccgugaccgcccugagaaacagcgagaagggcuucaacggcgaggacuucgagagacugaccaagaucugcgccacccaccaggacccccugcugagcaagcacaagaucgccgccguggagaagagccaggagagaaagugcagcacccagcugcuggugagcgaggaccccaaggagggcggcgccaccaccaaggagagcgagagcaagaccugccugggcaccgagagcagcaaggagagccagcacaccguggagccccugggcagcagccccugcugccaccagauggacgugcagaccgacagccccagccugagcgugaccgccggcaaggaccacauggaggagcugcugugcagcgccgaggccacccuggcccugcacacccagagcagcgagaccgccggcagccccagcggccccgacagcagcgaggacgccugcgaggacgacagcagacugcagcuggcccagaccgaggccugccaggacguggccagaaucgagggcaucgccgaggaccccaagguguuccugagcagcaagagcaagaccgagccccugaucagccccggcugcgacagaaucccccccgcccugaucagcgagggcaaguacagccaggcccagagaaaggagcugagacugccccugagagacgccagcgaggcccugcccaccgaccagcuggagaacaacgagcugaacgagcugcagcagcccgaccugaccgacagcgacggcaagagcccccaggcccaggccgacagcgacggcagcgagaacgugcugugcggcaacaaccagaucagcgaccugggcauccugcugcccgaggugugcauggcccccgaggagaagggcgacaaggacgaccagcugaacaaggagaccgaggacuaccugaacagccugcuggagggcugccugaaggacaccgaggacagccugagcuacgaggacaaccaggacgacgacagcgaccugcugcaggaccugagccccgaggaggccagcuacagccugcaggagaaccugcccagcgacgagagcugccugagccuggacgaccuggccaagagaaucgagaucgccgaggugaaccagagauaa

SEQ ID NO: 15419 - RNA, 603 nt, Artificial Sequence
  CNTF__Homo_sapiens__NP_000605
auggccuucaccgagcacagcccccugaccccccacagaagagaccugugcagcagaagcaucuggcuggccagaaagaucagaagcgaccugaccgcccugaccgagagcuacgugaagcaccagggccugaacaagaacaucaaccuggacagcgccgacggcaugcccguggccagcaccgaccaguggagcgagcugaccgaggccgagagacugcaggagaaccugcaggccuacagaaccuuccacgugcugcuggccagacugcuggaggaccagcaggugcacuucacccccaccgagggcgacuuccaccaggccauccacacccugcugcugcagguggccgccuucgccuaccagaucgaggagcugaugauccugcuggaguacaagauccccagaaacgaggccgacggcaugcccaucaacgugggcgacggcggccuguucgagaagaagcuguggggccugaaggugcugcaggagcugagccaguggaccgugagaagcauccacgaccugagauucaucagcagccaccagaccggcauccccgccagaggcagccacuacaucgccaacaacaagaagauguaa

SEQ ID NO: 15420 - RNA, 1119 nt, Artificial Sequence
  CNTFR__Homo_sapiens__NP_001193940
auggccgcccccgugcccugggccugcugcgccgugcuggccgccgccgccgccgugguguacgcccagagacacagcccccaggaggccccccacgugcaguacgagagacugggcagcgacgugacccugcccugcggcaccgccaacugggacgccgccgugaccuggagagugaacggcaccgaccuggcccccgaccugcugaacggcagccagcuggugcugcacggccuggagcugggccacagcggccuguacgccugcuuccacagagacagcuggcaccugagacaccaggugcugcugcacgugggccugccccccagagagcccgugcugagcugcagaagcaacaccuaccccaagggcuucuacugcagcuggcaccugcccacccccaccuacauccccaacaccuucaacgugaccgugcugcacggcagcaagaucauggugugcgagaaggaccccgcccugaagaacagaugccacaucagauacaugcaccuguucagcaccaucaaguacaaggugagcaucagcgugagcaacgcccugggccacaacgccaccgccaucaccuucgacgaguucaccaucgugaagcccgacccccccgagaacgugguggccagacccgugcccagcaaccccagaagacuggaggugaccuggcagacccccagcaccuggcccgaccccgagagcuucccccugaaguucuuccugagauacagaccccugauccuggaccaguggcagcacguggagcugagcgacggcaccgcccacaccaucaccgacgccuacgccggcaaggaguacaucauccagguggccgccaaggacaacgagaucggcaccuggagcgacuggagcguggccgcccacgccacccccuggaccgaggagcccagacaccugaccaccgaggcccaggccgccgagaccaccaccagcaccaccagcagccuggcccccccccccaccaccaagaucugcgaccccggcgagcugggcagcggcggcggccccagcgcccccuuccuggugagcgugcccaucacccuggcccuggccgccgccgccgccaccgccagcagccugcugaucuaa

SEQ ID NO: 15421 - RNA, 1176 nt, Artificial Sequence
  CNTLN__Homo_sapiens__NP_001107867
auggccgccagaagcccccccagcccccaccccagcccccccgccagacagcugggccccagaagccccagagugggcagaggcgccgaggugcacgccaugagaagcgaggccagcggcuucgccggcgccgccagagaggugguggccgacgagagcgacaagaucugggugggcgaggagggcagcggcggcagaagaggccccggcggcgccgcccccgcccacgccccccugcugagcgcccccaugggcagcagaagacuggagggcaucagcguggaggaggccauggugaccagaacccagcugcuggaggaggagcugagcagccugaaggaggagcuggcccugugccaggccgacaaggaguucguguggagccuguggaagagacugcaggugaccaaccccgaccugacccagguggugagccuggugguggagagagagaagcagaagagcgaggccaaggacagaaaggugcuggagauccugcaggugaaggacgccaagauccaggaguucgagcagagagagagcgugcugaagcaggagaucaacgaccuggugaagagaaagaucgccguggacgaggagaacgccuuccugagaaaggaguucagcgaccuggagaagaaguucaaggacaagagccaggagaucaaggacaccaaggagugcgugcagaacaaggaggagcagaacagacuggugaucaagaaccuggaggaggagaacaagaagcugagcaccagaugcaccgaccugcugaacgaccuggagaagcugagaaagcaggaggcccaccugagaaaggagaaguacagcaccgacgccaagaucaagaccuucgaggacaaccugaucgaggccagaaaggagguggaggugagccagagcaaguacaacgcccugagccugcagcugagcaacaagcagaccgagcugauccagaaggacauggacaucacccuggugagaaaggagcugcaggagcugcagaaccuguacaagcagaacagcacccacaccgcccagcaggccgagcugauccagcagcugcaggugcugaacauggacacccagaaggugcugagaaaccaggaggacgugcacaccgccgagagcaucagcuaccagaaggugugcuucuacagcgugaucaagauguaa

SEQ ID NO: 15422 - RNA, 1884 nt, Artificial Sequence
  CNTN1__Homo_sapiens__NP_001242993
augaagauguggcugcuggugagccaccuggugaucaucagcaucaccaccugccuggccgaguucaccugguacagaagauacggccacggcgugagcgaggaggacaagggcuucggccccaucuucgaggagcagcccaucaacaccaucuaccccgaggagagccuggagggcaaggugagccugaacugcagagccagagccagccccuuccccguguacaaguggagaaugaacaacggcgacguggaccugaccagcgacagauacagcauggugggcggcaaccuggugaucaacaaccccgacaagcagaaggacgccggcaucuacuacugccuggccagcaacaacuacggcauggugagaagcaccgaggccacccugagcuucggcuaccuggaccccuucccccccgaggagagacccgaggugagagugaaggagggcaagggcauggugcugcugugcgacccccccuaccacuuccccgacgaccugagcuacagauggcugcugaacgaguuccccguguucaucaccauggacaagagaagauucgugagccagaccaacggcaaccuguacaucgccaacguggaggccagcgacaagggcaacuacagcugcuucgugagcagccccagcaucaccaagagcguguucagcaaguucaucccccugauccccauccccgagagaaccaccaagcccuaccccgccgacaucguggugcaguucaaggacguguacgcccugaugggccagaacgugacccuggagugcuucgcccugggcaaccccgugcccgacaucagauggagaaaggugcuggagcccaugcccagcaccgccgagaucagcaccagcggcgccgugcugaagaucuucaacauccagcuggaggacgagggcaucuacgagugcgaggccgagaacaucagaggcaaggacaagcaccaggccagaaucuacgugcaggccuuccccgaguggguggagcacaucaacgacaccgagguggacaucggcagcgaccuguacuggcccugcguggccaccggcaagcccauccccaccaucagauggcugaagaacggcuacgccuaccacaagggcgagcugagacuguacgacgugaccuucgagaacgccggcauguaccagugcaucgccgagaacaccuacggcgccaucuacgccaacgccgagcugaagauccuggcccuggcccccaccuucgagaugaaccccaugaagaagaagauccuggccgccaagggcggcagagugaucaucgagugcaagcccaaggccgcccccaagcccaaguucagcuggagcaagggcaccgaguggcuggugaacagcagcagaauccugaucugggaggacggcagccuggagaucaacaacaucaccagaaacgacggcggcaucuacaccugcuucgccgagaacaacagaggcaaggccaacagcaccggcacccuggugaucaccgaccccaccagaaucauccuggcccccaucaacgccgacaucaccgugggcgagaacgccaccaugcagugcgccgccagcuucgaccccgcccuggaccugaccuucguguggagcuucaacggcuacgugaucgacuucaacaaggagaacauccacuaccagagaaacuucaugcuggacagcaacggcgagcugcugaucagaaacgcccagcugaagcacgccggcagauacaccugcaccgcccagaccaucguggacaacagcagcgccagcgccgaccugguggugagaggcaagaacagaaagggcggcgagaagaacaugguggacagcuuccugcccgugugcgccagccugccccccaccugguaa

SEQ ID NO: 15423 - RNA, 3123 nt, Artificial Sequence
  CNTN2__Homo_sapiens__NP_005067
augggcaccgccaccagaagaaagccccaccugcugcugguggccgccguggcccuggugagcagcagcgccuggagcagcgcccugggcagccagaccaccuucggccccguguucgaggaccagccccugagcgugcuguuccccgaggagagcaccgaggagcaggugcugcuggccugcagagccagagccagcccccccgccaccuacagauggaagaugaacggcaccgagaugaagcuggagcccggcagcagacaccagcuggugggcggcaaccuggugaucaugaaccccaccaaggcccaggacgccggcguguaccagugccuggccagcaaccccgugggcaccguggugagcagagaggccauccugagauucggcuuccugcaggaguucagcaaggaggagagagaccccgugaaggcccacgagggcuggggcgugaugcugcccugcaacccccccgcccacuaccccggccugagcuacagauggcugcugaacgaguuccccaacuucauccccaccgacggcagacacuucgugagccagaccaccggcaaccuguacaucgccagaaccaacgccagcgaccugggcaacuacagcugccuggccaccagccacauggacuucagcaccaagagcguguucagcaaguucgcccagcugaaccuggccgccgaggacaccagacuguucgcccccagcaucaaggccagauuccccgccgagaccuacgcccuggugggccagcaggugacccuggagugcuucgccuucggcaaccccgugcccagaaucaaguggagaaagguggacggcagccugagcccccaguggaccaccgccgagcccacccugcagauccccagcgugagcuucgaggacgagggcaccuacgagugcgaggccgagaacagcaagggcagagacaccgugcagggcagaaucaucgugcaggcccagcccgaguggcugaaggugaucagcgacaccgaggccgacaucggcagcaaccugagauggggcugcgccgccgccggcaagcccagacccaccgugagauggcugagaaacggcgagccccuggccagccagaacagaguggaggugcuggccggcgaccugagauucagcaagcugagccuggaggacagcggcauguaccagugcguggccgagaacaagcacggcaccaucuacgccagcgccgagcuggccgugcaggcccuggcccccgacuucagacugaaccccgugagaagacugauccccgccgccagaggcggcgagauccugauccccugccagcccagagccgcccccaaggccguggugcuguggagcaagggcaccgagauccuggugaacagcagcagagugaccgugacccccgacggcacccugaucaucagaaacaucagcagaagcgacgagggcaaguacaccugcuucgccgagaacuucaugggcaaggccaacagcaccggcauccugagcgugagagacgccaccaagaucacccuggcccccagcagcgccgacaucaaccugggcgacaaccugacccugcagugccacgccagccacgaccccaccauggaccugaccuucaccuggacccuggacgacuuccccaucgacuucgacaagcccggcggccacuacagaagaaccaacgugaaggagaccaucggcgaccugaccauccugaacgcccagcugagacacggcggcaaguacaccugcauggcccagaccgugguggacagcgccagcaaggaggccaccgugcuggugagaggcccccccggcccccccggcggcgugguggugagagacaucggcgacaccaccauccagcugagcuggagcagaggcuucgacaaccacagccccaucgccaaguacacccugcaggccagaaccccccccgccggcaaguggaagcaggugagaaccaaccccgccaacaucgagggcaacgccgagaccgcccaggugcugggccugacccccuggauggacuacgaguucagagugaucgccagcaacauccugggcaccggcgagcccagcggccccagcagcaagaucagaaccagagaggccgcccccagcguggcccccagcggccugagcggcggcggcggcgcccccggcgagcugaucgugaacuggacccccaugagcagagaguaccagaacggcgacggcuucggcuaccugcugagcuucagaagacagggcagcacccacuggcagaccgccagagugcccggcgccgacgcccaguacuucguguacagcaacgagagcgugagacccuacacccccuucgaggugaagaucagaagcuacaacagaagaggcgacggccccgagagccugaccgcccugguguacagcgccgaggaggagcccagaguggcccccaccaaggugugggccaagggcgugagcagcagcgagaugaacgugaccugggagcccgugcagcaggacaugaacggcauccugcugggcuacgagaucagauacuggaaggccggcgacaaggaggccgccgccgacagagugagaaccgccggccuggacaccagcgccagagugagcggccugcaccccaacaccaaguaccacgugaccgugagagccuacaacagagccggcaccggccccgccagccccagcgccaacgccaccaccaugaagcccccccccagaagaccccccggcaacaucagcuggaccuucagcagcagcagccugagcaucaagugggaccccguggugcccuucagaaacgagagcgccgugaccggcuacaagaugcuguaccagaacgaccugcaccugacccccacccugcaccugaccggcaagaacuggaucgagauccccgugcccgaggacaucggccacgcccuggugcagaucagaaccaccggccccggcggcgacggcauccccgccgaggugcacaucgugagaaacggcggcaccagcaugaugguggagaacauggccgugagacccgccccccaccccggcaccgugaucagccacagcguggccaugcugauccugaucggcagccuggagcuguaa

SEQ ID NO: 15424 - RNA, 3087 nt, Artificial Sequence
  CNTN3__Homo_sapiens__NP_065923
augauguuccccuggaagcagcugauccugcugagcuucaucggcugccugggcggcgagcugcugcugcagggccccguguucaucaaggagcccagcaacagcaucuuccccgugggcagcgaggacaagaagaucacccugcacugcgaggccagaggcaaccccagcccccacuacagauggcagcugaacggcagcgacaucgacaugagcauggagcacagauacaagcugaacggcggcaaccugguggugaucaaccccaacagaaacugggacaccggcaccuaccagugcuucgccaccaacagccugggcaccaucgugagcagagaggccaagcugcaguucgccuaccuggagaacuucaagaccaagaugagaagcaccgugagcgugagagagggccagggcguggugcugcugugcggcccccccccccacagcggcgagcugagcuacgccuggaucuucaacgaguaccccagcuucguggaggaggacagcagaagauucgugagccaggagaccggccaccuguacaucagcaagguggagcccagcgacgugggcaacuacaccugcguggugaccagcauggugaccaacgccagagugcugggcagccccaccccccuggugcugagaagcgacggcgugaugggcgaguacgagcccaagaucgaggugcaguuccccgagacccugcccgccgccaagggcagcaccgugaagcuggagugcuucgcccugggcaaccccaucccccagaucaacuggagaagaagcgacggccugcccuucagcagcaagaucaagcugagaaaguucagcggcgugcuggagauccccaacuuccagcaggaggacgccggcagcuacgagugcaucgccgagaacagcagaggcaagaacguggccagaggcagacugaccuacuacgccaagccccacugggugcagcugaucaaggacguggagaucgccguggaggacagccuguacugggagugcagagccagcggcaagcccaagcccagcuacagauggcugaagaacggcgccgcccuggugcuggaggagagaacccagaucgagaacggcgcccugaccaucagcaaccugagcgugaccgacagcggcauguuccagugcaucgccgagaacaagcacggccugguguacagcagcgccgagcugaaggugguggccagcgcccccgacuucagcaagaaccccaugaagaagcuggugcaggugcaggugggcagccuggugagccuggacugcaagcccagagccagccccagagcccugagcagcuggaagaagggcgacgugagcgugcaggagcacgagagaaucagccugcugaacgacggcggccugaagaucgccaacgugaccaaggccgacgccggcaccuacaccugcauggccgagaaccaguucggcaaggccaacggcaccacccaccugguggugaccgagcccaccagaaucacccuggcccccagcaacauggacgugagcgugggcgagagcgugauccugcccugccaggugcagcacgacccccugcuggacaucaucuucaccugguacuucaacggcgcccuggccgacuucaagaaggacggcagccacuucgagaaggugggcggcagcagcagcggcgaccugaugaucagaaacauccagcugaagcacagcggcaaguacgugugcauggugcagaccggcguggacagcgugagcagcgccgccgaccugaucgugagaggcagccccggcccccccgagaacgugaagguggacgagaucaccgacaccaccgcccagcugagcuggaaggagggcaaggacaaccacagccccgugaucagcuacagcauccaggccagaacccccuucagcgugggcuggcagaccgugaccaccgugcccgaggugaucgacggcaagacccacaccgccaccgugguggagcugaaccccuggguggaguacgaguucagagugguggccagcaacaagaucggcggcggcgagcccagccugcccagcgagaaggugagaaccgaggaggccgugcccgaggugccccccagcgaggugaacggcggcggcggcagcagaagcgagcuggugaucaccugggaccccgugcccgaggagcugcagaacggcgagggcuucggcuacgugguggccuucagaccccugggcgugaccaccuggauccagaccguggugaccagccccgacacccccagauacguguucagaaacgagagcaucgugcccuacagccccuacgaggugaaggugggcguguacaacaacaagggcgagggccccuucagccccgugaccaccguguucagcgccgaggaggagcccaccguggcccccagccaggugagcgccaacagccugagcagcagcgagaucgaggugagcuggaacaccauccccuggaagcugagcaacggccaccugcugggcuacgaggugagauacuggaacggcggcggcaaggaggagagcagcagcaagaugaagguggccggcaacgagaccagcgccagacugagaggccugaagagcaaccuggccuacuacaccgccgugagagccuacaacagcgccggcgccggccccuucagcgccaccgugaacgugaccaccaagaagaccccccccagccagccccccggcaacgugguguggaacgccaccgacaccaaggugcugcugaacugggagcaggugaaggccauggagaacgagagcgaggugaccggcuacaagguguucuacagaaccagcagccagaacaacgugcaggugcugaacaccaacaagaccagcgccgagcuggugcugcccaucaaggaggacuacaucaucgaggugaaggccaccaccgacggcggcgacggcaccagcagcgagcagaucagaauccccagaaucaccagcauggacgccagaggcagcaccagcgccaucagcaacgugcaccccaugagcagcuacaugcccaucgugcuguuccugaucguguacgugcugugguaa

SEQ ID NO: 15425 - RNA, 3081 nt, Artificial Sequence
  CNTN4__Homo_sapiens__NP_001193884
augagacugcccugggagcugcuggugcugcagagcuucauccugugccuggccgacgacagcacccugcacggccccaucuucauccaggagcccagccccgugauguucccccuggacagcgaggagaagaaggugaagcugaacugcgaggugaagggcaaccccaagccccacaucagauggaagcugaacggcaccgacguggacaccggcauggacuucagauacagcgugguggagggcagccugcugaucaacaaccccaacaagacccaggacgccggcaccuaccagugcaccgccaccaacagcuucggcaccaucgugagcagagaggccaagcugcaguucgccuaccuggacaacuucaagaccagaaccagaagcaccgugagcgugagaagaggccagggcauggugcugcugugcggcccccccccccacagcggcgagcugagcuacgccuggaucuucaacgaguaccccagcuaccaggacaacagaagauucgugagccaggagaccggcaaccuguacaucgccaagguggagaagagcgacgugggcaacuacaccugcguggugaccaacaccgugaccaaccacaaggugcugggcccccccaccccccugauccugagaaacgacggcgugaugggcgaguacgagcccaagaucgaggugcaguuccccgagaccgugcccaccgccaagggcgccaccgugaagcuggagugcuucgcccugggcaaccccgugcccaccaucaucuggagaagagccgacggcaagcccaucgccagaaaggccagaagacacaagagcaacggcauccuggagauccccaacuuccagcaggaggacgccggccuguacgagugcguggccgagaacagcagaggcaagaacguggccagaggccagcugaccuucuacgcccagcccaacuggauccagaagaucaacgacauccacguggccauggaggagaacguguucugggagugcaaggccaacggcagacccaagcccaccuacaaguggcugaagaacggcgagccccugcugaccagagacagaauccagaucgagcagggcacccugaacaucaccaucgugaaccugagcgacgccggcauguaccagugccuggccgagaacaagcacggcgugaucuucagcaacgccgagcugagcgugaucgccgugggccccgacuucagcagaacccugcugaagagagugacccuggugaaggugggcggcgagguggugaucgagugcaagcccaaggccagccccaagcccguguacaccuggaagaagggcagagacauccugaaggagaacgagagaaucaccaucagcgaggacggcaaccugagaaucaucaacgugaccaagagcgacgccggcagcuacaccugcaucgccaccaaccacuucggcaccgccagcagcaccggcaaccugguggugaaggaccccaccagagugauggugccccccagcagcauggacgugaccgugggcgagagcaucgugcugcccugccaggugacccacgaccacagccuggacaucguguucaccuggagcuucaacggccaccugaucgacuucgacagagacggcgaccacuucgagagagugggcggccaggacagcgccggcgaccugaugaucagaaacauccagcugaagcacgccggcaaguacgugugcauggugcagaccagcguggacagacugagcgccgccgccgaccugaucgugagaggcccccccggcccccccgaggccgugaccaucgacgagaucaccgacaccaccgcccagcugagcuggagacccggccccgacaaccacagccccaucaccauguacgugauccaggccagaacccccuucagcgugggcuggcaggccgugagcaccgugcccgagcugaucgacggcaagaccuucaccgccaccguggugggccugaaccccuggguggaguacgaguucagaaccguggccgccaacgugaucggcaucggcgagcccagcagacccagcgagaagagaagaaccgaggaggcccugcccgaggugacccccgccaacgugagcggcggcggcggcagcaagagcgagcuggugaucaccugggagaccgugcccgaggagcugcagaacggcagaggcuucggcuacgugguggccuucagacccuacggcaagaugaucuggaugcugaccgugcuggccagcgccgacgccagcagauacguguucagaaacgagagcgugcaccccuucagccccuucgaggugaaggugggcguguucaacaacaagggcgagggccccuucagccccaccaccgugguguacagcgccgaggaggagcccaccaagccccccgccagcaucuucgccagaagccugagcgccaccgacaucgagguguucugggccagcccccuggagaagaacagaggcagaauccagggcuacgaggugaaguacuggagacacgaggacaaggaggagaacgccagaaagaucagaaccgugggcaaccagaccagcaccaagaucaccaaccugaagggcagcgugcuguaccaccuggccgugaaggccuacaacagcgccggcaccggccccagcagcgccaccgugaacgugaccaccagaaagcccccccccagccagccccccggcaacaucaucuggaacagcagcgacagcaagaucauccugaacugggaccaggugaaggcccuggacaacgagagcgaggugaagggcuacaaggugcuguacagauggaacagacagagcagcaccagcgugaucgagaccaacaagaccagcguggagcugagccugcccuucgacgaggacuacaucaucgagaucaagcccuucagcgacggcggcgacggcagcagcagcgagcagaucagaauccccaagaucagcaacgccuacgccagaggcagcggcgccagcaccagcaacgccugcacccugagcgccaucagcaccaucaugaucagccugaccgccagaagcagccuguaa

SEQ ID NO: 15426 - RNA, 3303 nt, Artificial Sequence
  CNTN5__Homo_sapiens__NP_001230199
auggccagcagcuggaagcugaugcuguuccugagcgugaccaugugccugagcgaguacagcaagagccugcccggccugagcaccagcuacgccgcccugcugagaaucaagaagagcagcagcagcagccuguucggcagcaagaccagacccagauacagcagccccagccugggcacccugagcgccagcagccccagcuggcugggcgccgcccagaacuacuacagccccaucaaccuguaccacagcagcgacgccuucaagcaggacgagagcguggacuacggccccguguucgugcaggagcccgacgacaucaucuuccccaccgacagcgacgagaagaagguggcccugaacugcgaggugagaggcaaccccgugcccagcuacagauggcugagaaacggcaccgagaucgaccuggagagcgacuacagauacagccugaucgacggcaccuucaucaucagcaaccccagcgaggccaaggacagcggccacuaccagugccuggccaccaacaccgugggcagcauccugagcagagaggccacccugcaguucgccuaccugggcaacuucagcggcagaaccagaagcgccgugagcgugagagagggccagggcguggugcugaugugcagcccccccccccacagccccgagaucaucuacagcuggguguucaacgaguuccccagcuucguggccgaggacagcagaagauucaucagccaggagaccggcaaccuguacaucagcaaggugcagaccagcgacgugggcagcuacaucugccuggugaagaacaccgugaccaacgccagagugcugagcccccccaccccccugacccugagaaacgacggcgugaugggcgaguacgagcccaagaucgaggugcacuuccccuucaccgugaccgccgccaagggcaccaccgugaagauggagugcuucgcccugggcaaccccgugcccaccaucaccuggaugaaggugaacggcuacauccccagcaaggccagacugagaaagagccaggccgugcuggagauccccaacgugcagcuggacgacgccggcaucuacgagugcagagccgagaacagcagaggcaagaacagcuucagaggccagcugcagguguacaccuacccccacuggguggagaagcugaacgacacccagcuggacagcggcagcccccugagaugggagugcaaggccaccggcaagcccagacccaccuacagauggcugaagaacggcgugccccugagcccccagagcagaguggagauggugaacggcgugcugaugauccacaacgugaaccagagcgacgccggcauguaccagugccuggccgagaacaaguacggcgccaucuacgccagcgccgagcugaagauccuggccagcgcccccaccuucgcccugaaccagcugaagaagaccaucaucgugaccaaggaccaggagguggugaucgagugcaagccccagggcagccccaagcccaccaucagcuggaagaagggcgacagagccgugagagagaacaagagaaucgccauccugcccgacggcagccugagaauccugaacgccagcaagagcgacgagggcaaguacgugugcagaggcgagaacguguucggcagcgccgagaucaucgccagccugagcgugaaggagcccaccagaaucgagcugacccccaagagaaccgagcugaccgugggcgagagcaucgugcugaacugcaaggccauccacgacgccagccuggacgugaccuucuacuggacccugaagggccagcccaucgacuucgaggaggagggcggccacuucgagagcaucagagcccaggccagcagcgccgaccugaugaucagaaacauccugcugaugcacgccggcagauacggcugcagagugcagaccaccgccgacagcgugagcgacgaggccgagcugcuggugagaggcccccccggcccccccggcaucgugaucguggaggagaucaccgagagcaccgccacccugagcuggagccccgccgccgacaaccacagccccaucagcagcuacaaccugcaggccagaagccccuucagccugggcuggcagaccgugaagaccgugcccgagaucaucaccggcgacauggagagcgccauggccguggaccugaaccccuggguggaguacgaguucagagugguggccaccaaccccaucggcaccggcgaccccagcacccccagcagaaugaucagaaccaacgaggccgugcccaagaccgcccccaccaacgugagcggcagaagcggcagaagacacgagcuggugaucgccugggagcccgugagcgaggaguuccagaacggcgagggcuucggcuacaucguggccuucagacccaacggcaccagaggcuggaaggagaagauggugaccagcagcgaggccagcaaguucaucuacagagacgagagcgugcccccccugacccccuucgaggugaaggugggcguguacaacaacaagggcgacggccccuucagccagaucguggugaucugcagcgccgagggcgagcccagcgccgcccccaccgacgugaaggccaccagcgugagcgugagcgagauccugguggccuggaagcacaucaaggagagccugggcagaccccagggcuucgaggugggcuacuggaaggacauggagcaggaggacaccgccgagaccgugaagaccagaggcaacgagagcuucgugauccugaccggccuggagggcaacacccuguaccacuucaccgugagagccuacaacggcgccggcuacggcccccccagcagcgaggugagcgccaccaccaagaagagcccccccagccaggcccccagcaaccugagaugggagcagcagggcagccaggugagccugggcugggagcccgugaucccccuggccaacgagagcgagguggugggcuacaagguguucuacagacaggagggccacagcaacagccaggugaucgagacccagaagcugcaggccguggugccccugcccgacgccggcguguacaucaucgaggugagagccuacagcgagggcggcgacggcaccgccagcagccagaucagagugcccagcuacagcggcggcaagaucaccagcgcccagagcacccugcacagccugagcaccagcagcagcagcgugacccugcugcuggcccugaugauccccagcaccagcugguaa

SEQ ID NO: 15427 - RNA, 2871 nt, Artificial Sequence
  CNTN6__Homo_sapiens__NP_001276010
augagcuaccacuacagacuggacggcggcagccuggccaucaacagcccccacaccgaccaggacaucggcauguaccagugccuggccaccaaccugcugggcaccauccugagcagaaaggccaagcugcaguucgccuacaucgaggacuucgagaccaagaccagaagcaccgugagcgugagagagggccagggcguggugcugcugugcggcccccccccccacuucggcgaccugagcuacgccuggaccuucaacgacaacccccuguacgugcaggaggacaacagaagauucgugagccaggagaccggcaaccuguacaucgccaagguggagcccagcgacgugggcaacuacaccugcuucaucaccaacaaggaggcccagagaagcgugcagggcccccccaccccccuggugcagagaaccgacggcgugaugggcgaguacgagcccaagaucgaggugagauuccccgagaccauccaggccgccaaggacagcagcgugaagcuggagugcuucgcccugggcaaccccgugcccgacaucagcuggagaagacuggacggcagcccccugcccggcaaggugaaguacagcaagagccaggccauccuggagauccccaacuuccagcaggaggacgagggcuucuacgagugcaucgccagcaaccugagaggcagaaaccuggccaagggccagcugaucuucuacgccccccccgagugggagcagaagauccagaacacccaccugagcaucuacgacaaccugcugugggagugcaaggccagcggcaagcccaaccccugguacaccuggcugaagaacggcgagagacugaaccccgaggagagaauccagaucgagaacggcacccugaucaucaccaugcugaacgugagcgacagcggcguguaccagugcgccgccgagaacaaguaccagaucaucuacgccaacgccgagcugagagugcuggccagcgcccccgacuucagcaagagccccgugaagaagaagagcuucgugcaggugggcggcgacaucgugaucggcugcaagcccaacgccuuccccagagccgccaucagcuggaagagaggcaccgagacccugagacagagcaagagaaucuuccugcuggaggacggcagccugaagaucuacaacaucaccagaagcgacgccggcagcuacaccugcaucgccaccaaccaguucggcaccgccaagaacaccggcagccugaucgugaaggagagaaccgugaucaccgugccccccagcaagauggacgugaccgugggcgagagcaucgugcugcccugccaggugagccacgaccccagcaucgaggugguguucgugugguucuucaacggcgacgugaucgaccugaagaagggcguggcccacuucgagagaaucggcggcgagagcgugggcgaccugaugaucagaaacauccagcugcaccacagcggcaaguaccugugcaccgugcagaccacccuggagagccugagcgccguggccgacaucaucgugagaggcccccccggcccccccgaggacgugcagguggaggacaucagcagcaccaccagccagcugagcuggagagccggccccgacaacaacagccccauccagaucuucaccauccagaccagaacccccuucagcgugggcuggcaggccguggccaccgugcccgagauccugaacggcaagaccuacaacgccaccguggugggccugagccccuggguggaguacgaguucagagugguggccggcaacagcaucggcaucggcgagcccagcgagcccagcgagcugcugagaaccaaggccagcgugcccgugguggcccccgugaacauccacggcggcggcggcagcagaagcgagcuggugaucaccugggagagcauccccgaggagcugcagaacggcgagggcuucggcuacaucaucauguucagacccgugggcagcaccaccuggagcaaggagaaggugagcagcguggagagcagcagauucguguacagaaacgagagcaucaucccccugagccccuucgaggugaaggugggcguguacaacaacgagggcgagggcagccugagcaccgugaccaucguguacagcggcgaggacgagccccagcuggcccccagaggcaccagccugcagagcuucagcgccagcgagauggaggugagcuggaacgccaucgccuggaacagaaacaccggcagagugcugggcuacgaggugcuguacuggaccgacgacagcaaggagagcaugaucggcaagaucagagugagcggcaacgugaccaccaagaacaucaccggccugaaggccaacaccaucuacuucgccagcgugagagccuacaacaccgccggcaccggccccagcagcccccccgugaacgugaccaccaagaagagcccccccagccagccccccgccaacaucgccuggaagcugaccaacagcaagcugugccugaacugggagcacgugaagaccauggagaacgagagcgaggugcugggcuacaagauccuguacagacagaacagacagagcaagacccacauccuggagaccaacaacaccagcgccgagcugcuggugcccuucgaggaggacuaccugaucgagaucagaaccgugagcgacggcggcgacggcagcagcagcgaggagaucagaauccccaagaugagcagccugagcagcagaggcauccaguuccuggagcccagcacccacuuccugagcaucgugaucgugaucuuccacugcuucgccauccagccccugaucuaa

SEQ ID NO: 15428 - RNA, 4155 nt, Artificial Sequence
  CNTNAP1__Homo_sapiens__NP_003623
augaugcaccugagacuguucugcauccugcuggccgccgugagcggcgccgagggcuggggcuacuacggcugcgacgaggagcuggugggcccccuguacgccagaagccugggcgccagcagcuacuacagccugcugaccgcccccagauucgccagacugcacggcaucagcggcuggagccccagaaucggcgaccccaaccccuggcugcagaucgaccugaugaagaagcacagaaucagagccguggccacccagggcagcuucaacagcugggacugggugaccagauacaugcugcuguacggcgacagaguggacagcuggacccccuucuaccagagaggccacaacagcaccuucuucggcaacgugaacgagagcgccguggugagacacgaccugcacuuccacuucaccgccagauacaucagaaucgugccccuggccuggaaccccagaggcaagaucggccugagacugggccuguacggcugccccuacaaggccgacauccuguacuucgacggcgacgacgccaucagcuacagauuccccagaggcgugagcagaagccugugggacguguucgccuucagcuucaagaccgaggagaaggacggccugcugcugcacgccgagggcgcccagggcgacuacgugacccuggagcuggagggcgcccaccugcugcugcacaugagccugggcagcagccccauccagcccagacccggccacaccaccgugagcgccggcggcgugcugaacgaccagcacuggcacuacgugagaguggacagauucggcagagacgugaacuucacccuggacggcuacgugcagagauucauccugaacggcgacuucgagagacugaaccuggacaccgagauguucaucggcggccuggugggcgccgccagaaagaaccuggccuacagacacaacuucagaggcugcaucgagaacgugaucuucaacagagugaacaucgccgaccuggccgugagaagacacagcagaaucaccuucgagggcaagguggccuucagaugccuggaccccgugccccaccccaucaacuucggcggcccccacaacuucgugcaggugcccggcuuccccagaagaggcagacuggccgugagcuucagauucagaaccugggaccugaccggccugcugcuguucagcagacugggcgacggccugggccacguggagcugacccugagcgagggccaggugaacgugagcaucgcccagagcggcagaaagaagcugcaguucgccgccggcuacagacugaacgacggcuucuggcacgaggugaacuucguggcccaggagaaccacgccgugaucagcaucgacgacguggagggcgccgaggugagagugagcuacccccugcugaucagaaccggcaccagcuacuucuucggcggcugccccaagcccgccagcagaugggacugccacagcaaccagaccgccuuccacggcugcauggagcugcugaagguggacggccagcuggugaaccugacccugguggagggcagaagacugggcuucuacgccgaggugcuguucgacaccugcggcaucaccgacagaugcagccccaacaugugcgagcacgacggcagaugcuaccagagcugggacgacuucaucugcuacugcgagcugaccggcuacaagggcgagaccugccacaccccccuguacaaggagagcugcgaggccuacagacugagcggcaagaccagcggcaacuucaccaucgaccccgacggcagcggcccccugaagcccuucgugguguacugcgacaucagagagaacagagccuggaccguggugagacacgacagacuguggaccaccagagugaccggcagcagcauggagagacccuuccugggcgccauccaguacuggaacgccagcugggaggaggugagcgcccuggccaacgccagccagcacugcgagcaguggaucgaguucagcugcuacaacagcagacugcugaacaccgccggcggcuaccccuacagcuucuggaucggcagaaacgaggagcagcacuucuacuggggcggcagccagcccggcauccagagaugcgccugcggccuggacagaagcugcguggaccccgcccuguacugcaacugcgacgccgaccagccccaguggagaaccgacaagggccugcugaccuucguggaccaccugcccgugacccagguggugaucggcgacaccaacagaagcaccagcgaggcccaguucuuccugagaccccugagaugcuacggcgacagaaacagcuggaacaccaucagcuuccacaccggcgccgcccugagauucccccccaucagagccaaccacagccuggacgugagcuucuacuucagaaccagcgcccccagcggcguguuccuggagaacaugggcggccccuacugccaguggagaagacccuacgugagaguggagcugaacaccagcagagacgugguguucgccuucgacgugggcaacggcgacgagaaccugaccgugcacagcgacgacuucgaguucaacgacgacgaguggcaccuggugagagccgagaucaacgugaagcaggccagacugagaguggaccacagacccugggugcugagacccaugccccugcagaccuacaucuggauggaguacgaccagccccuguacgugggcagcgccgagcugaagagaagacccuucgugggcugccugagagccaugagacugaacggcgugacccugaaccuggagggcagagccaacgccagcgagggcaccagccccaacugcaccggccacugcgcccaccccagacugcccugcuuccacggcggcagaugcguggagagauacagcuacuacaccugcgacugcgaccugaccgccuucgacggccccuacugcaaccacgacaucggcggcuucuucgagcccggcaccuggaugagauacaaccugcagagcgcccugagaagcgccgccagagaguucagccacaugcugagcagacccgugcccggcuacgagcccggcuacauccccggcuacgacacccccggcuacgugcccggcuaccacggccccggcuacagacugcccgacuaccccagacccggcagacccgugcccggcuacagaggccccguguacaacgugaccggcgaggaggugagcuucagcuucagcaccagcagcgcccccgccgugcugcuguacgugagcagcuucgugagagacuacauggccgugcugaucaaggacgacggcacccugcagcugagauaccagcugggcaccagccccuacguguaccagcugaccaccagacccgugaccgacggccagccccacagcaucaacaucaccagaguguacagaaaccuguucauccagguggacuacuucccccugaccgagcagaaguucagccugcugguggacagccagcuggacagccccaaggcccuguaccugggcagagugauggagaccggcgugaucgaccccgagauccagagauacaacacccccggcuucagcggcugccugagcggcgugagauucaacaacguggccccccugaagacccacuucagaacccccagacccaugaccgccgagcuggccgaggcccugagagugcagggcgagcugagcgagagcaacugcggcgccaugcccagacuggugagcgaggugccccccgagcuggaccccugguaccugccccccgacuuccccuacuaccacgacgagggcuggguggccauccugcugggcuuccugguggccuuccugcugcugggccuggugggcaugcuggugcuguucuaccugcagaaccacagauacaagggcagcuaccacaccaacgagcccaaggccgcccacgaguaccaccccggcagcaagcccccccugcccaccagcggccccgcccaggugcccacccccaccgccgcccccaaccaggcccccgccagcgcccccgcccccgcccccacccccgcccccgcccccggccccagagaccagaaccugccccagauccuggaggagagcagaagcgaguaa

SEQ ID NO: 15429 - RNA, 3996 nt, Artificial Sequence
  CNTNAP2__Homo_sapiens__NP_054860
augcaggccgcccccagagccggcugcggcgccgcccugcugcuguggaucgugagcagcugccugugcagagccuggaccgcccccagcaccagccagaagugcgacgagccccuggugagcggccugccccacguggccuucagcagcagcagcagcaucagcggcagcuacagccccggcuacgccaagaucaacaagagaggcggcgccggcggcuggagccccagcgacagcgaccacuaccaguggcugcagguggacuucggcaacagaaagcagaucagcgccaucgccacccagggcagauacagcagcagcgacugggugacccaguacagaaugcuguacagcgacaccggcagaaacuggaagcccuaccaccaggacggcaacaucugggccuuccccggcaacaucaacagcgacggcguggugagacacgagcugcagcaccccaucaucgccagauacgugagaaucgugccccuggacuggaacggcgagggcagaaucggccugagaaucgagguguacggcugcagcuacugggccgacgugaucaacuucgacggccacguggugcugcccuacagauucagaaacaagaagaugaagacccugaaggacgugaucgcccugaacuucaagaccagcgagagcgagggcgugauccugcacggcgagggccagcagggcgacuacaucacccuggagcugaagaaggccaagcuggugcugagccugaaccugggcagcaaccagcugggccccaucuacggccacaccagcgugaugaccggcagccugcuggacgaccaccacuggcacagcguggugaucgagagacagggcagaagcaucaaccugacccuggacagaagcaugcagcacuucagaaccaacggcgaguucgacuaccuggaccuggacuacgagaucaccuucggcggcauccccuucagcggcaagcccagcagcagcagcagaaagaacuucaagggcugcauggagagcaucaacuacaacggcgugaacaucaccgaccuggccagaagaaagaagcuggagcccagcaacgugggcaaccugagcuucagcugcguggagcccuacaccgugcccguguucuucaacgccaccagcuaccuggaggugcccggcagacugaaccaggaccuguucagcgugagcuuccaguucagaaccuggaaccccaacggccugcugguguucagccacuucgccgacaaccugggcaacguggagaucgaccugaccgagagcaaggugggcgugcacaucaacaucacccagaccaagaugagccagaucgacaucagcagcggcagcggccugaacgacggccaguggcacgaggugagauuccuggccaaggagaacuucgccauccugaccaucgacggcgacgaggccagcgccgugagaaccaacagcccccugcaggugaagaccggcgagaaguacuucuucggcggcuuccugaaccagaugaacaacagcagccacagcgugcugcagcccagcuuccagggcugcaugcagcugauccagguggacgaccagcuggugaaccuguacgagguggcccagagaaagcccggcagcuucgccaacgugagcaucgacaugugcgccaucaucgacagaugcgugcccaaccacugcgagcacggcggcaagugcagccagaccugggacagcuucaagugcaccugcgacgagaccggcuacagcggcgccaccugccacaacagcaucuacgagcccagcugcgaggccuacaagcaccugggccagaccagcaacuacuacuggaucgaccccgacggcagcggcccccugggcccccugaagguguacugcaacaugaccgaggacaagguguggaccaucgugagccacgaccugcagaugcagacccccguggugggcuacaaccccgagaaguacagcgugacccagcugguguacagcgccagcauggaccagaucagcgccaucaccgacagcgccgaguacugcgagcaguacgugagcuacuucugcaagaugagcagacugcugaacacccccgacggcagccccuacaccuggugggugggcaaggccaacgagaagcacuacuacuggggcggcagcggccccggcauccagaagugcgccugcggcaucgagagaaacugcaccgaccccaaguacuacugcaacugcgacgccgacuacaagcaguggagaaaggacgccggcuuccugagcuacaaggaccaccugcccgugagccaggugguggugggcgacaccgacagacagggcagcgaggccaagcugagcgugggcccccugagaugccagggcgacagaaacuacuggaacgccgccagcuuccccaaccccagcagcuaccugcacuucagcaccuuccagggcgagaccagcgccgacaucagcuucuacuucaagacccugacccccuggggcguguuccuggagaacaugggcaaggaggacuucaucaagcuggagcugaagagcgccaccgaggugagcuucagcuucgacgugggcaacggccccguggagaucguggugagaagccccaccccccugaacgacgaccaguggcacagagugaccgccgagagaaacgugaagcaggccagccugcagguggacagacugccccagcagaucagaaaggcccccaccgagggccacaccagacuggagcuguacagccagcuguucgugggcggcgccggcggccagcagggcuuccugggcugcaucagaagccugagaaugaacggcgugacccuggaccuggaggagagagccaaggugaccagcggcuucaucagcggcugcagcggccacugcaccagcuacggcaccaacugcgagaacggcggcaagugccuggagagauaccacggcuacagcugcgacugcagcaacaccgccuacgacggcaccuucugcaacaaggacgugggcgccuucuucgaggagggcauguggcugagauacaacuuccaggcccccgccaccaacgccagagacagcagcagcagaguggacaacgcccccgaccagcagaacagccaccccgaccuggcccaggaggagaucagauucagcuucagcaccaccaaggcccccugcauccugcuguacaucagcagcuucaccaccgacuuccuggccgugcuggugaagcccaccggcagccugcagaucagauacaaccugggcggcaccagagagcccuacaacaucgacguggaccacagaaacauggccaacggccagccccacagcgugaacaucaccagacacgagaagaccaucuuccugaagcuggaccacuaccccagcgugagcuaccaccugcccagcagcagcgacacccuguucaacagccccaagagccuguuccugggcaaggugaucgagaccggcaagaucgaccaggagauccacaaguacaacacccccggcuucaccggcugccugagcagagugcaguucaaccagaucgccccccugaaggccgcccugagacagaccaacgccagcgcccacgugcacauccagggcgagcugguggagagcaacugcggcgccagcccccugacccugagccccaugagcagcgccaccgaccccuggcaccuggaccaccuggacagcgccagcgccgacuuccccuacaaccccggccagggccaggccaucagaaacggcgugaacagaaacagcgccaucaucggcggcgugaucgccguggugaucuucaccauccugugcacccugguguuccugaucagauacauguucagacacaagggcaccuaccacaccaacgaggccaagggcgccgagagcgccgagagcgccgacgccgccaucaugaacaacgaccccaacuucaccgagaccaucgacgagagcaagaaggaguggcugaucuaa

SEQ ID NO: 15430 - RNA, 3867 nt, Artificial Sequence
  CNTNAP3__Homo_sapiens__NP_387504
auggccagcguggccugggccgugcugaaggugcugcugcugcugcccacccagaccuggagccccgugggcgccggcaacccccccgacugcgacgccccccuggccagcgcccugcccagaagcagcuucagcagcagcagcgagcugagcagcagccacggccccggcuucagcagacugaacagaagagacggcgccggcggcuggaccccccuggugagcaacaaguaccaguggcugcagaucgaccugggcgagagaauggaggugaccgccguggccacccagggcggcuacggcagcagcgacugggugaccagcuaccugcugauguucagcgacggcggcagaaacuggaagcaguacagaagagaggagagcaucuggggcuuccccggcaacaccaacgccgacagcguggugcacuacagacugcagccccccuucgaggccagauuccugagauuccugccccuggccuggaaccccagaggcagaaucggcaugagaaucgagguguacggcugcgccuacaagagcgaggugguguacuucgacggccagagcgcccugcuguacagacuggacaagaagccccugaagcccaucagagacgugaucagccugaaguucaaggccaugcagagcaacggcauccugcugcacagagagggccagcacggcaaccacaucacccuggagcugaucaagggcaagcugguguucuuccugaacagcggcaacgccaagcugcccagcaccaucgcccccgugacccugacccugggcagccugcuggacgaccagcacuggcacagcgugcugaucgagcugcuggacacccaggugaacuucaccguggacaagcacacccaccacuuccaggccaagggcgacagcagcuaccuggaccugaacuucgagaucagcuucggcggcauccccacccccggcagaagcagagccuucagaagaaagagcuuccacggcugccuggagaaccuguacuacaacggcguggacgugaccgagcuggccaagaagcacaagccccagauccugaugaugggcaacgugagcuucagcugcccccagccccagaccgugcccgugaccuuccugagcagcagaagcuaccuggcccugcccggcaacagcggcgaggacaaggugagcgugaccuuccaguucagaaccuggaacagagccggccaccugcuguucggcgagcugagaagaggcagcggcagcuucgugcuguuccugaaggacggcaagcugaagcugagccuguuccagcccggccagagccccagaaacgugaccgccggcgccggccugaacgacggccaguggcacagcgugagcuucagcgccaaguggagccacaugaacguggugguggacgacgacaccgccgugcagccccugguggccgugcugaucgacagcggcgacaccuacuacuucggcggcugccuggacaacagcagcggcagcggcugcaagagcccccugggcggcuuccagggcugccugagacugaucaccaucggcgacaaggccguggaccccauccuggugcagcagggcgcccugggcagcuucagagaccugcagaucgacagcugcggcaucaccgacagaugccugcccagcuacugcgagcacggcggcgagugcagccagagcugggacaccuucagcugcgacugccugggcaccggcuacaccggcgagaccugccacagcagccuguacgagcagagcugcgaggcccacaagcacagaggcaaccccagcggccuguacuacaucgacgccgacggcagcggcccccugggccccuuccugguguacugcaacaugaccgccgacgccgccuggaccguggugcagcacggcggccccgacgccgugacccugagaggcgcccccagcggccaccccagaagcgccgugagcuucgccuacgccgccggcgccggccagcugagaagcgccgugaaccuggccgagagaugcgagcagagacuggcccugagaugcggcaccgccagaagacccgacagcagagacggcaccccccugagcuggugggugggcagaaccaacgagacccacaccagcuggggcggcagccugcccgacgcccagaagugcaccugcggccuggagggcaacugcaucgacagccaguacuacugcaacugcgacgccggcagaaacgaguggaccagcgacaccaucgugcugagccagaaggagcaccugcccgugacccagaucgugaugaccgacgccggcagaccccacagcgaggccgccuacacccugggcccccugcugugcagaggcgaccagagcuucuggaacagcgccagcuucaacaccgagaccagcuaccugcacuuccccgccuuccacggcgagcugaccgccgacgugugcuucuucuucaagaccaccgugagcagcggcguguucauggagaaccugggcaucaccgacuucaucagaaucgagcugagagcccccaccgaggugaccuucagcuucgacgugggcaacggccccugcgaggugaccgugcagagccccacccccuucaacgacaaccaguggcaccacgugagagccgagagaaacgugaagggcgccagccugcagguggaccagcugccccagaagaugcagcccgcccccgccgacggccacgugagacugcagcugaacagccagcuguucaucggcggcaccgccaccagacagagaggcuuccugggcugcaucagaagccugcagcugaacggcguggcccuggaccuggaggagagagccaccgugacccccggcguggagcccggcugcgccggccacugcagcaccuacggccaccugugcagaaacggcggcagaugcagagagaagagaagaggcgugaccugcgacugcgccuucagcgccuacgacggccccuucugcagcaacgagaucagcgccuacuucgccaccggcagcagcaugaccuaccacuuccaggagcacuacacccugagcgagaacagcagcagccuggugagcagccugcacagagacgugacccugaccagagagaugaucacccugagcuucagaaccaccagaacccccagccugcugcuguacgugagcagcuucuacgaggaguaccugagcgugauccuggccaacaacggcagccugcagaucagauacaagcuggacagacaccagaaccccgacgccuucaccuucgacuucaagaacauggccgacggccagcugcaccaggugaagaucaacagagaggaggccguggugaugguggaggugaaccagagcaccaagaagcaggugauccugagcagcggcaccgaguucaacgccgugaagagccugauccugggcaaggugcuggaggccgccggcgccgaccccgacaccagaagagccgccaccagcggcuucaccggcugccugagcgccgugagauucggcagagccgccccccugaaggccgcccugagacccagcggccccagcagagugaccgugagaggccacguggcccccauggccagaugcgccgccggcgccgccagcggcagccccgccagagagcuggcccccagacuggccggcggcgccggcagaagcggccccgccgacgagggcgagccccuggugaacgccgacagaagagacagcgccgugaucggcggcgugaucgccguggugaucuucauccugcugugcaucaccgccaucgccaucagaaucuaccagcagagaaagcugagaaaggagaacgagagcaaggugagcaagaaggaggagugcuaa

SEQ ID NO: 15431 - RNA, 3927 nt, Artificial Sequence
  CNTNAP4__Homo_sapiens__NP_207837
augggcagcgugaccggcgccgugcugaagacccugcugcugcugagcacccagaacuggaacagaguggaggccggcaacagcuacgacugcgacgacccccuggugagcgcccugccccaggccagcuucagcagcagcagcgagcugagcagcagccacggccccggcuucgccagacugaacagaagagacggcgccggcggcuggagcccccuggugagcaacaaguaccaguggcugcagaucgaccugggcgagagaauggaggugaccgccguggccacccagggcggcuacggcagcagcaacugggugaccagcuaccugcugauguucagcgacagcggcuggaacuggaagcaguacagacaggaggacagcaucuggggcuucagcggcaacgccaacgccgacagcgugguguacuacagacugcagcccagcaucaaggccagauuccugagauucaucccccuggaguggaaccccaagggcagaaucggcaugagaaucgagguguucggcugcgccuacagaagcgaggugguggaccuggacggcaagagcagccugcuguacagauucgaccagaagagccugagccccaucaaggacaucaucagccugaaguucaagaccaugcagagcgacggcauccugcugcacagagagggccccaacggcgaccacaucacccugcagcugagaagagccagacuguuccugcugaucaacagcggcgaggccaagcugcccagcaccagcacccuggugaaccugacccugggcagccugcuggacgaccagcacuggcacagcgugcugauccagagacugggcaagcaggugaacuucaccguggacgagcacagacaccacuuccacgccagaggcgaguucaaccugaugaaccuggacuacgagaucagcuucggcggcauccccgcccccggcaagagcgugagcuucccccacagaaacuuccacggcugccuggagaaccuguacuacaacggcguggacaucaucgaccuggccaagcagcagaagccccagaucaucgccaugggcaacgugagcuucagcugcagccagccccagagcaugcccgugaccuuccugagcagcagaagcuaccuggcccugcccgacuucagcggcgaggaggaggugagcgccaccuuccaguucagaaccuggaacaaggccggccugcugcuguucagcgagcugcagcugaucagcggcggcauccugcuguuccugagcgacggcaagcugaagagcaaccuguaccagcccggcaagcugcccagcgacaucaccgccggcguggagcugaacgacggccaguggcacagcgugagccugagcgccaagaagaaccaccugagcguggccguggacggccagauggccagcgccgccccccugcugggccccgagcagaucuacagcggcggcaccuacuacuucggcggcugccccgacaagagcuucggcagcaagugcaagagcccccugggcggcuuccagggcugcaugagacugaucagcaucagcggcaaggugguggaccugaucagcgugcagcagggcagccugggcaacuucagcgaccugcagaucgacagcugcggcaucagcgacagaugccugcccaacuacugcgagcacggcggcgagugcagccagagcuggagcaccuuccacugcaacugcaccaacaccggcuacagaggcgccaccugccacaacagcaucuacgagcagagcugcgaggccuacaagcacagaggcaacaccagcggcuucuacuacaucgacagcgacggcagcggcccccuggagcccuuccugcuguacugcaacaugaccgagaccgccuggaccaucauccagcacaacggcagcgaccugaccagagugagaaacaccaaccccgagaaccccuacgccggcuucuucgaguacguggccagcauggagcagcugcaggccaccaucaacagagccgagcacugcgagcaggaguucaccuacuacugcaagaagagcagacuggugaacaagcaggacggcaccccccugagcuggugggugggcagaaccaacgagacccagaccuacuggggcggcagcagccccgaccugcagaagugcaccugcggccuggagggcaacugcaucgacagccaguacuacugcaacugcgacgccgacagaaacgaguggaccaacgacaccggccugcuggccuacaaggagcaccugcccgugaccaagaucgugaucaccgacaccggcagacugcacagcgaggccgccuacaagcugggcccccugcugugccagggcgacagaagcuucuggaacagcgccagcuucgacaccgaggccagcuaccugcacuuccccaccuuccacggcgagcugagcgccgacgugagcuucuucuucaagaccaccgccagcagcggcguguuccuggagaaccugggcaucgccgacuucaucagaaucgagcugagaagccccaccguggugaccuucagcuucgacgugggcaacggccccuucgagaucagcgugcagagccccacccacuucaacgacaaccaguggcaccacgugagaguggagagaaacaugaaggaggccagccugcagguggaccagcugacccccaagacccagcccgcccccgccgacggccacgugcugcugcagcugaacagccagcuguucgugggcggcaccgccaccagacagagaggcuuccugggcugcaucagaagccugcagcugaacggcaugacccuggaccuggaggagagagcccaggugacccccgaggugcagcccggcugcagaggccacugcagcagcuacggcaagcugugcagaaacggcggcaagugcagagagagacccaucggcuucuucugcgacugcaccuucagcgccuacaccggccccuucugcagcaacgagaucagcgccuacuucggcagcggcagcagcgugaucuacaacuuccaggagaacuaccugcugagcaagaacagcagcagccacgccgccagcuuccacggcgacaugaagcugagcagagagaugaucaaguucagcuucagaaccaccagaacccccagccugcugcuguucgugagcagcuucuacaaggaguaccugagcgugaucaucgccaagaacggcagccugcagaucagauacaagcugaacaaguaccaggagcccgacguggugaacuucgacuucaagaacauggccgacggccagcugcaccacaucaugaucaacagagaggagggcgugguguucaucgagaucgacgacaacagaagaagacaggugcaccugagcagcggcaccgaguucagcgccgugaagagccuggugcugggcagaauccuggagcacagcgacguggaccaggacaccgcccuggccggcgcccagggcuucaccggcugccugagcgccgugcagcugagccacguggccccccugaaggccgcccugcaccccagccaccccgaccccgugaccgugaccggccacgugaccgagagcagcugcauggcccagcccggcaccgacgccaccagcagagagagaacccacagcuucgccgaccacagcggcaccaucgacgacagagagccccuggccaacgccaucaagagcgacagcgccgugaucggcggccugaucgccguggugaucuucauccugcugugcaucaccgccaucgccgugagaaucuaccagcagaagagacuguacaagagaagcgaggccaagagaagcgagaacguggacagcgccgaggccgugcugaagagcgagcugaacauccagaacgccgugaacgagaaccagaaggaguacuucuucuaa

SEQ ID NO: 15432 - RNA, 3921 nt, Artificial Sequence
  CNTNAP5__Homo_sapiens__NP_570129
auggacagccugcccagacugaccagcgugcugacccugcuguucagcggccuguggcaccugggccugaccgccaccaacuacaacugcgacgacccccuggccagccugcugagccccauggccuucagcagcagcagcgaccugaccggcacccacagccccgcccagcugaacuggagagugggcaccggcggcuggagccccgccgacagcaacgcccagcaguggcugcagauggaccugggcaacagaguggagaucaccgccguggccacccagggcagauacggcagcagcgacugggugaccagcuacagccugauguucagcgacaccggcagaaacuggaagcaguacaagcaggaggacagcaucuggaccuucgccggcaacaugaacgccgacagcguggugcaccacaagcugcugcacagcgugagagccagauucgugagauucgugccccuggaguggaaccccagcggcaagaucggcaugagaguggagguguacggcugcagcuacaagagcgacguggccgacuucgacggcagaagcagccugcuguacagauucaaccagaagcugaugagcacccugaaggacgugaucagccugaaguucaagagcaugcagggcgacggcgugcuguuccacggcgagggccagagaggcgaccacaucacccuggagcugcagaagggcagacuggcccugcaccugaaccugggcgacagcaaggccagacugagcagcagccugcccagcgccacccugggcagccugcuggacgaccagcacuggcacagcgugcugaucgagagagugggcaagcaggugaacuucaccguggacaagcacacccagcacuucagaaccaagggcgagaccgacgcccuggacaucgacuacgagcugagcuucggcggcauccccgugcccggcaagcccggcaccuuccugaagaagaacuuccacggcugcaucgagaaccuguacuacaacggcgugaacaucaucgaccuggccaagagaagaaagcaccagaucuacaccggcaacgugaccuucagcugcagcgagccccagaucgugcccaucaccuucgugaacagcagcggcagcuaccugcugcugcccggcaccccccagaucgacggccugagcgugagcuuccaguucagaaccuggaacaaggacggccugcugcugagcaccgagcugagcgagggcagcggcacccugcugcugagccuggagggcggcauccugagacuggugauccagaagaugaccgagagaguggccgagauccugaccggcagcaaccugaacgacggccuguggcacagcgugagcaucaacgccagaagaaacagaaucacccugacccuggacgacgaggccgccccccccgcccccgacagcaccugggugcagaucuacagcggcaacagcuacuacuucggcggcugccccgacaaccugaccgacagccagugccugaaccccaucaaggccuuccagggcugcaugagacugaucuucaucgacaaccagcccaaggaccugaucagcgugcagcagggcagccugggcaacuucagcgaccugcacaucgaccugugcagcaucaaggacagaugccugcccaacuacugcgagcacggcggcagcugcagccagagcuggaccaccuucuacugcaacugcagcgacaccagcuacaccggcgccaccugccacaacagcaucuacgagcagagcugcgagguguacagacaccagggcaacaccgccggcuucuucuacaucgacagcgacggcagcggcccccugggcccccugcagguguacugcaacaucaccgaggacaagaucuggaccagcgugcagcacaacaacaccgagcugaccagagugagaggcgccaaccccgagaagcccuacgccauggcccuggacuacggcggcagcauggagcagcuggaggccgugaucgacggcagcgagcacugcgagcaggagguggccuaccacugcagaagaagcagacugcugaacacccccgacggcacccccuucaccugguggaucggcagaagcaacgagagacaccccuacuggggcggcagcccccccggcgugcagcagugcgagugcggccuggacgagagcugccuggacauccagcacuucugcaacugcgacgccgacaaggacgaguggaccaacgacaccggcuuccugagcuucaaggaccaccugcccgugacccagaucgugaucaccgacaccgacagaagcaacagcgaggccgccuggagaaucggcccccugagaugcuacggcgacagaagauucuggaacgccgugagcuucuacaccgaggccagcuaccugcacuuccccaccuuccacgccgaguucagcgccgacaucagcuucuucuucaagaccaccgcccugagcggcguguuccuggagaaccugggcaucaaggacuucaucagacuggagaucagcagccccagcgagaucaccuucgccaucgacgugggcaacggccccguggagcugguggugcagagccccagccugcugaacgacaaccaguggcacuacgugagagccgagagaaaccugaaggagaccagccugcagguggacaaccugcccagaagcaccagagagaccagcgaggagggccacuucagacugcagcugaacagccagcuguucgugggcggcaccagcagcagacagaagggcuuccugggcugcaucagaagccugcaccugaacggccagaagauggaccuggaggagagagccaaggugaccagcggcgugagacccggcugccccggccacugcagcagcuacggcagcaucugccacaacggcggcaagugcguggagaagcacaacggcuaccugugcgacugcaccaacagccccuacgagggccccuucugcaagaaggaggugagcgccguguucgaggccggcaccagcgugaccuacauguuccaggagcccuaccccgugaccaagaacaucagccugagcagcagcgccaucuacaccgacagcgcccccagcaaggagaacaucgcccugagcuucgugaccacccaggcccccagccugcugcuguucaucaacagcagcagccaggacuucgugguggugcugcugugcaagaacggcagccugcaggugagauaccaccugaacaaggaggagacccacguguucaccaucgacgccgacaacuucgccaacagaagaaugcaccaccugaagaucaacagagagggcagagagcugaccauccagauggaccagcagcugagacugagcuacaacuucagccccgagguggaguucagagugaucagaagccugacccugggcaaggugaccgagaaccugggccuggacagcgagguggccaaggccaacgccaugggcuucgccggcugcaugagcagcgugcaguacaaccacaucgccccccugaaggccgcccugagacacgccaccguggcccccgugaccgugcacggcacccugaccgagagcagcugcggcuucaugguggacagcgacgugaacgccgugaccaccgugcacagcagcagcgaccccuucggcaagaccgacgagagagagccccugaccaacgccgugagaagcgacagcgccgugaucggcggcgugaucgccguggugaucuucaucaucuucugcaucaucggcaucaugaccagauuccuguaccagcacaagcagagccacagaaccagccagaugaaggagaaggaguaccccgagaaccuggacagcagcuucagaaacgagaucgaccugcagaacaccgugagcgagugcaagagagaguacuucaucuaa

SEQ ID NO: 15433 - RNA, 6978 nt, Artificial Sequence
  CNTRL__Homo_sapiens__XP_005251736
augaagaagggcagccagcagaagaucuucagcaaggccaagauccccagcagcagccacagccccauccccagcagcaugagcaacaugagaagcagaagccugagcccccugaucggcagcgagacccugcccuuccacagcggcggccaguggugcgagcagguggagaucgccgacgagaacaacaugcugcuggacuaccaggaccacaagggcgccgacagccacgccggcgugagauacaucaccgaggcccugaucaagaagcugaccaagcaggacaaccuggcccugaucaagagccugaaccugagccugagcaaggacggcggcaagaaguucaaguacaucgagaaccuggagaagugcgugaagcuggaggugcugaaccugagcuacaaccugaucggcaagaucgagaagcuggacaagcugcugaagcugagagagcugaaccugagcuacaacaagaucagcaagaucgagggcaucgagaacaugugcaaccugcagaagcugaaccuggccggcaacgagaucgagcacauccccguguggcugggcaagaagcugaagagccugagagugcugaaccugaagggcaacaagaucagcagccugcaggacaucagcaagcugaagccccugcaggaccugaucagccugauccugguggagaaccccguggugacccugccccacuaccugcaguucaccaucuuccaccugagaagccuggagagccuggagggccagcccgugaccacccaggacagacaggaggccuucgagagauucagccuggaggagguggagagacuggagagagaccuggagaagaagaugaucgagaccgaggagcugaagagcaagcagaccagauuccuggaggagaucaagaaccaggacaagcugaacaagagccugaaggaggaggccaugcugcagaagcagagcugcgaggagcugaagagcgaccugaacaccaagaacgagcugcugaagcagaagaccaucgagcugaccagagccugccagaagcaguacgagcuggagcaggagcuggccuucuacaagaucgacgccaaguucgagccccugaacuacuaccccagcgaguacgccgagaucgacaaggcccccgacgagagccccuacaucggcaagagcagauacaagagaaacauguucgccaccgagagcuacaucaucgacagcgcccaggccgugcagaucaagaagauggagcccgacgagcagcugagaaacgaccacaugaaccugagaggccacaccccccuggacacccagcuggaggacaaggagaagaagaucagcgccgcccagaccagacugagcgagcugcacgacgagaucgagaaggccgagcagcagauccugagagccaccgaggaguucaagcagcuggaggaggccauccagcugaagaagaucagcgaggccggcaaggaccugcuguacaagcagcugagcggcagacugcagcuggugaacaagcugagacaggaggcccuggaccuggagcugcagauggagaagcagaagcaggagaucgccggcaagcagaaggagaucaaggaccugcagaucgccaucgacagccuggacagcaaggaccccaagcacagccacaugaaggcccagaagagcggcaaggagcagcagcuggacaucaugaacaagcaguaccagcagcuggagagcagacuggacgagauccugagcagaaucgccaaggagaccgaggagaucaaggaccuggaggagcagcugaccgagggccagaucgccgccaacgaggcccugaagaaggaccuggagggcgugaucagcggccugcaggaguaccugggcaccaucaagggccaggccacccaggcccagaacgagugcagaaagcugagagacgagaaggagacccugcugcagagacugaccgagguggagcaggagagagaccagcuggagaucguggccauggacgccgagaacaugagaaaggagcuggccgagcuggagagcgcccugcaggagcagcacgaggugaacgccagccugcagcagacccagggcgaccugagcgccuacgaggccgagcuggaggccagacugaaccugagagacgccgaggccaaccagcugaaggaggagcuggagaaggugaccagacugacccagcuggagcagagcgcccugcaggccgagcuggagaaggagagacaggcccugaagaacgcccugggcaaggcccaguucagcgaggagaaggagcaggagaacagcgagcugcacgccaagcugaagcaccugcaggacgacaacaaccugcugaagcagcagcugaaggacuuccagaaccaccugaaccacgugguggacggccuggugagacccgaggagguggccgccagaguggacgagcugagaagaaagcugaagcugggcaccggcgagaugaacauccacagccccagcgacgugcugggcaagagccuggccgaccugcagaagcaguucagcgagauccuggccagaagcaagugggagagagacgaggcccaggugagagagagaaagcugcaggaggagauggcccugcagcaggagaagcuggccaccggccaggaggaguucagacaggccugcgagagagcccuggaggccagaaugaacuucgacaagagacagcacgaggccagaauccagcagauggagaacgagauccacuaccugcaggagaaccugaagagcauggaggagauccagggccugaccgaccugcagcugcaggaggccgacgaggagaaggagagaauccuggcccagcugagagagcuggagaagaagaagaagcuggaggacgccaagagccaggagcagguguucggccuggacaaggagcugaagaagcugaagaaggccguggccaccagcgacaagcuggccaccgccgagcugaccaucgccaaggaccagcugaagagccugcacggcaccgugaugaagaucaaccaggagagagccgaggagcugcaggaggccgagagauucagcagaaaggccgcccaggccgccagagaccugaccagagccgaggccgagaucgagcugcugcagaaccugcugagacagaagggcgagcaguucagacuggagauggagaagaccggcgugggcaccggcgccaacagccaggugcuggagaucgagaagcugaacgagaccauggagagacagagaaccgagaucgccagacugcagaacgugcuggaccugaccggcagcgacaacaagggcggcuucgagaacgugcuggaggagaucgccgagcugagaagagaggugagcuaccagaacgacuacaucagcagcauggccgaccccuucaagagaagaggcuacugguacuucaugccccccccccccagcagcaaggugagcagccacagcagccaggccaccaaggacagcggcgugggccugaaguacagcgccagcacccccgugagaaagcccagacccggccagcaggacggcaaggagggcagccagcccccccccgccagcggcuacuggguguacagccccaucagaagcggccugcacaagcuguuccccagcagagacgccgacagcggcggcgacagccaggaggagagcgagcuggacgaccaggaggagccccccuucgugcccccccccggcuacaugauguacaccgugcugcccgacggcagccccgugccccagggcauggcccuguacgcccccccccccccccugcccaacaacagcagaccccugacccccggcaccgugguguacggccccccccccgccggcgcccccaugguguacggcccccccccccccaacuucagcauccccuucauccccaugggcgugcugcacugcaacgugcccgagcaccacaaccuggagaacgaggugagcagacuggaggacaucaugcagcaccugaagagcaagaagagagaggagagauggaugagagccagcaagagacagagcgagaaggagauggaggagcugcaccacaacaucgacgaccugcugcaggagaagaagagccuggagugcgagguggaggagcugcacagaaccgugcagaagagacagcagcagaaggacuucaucgacggcaacguggagagccugaugaccgagcuggagaucgagaagagccugaagcaccacgaggacaucguggacgagaucgagugcaucgagaagacccugcugaagagaagaagcgagcugagagaggccgacagacugcuggccgaggccgagagcgagcugagcugcaccaaggagaagaccaagaacgccguggagaaguucaccgacgccaagagaagccugcugcagaccgagagcgacgccgaggagcuggagagaagagcccaggagaccgccgugaaccuggugaaggccgaccagcagcugagaagccugcaggccgacgccaaggaccuggagcagcacaagaucaagcaggaggagauccugaaggagaucaacaagaucguggccgccaaggacagcgacuuccagugccugagcaagaagaaggagaagcugaccgaggagcugcagaagcugcagaaggacaucgagauggccgagagaaacgaggaccaccaccugcaggugcugaaggagagcgaggugcugcugcaggccaagagagccgagcuggagaagcugaagagccaggugaccagccagcagcaggagauggccgugcuggacagacagcugggccacaagaaggaggagcugcaccugcugcagggcagcauggugcaggccaaggccgaccugcaggaggcccugagacugggcgagaccgaggugaccgagaagugcaaccacaucagagaggugaagagccugcuggaggagcugagcuuccagaagggcgagcugaacgugcagaucagcgagagaaagacccagcugacccugaucaagcaggagaucgagaaggaggaggagaaccugcagguggugcugagacagaugagcaagcacaagaccgagcugaagaacauccuggacaugcugcagcuggagaaccacgagcugcagggccugaagcugcagcacgaccagagagugagcgagcuggagaagacccagguggccgugcuggaggagaagcuggagcuggagaaccugcagcagaucagccagcagcagaagggcgagaucgaguggcagaagcagcugcuggagagagacaagagagagaucgagagaaugaccgccgagagcagagcccugcagagcugcguggagugccugagcaaggagaaggaggaccugcaggagaagugcgacaucugggagaagaagcuggcccagaccaagagagugcuggccgccgccgaggagaacagcaagauggagcagagcaaccuggagaagcuggagcugaacgugagaaagcugcagcaggagcuggaccagcugaacagagacaagcugagccugcacaacgacaucagcgccaugcagcagcagcugcaggagaagagagaggccgugaacagccugcaggaggagcuggccaacgugcaggaccaccugaaccuggccaagcaggaccugcugcacaccaccaagcaccaggacgugcugcugagcgagcagaccagacugcagaaggacaucagcgagugggccaacagauucgaggacugccagaaggaggaggagaccaagcagcagcagcugcaggugcugcagaacgagaucgaggagaacaagcugaagcuggugcagcaggagaugauguuccagagacugcagaaggagagagagagcgaggagagcaagcuggagaccagcaaggugacccugaaggagcagcagcaccagcuggagaaggagcugaccgaccagaagagcaagcuggaccaggugcugagcaaggugcuggccgccgaggagagagugagaacccugcaggaggaggagagauggugcgagagccuggagaagacccugagccagaccaagagacagcugagcgagagagagcagcagcugguggagaagagcggcgagcugcuggcccugcagaaggaggccgacagcaugagagccgacuucagccugcugagaaaccaguuccugaccgagagaaagaaggccgagaagcagguggccagccugaaggaggcccugaagauccagagaagccagcuggagaagaaccugcuggagcagaagcaggagaacagcugcauccagaaggagauggccaccaucgagcugguggcccaggacaaccacgagagagccagaagacugaugaaggagcugaaccagaugcaguacgaguacaccgagcugaagaagcagauggccaaccagaaggaccuggagagaagacagauggagaucagcgacgccaugagaacccugaagagcgaggugaaggacgagaucagaaccagccugaagaaccugaaccaguuccugcccgagcugcccgccgaccuggaggccauccuggagagaaacgagaaccuggagggcgagcuggagagccugaaggagaaccugcccuucaccaugaacgagggccccuucgaggagaagcugaacuucagccaggugcacaucauggacgagcacuggagaggcgaggcccugagagagaagcugagacacagagaggacagacugaaggcccagcugagacacugcaugagcaagcaggccgaggugcugaucaagggcaagagacagaccgagggcacccugcacagccugagaagacagguggacgcccugggcgagcuggugaccagcaccagcgccgacagcgccagcagccccagccugagccagcuggagagcagccugaccgaggacagccagcugggccagaaccaggagaagaacgccagcgccagauaa

SEQ ID NO: 15434 - RNA, 2778 nt, Artificial Sequence
  CNTROB__Homo_sapiens__NP_001032221
auggccaccagcgccgacagccccagcagcccccugggcgccgaggaccugcugagcgacagcagcgagccccccggccugaaccaggugagcagcgaggugaccagccagcuguacgccagccugagacugagcagacaggccgaggccaccgccagagcccagcuguaccugcccagcaccagccccccccacgagggccuggacggcuucgcccaggagcugagcagaagccugagcgugggccuggagaagaaccugaagaagaaggacggcagcaagcacaucuucgagauggagagcgugagaggccagcugcagaccaugcugcagaccagcagagacaccgccuacagagacccccugauccccggcgccggcagcgagagaagagaggaggacagcuucgacagcgacagcaccgccacccugcugaacaccagaccccugcaggaccugagccccagcagcagcgcccaggcccuggaggagcuguuccccagauacaccagccugagacccggccccccccugaacccccccgacuuccagggccugagagacgcccuggacagcgagcacaccagaagaaagcacugcgagagacacauccagagccugcagaccagagugcuggagcugcagcagcagcuggccguggccguggccgccgacagaaagaaggacaccaugaucgagcagcuggacaagacccuggccagagugguggagggcuggaacagacacgaggccgagagaaccgaggugcugagaggccugcaggaggagcaccaggccgccgagcugaccagaagcaagcagcaggagaccgugaccagacuggagcagagccugagcgaggccauggaggcccugaacagagagcaggagagcgccagacugcagcagagagagagagagacccuggaggaggagagacaggcccugacccugagacuggaggccgagcagcagagaugcugcgugcugcaggaggagagagacgccgccagagccggccagcugagcgagcacagagagcuggagacccugagagccgcccuggaggaggagagacagaccugggcccagcaggagcaccagcugaaggagcacuaccaggcccugcaggaggagagccaggcccagcuggagagagagaaggagaagagccagagagaggcccaggccgccugggagacccagcaccagcuggcccuggugcagagcgaggugagaagacuggagggcgagcuggacaccgccagaagagagagagacgcccugcagcuggagaugagccuggugcaggccagauacgagagccagagaauccagcuggagagcgagcuggccgugcagcuggagcagagagugaccgagagacuggcccaggcccaggagagcagccugagacaggccgccagccugagagagcaccacagaaagcagcugcaggaccugagcggccagcaccagcaggagcuggccagccagcuggcccaguucaagguggagauggccgagagagaggagagacagcagcagguggccgaggacuacgagcugagacuggccagagagcaggccagagugugcgagcugcagagcggcaaccagcagcuggaggagcagagaguggagcugguggagagacugcaggccaugcugcaggcccacugggacgaggccaaccagcugcugagcaccacccugcccccccccaacccccccgccccccccgccggccccagcagccccggcccccaggagcccgagaaggaggagagaagaguguggaccaugccccccauggccguggcccugaagcccgugcugcagcagagcagagaggccagagacgagcugcccggcgccccccccgugcugugcagcagcagcagcgaccugagccugcugcugggccccagcuuccagagccagcacagcuuccagccccuggagcccaagcccgaccugaccagcagcaccgccggcgccuucagcgcccugggcgccuuccaccccgaccacagagccgagagacccuuccccgaggaggaccccggccccgacggcgagggccugcugaagcagggccugccccccgcccagcuggagggccugaagaacuuccugcaccagcugcuggagaccgugccccagaacaacgagaaccccagcguggaccugcugccccccaagagcggcccccugaccgugcccagcugggaggaggccccccaggugcccagaauccccccccccgugcacaagaccaaggugccccuggccauggccagcagccuguucagagugcccgagccccccagcagccacagccagggcagcggccccagcagcggcagccccgagagaggcggcgacggccugaccuuccccagacagcugauggaggugagccagcugcugagacuguaccaggccagaggcuggggcgcccugcccgccgaggaccugcugcuguaccugaagagacuggagcacagcggcuacaagcccggcagaaaggaggagggcuucagcggcuggaagcuggacuacggcgaguggagcggcaccgacggcagaggcgacaacgugcccagaagaaacaccgacagcagacugggcgagauccccagaaaggagauccccagccaggccgugcccagaagacuggccaccgcccccaagaccgagaagccccccgccagaaagaagagcggccaccccgcccccagcagcaugagaagcagaggcggcguguggagauaa

SEQ ID NO: 15435 - RNA, 441 nt, Artificial Sequence
  COA1__Homo_sapiens__NP_060694
augauguggcagaaguacgccggcagcagaagaagcaugccccugggcgccagaauccuguuccacggcguguucuacgccggcggcuucgccaucguguacuaccugauccagaaguuccacagcagagcccuguacuacaagcuggccguggagcagcugcagagccaccccgaggcccaggaggcccugggccccccccugaacauccacuaccugaagcugaucgacagagagaacuucguggacaucguggacgccaagcugaagauccccgugagcggcagcaagagcgagggccugcuguacgugcacagcagcagaggcggccccuuccagagauggcaccuggacgagguguuccuggagcugaaggacggccagcagauccccguguucaagcugagcggcgagaacggcgacgaggugaagaaggaguaa

SEQ ID NO: 15436 - RNA, 225 nt, Artificial Sequence
  COA5__Homo_sapiens__NP_001008216
augcccaaguacuacgaggacaagccccagggcggcgccugcgccggccugaaggaggaccugggcgccugccugcugcagagcgacugcguggugcaggagggcaagagccccagacagugccugaaggagggcuacugcaacagccugaaguacgccuucuucgagugcaagagaagcgugcuggacaacagagccagauucagaggcagaaagggcuacuaa

SEQ ID NO: 15437 - RNA, 1782 nt, Artificial Sequence
  COASY__Homo_sapiens__NP_001035997
augagaacccccagacugagagcccagcccagaggcgccguguaccaggcccccagccccccccccgcccccgugggccugggcagcauggccguguucagaagcggccugcuggugcugaccaccccccuggccagccuggcccccagacuggccagcauccugaccagcgccgccagacuggugaaccacacccuguacgugcaccugcagcccggcaugagccuggagggccccgcccagccccagagcagccccgugcaggccaccuucgaggugcuggacuucaucacccaccuguacgccggcgccgacgugcacagacaccuggacgugagaauccugcugaccaacaucagaaccaagagcaccuuccugcccccccugcccaccagcgugcagaaccuggcccacccccccgagguggugcugaccgacuuccagacccuggacggcagccaguacaaccccgugaagcagcagcuggugagauacgccaccagcugcuacagcugcugccccagacuggccagcgugcugcuguacagcgacuacggcaucggcgaggugcccguggagccccuggacgugccccugcccagcaccaucagacccgccagccccguggccggcagccccaagcagcccgugagaggcuacuacagaggcgccgugggcggcaccuucgacagacugcacaacgcccacaaggugcugcugagcguggccugcauccuggcccaggagcagcugguggugggcguggccgacaaggaccugcugaagagcaagcugcugcccgagcugcugcagcccuacaccgagagaguggagcaccugagcgaguuccugguggacaucaagcccagccugaccuucgacgugaucccccugcuggaccccuacggccccgccggcagcgaccccagccuggaguuccugguggugagcgaggagaccuacagaggcggcauggccaucaacagauucagacuggagaacgaccuggaggagcuggcccuguaccagauccagcugcugaaggaccugagacacaccgagaacgaggaggacaaggugagcagcagcagcuucagacagagaaugcugggcaaccugcugagaccccccuacgagagacccgagcugcccaccugccuguacgugaucggccugaccggcaucagcggcagcggcaagagcagcaucgcccagagacugaagggccugggcgccuucgugaucgacagcgaccaccugggccacagagccuacgcccccggcggccccgccuaccagcccgugguggaggccuucggcaccgacauccugcacaaggacggcaucaucaacagaaaggugcugggcagcagaguguucggcaacaagaagcagcugaagauccugaccgacaucauguggcccaucaucgccaagcuggccagagaggagauggacagagccguggccgagggcaagagagugugcgugaucgacgccgccgugcugcuggaggccggcuggcagaaccuggugcacgagguguggaccgccgugauccccgagaccgaggccgugagaagaaucguggagagagacggccugagcgaggccgccgcccagagcagacugcagagccagaugagcggccagcagcugguggagcagagccacguggugcugagcacccugugggagccccacaucacccagagacagguggagaaggccugggcccugcugcagaagagaauccccaagacccaccaggcccuggacuaa

SEQ ID NO: 15438 - RNA, 1140 nt, Artificial Sequence
  COBL__Homo_sapiens__NP_001274367
auggacgcccccagagccagcgccgccaagccccccaccggcagaaagaugaaggccagagccccccccccccccggcaaggccgccacccugcacgugcacagcgaccagaagcccccccacgacggcgcccugggcagccagcagaaccuggugagaaugaaggaggcccugagagccagcaccauggacgugaccguggugcugcccagcggccuggagaagagaagcgugcugaacggcagccacgccaugauggaccugcugguggagcugugccugcagaaccaccugaaccccagccaccacgcccuggagaucagaagcagcgagacccagcagccccugagcuucaagcccaacacccugaucggcacccugaacgugcacaccguguuccugaaggagaaggugcccgaggagaaggugaagcccggcccccccaaggugcccgagaagagcgugagacugguggugaacuaccugagaacccagaaggccguggugagagugagccccgaggugccccugcagaacauccugcccgugaucugcgccaagugcgaggugagccccgagcacguggugcugcugagagacaacaucgccggcgaggagcuggagcugagcaagagccugaacgagcugggcaucaaggagcuguacgccugggacaacagaagagagaccuucagaaagagcagccugggcaacgacgagaccgacaaggagaagaagaaguuccugggcuucuucaaggugaacaagagaagcaacagcaagggcugccugaccacccccaacagccccagcaugcacagcagaagccugacccugggccccagccugagccugggcagcaucagcggcgugagcgugaagagcgagaugaagaagagaagagccccccccccccccggcagcggcccccccgugcaggacaaggccagcgagaaggugagccugggcagccagaucgaccugcagaagaagaagagaagagcccccgcccccccccccccccagccccccccccccagcccccugauccccaacagaaccgaggacaaggaggagaacagaaagagcaccaugguguacugcugcgccagcuuccccacccaggccaagagauucuaa

SEQ ID NO: 15439 - RNA, 3702 nt, Artificial Sequence
  COBLL1__Homo_sapiens__NP_001265387
augccccccagcuggagcccccugaugugcggcagagccgccgaggccgccgccagcagcagaacccccggcagagagaugggccaggccgugaccagaagacugggcgccggcgccagagccgcccccagaagagccauggacggcagaacccccagaccccaggacgcccccgccagaagagagaucgccggcagcuggagaaagcccaaggccaaggccccccugccccccgccgagaccaaguacaccgacgugagcagcgccgccgacagcguggagagcaccgccuucaucauggagcagaaggagaacaugaucgacaaggacguggagcugagcguggugcugcccggcgacaucaucaagagcaccaccgugcacggcagcaagcccaugauggaccugcugaucuuccugugcgcccaguaccaccugaaccccagcagcuacaccaucgaccugcugagcgccgagcagaaccacaucaaguucaagcccaacacccccaucggcaugcuggagguggagaaggugauccugaagcccaagaugcuggacaagaagaagcccacccccaucauccccgagaagaccgugagaguggugaucaacuucaagaagacccagaagaccaucgugagagugagcccccacgccagccugcaggagcuggcccccaucaucugcagcaagugcgaguucgacccccugcacacccugcugcugaaggacuaccagagccaggagccccuggaccugaccaagagccugaacgaccugggccugagagagcuguacgccauggacgugaacagagccaccagcgugaccguguucagcaagagcagccugcaggagagcugccagaucagccagaaccuggacaucaugaaggagaaggagaacaagggcuucuucagcuucuuccagagaagcaagaagaagagagaccagaccgccagcgcccccgccaccccccuggugaacaagcacagacccaccuucaccagaagcaacaccaucagcaagcccuacaucagcaacacccugcccagcgacgcccccaagaagagaagagccccccugccccccaugcccgccagccagagcgugccccaggaccuggcccacauccaggagagacccgccagcugcaucgugaagagcaugagcguggacgagaccgacaagagccccugcgaggccggcagagugagagccggcagccugcagcugagcagcaugagcgccggcaacagcagccugagaagaaccaagagaaaggcccccagcccccccagcaagauccccccccaccagagcgacgagaacagcagagugaccgcccugcagcccguggacggcgugccccccgacagcgccagcgaggccaacagccccgaggagcugagcagccccgagaccuuccaccccggccugagcagccaggagcagugcaccgcccccaagcugauggaggagaccagcguguucgagugccccggcacccccgaggccgccaucaccagccugaccagcggcaucagcagcgacuacagccuggaggagaucgacgagaaggaggagcugagcgaggugcccaagguggaggccgagaacaucagccccaagagccaggacauccccuucgugagcaccgacaucaucaacacccugaagaacgaccccgacagcgcccugggcaacggcagcggcgaguucagccagaacagcauggaggagaagcaggagaccaagagcaccgacggccaggagccccacagcgugguguacgacaccagcaacggcaagaaggugguggacagcaucagaaaccugaagagccugggccccaaccaggagaacguggugcagaacgagaucaucguguaccccgagaacaccgaggacaacaugaagaacggcgugaagaagaccgagaucaacguggagggcguggccaagaacaacaacaucgacauggagguggagagacccagcaacagcgaggcccacgagaccgacaccgccaucagcuacaaggagaaccaccuggccgccagcagcgugcccgaccagaagcugaaccagcccagcgccgagaagaccaaggacgccgccauccagaccacccccagcugcaacagcuucgacggcaagcaccaggaccacaaccugagcgacagcaagguggaggagugcgugcagaccagcaacaacaacaucagcacccagcacagcugccugagcagccaggacagcgugaacaccagcagagaguucagaagccagggcacccugaucauccacagcgaggacccccugaccgugaaggaccccaucugcgcccacggcaacgacgaccugcugccccccguggacagaaucgacaagaacagcaccgccagcuaccugaagaacuacccccuguacagacaggacuacaaccccaagcccaagcccagcaacgagaucaccagagaguacauccccaagaucggcaugaccaccuacaagaucgugccccccaagagccuggagaucagcaaggacuggcagagcgagaccaucgaguacaaggacgaccaggacaugcacgcccugggcaagaagcacacccacgagaacgugaaggagaccgccauccagaccgaggacagcgccaucagcgagagccccgaggagccccugcccaaccugaagcccaagcccaaccugagaaccgagcaccaggugcccagcagcgugagcagccccgacgacgccauggugagcccccugaagcccgcccccaagaugaccagagacaccggcaccgcccccuucgcccccaaccuggaggagaucaacaacauccuggagagcaaguucaagagcagagccagcaacgcccaggccaagcccagcagcuucuuccugcagaugcagaagagagugagcggccacuacgugaccagcgccgccgccaagagcgugcacgccgcccccaaccccgcccccaaggagcugaccaacaaggaggccgagagagacaugcugcccagccccgagcagacccugagcccccugagcaagaugccccacagcgugccccagccccugguggagaagaccgacgacgacgugaucggccaggcccccgccgaggccagccccccccccaucgcccccaagcccgugaccauccccgccagccaggugagcacccagaaccugaagacccugaagaccuucggcgcccccagacccuacagcagcagcggccccagccccuucgcccuggccguggugaagagaagccagagcuucagcaaggagagaaccgagagccccagcgccagcgcccuggugcagccccccgccaacaccgaggagggcaagacccacagcgugaacaaguucguggacaucccccagcugggcgugagcgacaaggagaacaacagcgcccacaacgagcagaacagccagauccccacccccaccgacggccccagcuucaccgugaugagacagagcagccugaccuuccagagcagcgaccccgagcagaugagacagagccugcugaccgccaucagaagcggcgaggccgccgccaagcugaagagagugaccauccccagcaacaccaucagcgugaacggcagaagcagacugagccacagcaugagccccgacgcccaggacggccacuaa

SEQ ID NO: 15440 - RNA, 1653 nt, Artificial Sequence
  COCH__Homo_sapiens__XP_011534841
augagcgccgccuggauccccgcccugggccugggcgugugccugcugcugcugcccggccccgccggcagcgagggcgccgcccccaucgccaucaccugcuucaccagaggccuggacaucagaaaggagaaggccgacgugcugugccccggcggcugcccccuggaggaguucagcguguacggcaacaucguguacgccagcgugagcagcaucugcggcgccgccgugcacagaggcgugaucagcaacagcggcggccccgugagaguguacagccugcccggcagagagaacuacagcagcguggacgccaacggcauccagagccagaugcugagcagauggagcgccagcuucaccgugaccaagggcaagagcagcacccaggaggccaccggccaggccgugagcaccgcccacccccccaccggcaagagacugaagaagacccccgagaagaagaccggcaacaaggacugcaaggccgacaucgccuuccugaucgacggcagcuucaacaucggccagagaagauucaaccugcagaagaacuucgugggcaagguggcccugaugcugggcaucggcaccgagggcccccacgugggccuggugcaggccagcgagcaccccaagaucgaguucuaccugaagaacuucaccagcgccaaggacgugcuguucgccaucaaggaggugggcuucagaggcggcaacagcaacaccggcaaggcccugaagcacaccgcccagaaguucuucaccguggacgccggcgugagaaagggcauccccaaggugguggugguguucaucgacggcuggcccagcgacgacaucgaggaggccggcaucguggccagagaguucggcgugaacguguucaucgugagcguggccaagcccauccccgaggagcugggcauggugcaggacgugaccuucguggacaaggccgugugcagaaacaacggcuucuucagcuaccacaugcccaacugguucggcaccaccaaguacgugaagccccuggugcagaagcugugcacccacgagcagaugaugugcagcaagaccugcuacaacagcgugaacaucgccuuccugaucgacggcagcagcagcgugggcgacagcaacuucagacugaugcuggaguucgugagcaacaucgccaagaccuucgagaucagcgacaucggcgccaagaucgccgccgugcaguucaccuacgaccagagaaccgaguucagcuucaccgacuacagcaccaaggagaacgugcuggccgugaucagaaacaucagauacaugagcggcggcaccgccaccggcgacgccaucagcuucaccgugagaaacguguucggccccaucagagagagccccaacaagaacuuccuggugaucgugaccgacggccagagcuacgacgacgugcagggccccgccgccgccgcccacgacgccggcaucaccaucuucagcgugggcguggccugggccccccuggacgaccugaaggacauggccagcaagcccaaggagagccacgccuucuucaccagagaguucaccggccuggagcccaucgugagcgacgugaucagaggcaucugcagagacuuccuggagagccagcaguaa

SEQ ID NO: 15441 - RNA, 2943 nt, Artificial Sequence
  COG1__Homo_sapiens__NP_061184
auggccaccgccgccaccagccccgcccugaagagacuggaccugagagaccccgccgcccuguucgagacccacggcgccgaggagaucagaggccuggagagacaggugagagccgagaucgagcacaagaaggaggagcugagacagauggugggcgagagauacagagaccugaucgaggccgccgacaccaucggccagaugagaagaugcgccgugggccugguggacgccgugaaggccaccgaccaguacugcgccagacugagacaggccggcagcgccgcccccagaccccccagagcccagcagccccagcagcccagccaggagaaguucuacagcauggccgcccagaucaagcugcugcuggagauccccgagaagaucuggagcagcauggaggccagccagugccugcacgccacccagcuguaccugcugugcugccaccugcacagccugcugcagcuggacagcagcagcagcagauacagccccgugcugagcagauuccccauccugaucagacagguggccgccgccagccacuucagaagcaccauccugcacgagagcaagaugcugcugaagugccagggcgugagcgaccaggccguggccgaggcccugugcagcaucaugcugcuggaggagagcagccccagacaggcccugaccgacuuccugcuggccagaaaggccaccauccagaagcugcugaaccagccccaccacggcgccggcaucaaggcccagaucugcagccugguggagcugcuggccaccacccugaagcaggcccacgcccuguucuacacccugcccgagggccugcugcccgaccccgcccugcccugcggccugcuguucagcacccuggagaccaucaccggccagcaccccgccggcaagggcaccggcgugcugcaggaggagaugaagcugugcagcugguucaagcaccugcccgccagcaucguggaguuccagcccacccugagaacccuggcccaccccaucagccaggaguaccugaaggacacccugcagaaguggauccacaugugcaacgaggacaucaagaacggcaucaccaaccugcugauguacgugaagagcaugaagggccuggccggcaucagagacgccaugugggagcugcugaccaacgagagcaccaaccacagcugggacgugcugugcagaagacugcuggagaagccccugcuguucugggaggacaugaugcagcagcuguuccuggacagacugcagacccugaccaaggagggcuucgacagcaucagcagcagcagcaaggagcugcuggugagcgcccugcaggagcuggagagcagcaccagcaacagccccagcaacaagcacauccacuucgaguacaacaugagccuguuccuguggagcgagagccccaacgaccugcccagcgacgccgccugggugagcguggccaacagaggccaguucgccagcagcggccugagcaugaaggcccaggccaucagccccugcgugcagaacuucugcagcgcccuggacagcaagcugaaggugaagcuggacgaccugcuggccuaccugcccagcgacgacagcagccugcccaaggacgugagccccacccaggccaagagcagcgccuucgacagauacgccgacgccggcaccgugcaggagaugcugagaacccagagcguggccugcaucaagcacaucguggacugcaucagagccgagcugcagagcaucgaggagggcgugcagggccagcaggacgcccugaacagcgccaagcugcacagcgugcuguucauggccagacugugccagagccugggcgagcugugcccccaccugaagcagugcauccugggcaagagcgagagcagcgagaagcccgccagagaguucagagcccugagaaagcagggcaaggugaagacccaggagaucauccccacccaggccaaguggcaggaggugaaggaggugcugcugcagcagagcgugaugggcuaccagguguggagcagcgccguggugaaggugcugauccacggcuucacccagagccugcugcuggacgacgccggcagcgugcuggccaccgccaccagcugggacgagcuggagauccaggaggaggccgagagcggcagcagcgugaccagcaagaucagacugcccgcccagcccagcugguacgugcagagcuuccuguucagccugugccaggagaucaacagagugggcggccacgcccugcccaaggugacccugcaggagaugcugaagagcugcauggugcaggugguggccgccuacgagaagcugagcgaggagaagcagaucaagaaggagggcgccuuccccgugacccagaacagagcccugcagcugcuguacgaccugagauaccugaacaucgugcugaccgccaagggcgacgaggugaagagcggcagaagcaagcccgacagcagaaucgagaaggugaccgaccaccuggaggcccugaucgaccccuucgaccuggacguguucaccccccaccugaacagcaaccugcacagacuggugcagagaaccagcgugcuguucggccuggugaccggcaccgagaaccagcuggcccccagaagcagcaccuucaacagccaggagccccacaacauccugccccuggccagcagccagaucagauucggccugcugccccugagcaugaccagcaccagaaaggccaagagcaccagaaacaucgagaccaaggcccagguggugccccccgccagaagcaccgccggcgaccccaccgugcccggcagccuguucagacagcuggugagcgaggaggacaacaccagcgcccccagccuguucaagcugggcuggcugagcagcaugaccaaguaa

SEQ ID NO: 15442 - RNA, 2214 nt, Artificial Sequence
  COG2__Homo_sapiens__NP_001138508
auggagaagagcagaaugaaccugcccaagggccccgacacccugugcuucgacaaggacgaguucaugaaggaggacuucgacguggaccacuucgugagcgacugcagaaagagagugcagcuggaggagcugagagacgaccuggagcuguacuacaagcugcugaagaccgccaugguggagcugaucaacaaggacuacgccgacuucgugaaccugagcaccaaccuggugggcauggacaaggcccugaaccagcugagcgugccccugggccagcugagagaggaggugcugagccugagaagcagcgugagcgagggcaucagagccguggacgagagaaugagcaagcaggaggacaucagaaagaagaagaugugcgugcugagacugauccaggugaucagaagcguggagaagaucgagaagauccugaacagccagagcagcaaggagaccagcgcccuggaggccagcagcccccugcugaccggccagauccuggagagaaucgccaccgaguucaaccagcugcaguuccacgccgugcagagcaagggcaugccccugcuggacaaggugagacccagaaucgccggcaucaccgccaugcugcagcagagccuggagggccugcugcuggagggccugcagaccagcgacguggacaucaucagacacugccugagaaccuacgccaccaucgacaagaccagagacgccgaggcccuggugggccaggugcuggugaagcccuacaucgacgaggugaucaucgagcaguucguggagagccaccccaacggccugcaggugauguacaacaagcugcuggaguucgugccccaccacugcagacugcugagagaggugaccggcggcgccaucagcagcgagaagggcaacaccgugcccggcuacgacuuccuggugaacagcguguggccccagaucgugcagggccuggaggagaagcugcccagccuguucaaccccggcaaccccgacgccuuccacgagaaguacaccaucagcauggacuucgugagaagacuggagagacagugcggcagccaggccagcgugaagagacugagagcccaccccgccuaccacagcuucaacaagaaguggaaccugcccguguacuuccagaucagauucagagagaucgccggcagccuggaggccgcccugaccgacgugcuggaggacgcccccgccgagagccccuacugccugcuggccagccacagaaccuggagcagccugagaagaugcuggagcgacgagauguuccugccccugcuggugcacagacuguggagacugacccugcagauccuggccagauacagcguguucgugaacgagcugagccugagacccaucagcaacgagagccccaaggagaucaagaagccccuggugaccggcagcaaggagcccagcaucacccagggcaacaccgaggaccagggcagcggccccagcgagaccaagcccguggugagcaucagcagaacccagcugguguacgugguggccgaccuggacaagcugcaggagcagcugcccgagcugcuggagaucaucaagcccaagcuggagaugaucggcuucaagaacuucagcagcaucagcgcccuggaggacagccagagcagcuucagcgccugcgugcccagccugagcagcaagaucauccaggaccugagcgacagcugcuucggcuuccugaagagcgcccuggaggugcccagacuguacagaagaaccaacaaggaggugcccaccaccgccagcagcuacguggacagcgcccugaagccccuguuccagcugcagagcggccacaaggacaagcugaagcaggccaucauccagcaguggcuggagggcacccugagcgagagcacccacaaguacuacgagaccgugagcgacgugcugaacagcgugaagaagauggaggagagccugaagagacugaagcaggccagaaagaccacccccgccaaccccgugggccccagcggcggcaugagcgacgacgacaagaucagacugcagcuggcccuggacguggaguaccugggcgagcagauccagaagcugggccugcaggccagcgacaucaagagcuucagcgcccuggccgagcugguggccgccgccaaggaccaggccaccgccgagcagcccuaa

SEQ ID NO: 15443 - RNA, 2487 nt, Artificial Sequence
  COG3__Homo_sapiens__NP_113619
auggccgaggccgcccugcugcugcugcccgaggccgccgccgagagagacgccagagagaagcuggcccugugggacagaagacccgacaccaccgccccccugaccgacagacagaccgacagcgugcuggagcugaaggccgccgccgagaaccugcccgugcccgccgagcugcccaucgaggaccugugcagccugaccagccagagccugcccaucgagcugaccagcguggugcccgagagcaccgaggacauccugcugaagggcuucaccagccugggcauggaggaggagagaaucgagaccgcccagcaguucuucagcugguucgccaagcugcagacccagauggaccaggacgagggcaccaaguacagacagaugagagacuaccugagcggcuuccaggagcagugcgacgccauccugaacgacgugaacagcgcccugcagcaccuggagagccugcagaagcaguaccuguucgugagcaacaagaccggcacccugcacgaggccugcgagcagcugcugaaggagcagagcgagcugguggaccuggccgagaacauccagcagaagcugagcuacuucaacgagcuggagaccaucaacaccaagcugaacagccccacccugagcgugaacagcgacggcuucauccccaugcuggccaagcuggacgacugcaucaccuacaucagcagccaccccaacuucaaggacuaccccaucuaccugcugaaguucaagcagugccugagcaaggcccugcaccugaugaagaccuacaccgugaacacccugcagacccugaccagccagcugcugaagagagaccccagcagcgugcccaacgccgacaacgccuucacccuguucuacgugaaguucagagccgccgcccccaaggugagaacccugaucgagcagaucgagcugagaagcgagaagauccccgaguaccagcagcugcugaacgacauccaccagugcuaccuggaccagagagagcugcugcugggccccagcaucgccugcaccguggccgagcugaccagccagaacaacagagaccacugcgcccuggugagaagcggcugcgccuucauggugcacgugugccaggacgagcaccagcuguacaacgaguucuucaccaagcccaccagcaagcuggacgagcugcuggagaagcugugcgugagccuguacgacguguucagaccccugaucauccacgugauccaccuggagacccugagcgagcugugcggcauccugaagaacgaggugcuggaggaccacgugcagaacaacgccgagcagcugggcgccuucgccgccggcgugaagcagaugcuggaggacgugcaggagagacugguguacagaacccacaucuacauccagaccgacaucaccggcuacaagcccgcccccggcgaccuggccuaccccgacaagcuggugaugauggagcagaucgcccagagccugaaggacgagcagaagaaggugcccagcgaggccagcuucagcgacgugcaccuggaggagggcgagagcaacagccugaccaagagcggcagcaccgagagccugaaccccagaccccagaccaccaucagccccgccgaccugcacggcaugugguaccccaccgugagaagaacccuggugugccugagcaagcuguacagaugcaucgacagagccguguuccagggccugagccaggaggcccugagcgccugcauccagagccugcugggcgccagcgagagcaucagcaagaacaagacccagaucgacggccagcuguuccugaucaagcaccugcugauccugagagagcagaucgcccccuuccacaccgaguucaccaucaaggagaucagccuggaccugaagaagaccagagacgccgccuucaagauccugaaccccaugaccgugcccagauucuucagacugaacagcaacaacgcccugaucgaguuccugcuggagggcacccccgagaucagagagcacuaccuggacagcaagaaggacguggacagacaccugaagagcgccugcgagcaguucauccagcagcagaccaagcuguucguggagcagcuggaggaguucaugaccaaggugagcgcccugaagaccauggccagccagggcggccccaaguacacccugagccagcagcccugggcccagcccgccaaggugaacgaccuggccgccaccgccuacaagaccaucaagaccaagcugcccgugacccugagaagcaugagccuguaccugagcaacaaggacaccgaguucauccuguucaagcccgugagaaacaacauccagcagguguuccagaaguuccacgcccugcugaaggaggaguucagccccgaggacauccagaucaucgccugccccagcauggagcagcugagccugcugcugagcgugagcaaguaa

SEQ ID NO: 15444 - RNA, 2307 nt, Artificial Sequence
  COG4__Homo_sapiens__NP_001182068
augggcaccaagauggccgaccuggacagcccccccaagcugagcggcgugcagcagcccagcgagggcgugggcggcggcagaugcagcgagaucagcgccgagcugaucagaagccugaccgagcugcaggagcuggaggccguguacgagagacugugcggcgaggagaaggugguggagagagagcuggacgcccugcuggagcagcagaacaccaucgagagcaagauggugacccugcacagaaugggccccaaccugcagcugaucgagggcgacgccaagcagcuggccggcaugaucaccuucaccugcaaccuggccgagaacgugagcagcaaggugagacagcuggaccuggccaagaacagacuguaccaggccauccagagagccgacgacauccuggaccugaaguucugcauggacggcgugcagaccgcccugagaagcgaggacuacgagcaggccgccgcccacacccacagauaccugugccuggacaagagcgugaucgagcugagcagacagggcaaggagggcagcaugaucgacgccaaccugaagcugcugcaggaggccgagcagagacugaaggccaucguggccgagaaguucgccaucgccaccaaggagggcgaccugccccagguggagagauucuucaagaucuucccccugcugggccugcacgaggagggccugagaaaguucagcgaguaccugugcaagcagguggccagcaaggccgaggagaaccugcugauggugcugggcaccgacaugagcgacagaagagccgccgugaucuucgccgacacccugacccugcuguucgagggcaucgccagaaucguggagacccaccagcccaucguggagaccuacuacggccccggcagacuguacacccugaucaaguaccugcagguggagugcgacagacagguggagaaggugguggacaaguucaucaagcagagagacuaccaccagcaguucagacacgugcagaacaaccugaugagaaacagcaccaccgagaagaucgagcccagagagcuggaccccauccugaccgaggugacccugaugaacgccagaagcgagcuguaccugagauuccugaagaagagaaucagcagcgacuucgaggugggcgacagcauggccagcgaggaggugaagcaggagcaccagaagugccuggacaagcugcugaacaacugccugcugagcugcaccaugcaggagcugaucggccuguacgugaccauggaggaguacuucaugagagagaccgugaacaaggccguggcccuggacaccuacgagaagggccagcugaccagcagcaugguggacgacguguucuacaucgugaagaagugcaucggcagagcccugagcagcagcagcaucgacugccugugcgccaugaucaaccuggccaccaccgagcuggagagcgacuucagagacgugcugugcaacaagcugagaaugggcuuccccgccaccaccuuccaggacauccagagaggcgugaccagcgccgugaacaucaugcacagcagccugcagcagggcaaguucgacaccaagggcaucgagagcaccgacgaggccaagaugagcuuccugagcgacugcaccaagcuguucagccagggcaucggcggcgagcaggcccaggccaaguucgacagcugccugagcgaccuggccgccgugagcaacaaguucagagaccugcugcaggagggccugaccgagcugaacagcaccgccaucaagccccaggugcagcccuggaucaacagcuucuucagcgugagccacaacaucgaggaggaggaguucaacgacuacgaggccaacgaccccugggugcagcaguucauccugaaccuggagcagcagauggccgaguucaaggccagccugagccccgugaucuacgacagccugaccggccugaugaccagccugguggccguggagcuggagaagguggugcugaagagcaccuucaacagacugggcggccugcaguucgacaaggagcugagaagccugaucgccuaccugaccaccgugaccaccuggaccaucagagacaaguucgccagacugagccagauggccaccauccugaaccuggagagagugaccgagauccuggacuacuggggccccaacagcggcccccugaccuggagacugacccccgccgaggugagacaggugcuggcccugagaaucgacuucagaagcgaggacaucaagagacugagacuguaa

SEQ ID NO: 15445 - RNA, 2583 nt, Artificial Sequence
  COG5__Homo_sapiens__NP_006339
augggcugggugggcggcagaagaagagacagcgccagcccccccggcagaagcagaagcgccgccgacgacaucaaccccgcccccgccaacauggagggcggcggcggcagcguggccguggccggccugggcgccagaggcagcggcgccgccgccgccaccgugagagagcugcugcaggacggcugcuacagcgacuuccugaacgaggacuucgacgugaagaccuacaccagccagagcauccaccaggccgugaucgccgagcagcuggccaagcuggcccagggcaucagccagcuggacagagagcugcaccugcaggugguggccagacacgaggaccugcuggcccaggccaccggcaucgagagccuggagggcgugcugcagaugaugcagaccagaaucggcgcccugcagggcgccguggacagaaucaaggccaagaucguggagcccuacaacaagaucguggccagaaccgcccagcuggccagacugcagguggccugcgaccugcugagaagaaucaucagaauccugaaccugagcaagagacugcagggccagcugcagggcggcagcagagagaucaccaaggccgcccagagccugaacgagcuggacuaccugagccagggcaucgaccugagcggcaucgaggugaucgagaacgaccugcuguucaucgccagagccagacuggagguggagaaccaggccaagagacugcuggagcagggccuggagacccagaaccccacccaggugggcaccgcccugcagguguucuacaaccugggcacccugaaggacaccaucaccagcgugguggacggcuacugcgccacccuggaggagaacaucaacagcgcccuggacaucaaggugcugacccagcccagccagagcgccgugagaggcggccccggcagaagcaccaugcccacccccggcaacaccgccgcccugagagccagcuucuggaccaacauggagaagcugauggaccacaucuacgccgugugcggccaggugcagcaccugcagaaggugcuggccaagaagagagaccccgugagccacaucugcuucaucgaggagaucgugaaggacggccagcccgagaucuucuacaccuucuggaacagcgugacccaggcccugagcagccaguuccacauggccaccaacagcagcauguuccugaagcaggccuucgagggcgaguaccccaagcugcugagacuguacaacgaccuguggaagagacugcagcaguacagccagcacauccagggcaacuucaacgccagcggcaccaccgaccuguacguggaccugcagcacauggaggacgacgcccaggacaucuucauccccaagaagcccgacuacgaccccgagaaggcccugaaggacagccugcagcccuacgaggccgccuaccugagcaagagccugagcagacuguucgaccccaucaaccugguguucccccccggcggcagaaacccccccagcagcgacgagcuggacggcaucaucaagaccaucgccagcgagcugaacguggccgccguggacaccaaccugacccuggccgugagcaagaacguggccaagaccauccagcuguacagcgugaagagcgagcagcugcugagcacccagggcgacgccagccaggugaucggcccccugaccgagggccagagaagaaacguggccguggugaacagccuguacaagcugcaccagagcgugaccaagguggugagcagccagagcagcuucccccuggccgccgagcagaccaucaucagcgcccugaaggccauccacgcccugauggagaacgccgugcagccccugcugaccagcgugggcgacgccaucgaggccaucaucaucaccaugcaccaggaggacuucagcggcagccugagcagcagcggcaagcccgacgugcccugcagccuguacaugaaggagcugcagggcuucaucgccagagugaugagcgacuacuucaagcacuucgagugccuggacuucguguucgacaacaccgaggccaucgcccagagagccguggagcuguucaucagacacgccagccugaucagaccccugggcgagggcggcaagaugagacuggccgccgacuucgcccagauggagcuggccgugggccccuucugcagaagagugagcgaccugggcaagagcuacagaaugcugagaagcuucagaccccugcuguuccaggccagcgagcacguggccagcagccccgcccugggcgacgugauccccuucagcaucaucauccaguuccuguucaccagagcccccgccgagcugaagagccccuuccagagagccgaguggagccacaccagauucagccaguggcuggacgaccaccccagcgagaaggacagacugcugcugaucagaggcgcccuggaggccuacgugcagagcgugagaagcagagagggcaaggaguucgcccccguguaccccaucauggugcagcugcugcagaaggccaugagcgcccugcaguaa

SEQ ID NO: 15446 - RNA, 1848 nt, Artificial Sequence
  COG6__Homo_sapiens__NP_001138551
auggccgagggcagcggcgaggugguggccgugagcgccaccggcgccgccaacggccugaacaacggcgccggcggcaccagcgccaccaccugcaacccccugagcagaaagcugcacaagauccuggagaccagacuggacaacgacaaggagaugcuggaggcccugaaggcccugagcaccuucuucguggagaacagccugagaaccagaagaaaccugagaggcgacaucgagagaaagagccuggccaucaacgaggaguucgugagcaucuucaaggaggugaaggaggagcuggagagcaucagcgaggacgugcaggccaugagcaacugcugccaggacaugaccagcagacugcaggccgccaaggagcagacccaggaccugaucgugaagaccaccaagcugcagagcgagagccagaagcuggagaucagagcccagguggccgacgccuuccugagcaaguuccagcugaccagcgacgagaugagccugcugagaggcaccagagagggccccaucaccgaggacuucuucaaggcccugggcagagugaagcagauccacaacgacgugaaggugcugcugagaaccaaccagcagaccgccggccuggagaucauggagcagauggcccugcugcaggagaccgccuacgagagacuguacagaugggcccagagcgagugcagaacccugacccaggagagcugcgacgugagccccgugcugacccaggccauggaggcccugcaggacagacccgugcuguacaaguacacccuggacgaguucggcaccgccagaagaagcaccguggugagaggcuucaucgacgcccugaccagaggcggccccggcggcacccccagacccaucgagaugcacagccacgacccccugagauacgugggcgacaugcuggccuggcugcaccaggccaccgccagcgagaaggagcaccuggaggcccugcugaagcacgugaccacccagggcguggaggagaacauccaggagguggugggccacaucaccgagggcgugugcagaccccugaaggugagaaucgagcaggugaucguggccgagcccggcgccgugcugcuguacaagaucagcaaccugcugaaguucuaccaccacaccaucagcggcaucgugggcaacagcgccaccgcccugcugaccaccaucgaggagaugcaccugcugagcaagaagaucuucuucaacagccugagccugcacgccagcaagcugauggacaagguggagcugcccccccccgaccugggccccagcagcgcccugaaccagacccugaugcugcugagagaggugcuggccagccacgacagcagcguggugccccuggacgccagacaggccgacuucgugcaggugcugagcugcgugcuggacccccugcugcagaugugcaccgugagcgccagcaaccugggcaccgccgacauggccaccuucauggugaacagccuguacaugaugaagaccacccuggcccuguucgaguucaccgacagaagacuggagaugcugcaguuccagaucgaggcccaccuggacacccugaucaacgagcaggccagcuacgugcugaccagagugggccugagcuacaucuacaacaccgugcagcagcacaagcccgagcagggcagccuggccaacaugcccaaccuggacagcgugacccugaaggccgccauggugcaguucgacagauaccugagcgcccccgacaaccugcugaucccccagcugaacuuccugcugagcgccaccgugaagagaccccccaacggccccuaa

SEQ ID NO: 15447 - RNA, 2313 nt, Artificial Sequence
  COG7__Homo_sapiens__NP_705831
auggacuucagcaaguuccuggccgacgacuucgacgugaaggaguggaucaacgccgccuucagagccggcagcaaggaggccgccagcggcaaggccgacggccacgccgccacccuggugaugaagcugcagcuguucauccaggaggugaaccacgccguggaggagaccagccaccaggcccugcagaacaugcccaaggugcugagagacguggaggcccugaagcaggaggccagcuuccugaaggagcagaugauccuggugaaggaggacaucaagaaguucgagcaggacaccagccagagcaugcaggugcugguggagaucgaccaggugaagagcagaaugcagcuggccgccgagagccugcaggaggccgacaaguggagcacccugagcgccgacaucgaggagaccuucaagacccaggacaucgccgugaucagcgccaagcugaccggcaugcagaacagccugaugaugcugguggacacccccgacuacagcgagaagugcgugcaccuggaggcccugaagaacagacuggaggcccuggccagcccccagaucguggccgccuucaccagccaggccguggaccagagcaagguguucgugaagguguucaccgagaucgacagaaugccccagcugcuggccuacuacuacaagugccacaaggugcagcugcuggccgccuggcaggagcugugccagagcgaccugagccuggacagacagcugaccggccuguacgacgcccugcugggcgccuggcacacccagauccagugggccacccagguguuccagaagccccacgagguggugauggugcugcugauccagacccugggcgcccugaugcccagccugcccagcugccugagcaacggcguggagagagccggccccgagcaggagcugaccagacugcuggaguucuacgacgccaccgcccacuucgccaagggccuggagauggcccugcugccccaccugcacgagcacaaccuggugaaggugaccgagcugguggacgccguguacgaccccuacaagcccuaccagcugaaguacggcgacauggaggagagcaaccugcugauccagaugagcgccgugccccuggagcacggcgaggugaucgacugcgugcaggagcugagccacagcgugaacaagcuguucggccuggccagcgccgccguggacagaugcgugagauucaccaacggccugggcaccugcggccugcugagcgcccugaagagccuguucgccaaguacgugagcgacuucaccagcacccugcagagcaucagaaagaagugcaagcuggaccacaucccccccaacagccuguuccaggaggacuggaccgccuuccagaacagcaucagaaucaucgccaccugcggcgagcugcugagacacugcggcgacuucgagcagcagcuggccaacagaauccugagcaccgccggcaaguaccugagcgacagcugcagccccagaagccuggccggcuuccaggagagcauccugaccgacaagaagaacagcgccaagaaccccuggcaggaguacaacuaccugcagaaggacaaccccgccgaguacgccagccugauggagauccuguacacccugaaggagaagggcagcagcaaccacaaccugcuggccgcccccagagccgcccugaccagacugaaccagcaggcccaccagcuggccuucgacagcguguuccugagaaucaagcagcagcugcugcugaucagcaagauggacagcuggaacaccgccggcaucggcgagacccugaccgacgagcugcccgccuucagccugaccccccuggaguacaucagcaacaucggccaguacaucaugagccugccccugaaccuggagcccuucgugacccaggaggacagcgcccuggagcuggcccugcacgccggcaagcugcccuucccccccgagcagggcgacgagcugcccgagcuggacaacauggccgacaacuggcugggcagcaucgccagagccaccaugcagaccuacugcgacgccauccugcagauccccgagcugagcccccacagcgccaagcagcuggccaccgacaucgacuaccugaucaacgugauggacgcccugggccugcagcccagcagaacccugcagcacaucgugacccugcugaagaccagacccgaggacuacagacaggugagcaagggccugcccagaagacuggccaccaccguggccaccaugagaagcgugaacuacuaa

SEQ ID NO: 15448 - RNA, 1839 nt, Artificial Sequence
  COG8__Homo_sapiens__NP_115758
auggccaccgccgccaccauccccagcguggccaccgccaccgccgccgcccugggcgagguggaggacgagggccugcuggccagccuguucagagacagauuccccgaggcccaguggagagagagacccgacgugggcagauaccugagagagcugagcggcagcggccuggagagacugagaagagagcccgagagacuggccgaggagagagcccagcugcugcagcagaccagagaccuggccuucgccaacuacaagaccuucaucagaggcgccgagugcaccgagagaauccacagacuguucggcgacguggaggccagccugggcagacugcuggacagacugcccagcuuccagcagagcugcagaaacuucgugaaggaggccgaggagaucagcagcaacagaagaaugaacagccugacccugaacagacacaccgagauccuggagauccuggagaucccccagcugauggacaccugcgugagaaacagcuacuacgaggaggcccuggagcuggccgccuacgugagaagacuggagagaaaguacagcagcauccccgugauccagggcaucgugaacgaggugagacagagcaugcagcugaugcugagccagcugauccagcagcugagaaccaacauccagcugcccgccugccugagagugaucggcuaccugagaagaauggacguguucaccgaggccgagcugagagugaaguuccugcaggccagagacgccuggcugagaagcauccugaccgccauccccaacgacgaccccuacuuccacaucaccaagaccaucgaggccagcagagugcaccuguucgacaucaucacccaguacagagccaucuucagcgacgaggacccccugcugccccccgccaugggcgagcacaccgugaacgagagcgccaucuuccacggcugggugcugcagaaggugagccaguuccugcaggugcuggagaccgaccuguacagaggcaucggcggccaccuggacagccugcugggccagugcauguacuucggccugagcuucagcagagugggcgccgacuucagaggccagcuggcccccguguuccagagaguggccaucagcaccuuccagaaggccauccaggagaccguggagaaguuccaggaggagaugaacagcuacaugcugaucagcgcccccgccauccugggcaccagcaacaugcccgccgccgugcccgccacccagcccggcacccugcagccccccauggugcugcuggacuuccccccccuggccugcuuccugaacaacauccugguggccuucaacgaccugagacugugcugccccguggcccuggcccaggacgugaccggcgcccuggaggacgcccuggccaaggugaccaagaucauccuggccuuccacagagccgaggaggccgccuucagcagcggcgagcaggagcuguucgugcaguucugcaccguguuccuggaggaccuggugcccuaccugaacagaugccugcaggugcuguucccccccgcccagaucgcccagacccugggcaucccccccacccagcugagcaaguacggcaaccugggccacgugaacaucggcgccauccaggagccccuggccuucauccugcccaagagagagacccuguucacccuggacgaccaggcccugggccccgagcugaccgcccccgcccccgagccccccgccgaggagcccagacuggagcccgccggccccgccugccccgagggcggcagagccgagacccaggccgagccccccagcgugggccccuaa

SEQ ID NO: 15449 - RNA, 1731 nt, Artificial Sequence
  COIL__Homo_sapiens__NP_004636
auggccgccagcgagaccgugagacugagacugcaguucgacuaccccccccccgccaccccccacugcaccgccuucuggcugcugguggaccugaacagaugcagaguggugaccgaccugaucagccugaucagacagagauucggcuucagcagcggcgccuuccugggccuguaccuggagggcggccugcugccccccgccgagagcgccagacuggugagagacaacgacugccugagagugaagcuggaggagagaggcguggccgagaacagcguggugaucagcaacggcgacaucaaccugagccugagaaaggccaagaagagagccuuccagcuggaggagggcgaggagaccgagcccgacugcaaguacagcaagaagcacuggaagagcagagagaacaacaacaacaacgagaaggugcuggaccuggagcccaaggccgugaccgaccagaccgugagcaagaagaacaagagaaagaacaaggccaccugcggcaccgugggcgacgacaacgaggaggccaagagaaagagccccaagaagaaggagaagugcgaguacaagaagaaggccaagaaccccaagagccccaaggugcaggccgugaaggacugggccaaccagagaugcagcagccccaagggcagcgccagaaacagccuggugaaggccaagagaaagggcagcgugagcgugugcagcaaggagagccccagcagcagcagcgagagcgagagcugcgacgagagcaucagcgacggccccagcaaggugacccuggaggccagaaacagcagcgagaagcugcccaccgagcugagcaaggaggagcccagcaccaagaacaccaccgccgacaagcuggccaucaagcugggcuucagccugacccccagcaagggcaagaccagcggcaccaccagcagcagcagcgacagcagcgccgagagcgacgaccagugccugaugagcagcagcacccccgagugcgccgccggcuuccugaagaccgugggccuguucgccggcagaggcagacccggccccggccugagcagccagaccgccggcgccgccggcuggagaagaagcggcagcaacggcggcggccaggcccccggcgccagccccagcgugagccugcccgccagccugggcagaggcuggggcagagaggagaaccuguucagcuggaagggcgccaagggcagaggcaugagaggcagaggcagaggcagaggccaccccgugagcugcguggugaacagaagcaccgacaaccagagacagcagcagcugaacgacguggugaagaacagcagcaccaucauccagaaccccguggagacccccaagaaggacuacagccugcugccccugcuggccgccgccccccaggugggcgagaagaucgccuucaagcugcuggagcugaccagcagcuacagccccgacgugagcgacuacaaggagggcagaauccugagccacaaccccgagacccagcagguggacaucgagauccugagcagccugcccgcccugagagagcccggcaaguucgaccugguguaccacaacgagaacggcgccgaggugguggaguacgccgugacccaggagagcaagaucaccguguucuggaaggagcugaucgaccccagacugaucaucgagagccccagcaacaccagcagcaccgagcccgccuaa

SEQ ID NO: 15450 - RNA, 2043 nt, Artificial Sequence
  COL10A1__Homo_sapiens__XP_011533735
augcugccccagauccccuuccugcugcuggugagccugaaccuggugcacggcguguucuacgccgagagauaccagaugcccaccggcaucaagggcccccugcccaacaccaagacccaguucuucauccccuacaccaucaagagcaagggcaucgccgugagaggcgagcagggcacccccggcccccccggccccgccggccccagaggccaccccggccccagcggcccccccggcaagcccggcuacggcagccccggccugcagggcgagcccggccugcccggcccccccggccccagcgccgugggcaagcccggcgugcccggccugcccggcaagcccggcgagagaggccccuacggccccaagggcgacgugggccccgccggccugcccggccccagaggcccccccggcccccccggcauccccggccccgccggcaucagcgugcccggcaagcccggccagcagggccccaccggcgcccccggccccagaggcuuccccggcgagaagggcgcccccggcgugcccggcaugaacggccagaagggcgagaugggcuacggcgcccccggcagacccggcgagagaggccugcccggcccccagggccccaccggccccagcggcccccccggcgugggcaagagaggcgagaacggcgugcccggccagcccggcaucaagggcgacagaggcuuccccggcgagaugggccccaucggcccccccggcccccagggcccccccggcgagagaggccccgagggcaucggcaagcccggcgccgccggcgcccccggccagcccggcauccccggcaccaagggccugcccggcgcccccggcaucgccggcccccccggcccccccggcuucggcaagcccggccugcccggccugaagggcgagagaggccccgccggccugcccggcggccccggcgccaagggcgagcagggccccgccggccugcccggcaagcccggccugaccggcccccccggcaacaugggcccccagggccccaagggcauccccggcagccacggccugcccggccccaagggcgagaccggccccgccggccccgccggcuaccccggcgccaagggcgagagaggcagccccggcagcgacggcaagcccggcuaccccggcaagcccggccuggacggccccaagggcaaccccggccugcccggccccaagggcgaccccggcgugggcggcccccccggccugcccggccccgugggccccgccggcgccaagggcaugcccggccacaacggcgaggccggccccagaggcgcccccggcauccccggcaccagaggccccaucggcccccccggcauccccggcuuccccggcagcaagggcgaccccggcagccccggcccccccggccccgccggcaucgccaccaagggccugaacggccccaccggcccccccggcccccccggccccagaggccacagcggcgagcccggccugcccggcccccccggcccccccggcccccccggccaggccgugaugcccgagggcuucaucaaggccggccagagacccagccugagcggcaccccccuggugagcgccaaccagggcgugaccggcaugcccgugagcgccuucaccgugauccugagcaaggccuaccccgccaucggcacccccauccccuucgacaagauccuguacaacagacagcagcacuacgaccccagaaccggcaucuucaccugccagauccccggcaucuacuacuucagcuaccacgugcacgugaagggcacccacgugugggugggccuguacaagaacggcacccccgugauguacaccuacgacgaguacaccaagggcuaccuggaccaggccagcggcagcgccaucaucgaccugaccgagaacgaccagguguggcugcagcugcccaacgccgagagcaacggccuguacagcagcgaguacgugcacagcagcuucagcggcuuccugguggcccccauguaa

SEQ ID NO: 15451 - RNA, 4395 nt, Artificial Sequence
  COL11A1__Homo_sapiens__XP_011539021
auggagcccuggagcagcagauggaagaccaagagauggcugugggacuucaccgugaccacccuggcccugaccuuccuguuccaggccagagaggugagaggcgccgcccccguggacgugcugaaggcccuggacuuccacaacagccccgagggcaucagcaagaccaccggcuucugcaccaacagaaagaacagcaagggcagcgacaccgccuacagagugagcaagcaggcccagcugagcgcccccaccaagcagcuguuccccggcggcaccuuccccgaggacuucagcauccuguucaccgugaagcccaagaagggcauccagagcuuccugcugagcaucuacaacgagcacggcauccagcagaucggcguggaggugggcagaagccccguguuccuguucgaggaccacaccggcaagcccgcccccgaggacuacccccuguucagaaccgugaacaucgccgacggcaaguggcacagaguggccaucagcguggagaagaagaccgugaccaugaucguggacugcaagaagaagaccaccaagccccuggacagaagcgagagagccaucguggacaccaacggcaucaccguguucggcaccagaauccuggacgaggagguguucgagggcgacauccagcaguuccugaucaccggcgaccccaaggccgccuacgacuacugcgagcacuacagccccgacugcgacagcagcgcccccaaggccgcccaggcccaggagccccagaucgacgaguacgcccccgaggacaucaucgaguacgacuacgaguacggcgaggccgaguacaaggaggccgagagcgugaccgagggccccaccgugaccgaggagaccaucgcccagaccgaggccaacaucguggacgacuuccaggaguacaacuacggcaccauggagagcuaccagaccgaggcccccagacacgugagcggcaccaacgagcccaaccccguggaggagaucuucaccgaggaguaccugaccggcgaggacuacgacagccagagaaagaacagcgaggacacccuguacgagaacaaggagaucgacggcagagacagcgaccugcugguggacggcgaccugggcgaguacgacuucuacgaguacaaggaguacgaggacaagcccaccagcccccccaacgaggaguucggccccggcgugcccgccgagaccgacaucaccgagaccagcaucaacggccacggcgccuacggcgagaagggccagaagggcgagcccgccgugguggagcccggcaugcugguggagggcccccccggccccgccggccccgccggcaucaugggcccccccggccugcagggccccaccggcccccccggcgaccccggcgacagaggcccccccggcagacccggccugcccggcgccgacggccugcccggcccccccggcaccaugcugaugcugcccuucagauacggcggcgacggcagcaagggccccaccaucagcgcccaggaggcccaggcccaggccauccugcagcaggccagaaucgcccugagaggcccccccggccccaugggccugaccggcagacccggccccgugggcggccccggcagcagcggcgccaagggcgagagcggcgaccccggcccccagggccccagaggcgugcagggcccccccggccccaccggcaagcccggcaagagaggcagacccggcgccgacggcggcagaggcaugcccggcgagcccggcgccaagggcgacagaggcuucgacggccugcccggccugcccggcgacaagggccacagaggcgagagaggcccccagggcccccccggcccccccggcgacgacggcaugagaggcgaggacggcgagaucggccccagaggccugcccggcgaggccggccccagaggccugcugggccccagaggcacccccggcgcccccggccagcccggcauggccggcguggacggcccccccggccccaagggcaacaugggcccccagggcgagcccggcccccccggccagcagggcaaccccggcccccagggccugcccggcccccagggccccaucggcccccccggcgagaagggcccccagggcaagcccggccuggccggccugcccggcgccgacggcccccccggccaccccggcaaggagggccagagcggcgagaagggcgcccugggcccccccggcccccagggccccaucggcuaccccggccccagaggcgugaagggcgccgacggcgugagaggccugaagggcagcaagggcgagaagggcgaggacggcuuccccggcuucaagggcgacaugggccugaagggcgacagaggcgaggugggccagaucggccccagaggcgaggacggccccgagggccccaagggcagagccggccccaccggcgaccccggccccagcggccaggccggcgagaagggcaagcugggcgugcccggccugcccggcuaccccggcagacagggccccaagggcagcaccggcuuccccggcuuccccggcgccaacggcgagaagggcgccagaggcguggccggcaagcccggccccagaggccagagaggccccaccggccccagaggcagcagaggcgccagaggccccaccggcaagcccggccccaagggcaccagcggcggcgacggcccccccggcccccccggcgagagaggcccccagggcccccagggccccgugggcuuccccggccccaagggcccccccggcccccccggcaaggacggccugcccggccaccccggccagagaggcgagaccggcuuccagggcaagaccggcccccccggccccggcggcguggugggcccccagggccccaccggcgagaccggccccaucggcgagagaggccaccccggcccccccggcccccccggcgagcagggccugcccggcgccgccggcaaggagggcgccaagggcgaccccggcccccagggcaucagcggcaaggacggccccgccggccugagaggcuuccccggcgagagaggccugcccggcgcccagggcgcccccggccugaagggcggcgagggcccccagggcccccccggccccgugggcagccccggcgagagaggcagcgccggcaccgccggccccaucggccugcccggcagacccggcccccagggcccccccggccccgccggcgagaagggcgcccccggcgagaagggcccccagggccccgccggcagagacggcgugcagggccccgugggccugcccggccccgccggccccgccggcagccccggcgaggacggcgacaagggcgagaucggcgagcccggccagaagggcagcaagggcgacaagggcgagaacggcccccccggcccccccggccugcagggccccgugggcgcccccggcaucgccggcggcgacggcgagcccggccccagaggccagcagggcauguucggccagaagggcgacgagggcgccagaggcuuccccggcccccccggccccaucggccugcagggccugcccggcccccccggcgagaagggcgagaacggcgacgugggccccaugggcccccccggcccccccggccccagaggcccccagggccccaacggcgccgacggcccccagggcccccccggcagcgugggcagcgugggcggcgugggcgagaagggcgagcccggcgaggccggcaaccccggcccccccggcgaggccggcgugggcggccccaagggcgagagaggcgagaagggcgaggccggcccccccggcgccgccggcccccccggcgccaagggcccccccggcgacgacggccccaagggcaaccccggccccgugggcuuccccggcgaccccggcccccccggcgagcccggccccgccggccaggacggcgugggcggcgacaagggcgaggacggcgaccccggccagcccggcccccccggccccagcggcgaggccggcccccccggcccccccggcaagagaggcccccccggcgccgccggcgccgagggcagacagggcgagaagggcgccaagggcgaggccggcgccgagggcccccccggcaagaccggccccgugggcccccagggccccgccggcaagcccggccccgagggccugagaggcauccccggccccgugggcgagcagggccugcccggcgccgccggccaggacggcccccccggccccaugaagcugcccgugaccaccuacugcaucgugagcaccggcgagaucaagcugcccagacacagccccuucccccaccugcugaacaccaccuaa

SEQ ID NO: 15452 - RNA, 873 nt, Artificial Sequence
  COL11A2__Homo_sapiens__NP_001157243
auggagagaugcagcagaugccacagacugcugcugcugcugccccuggugcugggccugagcgccgcccccggcugggccggcgccccccccguggacgugcugagagcccugagauuccccagccugcccgacggcgugagaagagccaagggcaucugccccgccgacguggccuacagaguggccagacccgcccagcugagcgcccccaccagacagcuguuccccggcggcuuccccaaggacuucagccugcugaccguggugagaaccagacccggccugcaggccccccugcugacccuguacagcgcccagggcgugagacagcugggccuggagcugggcagacccgugagauuccuguacgaggaccagaccggcagaccccagccccccagccagcccguguucagaggccugagccuggccgacggcaaguggcacagaguggccguggccgugaagggccagagcgugacccugaucguggacugcaagaagagagugaccagaccccugcccagaagcgccagacccgugcuggacacccacggcgugaucaucuucggcgccagaauccuggacgaggagguguucgagggcgacgugcaggagcuggccaucgugcccggcgugcaggccgccuacgagagcugcgagcagaaggagcuggagugcgagggcggccagagagagagaccccagaaccagcagccccacagagcccagagaagcccccagcagcagcccagcagacugcacagaccccagaaccaggagccccagagccaggugagagagcugggcgagccccccagcgccgcccaccccagagagggcagacaccccggcaucagcccccccuaa

SEQ ID NO: 15453 - RNA, 9192 nt, Artificial Sequence
  COL12A1__Homo_sapiens__NP_004361
augagaagcagacugccccccgcccuggccgcccugggcgccgcccugcugcugagcagcaucgaggccgagguggacccccccagcgaccugaacuucaagaucaucgacgagaacaccgugcacaugagcugggccaagcccguggaccccaucgugggcuacagaaucaccguggaccccaccaccgacggccccaccaaggaguucacccugagcgccagcaccaccgagacccugcugagcgagcuggugcccgagaccgaguacguggugaccaucaccagcuacgacgagguggaggagagcgugcccgugaucggccagcugaccauccagaccggcagcagcaccaagcccguggagaagaagcccggcaagaccgagauccagaagugcagcgugagcgccuggaccgaccugguguuccugguggacggcagcuggagcgugggcagaaacaacuucaaguacauccuggacuucaucgccgcccuggugagcgccuucgacaucggcgaggagaagaccagagugggcguggugcaguacagcagcgacaccagaaccgaguucaaccugaaccaguacuaccagagagacgagcugcuggccgccaucaagaagauccccuacaagggcggcaacaccaugaccggcgacgccaucgacuaccuggugaagaacaccuucaccgagagcgccggcgccagagugggcuuccccaagguggccaucaucaucaccgacggcaagagccaggacgagguggagauccccgccagagagcugagaaacgugggcguggagguguucagccugggcaucaaggccgccgacgccaaggagcugaagcagaucgccagcacccccagccugaaccacguguucaacguggccaacuucgacgccaucguggacauccagaacgagaucaucagccaggugugcagcggcguggacgagcagcugggcgagcuggugagcggcgaggaggugguggagccccccagcaaccugaucgccauggaggugagcagcaaguacgugaagcugaacuggaaccccagccccagccccgugaccggcuacaaggugauccugacccccaugaccgccggcagcagacagcacgcccugagcgugggcccccagaccaccacccugagcgugagagaccugagcgccgacaccgaguaccagaucagcgugagcgccaugaagggcaugaccagcagcgagcccaucagcaucauggagaagacccagcccaugaaggugcagguggagugcagcagaggcguggacaucaaggccgacaucguguuccugguggacggcagcuacagcaucggcaucgccaacuucgugaaggugagagccuuccuggaggugcuggugaagagcuucgagaucagccccaacagagugcagaucagccuggugcaguacagcagagacccccacaccgaguucacccugaagaaguucaccaagguggaggacaucaucgaggccaucaacaccuuccccuacagaggcggcagcaccaacaccggcaaggccaugaccuacgugagagagaagaucuucgugcccagcaagggcagcagaagcaacgugcccaaggugaugauccugaucaccgacggcaagagcagcgacgccuucagagaccccgccaucaagcugagaaacagcgacguggagaucuucgccgugggcgugaaggacgccgugagaagcgagcuggaggccaucgccagcccccccgccgagacccacguguucaccguggaggacuucgacgccuuccagagaaucagcuucgagcugacccagagcaucugccugagaaucgagcaggagcuggccgccaucaagaagaaggccuacgugccccccaaggaccugagcuucagcgaggugaccagcuacggcuucaagaccaacuggagccccgccggcgagaacguguucagcuaccacaucaccuacaaggaggccgccggcgacgacgaggugaccgugguggagcccgccagcagcaccagcguggugcugagcagccugaagcccgagacccuguaccuggugaacgugaccgccgaguacgaggacggcuucagcaucccccuggccggcgaggagaccaccgaggaggugaagggcgcccccagaaaccugaaggugaccgacgagaccaccgacagcuucaagaucaccuggacccaggcccccggcagagugcugagauacagaaucaucuacagacccguggccggcggcgagagcagagaggugaccaccccccccaaccagagaagaagaacccuggagaaccugauccccgacaccaaguacgaggugagcgugauccccgaguacuucagcggccccggcaccccccugaccggcaacgccgccaccgaggaggugagaggcaaccccagagaccugagagugagcgaccccaccaccagcaccaugaagcugagcuggagcggcgcccccggcaaggugaagcaguaccuggugaccuacacccccguggccggcggcgagacccaggaggugaccgugagaggcgacaccaccaacaccgugcugcagggccugaaggagggcacccaguacgcccugagcgugaccgcccuguacgccagcggcgccggcgacgcccuguucggcgagggcaccacccuggaggagagaggcagcccccaggaccuggugaccaaggacaucaccgacaccagcaucggcgccuacuggaccagcgcccccggcauggugagaggcuacagagugagcuggaagagccuguacgacgacguggacaccggcgagaagaaccugcccgaggacgccauccacaccaugaucgagaaccugcagcccgagaccaaguacagaaucagcguguucgccaccuacagcagcggcgagggcgagccccugaccggcgacgccaccaccgagcugagccaggacagcaagacccugaagguggacgaggagaccgagaacaccaugagagugaccuggaagcccgcccccggcaagguggugaacuacagagugguguacagaccccacggcagaggcaagcagaugguggccaaggugccccccaccgugaccagcaccgugcugaagagacugcagccccagaccaccuacgacaucaccgugcugcccaucuacaagaugggcgagggcaagcugagacagggcagcggcaccaccgccagcagauucaagagccccagaaaccugaagaccagcgaccccaccaugagcagcuucagagugaccugggagcccgcccccggcgaggugaagggcuacaaggugaccuuccaccccaccggcgacgacagaagacugggcgagcugguggugggccccuacgacaacaccguggugcuggaggagcugagagccggcaccaccuacaaggugaacguguucggcauguucgacggcggcgagagcagcccccuggugggccaggagaugaccacccugagcgacaccaccgugaugcccauccugagcagcggcauggagugccugaccagagccgaggccgacaucgugcugcugguggacggcagcuggagcaucggcagagccaacuucagaaccgugagaagcuucaucagcagaaucguggagguguucgacaucggccccaagagagugcagaucgcccuggcccaguacagcggcgaccccagaaccgaguggcagcugaacgcccacagagacaagaagagccugcugcaggccguggccaaccugcccuacaagggcggcaacacccugaccggcauggcccugaacuucaucagacagcagaacuucagaacccaggccggcaugagacccagagccagaaagaucggcgugcugaucaccgacggcaagagccaggacgacguggaggcccccagcaagaagcugaaggacgagggcguggagcuguucgccaucggcaucaagaacgccgacgagguggagcugaagaugaucgccaccgaccccgacgacacccacgccuacaacguggccgacuucgagagccugagcagaaucguggacgaccugaccaucaaccugugcaacagcgugaagggccccggcgaccuggaggcccccagcaaccuggugaucagcgagagaacccacagaagcuucagagugagcuggaccccccccagcgacagcguggacagauacaagguggaguacuaccccgugagcggcggcaagagacaggaguucuacgugagcagaauggagaccagcaccgugcugaaggaccugaagcccgagaccgaguacguggugaacguguacagcgugguggaggacgaguacagcgagccccugaagggcaccgagaagacccugcccgugcccguggugagccugaacaucuacgacgugggccccaccaccaugcacgugcaguggcagcccgugggcggcgccaccggcuacauccugagcuacaagcccgugaaggacaccgagcccaccagacccaaggaggugagacugggccccaccgugaacgacaugcagcugaccgaccuggugcccaacaccgaguacgccgugaccgugcaggccgugcugcacgaccugaccagcgagcccgugaccgugagagaggugacccugccccugcccagaccccaggaccugaagcugagagacgugacccacagcaccaugaacguguucugggagcccgugcccggcaaggugagaaaguacaucgugagauacaagacccccgaggaggacgugaaggagguggagguggacagaagcgagaccagcaccagccugaaggaccuguucagccagacccuguacaccgugagcgugagcgccgugcacgacgagggcgagagcccccccgugaccgcccaggagaccaccagacccgugcccgcccccaccaaccugaagaucaccgaggugaccagcgagggcuucagaggcaccugggaccacggcgccagcgacgugagccuguacagaaucaccugggcccccuucggcagcagcgacaagauggagaccauccugaacggcgacgagaacacccugguguucgagaaccugaaccccaacaccaucuacgaggugagcaucaccgccaucuaccccgacgagagcgagagcgacgaccugaucggcagcgagagaacccugcccauccugaccacccaggcccccaagagcggccccagaaaccugcagguguacaacgccaccagcaacagccugaccgugaagugggaccccgccagcggcagagugcagaaguacagaaucaccuaccagcccagcaccggcgagggcaacgagcagaccaccaccaucggcggcagacagaacagcguggugcugcagaagcugaagcccgacacccccuacaccaucaccgugagcagccuguaccccgacggcgagggcggcagaaugaccggcagaggcaagaccaagccccugaacaccgugagaaaccugagaguguacgaccccagcaccagcacccugaacgugagaugggaccacgccgagggcaaccccagacaguacaagcuguucuacgcccccgccgccggcggccccgaggagcuggugcccauccccggcaacaccaacuacgccauccugagaaaccugcagcccgacaccagcuacaccgugaccguggugcccguguacaccgagggcgacggcggcagaaccagcgacaccggcagaacccugaugagaggccuggccagaaacgugcagguguacaaccccacccccaacagccuggacgugagaugggaccccgcccccggccccgugcugcaguacagagugguguacagccccguggacggcaccagacccagcgagagcaucguggugcccggcaacaccagaauggugcaccuggagagacugauccccgacacccuguacagcgugaaccugguggcccuguacagcgacggcgagggcaaccccagccccgcccagggcagaacccugcccagaagcggccccagaaaccugagaguguucggcgagaccaccaacagccugagcguggccugggaccacgccgacggccccgugcagcaguacagaaucaucuacagccccaccgugggcgaccccaucgacgaguacaccaccgugcccggcagaagaaacaacgugauccugcagccccugcagcccgacacccccuacaagaucaccgugaucgccguguacgaggacggcgacggcggccaccugaccggcaacggcagaaccgugggccugcugcccccccagaacauccacaucagcgacgagugguacaccagauucagagugagcugggaccccagccccagccccgugcugggcuacaagaucguguacaagcccgugggcagcaacgagcccauggaggccuucgugggcgagaugaccagcuacacccugcacaaccugaaccccagcaccaccuacgacgugaacguguacgcccaguacgacagcggccugagcgugccccugaccgaccagggcaccacccuguaccugaacgugaccgaccugaagaccuaccagaucggcugggacaccuucugcgugaaguggagcccccacagagccgccaccagcuacagacugaagcugagccccgccgacggcaccagaggccaggagaucaccgugagaggcagcgagaccagccacugcuucaccggccugagccccgacaccgacuacggcgugaccguguucgugcagacccccaaccuggagggccccggcgugagcgugaaggagcacaccaccgugaagcccaccgaggcccccaccgagccccccacccccccccccccccccaccaucccccccgccagagacgugugcaagggcgccaaggccgacaucguguuccugaccgacgccagcuggagcaucggcgacgacaacuucaacaagguggugaaguucaucuucaacaccgugggcggcuucgacgagaucagccccgccggcauccaggugagcuucgugcaguacagcgacgaggugaagagcgaguucaagcugaacaccuacaacgacaaggcccuggcccugggcgcccugcagaacaucagauacagaggcggcaacaccagaaccggcaaggcccugaccuucaucaaggagaaggugcugaccugggagagcggcaugagaaagaacgugcccaaggugcuggugguggugaccgacggcagaagccaggacgaggugaagaaggccgcccuggugauccagcagagcggcuucagcguguucguggugggcguggccgacguggacuacaacgagcuggccaacaucgccagcaagcccagcgagagacacguguucaucguggacgacuucgagagcuucgagaagaucgaggacaaccugaucaccuucgugugcgagaccgccaccagcagcugcccccugaucuaccuggacggcuacaccagccccggcuucaagaugcuggaggccuacaaccugaccgagaagaacuucgccagcgugcagggcgugagccuggagagcggcagcuuccccagcuacagcgccuacagaauccagaagaacgccuucgugaaccagcccaccgccgaccugcaccccaacggccugccccccagcuacaccaucauccugcuguucagacugcugcccgagacccccagcgaccccuucgccaucuggcagaucaccgacagagacuacaagccccaggugggcgugaucgccgaccccagcagcaagacccugagcuucuucaacaaggacaccagaggcgaggugcagaccgugaccuucgacaccgaggaggugaagacccuguucuacggcagcuuccacaaggugcacaucguggugaccagcaagagcgugaagaucuacaucgacugcuacgagaucaucgagaaggacaucaaggaggccggcaacaucaccaccgacggcuacgagauccugggcaagcugcugaagggcgagagaaagagcgccgccuuccagauccagagcuucgacaucgugugcagccccguguggaccagcagagacagaugcugcgacauccccagcagaagagacgagggcaagugccccgccuuccccaacagcugcaccugcacccaggacagcgugggcccccccggcccccccggccccgccggcggccccggcgccaagggccccagaggcgagagaggcaucagcggcgccaucggcccccccggccccagaggcgacaucggcccccccggcccccagggcccccccggcccccagggccccaacggccugagcauccccggcgagcagggcagacagggcaugaagggcgacgccggcgagcccggccugcccggcagaaccggcacccccggccugcccggcccccccggccccaugggcccccccggcgacagaggcuucaccggcaaggacggcgccaugggccccagaggcccccccggcccccccggcagccccggcagccccggcgugaccggccccagcggcaagcccggcaagcccggcgaccacggcagacccggccccagcggccugaagggcgagaagggcgacagaggcgacaucgccagccagaacaugaugagagccguggccagacaggugugcgagcagcugaucagcggccagaugaacagauucaaccagaugcugaaccagauccccaacgacuaccagagcagcagaaaccagcccggcccccccggcccccccggcccccccggcagcgccggcgccagaggcgagcccggccccggcggcagacccggcuuccccggcacccccggcaugcagggcccccccggcgagagaggccugcccggcgagaagggcgagagaggcaccggcagcagcggccccagaggccugcccggcccccccggcccccagggcgagagcagaaccggcccccccggcagcaccggcagcagaggcccccccggcccccccggcagacccggcaacagcggcaucagaggcccccccggcccccccggcuacugcgacagcagccagugcgccagcauccccuacaacggccagggcuaccccggcagcggcuaa

SEQ ID NO: 15454 - RNA, 2154 nt, Artificial Sequence
  COL13A1__Homo_sapiens__NP_001123575
augguggccgagagaacccacaaggccgccgccaccggcgccagaggccccggcgagcugggcgcccccggcaccguggcccugguggccgccagagccgagagaggcgccagacugcccagccccggcagcugcggccugcugacccuggcccugugcagccuggcccugagccugcuggcccacuucagaaccgccgagcugcaggccagagugcugagacuggaggccgagagaggcgagcagcagauggagaccgccauccugggcagagugaaccagcugcuggacgagaaguggaagcugcacagcagaagaagaagagaggcccccaagaccagccccggcugcaacugcccccccggcccccccggccccaccggcagacccggccugcccggcgacaagggcgccaucggcaugcccggcagagugggcagccccggcgacgccggccugagcaucaucggccccagaggcccccccggccagcccggcaccagaggcuuccccggcuuccccggccccaucggccuggacggcaagcccggccaccccggccccaagggcgacaugggccugaccggcccccccggccagcccggcccccagggccagaagggcgagaagggccagugcggcgaguacccccacagagagugccugagcagcaugcccgccgcccugagaagcagccagaucaucgcccugaagcugcugccccugcugaacagcgugagacuggcccccccccccgugaucaagagaagaaccuuccagggcgagcagagccaggccagcauccagggcccccccggcccccccggcccccccggccccagcggcccccugggccaccccggccugcccggccccaugggcccccccggccugcccggcccccccggccccaagggcgaccccggcauccagggcuaccacggcagaaagggcgagagaggcaugcccggcaugcccggcaagcacggcgccaagggcgcccccggcaucgccguggccggcaugaagggcgagcccggcauccccggcaccaagggcgagaagggcgccgagggcagccccggccugcccggccugcugggccagaagggcgagaagggcgacgccggcaacagcaucggcggcggcagaggcgagcccggcccccccggccugcccggcccccccggccccaagggcgaggccggcguggacggccaggugggcccccccggccagcccggcgacaagggcgagagaggcgccgccggcgagcagggccccgacggccccaagggcagcaagggcgagcccggcaagggcgagaugguggacuacaacggcaacaucaacgaggcccugcaggagaucagaacccuggcccugaugggcccccccggccugcccggccagaucggcccccccggcgcccccggcauccccggccagaagggcgagaucggccugcccggcccccccggccacgacggcgagaagggccccagaggcaagcccggcgacaugggcccccccggcccccagggcccccccggcaaggacggcccccccggcgugaagggcgagaacggccaccccggcagccccggcgagaagggcgagaagggcgagaccggccaggccggcagccccggcgagaagggcgaggccggcgagaagggcaaccccggcgccgaggugcccggccugcccggccccgagggcccccccggcccccccggccugcagggcgugcccggccccaagggcgaggccggccuggacggcgccaagggcgagaagggcuuccagggcgagaagggcgacagaggcccccugggccugcccggcgccagcggccuggacggcagacccggcccccccggcacccccggccccaucggcgugcccggccccgccggccccaagggcgagagaggcagcaagggcgaccccggcaugaccggccccaccggcgccgccggccugcccggccugcacggcccccccggcgacaagggcaacagaggcgagagaggcaagaagggcagcagaggccccaagggcgacaagggcgaccagggcgcccccggccuggacgcccccugcccccugggcgaggacggccugcccgugcagggcugcuggaacaaguaa

SEQ ID NO: 15455 - RNA, 5343 nt, Artificial Sequence
  COL14A1__Homo_sapiens__XP_005251116
augaagaucuuccagagaaagaugagauacuggcugcugccccccuuccuggccaucguguacuucugcaccaucgugcagggccagguggccccccccaccagacugagauacaacgugaucagccacgacagcauccagaucagcuggaaggcccccagaggcaaguucggcggcuacaagcugcuggugacccccaccagcggcggcaagaccaaccagcugaaccugcagaacaccgccaccaaggccaucauccagggccugaugcccgaccagaacuacaccgugcagaucaucgccuacaacaaggacaaggagagcaagcccgcccagggccaguucagaaucaaggaccuggagaagagaaaggaccccaagcccagagugaaggugguggacagaggcaacggcagcagacccagcagccccgaggaggugaaguucgugugccagacccccgccaucgccgacaucgugauccugguggacggcagcuggagcaucggcagauucaacuucagacuggugagacacuuccuggagaaccuggugaccgccuucgacgugggcagcgagaagaccagaaucggccuggcccaguacagcggcgaccccagaaucgaguggcaccugaacgccuucagcaccaaggacgaggugaucgaggccgugagaaaccugcccuacaagggcggcaacacccugaccggccuggcccugaacuacaucuucgagaacagcuucaagcccgaggccggcagcagaaccggcgugagcaagaucggcauccugaucaccgacggcaagagccaggacgacaucaucccccccagcagaaaccugagagagagcggcguggagcuguucgccaucggcgugaagaacgccgacgugaacgagcugcaggagaucgccagcgagcccgacagcacccacguguacaacguggccgaguucgaccugaugcacaccgugguggagagccugaccagaacccugugcagcagaguggaggagcaggacagagagaucaaggccagcgcccacgccaucaccggcccccccaccgagcugaucaccagcgaggugaccgccagaagcuucauggugaacuggacccacgcccccggcaacguggagaaguacagagugguguacuaccccaccagaggcggcaagcccgacgagguggugguggacggcaccgugagcagcaccgugcugaagaaccugaugagccugaccgaguaccagaucgccguguucgccaucuacgcccacaccgccagcgagggccugagaggcaccgagaccacccuggcccugcccauggccagcgaccugcugcuguacgacgugaccgagaacagcaugagagugaagugggacgccgugcccggcgccagcggcuaccugauccuguacgccccccugaccgagggccuggccggcgacgagaaggagaugaagaucggcgagacccacaccgacaucgagcugagcggccugcugcccaacaccgaguacaccgugaccguguacgccauguucggcgaggaggccagcgaccccgugaccggccaggagaccacccuggcccugagcccccccagaaaccugagaaucagcaacgugggcagcaacagcgccagacugaccugggaccccaccagcagacagaucaacggcuacagaaucguguacaacaacgccgacggcaccgagaucaacgagguggagguggaccccaucaccaccuucccccugaagggccugaccccccugaccgaguacaccaucgccaucuucagcaucuacgacgagggccagagcgagccccugaccggcguguucaccaccgaggaggugcccgcccagcaguaccuggagaucgacgaggugaccaccgacagcuucagagugaccuggcacccccugagcgccgacgagggccugcacaagcugauguggauccccguguacggcggcaagaccgaggagguggugcugaaggaggagcaggacagccacgugaucgagggccuggagcccggcaccgaguacgaggugagccugcuggccgugcuggacgacggcagcgagagcgagguggugaccgccgugggcaccacccuggacagcuucuggaccgagcccgccaccaccaucgugcccaccaccagcgugaccagcguguuccagaccggcaucagaaaccugguggugggcgacgagaccaccagcagccugagagugaagugggacaucagcgacagcgacgugcagcaguucagagugaccuacaugaccgcccagggcgaccccgaggaggaggugaucggcaccgugauggugcccggcagccagaacaaccugcugcugaagccccugcugcccgacaccgaguacaaggugaccgugacccccaucuacaccgacggcgagggcgugagcgugagcgcccccggcaagacccugcccagcagcggcccccagaaccugagagugagcgaggagugguacaacagacugagaaucaccugggacccccccagcagccccgugaagggcuacagaaucguguacaagcccgugagcgugcccggccccacccuggagaccuucgugggcgccgacaucaacaccauccugaucaccaaccugcugagcggcauggacuacaacgugaagaucuucgccagccaggccagcggcuucagcgacgcccugaccggcauggugaagacccuguuccugggcgugaccaaccugcaggccaagcacguggagaugaccagccugugcgcccacuggcaggugcacagacacgccaccgccuacagaguggugaucgagagccugcaggacagacagaagcaggagagcaccgugggcggcggcaccaccagacacugcuucuacggccugcagcccgacagcgaguacaagaucagcguguacaccaagcugcaggagaucgagggccccagcgugagcaucauggagaagacccagagccugcccaccagaccccccaccuucccccccaccaucccccccgccaaggaggugugcaaggccgccaaggccgaccugguguucaugguggacggcagcuggagcaucggcgacgagaacuucaacaagaucaucagcuuccuguacagcaccgugggcgcccugaacaagaucggcaccgacggcacccagguggccauggugcaguucaccgacgaccccagaaccgaguucaagcugaacgccuacaagaccaaggagacccugcuggacgccaucaagcacaucagcuacaagggcggcaacaccaagaccggcaaggccaucaaguacgugagagacacccuguucaccgccgagagcggcaccagaagaggcauccccaaggugaucguggugaucaccgacggcagaagccaggacgacgugaacaagaucagcagagagaugcagcuggacggcuacagcaucuucgccaucggcguggccgacgccgacuacagcgagcuggugagcaucggcagcaagcccagcgccagacacguguucuucguggacgacuucgacgccuucaagaagaucgaggacgagcugaucaccuucgugugcgagaccgccagcgccaccugccccguggugcacaaggacggcaucgaccuggccggcuucaagaugauggagauguucggccugguggagaaggacuucagcagcguggagggcgugagcauggagcccggcaccuucaacguguuccccugcuaccagcugcacaaggacgcccuggugagccagcccaccagauaccugcaccccgagggccugcccagcgacuacaccaucagcuuccuguucagaauccugcccgacaccccccaggagcccuucgcccugugggagauccugaacaagaacagcgacccccuggugggcgugauccuggacaacggcggcaagacccugaccuacuucaacuacgaccagagcggcgacuuccagaccgugaccuucgagggccccgagaucagaaagaucuucuacggcagcuuccacaagcugcacaucguggugagcgagacccuggugaagguggugaucgacugcaagcaggugggcgagaaggccaugaacgccagcgccaacaucaccagcgacggcguggaggugcugggcaagauggugagaagcagaggccccggcggcaacagcgcccccuuccagcugcagauguucgacaucgugugcagcaccagcugggccaacaccgacaagugcugcgagcugcccggccugagagacgacgagagcugccccgaccugccccacagcugcagcugcagcgagaccaacgagguggcccugggccccgccggcccccccggcggccccggccugagaggccccaagggccagcagggcgagcccggccccaagggccccgacggccccagaggcgagaucggccugcccggcccccagggcccccccggcccccagggccccagcggccugagcauccagggcaugcccggcaugcccggcgagaagggcgagaagggcgacaccggccugcccggcccccagggcauccccggcggcgugggcagccccggcagagacggcagccccggccagagaggccugcccggcaaggacggcagcagcggcccccccggcccccccggccccaucggcauccccggcacccccggcgugcccggcaucaccggcagcaugggcccccagggcgcccugggcccccccggcgugcccggcgccaagggcgagagaggcgagagaggcgaccugcagagccaggccauggugagaagcguggccagacaggugugcgagcagcugauccagagccacauggccagauacaccgccauccugaaccagauccccagccacagcagcagcaucagaaccgugcagggcccccccggcgagcccggcagacccggcagccccggcgcccccggcgagcagggcccccccggcacccccggcuuccccggcaacgccggcgugcccggcacccccggcgagagaggccugaccggcaucaagggcgagaagggcaaccccggcgugggcacccagggccccagaggcccccccggccccgccggccccagcggcgagagcagacccggcagccccggcccccccggcagccccggccccagaggcccccccggccaccugggcgugcccggcccccagggccccagcggccagcccggcuacugcgaccccagcagcugcagcgccuacggcgugagagaccugauccccuacaacgacuaccagcacuaa

SEQ ID NO: 15456 - RNA, 4167 nt, Artificial Sequence
  COL15A1__Homo_sapiens__XP_011516516
auggcccccagaagaaacaacggccagugcuggugccugcugaugcugcugagcgugagcaccccccugcccgccgugacccagaccagaggcgccaccgagaccgccagccagggccaccuggaccugacccagcugaucggcgugccccugcccagcagcgugagcuucgugaccggcuacggcggcuuccccgccuacagcuucggccccggcgccaacgugggcagacccgccagaacccugauccccagcaccuucuucagagacuucgccaucagcgugguggugaagcccagcagcaccagaggcggcgugcuguucgccaucaccgacgccuuccagaaggugaucuaccugggccugagacugagcggcguggaggacggccaccagagaaucauccuguacuacaccgagcccggcagccacgugagccaggaggccgccgccuucagcgugcccgugaugacccacagauggaacagauucgccaugaucgugcagggcgaggaggugacccugcuggugaacugcgaggagcacagcagaauccccuuccagagaagcagccaggcccuggccuucgagagcagcgccggcaucuucaugggcaacgccggcgccaccggccuggagagauucaccggcagccugcagcagcugaccgugcaccccgaccccagaacccccgaggagcugugcgaccccgaggagagcagcgccagcggcgagaccagcggccugcaggaggccgacggcguggccgagauccuggaggccgugaccuacacccaggccagccccaaggaggccaagguggagcccaucaacaccccccccacccccagcagccccuucgaggacauggagcugagcggcgagcccgugcccgagggcacccuggagaccaccaacaugagcaucauccagcacagcagccccaagcagggcagcggcgagauccugaacgacacccuggagggcgugcacagcguggacggcgaccccaucaccgacagcggcagcggcgccggcgccuuccuggacaucgccgaggagaagaaccuggccgccaccgccgccggccuggccgaggugcccaucagcaccgccggcgaggccgaggccagcagcgugcccaccggcggccccacccugagcaugagcaccgagaaccccgaggagggcgugacccccggccccgacaacgaggagagacuggccgccaccgccgccggcgaggccgaggcccuggccagcaugcccggcgagguggaggccagcggcguggcccccggcgagcuggaccugagcaugagcgcccagagccugggcgaggaggccaccgugggccccagcagcgaggacagccugaccaccgccgccgccgccaccgaggugagccugagcaccuucgaggacgaggaggccagcggcgugcccaccgacggccuggccccccugaccgccaccauggcccccgagagagccgugaccagcggccccggcgacgaggaggaccuggccgccgccaccaccgaggagccccugaucaccgccggcggcgaggagagcggcagccccccccccgacggccccccccugccccugcccaccguggcccccgagagauggaucacccccgcccagagagagcacgugggcaugaagggccaggccggccccaagggcgagaagggcgacgccggcgaggagcugcccggcccccccgagcccagcggccccgugggccccaccgccggcgccgaggccgagggcagcggccugggcuggggcagcgacgugggcagcggcagcggcgaccuggugggcagcgagcagcugcugagaggcccccccggcccccccggcccccccggccugcccggcauccccggcaagcccggcaccgacguguucaugggcccccccggcagccccggcgaggacggccccgccggcgagcccggcccccccggccccgagggccagcccggcguggacggcgccaccggccugcccggcaugaagggcgagaagggcgccagaggccccaacggcagcgugggcgagaagggcgaccccggcaacagaggccugcccggcccccccggcaagaagggccaggccggcccccccggcgugaugggcccccccggcccccccggcccccccggcccccccggccccggcugcaccaugggccugggcuucgaggacaccgagggcagcggcagcacccagcugcugaacgagcccaagcugagcagacccaccgccgccaucggccugaagggcgagaagggcgacagaggccccaagggcgagagaggcauggacggcgccagcaucgugggcccccccggccccagaggcccccccggccacaucaaggugcugagcaacagccugaucaacaucacccacggcuucaugaacuucagcgacauccccgagcuggugggcccccccggccccgacggccugcccggccugcccggcuuccccggccccagaggccccaagggcgacaccggccugcccggcuuccccggccugaagggcgagcagggcgagaagggcgagcccggcgccauccugaccgaggacaucccccuggagagacugaugggcaagaagggcgagcccggcaugcacggcgcccccggccccaugggccccaagggcccccccggccacaagggcgaguucggccugcccggcagacccggcagacccggccugaacggccugaagggcaccaagggcgaccccggcgugaucaugcagggcccccccggccugcccggcccccccggcccccccggcccccccggcgccgugaucaacaucaagggcgccaucuuccccauccccgugagaccccacugcaagaugcccguggacaccgcccaccccggcagccccgagcugaucaccuuccacggcgugaagggcgagaagggcagcuggggccugcccggcagcaagggcgagaagggcgaccagggcgcccagggcccccccggccccccccuggaccuggccuaccugagacacuuccugaacaaccugaagggcgagaacggcgacaagggcuucaagggcgagaagggcgagaagggcgacaucaacggcagcuuccugaugagcggcccccccggccugcccggcaaccccggccccgccggccagaagggcgagaccguggugggcccccagggcccccccggcgcccccggccugcccggcccccccggcuucggcagacccggcgaccccggcccccccggcccccccggcccccccggcccccccgccauccugggcgccgccguggcccugcccggcccccccggcccccccggccagcccggccugcccggcagcagaaaccuggugaccgccuucagcaacauggacgacaugcugcagaaggcccaccuggugaucgagggcaccuucaucuaccugagagacagcaccgaguucuucaucagagugagagacggcuggaagaagcugcagcugggcgagcugauccccauccccgccgacagcccccccccccccgcccugagcagcaacccccaccagcugcugcccccccccaaccccaucagcagcgccaacuacgagaagcccgcccugcaccuggccgcccugaacaugcccuucagcggcgacaucagagccgacuuccagugcuucaagcaggccagagccgccggccugcugagcaccuacagagccuuccugagcagccaccugcaggaccugagcaccaucgugagaaaggccgagagauacagccugcccaucgugaaccugaagggccaggugcuguucaacaacugggacagcaucuucagcggccacggcggccaguucaacaugcacauccccaucuacagcuucgacggcagagacaucaugaccgaccccagcuggccccagaaggugaucuggcacggcagcagcccccacggcgugagacugguggacaacuacugcgaggccuggagaaccgccgacaccgccgugaccggccuggccagcccccugagcaccggcaagauccuggaccagaaggccuacagcugcgccaacagacugaucgugcugugcaucgagaacagcuucaugaccgacgccagaaaguaa

SEQ ID NO: 15457 - RNA, 4692 nt, Artificial Sequence
  COL16A1__Homo_sapiens__XP_011539026
augugggugagcugggcccccggccuguggcugcugggccugugggccaccuucggccacggcgccaacaccggcgcccagugcccccccagccagcaggagggccugaagcuggagcacagcagcagccugcccgccaacgugaccggcuucaaccugauccacagacugagccugaugaagaccagcgccaucaagaagaucagaaaccccaagggcccccugauccugagacugggcgccgcccccgugacccagcccaccagaagaguguuccccagaggccugcccgaggaguucgcccuggugcugacccugcugcugaagaagcacacccaccagaagaccugguaccuguuccaggugaccgacgccaacggcuacccccagaucagccuggaggugaacagccaggagagaagccuggagcugagagcccagggccaggacggcgacuucgugagcugcaucuuccccgugccccagcuguucgaccugagauggcacaagcugaugcugagcguggccggcagaguggccagcgugcacguggacugcagcagcgccagcagccagccccugggccccagaagacccaugagacccgugggccacguguuccugggccuggacgccgagcagggcaagcccgugagcuucgaccugcagcaggugcacaucuacugcgaccccgagcuggugcuggaggagggcugcugcgagauccugcccgccggcugcccccccgagaccagcaaggccagaagagacacccagagcaacgagcugaucgagaucaacccccagagcgagggcaagguguacaccagaugcuucugccuggaggagccccagaacagcgagguggacgcccagcugaccggcagaaucagccagaaggccgagagaggcgccaaggugcaccaggagaccgccgccgacgagugcccccccugcgugcacggcgccagagacagcaacgugacccuggcccccagcggccccaagggcggcaagggcgagagaggccugcccggcccccccggcagcaagggcgagaagggcgccagaggcaacgacugcgugagaaucagccccgacgccccccugcagugcgccgagggccccaagggcgagaagggcgagagcggcgcccugggccccagcggccugcccggcagcaccggcgagaagggccagaagggcgagaagggcgacggcggcaucaagggcgugcccggcaagcccggcagagacggcagacccggcgagaucugcgugaucggccccaagggccagaagggcgaccccggcuucgugggccccgagggccuggccggcgagcccggcccccccggccugcccggcccccccggcaucggccugcccggcacccccggcgaccccggcggcccccccggccccaagggcgacaagggcagcagcggcauccccggcaaggagggccccggcggcaagcccggcaagcccggcgugaagggcgagaagggcgaccccugcgaggugugccccacccugcccgagggcuuccagaacuucgugggccugcccggcaagcccggccccaagggcgagcccggcgaccccgugcccgccagaggcgaccccggcauccagggcaucaagggcgagaagggcgagcccugccugagcugcagcagcguggugggcgcccagcaccuggugagcagcaccggcgccagcggcgacgugggcagccccggcuucggccugcccggccugcccggcagagccggcgugcccggccugaagggcgagaagggcaacuucggcgaggccggccccgccggcagccccggcccccccggccccgugggccccgccggcaucaagggcgccaagggcgagcccugcgagcccugccccgcccugagcaaccugcaggacggcgacgugagagugguggcccugcccggccccagcggcgagaagggcgagcccggcccccccggcuucggccugcccggcaagcagggcaaggccggcgagagaggccugaagggccagaagggcgacgccggcaaccccggcgaccccggcacccccggcaccaccggcagacccggccugagcggcgagcccggcgugcagggccccgccggccccaagggcgagaagggccagcccggccugcccggcgugcagggcccccccggccugaagggcgugcagggcgagcccggcccccccggcagaggcgugcagggcccccagggcgagcccggcgcccccggccugcccggcauccagggccugcccggccccagaggcccccccggccccaccggcgagaagggcgcccagggcagccccggcgugaagggcgccaccggccccgugggcccccccggcgccagcgugagcggcccccccggcagagacggccagcagggccagaccggccugagaggcacccccggcgagaagggccccagaggcgagaagggcgagcccggcgagugcagcugccccagccagggcgaccugaucuucagcggcaugcccggcgcccccggccuguggaugggcagcagcuggcagcccggcccccagggcccccccggcauccccggcccccccggcccccccggcgugcccggccugcagggcgugcccggcaacaacggccugcccggccagcccggccugaccgccgagcugggcagccugcccaucgagcagcaccugcugaagagcaucugcggcgacugcgugcagggccagagagcccaccccggcuaccugguggagaagggcgagaagggcgaccagggcauccccggcgugcccggccuggacaacugcgcccagugcuuccugagccuggagagacccagagccgaggaggccagaggcgacaacagcgagggcgaccccggcugcgugggcagccccggccugcccggcccccccggccugcccggccagagaggcgaggagggcccccccggcaugagaggcagccccggcccccccggccccaucggcccccccggcuuccccggcgccgugggcagccccggccugcccggccugcagggcgagagaggccugaccggccugaccggcgacaagggcgagcccggcccccccggccagcccggcuaccccggcgccaccggcccccccggccugcccggcaucaagggcgagagaggcuacaccggcagcgccggcgagaagggcgagcccggcccccccggcagcgagggccugcccggcccccccggccccgccggccccagaggcgagagaggcccccagggcaacagcggcgagaagggcgaccagggcuuccagggccagcccggcuuccccggcccccccggcccccccggcuuccccggcaaggugggcagccccggcccccccggcccccaggccgagaagggcagcgagggcaucagaggccccagcggccugcccggcagccccggcccccccggcccccccggcauccagggccccgccggccuggacggccuggacggcaaggacggcaagcccggccugagaggcgaccccggccccgccggcccccccggccugaugggcccccccggcuucaagggcaagaccggccaccccggccugcccggccccaagggcgacugcggcaagcccggcccccccggcagcaccggcagacccggcgccgagggcgagcccggcgccaugggcccccagggcagacccggcccccccggccacgugggcccccccggcccccccggccagcccggccccgccggcaucagcgccgugggccugaagggcgacagaggcgccaccggcgagagaggccuggccggccugcccggccagcccggcccccccggccaccccggcccccccggcgagcccggcaccgacggcgccgccggcaaggagggcccccccggcaagcagggcuucuacggcccccccggccccaagggcgaccccggcgccgccggccagaagggccaggccggcgagaagggcagagccggcaugcccggcggccccggcaagagcggcagcaugggccccgugggcccccccggccccgccggcgagagaggccaccccggcgcccccggccccagcggcagccccggccugcccggcgugcccggcagcaugggcgacauggugaacuacgacgagaucaagagauucaucagacaggagaucaucaagauguucgacgagagaauggccuacuacaccagcagaaugcaguuccccauggagauggccgccgcccccggcagacccggcccccccggcaaggacggcgcccccggcagacccggcgcccccggcagccccggccugcccggccagaucggcagagagggcagacagggccugcccggcgugagaggccugcccggcaccaagggcgagaagggcgacaucggcaucggcaucgccggcgagaacggccugcccggcccccccggcccccagggcccccccggcuacggcaagaugggcgccaccggccccaugggccagcagggcauccccggcauccccggcccccccggccccaugggccagcccggcaaggccggccacugcaaccccagcgacugcuucggcgccaugcccauggagcagcaguacccccccaugaagaccaugaagggccccuucggcuaa

SEQ ID NO: 15458 - RNA, 4494 nt, Artificial Sequence
  COL17A1__Homo_sapiens__NP_000485
auggacgugaccaagaagaacaagagagacggcaccgaggugaccgagagaaucgugaccgagaccgugaccaccagacugaccagccugccccccaagggcggcaccagcaacggcuacgccaagaccgccagccugggcggcggcagcagacuggagaagcagagccugacccacggcagcagcggcuacaucaacagcaccggcagcaccagaggccacgccagcaccagcagcuacagaagagcccacagccccgccagcacccugcccaacagccccggcagcaccuucgagagaaagacccacgugaccagacacgccuacgagggcagcagcagcggcaacagcagccccgaguaccccagaaaggaguucgccagcagcagcaccagaggcagaagccagaccagagagagcgagaucagagugagacugcagagcgccagccccagcaccagauggaccgagcuggacgacgugaagagacugcugaagggcagcagaagcgccagcgugagccccaccagaaacagcagcaacacccugcccauccccaagaagggcaccguggagaccaagaucgugaccgccagcagccagagcgugagcggcaccuacgacgccaccauccuggacgccaaccugcccagccacguguggagcagcacccugcccgccggcagcagcaugggcaccuaccacaacaacaugaccacccagagcagcagccugcugaacaccaacgccuacagcgccggcagcguguucggcgugcccaacaacauggccagcugcagccccacccugcaccccggccugagcaccagcagcagcguguucggcaugcagaacaaccuggcccccagccugaccacccugagccacggcaccaccaccaccagcaccgccuacggcgugaagaagaacaugccccagagccccgccgccgugaacaccggcgugagcaccagcgccgccugcaccaccagcgugcagagcgacgaccugcugcacaaggacugcaaguuccugauccuggagaaggacaacacccccgccaagaaggagauggagcugcugaucaugaccaaggacagcggcaagguguucaccgccagccccgccagcaucgccgccaccagcuucagcgaggacacccugaagaaggagaagcaggccgccuacaacgccgacagcggccugaaggccgaggccaacggcgaccugaagaccgugagcaccaagggcaagaccaccaccgccgacauccacagcuacggcagcagcggcggcggcggcagcggcggcggcggcggcgugggcggcgccggcggcggccccuggggccccgcccccgccuggugccccugcggcagcugcugcagcugguggaaguggcugcugggccugcugcugaccuggcugcugcugcugggccugcuguucggccugaucgcccuggccgaggaggugagaaagcugaaggccagaguggacgagcuggagagaaucagaagaagcauccugcccuacggcgacagcauggacagaaucgagaaggacagacugcagggcauggcccccgccgccggcgccgaccuggacaagaucggccugcacagcgacagccaggaggagcuguggauguucgugagaaagaagcugaugauggagcaggagaacggcaaccugagaggcagccccggccccaagggcgacaugggcagccccggccccaagggcgacagaggcuuccccggcacccccggcauccccggcccccugggccaccccggcccccagggccccaagggccagaagggcagcgugggcgaccccggcauggagggccccaugggccagagaggcagagagggccccaugggccccagaggcgaggccggcccccccggcagcggcgagaagggcgagagaggcgccgccggcgagcccggcccccacggcccccccggcgugcccggcagcgugggccccaagggcagcagcggcagccccggcccccagggcccccccggccccgugggccugcagggccugagaggcgaggugggccugcccggcgugaagggcgacaagggccccaugggcccccccggccccaagggcgaccagggcgagaagggccccagaggccugaccggcgagcccggcaugagaggccugcccggcgccgugggcgagcccggcgccaagggcgccaugggccccgccggccccgacggccaccagggccccagaggcgagcagggccugaccggcaugcccggcaucagaggcccccccggccccagcggcgaccccggcaagcccggccugaccggcccccagggcccccagggccugcccggcacccccggcagacccggcaucaagggcgagcccggcgcccccggcaagaucgugaccagcgagggcagcagcaugcugaccgugcccggcccccccggcccccccggcgccaugggcccccccggcccccccggcgcccccggccccgccggccccgccggccugcccggccaccaggaggugcugaaccugcagggcccccccggcccccccggccccagaggcccccccggccccagcauccccggcccccccggccccagaggcccccccggcgagggccugcccggcccccccggcccccccggcagcuuccugagcaacagcgagaccuuccugagcggcccccccggcccccccggcccccccggccccaagggcgaccagggcccccccggccccagaggccaccagggcgagcagggccugcccggcuucagcaccagcggcagcagcagcuucggccugaaccugcagggcccccccggcccccccggcccccagggccccaagggcgacaagggcgaccccggcgugcccggcgcccugggcauccccagcggccccagcgagggcggcagcagcagcaccauguacgugagcggcccccccggcccccccggcccccccggcccccccggcagcaucagcagcagcggccaggagauccagcaguacaucagcgaguacaugcagagcgacagcaucagaagcuaccugagcggcgugcagggcccccccggcccccccggcccccccggccccgugaccaccaucaccggcgagaccuucgacuacagcgagcuggccagccacguggugagcuaccugagaaccagcggcuacggcgugagccuguucagcagcagcaucagcagcgaggacauccuggccgugcugcagagagacgacgugagacaguaccugagacaguaccugaugggccccagaggcccccccggcccccccggcgccagcggcgacggcagccugcugagccuggacuacgccgagcugagcagcagaauccugagcuacaugagcagcagcggcaucagcaucggccugcccggcccccccggcccccccggccugcccggcaccagcuacgaggagcugcugagccugcugagaggcagcgaguucagaggcaucgugggcccccccggcccccccggcccccccggcauccccggcaacguguggagcagcaucagcguggaggaccugagcagcuaccugcacaccgccggccugagcuucauccccggcccccccggcccccccggcccccccggccccagaggcccccccggcgugagcggcgcccuggccaccuacgccgccgagaacagcgacagcuucagaagcgagcugaucagcuaccugaccagccccgacgugagaagcuucaucgugggcccccccggcccccccggcccccagggcccccccggcgacagcagacugcugagcaccgacgccagccacagcagaggcagcagcagcagcagccacagcagcagcgugagaagaggcagcagcuacagcagcagcaugagcaccggcggcggcggcgccggcagccugggcgccggcggcgccuucggcgaggccgccggcgacagaggccccuacggcaccgacaucggccccggcggcggcuacggcgccgccgccgagggcggcauguacgccggcaacggcggccugcugggcgccgacuucgccggcgaccuggacuacaacgagcuggccgugagagugagcgagagcaugcagagacagggccugcugcagggcauggccuacaccgugcagggcccccccggccagcccggcccccagggcccccccggcaucagcaagguguucagcgccuacagcaacgugaccgccgaccugauggacuucuuccagaccuacggcgccauccagggcccccccggccagaagggcgagaugggcacccccggccccaagggcgacagaggccccgccggcccccccggccaccccggcccccccggccccagaggccacaagggcgagaagggcgacaagggcgaccagguguacgccggcagaagaagaagaagaagcaucgccgugaagcccuaa

SEQ ID NO: 15459 - RNA, 4551 nt, Artificial Sequence
  COL18A1__Homo_sapiens__NP_085059
auggcccccuaccccugcggcugccacauccugcugcugcuguucugcugccuggccgccgccagagccaaccugcugaaccugaacuggcugugguucaacaacgaggacaccagccacgccgccaccaccauccccgagccccagggcccccugcccgugcagcccaccgccgacaccaccacccacgugacccccagaaacggcagcaccgagcccgccaccgcccccggcagccccgagccccccagcgagcugcuggaggacggccaggacacccccaccagcgccgagagccccgacgcccccgaggagaacaucgccggcgugggcgccgagauccugaacguggccaagggcaucagaagcuucgugcagcuguggaacgacaccgugcccaccgagagccuggccagagccgagacccuggugcuggagacccccgugggcccccuggcccuggccggccccagcagcaccccccaggagaacggcaccacccuguggcccagcagaggcauccccagcagccccggcgcccacaccaccgaggccggcacccugcccgcccccacccccagcccccccagccugggcagacccugggccccccugaccggccccagcgugcccccccccagcagcgagagaaucagcgaggaggugggccugcugcagcugcugggcgacccccccccccagcaggugacccagaccgacgaccccgacgugggccuggccuacguguucggccccgacgccaacagcggccagguggccagauaccacuuccccagccuguucuucagagacuucagccugcuguuccacaucagacccgccaccgagggccccggcgugcuguucgccaucaccgacagcgcccaggccauggugcugcugggcgugaagcugagcggcgugcaggacggccaccaggacaucagccugcuguacaccgagcccggcgccggccagacccacaccgccgccagcuucagacugcccgccuucgugggccaguggacccaccuggcccugagcguggccggcggcuucguggcccuguacguggacugcgaggaguuccagagaaugccccuggccagaagcagcagaggccuggagcuggagcccggcgccggccuguucguggcccaggccggcggcgccgaccccgacaaguuccagggcgugaucgccgagcugaaggugagaagagacccccaggugagccccaugcacugccuggacgaggagggcgacgacagcgacggcgccagcggcgacagcggcagcggccugggcgacgccagagagcugcugagagaggagaccggcgccgcccugaagcccagacugcccgcccccccccccgugaccacccccccccuggccggcggcagcagcaccgaggacagcagaagcgaggagguggaggagcagaccaccguggccagccugggcgcccagacccugcccggcagcgacagcgugagcaccugggacggcagcgugagaacccccggcggcagagugaaggagggcggccugaagggccagaagggcgagcccggcgugcccggcccccccggcagagccggcccccccggcagccccugccugcccggcccccccggccugcccugccccgugagcccccugggccccgccggccccgcccugcagaccgugcccggcccccagggcccccccggcccccccggcagagacggcacccccggcagagacggcgagcccggcgaccccggcgaggacggcaagcccggcgacaccggcccccagggcuuccccggcacccccggcgacgugggccccaagggcgacaagggcgaccccggcgugggcgagagaggcccccccggcccccagggcccccccggcccccccggccccagcuucagacacgacaagcugaccuucaucgacauggagggcagcggcuucggcggcgaccuggaggcccugagaggccccagaggcuuccccggcccccccggcccccccggcgugcccggccugcccggcgagcccggcagauucggcgugaacagcagcgacgugcccggccccgccggccugcccggcgugcccggcagagagggcccccccggcuuccccggccugcccggcccccccggcccccccggcagagagggcccccccggcagaaccggccagaagggcagccugggcgaggccggcgcccccggccacaagggcagcaagggcgcccccggccccgccggcgccagaggcgagagcggccuggccggcgcccccggccccgccggcccccccggcccccccggcccccccggcccccccggccccggccugcccgccggcuucgacgacauggagggcagcggcggccccuucuggagcaccgccagaagcgccgacggcccccagggcccccccggccugcccggccugaagggcgaccccggcgugcccggccugcccggcgccaagggcgaggugggcgccgacggcgugcccggcuuccccggccugcccggcagagagggcaucgccggcccccagggccccaagggcgacagaggcagcagaggcgagaagggcgaccccggcaaggacggcgugggccagcccggccugcccggcccccccggcccccccggccccgugguguacgugagcgagcaggacggcagcgugcugagcgugcccggccccgagggcagacccggcuucgccggcuuccccggccccgccggccccaagggcaaccugggcagcaagggcgagagaggcagccccggccccaagggcgagaagggcgagcccggcagcaucuucagccccgacggcggcgcccugggccccgcccagaagggcgccaagggcgagcccggcuucagaggcccccccggccccuacggcagacccggcuacaagggcgagaucggcuuccccggcagacccggcagacccggcaugaacggccugaagggcgagaagggcgagcccggcgacgccagccugggcuucggcaugagaggcaugcccggcccccccggcccccccggcccccccggcccccccggcacccccguguacgacagcaacguguucgccgagagcagcagacccggcccccccggccugcccggcaaccagggcccccccggccccaagggcgccaagggcgaggugggcccccccggcccccccggccaguuccccuucgacuuccugcagcuggaggccgagaugaagggcgagaagggcgacagaggcgacgccggccagaagggcgagagaggcgagcccggcggcggcggcuucuucggcagcagccugcccggcccccccggcccccccggccccagaggcuaccccggcauccccggccccaagggcgagagcaucagaggccagcccggcccccccggcccccagggcccccccggcaucggcuacgagggcagacagggcccccccggcccccccggcccccccggcccccccagcuuccccggcccccacagacagaccaucagcgugcccggcccccccggcccccccggcccccccggcccccccggcaccaugggcgccagcagcggcgugagacugugggccaccagacaggccaugcugggccaggugcacgaggugcccgagggcuggcugaucuucguggccgagcaggaggagcuguacgugagagugcagaacggcuucagaaaggugcagcuggaggccagaaccccccugcccagaggcaccgacaacgagguggccgcccugcagccccccguggugcagcugcacgacagcaaccccuaccccagaagagagcacccccaccccaccgccagacccuggagagccgacgacauccuggccagcccccccagacugcccgagccccagcccuaccccggcgccccccaccacagcagcuacgugcaccugagacccgccagacccaccagcccccccgcccacagccacagagacuuccagcccgugcugcaccugguggcccugaacagcccccugagcggcggcaugagaggcaucagaggcgccgacuuccagugcuuccagcaggccagagccgugggccuggccggcaccuucagagccuuccugagcagcagacugcaggaccuguacagcaucgugagaagagccgacagagccgccgugcccaucgugaaccugaaggacgagcugcuguuccccagcugggaggcccuguucagcggcagcgagggcccccugaagcccggcgccagaaucuucagcuucgacggcaaggacgugcugagacaccccaccuggccccagaagagcguguggcacggcagcgaccccaacggcagaagacugaccgagagcuacugcgagaccuggagaaccgaggcccccagcgccaccggccaggccagcagccugcugggcggcagacugcugggccagagcgccgccagcugccaccacgccuacaucgugcugugcaucgagaacagcuucaugaccgccagcaaguaa

SEQ ID NO: 15460 - RNA, 4395 nt, Artificial Sequence
  COL1A1__Homo_sapiens__NP_000079
auguucagcuucguggaccugagacugcugcugcugcuggccgccaccgcccugcugacccacggccaggaggagggccagguggagggccaggacgaggacaucccccccaucaccugcgugcagaacggccugagauaccacgacagagacguguggaagcccgagcccugcagaaucugcgugugcgacaacggcaaggugcugugcgacgacgugaucugcgacgagaccaagaacugccccggcgccgaggugcccgagggcgagugcugccccgugugccccgacggcagcgagagccccaccgaccaggagaccaccggcguggagggccccaagggcgacaccggccccagaggccccagaggccccgccggcccccccggcagagacggcauccccggccagcccggccugcccggcccccccggcccccccggcccccccggcccccccggccugggcggcaacuucgccccccagcugagcuacggcuacgacgagaagagcaccggcggcaucagcgugcccggccccaugggccccagcggccccagaggccugcccggcccccccggcgcccccggcccccagggcuuccagggcccccccggcgagcccggcgagcccggcgccagcggccccaugggccccagaggcccccccggcccccccggcaagaacggcgacgacggcgaggccggcaagcccggcagacccggcgagagaggcccccccggcccccagggcgccagaggccugcccggcaccgccggccugcccggcaugaagggccacagaggcuucagcggccuggacggcgccaagggcgacgccggccccgccggccccaagggcgagcccggcagccccggcgagaacggcgcccccggccagaugggccccagaggccugcccggcgagagaggcagacccggcgcccccggccccgccggcgccagaggcaacgacggcgccaccggcgccgccggcccccccggccccaccggccccgccggcccccccggcuuccccggcgccgugggcgccaagggcgaggccggcccccagggccccagaggcagcgagggcccccagggcgugagaggcgagcccggcccccccggccccgccggcgccgccggccccgccggcaaccccggcgccgacggccagcccggcgccaagggcgccaacggcgcccccggcaucgccggcgcccccggcuuccccggcgccagaggccccagcggcccccagggccccggcggcccccccggccccaagggcaacagcggcgagcccggcgcccccggcagcaagggcgacaccggcgccaagggcgagcccggccccgugggcgugcagggcccccccggccccgccggcgaggagggcaagagaggcgccagaggcgagcccggccccaccggccugcccggcccccccggcgagagaggcggccccggcagcagaggcuuccccggcgccgacggcguggccggccccaagggccccgccggcgagagaggcagccccggccccgccggccccaagggcagccccggcgaggccggcagacccggcgaggccggccugcccggcgccaagggccugaccggcagccccggcagccccggccccgacggcaagaccggcccccccggccccgccggccaggacggcagacccggcccccccggcccccccggcgccagaggccaggccggcgugaugggcuuccccggccccaagggcgccgccggcgagcccggcaaggccggcgagagaggcgugcccggcccccccggcgccgugggccccgccggcaaggacggcgaggccggcgcccagggcccccccggccccgccggccccgccggcgagagaggcgagcagggccccgccggcagccccggcuuccagggccugcccggccccgccggcccccccggcgaggccggcaagcccggcgagcagggcgugcccggcgaccugggcgcccccggccccagcggcgccagaggcgagagaggcuuccccggcgagagaggcgugcagggcccccccggccccgccggccccagaggcgccaacggcgcccccggcaacgacggcgccaagggcgacgccggcgcccccggcgcccccggcagccagggcgcccccggccugcagggcaugcccggcgagagaggcgccgccggccugcccggccccaagggcgacagaggcgacgccggccccaagggcgccgacggcagccccggcaaggacggcgugagaggccugaccggccccaucggcccccccggccccgccggcgcccccggcgacaagggcgagagcggccccagcggccccgccggccccaccggcgccagaggcgcccccggcgacagaggcgagcccggcccccccggccccgccggcuucgccggcccccccggcgccgacggccagcccggcgccaagggcgagcccggcgacgccggcgccaagggcgacgccggcccccccggccccgccggccccgccggcccccccggccccaucggcaacgugggcgcccccggcgccaagggcgccagaggcagcgccggcccccccggcgccaccggcuuccccggcgccgccggcagagugggcccccccggccccagcggcaacgccggcccccccggcccccccggccccgccggcaaggagggcggcaagggccccagaggcgagaccggccccgccggcagacccggcgaggugggcccccccggcccccccggccccgccggcgagaagggcagccccggcgccgacggccccgccggcgcccccggcacccccggcccccagggcaucgccggccagagaggcguggugggccugcccggccagagaggcgagagaggcuuccccggccugcccggccccagcggcgagcccggcaagcagggccccagcggcgccagcggcgagagaggcccccccggccccaugggcccccccggccuggccggcccccccggcgagagcggcagagagggcgcccccggcgccgagggcagccccggcagagacggcagccccggcgccaagggcgacagaggcgagaccggccccgccggcccccccggcgcccccggcgcccccggcgcccccggccccgugggccccgccggcaagagcggcgacagaggcgagaccggccccgccggccccgccggccccgugggccccgugggcgccagaggccccgccggcccccagggccccagaggcgacaagggcgagaccggcgagcagggcgacagaggcaucaagggccacagaggcuucagcggccugcagggcccccccggcccccccggcagccccggcgagcagggccccagcggcgccagcggccccgccggccccagaggcccccccggcagcgccggcgcccccggcaaggacggccugaacggccugcccggccccaucggcccccccggccccagaggcagaaccggcgacgccggccccgugggcccccccggcccccccggcccccccggcccccccggcccccccagcgccggcuucgacuucagcuuccugccccagcccccccaggagaaggcccacgacggcggcagauacuacagagccgacgacgccaacguggugagagacagagaccuggagguggacaccacccugaagagccugagccagcagaucgagaacaucagaagccccgagggcagcagaaagaaccccgccagaaccugcagagaccugaagaugugccacagcgacuggaagagcggcgaguacuggaucgaccccaaccagggcugcaaccuggacgccaucaagguguucugcaacauggagaccggcgagaccugcguguaccccacccagcccagcguggcccagaagaacugguacaucagcaagaaccccaaggacaagagacacgugugguucggcgagagcaugaccgacggcuuccaguucgaguacggcggccagggcagcgaccccgccgacguggccauccagcugaccuuccugagacugaugagcaccgaggccagccagaacaucaccuaccacugcaagaacagcguggccuacauggaccagcagaccggcaaccugaagaaggcccugcugcugcagggcagcaacgagaucgagaucagagccgagggcaacagcagauucaccuacagcgugaccguggacggcugcaccagccacaccggcgccuggggcaagaccgugaucgaguacaagaccaccaagaccagcagacugcccaucaucgacguggccccccuggacgugggcgcccccgaccaggaguucggcuucgacgugggccccgugugcuuccuguaa

SEQ ID NO: 15461 - RNA, 4101 nt, Artificial Sequence
  COL1A2__Homo_sapiens__NP_000080
augcugagcuucguggacaccagaacccugcugcugcuggccgugacccugugccuggccaccugccagagccugcaggaggagaccgugagaaagggccccgccggcgacagaggccccagaggcgagagaggcccccccggcccccccggcagagacggcgaggacggccccaccggcccccccggcccccccggcccccccggcccccccggccugggcggcaacuucgccgcccaguacgacggcaagggcgugggccugggccccggccccaugggccugaugggccccagaggcccccccggcgccgccggcgcccccggcccccagggcuuccagggccccgccggcgagcccggcgagcccggccagaccggccccgccggcgccagaggccccgccggcccccccggcaaggccggcgaggacggccaccccggcaagcccggcagacccggcgagagaggcguggugggcccccagggcgccagaggcuuccccggcacccccggccugcccggcuucaagggcaucagaggccacaacggccuggacggccugaagggccagcccggcgcccccggcgugaagggcgagcccggcgcccccggcgagaacggcacccccggccagaccggcgccagaggccugcccggcgagagaggcagagugggcgcccccggccccgccggcgccagaggcagcgacggcagcgugggccccgugggccccgccggccccaucggcagcgccggcccccccggcuuccccggcgcccccggccccaagggcgagaucggcgccgugggcaacgccggccccgccggccccgccggccccagaggcgaggugggccugcccggccugagcggccccgugggcccccccggcaaccccggcgccaacggccugaccggcgccaagggcgccgccggccugcccggcguggccggcgcccccggccugcccggccccagaggcauccccggccccgugggcgccgccggcgccaccggcgccagaggccuggugggcgagcccggccccgccggcagcaagggcgagagcggcaacaagggcgagcccggcagcgccggcccccagggcccccccggccccagcggcgaggagggcaagagaggccccaacggcgaggccggcagcgccggcccccccggcccccccggccugagaggcagccccggcagcagaggccugcccggcgccgacggcagagccggcgugaugggcccccccggcagcagaggcgccagcggccccgccggcgugagaggccccaacggcgacgccggcagacccggcgagcccggccugaugggccccagaggccugcccggcagccccggcaacaucggccccgccggcaaggagggccccgugggccugcccggcaucgacggcagacccggccccaucggccccgccggcgccagaggcgagcccggcaacaucggcuuccccggccccaagggccccaccggcgaccccggcaagaacggcgacaagggccacgccggccuggccggcgccagaggcgcccccggccccgacggcaacaacggcgcccagggcccccccggcccccagggcgugcagggcggcaagggcgagcagggcccccccggcccccccggcuuccagggccugcccggccccagcggccccgccggcgaggugggcaagcccggcgagagaggccugcacggcgaguucggccugcccggccccgccggccccagaggcgagagaggcccccccggcgagagcggcgccgccggccccaccggccccaucggcagcagaggccccagcggcccccccggccccgacggcaacaagggcgagcccggcguggugggcgccgugggcaccgccggccccagcggccccagcggccugcccggcgagagaggcgccgccggcauccccggcggcaagggcgagaagggcgagcccggccugagaggcgagaucggcaaccccggcagagacggcgccagaggcgcccccggcgccgugggcgcccccggccccgccggcgccaccggcgacagaggcgaggccggcgccgccggccccgccggccccgccggccccagaggcagccccggcgagagaggcgaggugggccccgccggccccaacggcuucgccggccccgccggcgccgccggccagcccggcgccaagggcgagagaggcgccaagggccccaagggcgagaacggcguggugggccccaccggccccgugggcgccgccggccccgccggccccaacggcccccccggccccgccggcagcagaggcgacggcggcccccccggcaugaccggcuuccccggcgccgccggcagaaccggcccccccggccccagcggcaucagcggcccccccggcccccccggccccgccggcaaggagggccugagaggccccagaggcgaccagggccccgugggcagaaccggcgaggugggcgccgugggcccccccggcuucgccggcgagaagggccccagcggcgaggccggcaccgccggcccccccggcacccccggcccccagggccugcugggcgcccccggcauccugggccugcccggcagcagaggcgagagaggccugcccggcguggccggcgccgugggcgagcccggcccccugggcaucgccggcccccccggcgccagaggcccccccggcgccgugggcagccccggcgugaacggcgcccccggcgaggccggcagagacggcaaccccggcaacgacggcccccccggcagagacggccagcccggccacaagggcgagagaggcuaccccggcaacaucggccccgugggcgccgccggcgcccccggcccccacggccccgugggccccgccggcaagcacggcaacagaggcgagaccggccccagcggccccgugggccccgccggcgccgugggccccagaggccccagcggcccccagggcaucagaggcgacaagggcgagcccggcgagaagggccccagaggccugcccggccugaagggccacaacggccugcagggccugcccggcaucgccggccaccacggcgaccagggcgcccccggcagcgugggccccgccggccccagaggccccgccggccccagcggccccgccggcaaggacggcagaaccggccaccccggcaccgugggccccgccggcaucagaggcccccagggccaccagggccccgccggcccccccggcccccccggcccccccggcccccccggcgugagcggcggcggcuacgacuucggcuacgacggcgacuucuacagagccgaccagcccagaagcgcccccagccugagacccaaggacuacgagguggacgccacccugaagagccugaacaaccagaucgagacccugcugacccccgagggcagcagaaagaaccccgccagaaccugcagagaccugagacugagccaccccgaguggagcagcggcuacuacuggaucgaccccaaccagggcugcaccauggacgccaucaagguguacugcgacuucagcaccggcgagaccugcaucagagcccagcccgagaacauccccgccaagaacugguacagaagcagcaaggacaagaagcacguguggcugggcgagaccaucaacgccggcagccaguucgaguacaacguggagggcgugaccagcaaggagauggccacccagcuggccuucaugagacugcuggccaacuacgccagccagaacaucaccuaccacugcaagaacagcaucgccuacauggacgaggagaccggcaaccugaagaaggccgugauccugcagggcagcaacgacguggagcugguggccgagggcaacagcagauucaccuacaccgugcugguggacggcugcagcaagaagaccaacgaguggggcaagaccaucaucgaguacaagaccaacaagcccagcagacugcccuuccuggacaucgccccccuggacaucggcggcgccgaccaggaguucuucguggacaucggccccgugugcuucaaguaa

SEQ ID NO: 15462 - RNA, 3855 nt, Artificial Sequence
  COL20A1__Homo_sapiens__NP_065933
augagcagcggcgaccccgcccaccugggccugugccuguggcuguggcugggcgccacccugggcagagagcaggugcaggccagcggccugcugagacuggccgugcugcccgaggacagacugcagaugaaguggagagagagcgagggcagcggccugggcuaccuggugcaggugaagcccauggccggcgacagcgagcaggaggugauccugaccaccaagacccccaaggccaccgugggcggccugagccccagcaagggcuacacccugcagaucuucgagcugaccggcagcggcagauuccugcuggccagaagagaguucgugaucgaggaccugaagagcagcagccuggacagaagcagccagagaccccugggcagcggcgcccccgagcccacccccagccacaccggcagccccgaccccgagcaggccagcgagccccagguggccuucacccccagccaggaccccagaacccccgccggcccccaguucagaugccugccccccgugcccgccgacaugguguuccugguggacggcagcuggagcaucggccacagccacuuccagcaggugaaggacuuccuggccagcgugaucgcccccuucgagaucggccccgacaaggugcaggugggccugacccaguacagcggcgacgcccagaccgagugggaccugaacagccugagcaccaaggagcaggugcuggccgccgugagaagacugagauacaagggcggcaacaccuucaccggccuggcccugacccacgugcugggccagaaccugcagcccgccgccggccugagacccgaggccgccaagguggugauccuggugaccgacggcaagagccaggacgacgugcacaccgccgccagagugcugaaggaccugggcgugaacguguucgccgugggcgugaagaacgccgacgaggccgagcugagacugcuggccagcccccccagagacaucaccgugcacagcgugcuggacuuccugcagcugggcgcccuggccggccugcugagcagacugaucugccagagacugcagggcggcagccccagacagggccccgccgccgcccccgcccuggacacccugcccgcccccaccagccuggugcugagccaggugaccagcagcagcaucagacugagcuggacccccgcccccagacacccccugaaguaccugaucguguggagagccagcagaggcggcacccccagagagguggugguggagggccccgccgccagcaccgagcugcacaaccuggccagcagaaccgaguaccuggugagcguguuccccaucuacgagggcggcgugggcgagggccugagaggccuggugaccaccgccccccugcccccccccagagcccugacccuggccgccgugacccccagaaccgugcaccugaccuggcagcccagcgccggcgccacccacuaccuggugagaugcagccccgccagccccaagggcgaggaggaggagagagaggugcaggugggcagacccgaggugcugcuggacggccuggagcccggcagagacuacgaggugagcgugcagagccugagaggccccgagggcagcgaggccagaggcaucagagccagaacccccacccuggccccccccagacaccugggcuucagcgacgugagccacgacgccgccagaguguucugggagggcgcccccagacccgugagacuggugagagugaccuacgugagcagcgagggcggccacagcggccagaccgaggcccccggcaacgccaccagcgccacccugggcccccugagcagcagcaccaccuacaccgugagagugaccugccuguaccccggcggcggcagcagcacccugaccggcagagugaccaccaagaaggcccccagccccagccagcugagcaugaccgagcugcccggcgacgccgugcagcuggccuggguggccgccgcccccagcggcgugcugguguaccagaucaccuggaccccccugggcgagggcaaggcccacgagaucagcgugcccggcaaccugggcaccgccgugcugcccggccugggcagacacaccgaguacgacgugaccauccuggccuacuacagagacggcgccagaagcgaccccgugagccugagauacacccccagcaccgugagcagaagcccccccagcaaccuggcccuggccagcgagacccccgacagccugcaggugagcuggacccccccccugggcagagugcugcacuacuggcugaccuacgcccccgccagcggccugggccccgagaagagcgugagcgugcccggcgccagaagccacgugacccugcccgaccugcaggccgccaccaaguacagagugcuggugagcgccaucuacgccgccggcagaagcgaggccgugagcgccaccggccagaccgccugccccgcccugagacccgacggcagccugcccggcuucgaccugaugguggccuucagccugguggagaaggccuacgccagcaucagaggcguggccauggagcccagcgccuucggcggcacccccaccuucacccuguucaaggacgcccagcugaccagaagagugagcgacguguaccccgccccccugccccccgagcacaccaucguguuccuggugagacugcugcccgagacccccagagaggccuucgcccuguggcagaugaccgccgaggacuuccagccccugcugggcgugcugcuggacgccggcaagaagagccugaccuacuuccacagagaccccagagccgcccugcaggaggccaccuucgacccccaggaggugagaaagaucuucuucggcagcuuccacaaggugcacguggccgugggcagaagcaaggugagacuguacguggacugcagaaagguggccgagagaccccugggcgagaugggcagcccccccgccgccggcuucgugacccugggcagacuggccaaggccagaggccccagaagcagcagcgccgccuuccagcugcagaugcugcagaucgugugcagcgacaccugggccgacgaggacagaugcugcgagcugcccgccagcagagacggcgagaccugccccgccuucgugagcgccugcagcugcagcagcgagacccccggcccccccggcccccagggcccccccggccugcccggcagaaacggcacccccggcgagcagggcuuccccggccccagaggcccccccggcgugaagggcgagaagggcgaccacggccugcccggccugcagggccaccccggccaccagggcauccccggcagagugggccugcagggccccaagggcaugagaggccuggagggcaccgccggccugcccggcccccccggccccagaggcuuccagggcauggccggcgccagaggcaccagcggcgagagaggcccccccggcaccgugggccccaccggccugcccggccccaagggcgagagaggcgagaagggcgagccccagagccuggccacccuguaccagcuggugagccaggccagccacgugagcaaguucgacagcuuccacgagaacaccagaccccccaugcccauccuggagcagaagcuggagcccggcaccgagccccugggcagccccggcaccagaagcaaggcccuggugcccggcgaguggggcagaggcggcagacaccuggagggcagaggcgagcccggcgccgugggccagaugggcagccccggccagcagggcgccagcacccagggccugugggaguaa

SEQ ID NO: 15463 - RNA, 2874 nt, Artificial Sequence
  COL21A1__Homo_sapiens__NP_110447
auggcccacuacaucaccuuccugugcauggugcuggugcugcugcugcagaacagcgugcuggccgaggacggcgaggugagaagcagcugcagaaccgcccccaccgaccugguguucauccuggacggcagcuacagcgugggccccgagaacuucgagaucgugaagaaguggcuggugaacaucaccaagaacuucgacaucggccccaaguucauccaggugggcguggugcaguacagcgacuaccccgugcuggagaucccccugggcagcuacgacagcggcgagcaccugaccgccgccguggagagcauccuguaccugggcggcaacaccaagaccggcaaggccauccaguucgcccuggacuaccuguucgccaagagcagcagauuccugaccaagaucgccguggugcugaccgacggcaagagccaggacgacgugaaggacgccgcccaggccgccagagacagcaagaucacccuguucgccaucggcgugggcagcgagaccgaggacgccgagcugagagccaucgccaacaagcccagcagcaccuacguguucuacguggaggacuacaucgccaucagcaagaucagagaggugaugaagcagaagcugugcgaggagagcgugugccccaccagaauccccguggccgccagagacgagagaggcuucgacauccugcugggccuggacgugaacaagaaggugaagaagagaauccagcugagccccaagaagaucaagggcuacgaggugaccagcaagguggaccugagcgagcugaccagcaacguguuccccgagggccugccccccagcuacguguucgugagcacccagagauucaaggugaagaagaucugggaccuguggagaauccugaccaucgacggcagaccccagaucgccgugacccugaacggcguggacaagauccugcuguucaccaccaccagcgugaucaacggcagccagguggugaccuucgccaacccccaggugaagacccuguucgacgagggcuggcaccagaucagacugcuggugaccgagcaggacgugacccuguacaucgacgaccagcagaucgagaacaagccccugcaccccgugcugggcauccugaucaacggccagacccagaucggcaaguacagcggcaaggaggagaccgugcaguucgacgugcagaagcugagaaucuacugcgaccccgagcagaacaacagagagaccgccugcgagauccccggcuucaacggcgagugccugaacggccccagcgacgugggcagcacccccgcccccugcaucugcccccccggcaagcccggccugcagggccccaagggcgaccccggccugcccggcaaccccggcuaccccggccagcccggccaggacggcaagcccggcuaccagggcaucgccggcacccccggcgugcccggcagccccggcauccagggcgccagaggccugcccggcuacaagggcgagcccggcagagacggcgacaagggcgacagaggccugcccggcuuccccggccugcacggcaugcccggcagcaagggcgagaugggcgccaagggcgacaagggcagccccggcuucuacggcaagaagggcgccaagggcgagaagggcaacgccggcuuccccggccugcccggccccgccggcgagcccggcagacacggcaaggacggccugaugggcagccccggcuucaagggcgaggccggcagccccggcgcccccggccaggacggcaccagaggcgagcccggcauccccggcuuccccggcaacagaggccugaugggccagaagggcgagaucggcccccccggccagcagggcaagaagggcgcccccggcaugcccggccugaugggcagcaacggcagccccggccagcccggcacccccggcagcaagggcagcaagggcgagcccggcauccagggcaugcccggcgccagcggccugaagggcgagcccggcgccaccggcagccccggcgagcccggcuacaugggccugcccggcauccagggcaagaagggcgacaagggcaaccagggcgagaagggcauccagggccagaagggcgagaacggcagacagggcauccccggccagcagggcauccagggccaccacggcgccaagggcgagagaggcgagaagggcgagcccggcgugagaggcgccaucggcagcaagggcgagagcggcguggacggccugaugggccccgccggccccaagggccagcccggcgaccccggcccccagggcccccccggccuggacggcaagcccggcagagaguucagcgagcaguucaucagacaggugugcaccgacgugaucagagcccagcugcccgugcugcugcagagcggcagaaucagaaacugcgaccacugccugagccagcacggcagccccggcauccccggcccccccggccccaucggccccgagggccccagaggccugcccggccugcccggcagagacggcgugcccggccuggugggcgugcccggcagacccggcgugagaggccugaagggccugcccggcagaaacggcgagaagggcagccagggcuucggcuaccccggcgagcagggcccccccggcccccccggccccgagggcccccccggcaucagcaaggagggcccccccggcgaccccggccugcccggcaaggacggcgaccacggcaagcccggcauccagggccagcccggcccccccggcaucugcgaccccagccugugcuucagcgugaucgccagaagagaccccuucagaaagggccccaacuacuaa

SEQ ID NO: 15464 - RNA, 4881 nt, Artificial Sequence
  COL22A1__Homo_sapiens__NP_690848
auggccggccugagaggcaacgccguggccggccugcuguggaugcugcugcuguggagcggcggcggcggcugccaggcccagagagccggcugcaagagcgugcacuacgaccugguguuccugcuggacaccagcagcagcgugggcaaggaggacuucgagaaggugagacaguggguggccaaccugguggacaccuucgaggugggccccgacagaaccagagugggcguggugagauacagcgacagacccaccaccgccuucgagcugggccuguucggcagccaggaggaggugaaggccgccgccagaagacuggccuaccacggcggcaacaccaacaccggcgacgcccugagauacaucaccgccagaagcuucagcccccacgccggcggcagacccagagacagagccuacaagcagguggccauccugcugaccgacggcagaagccaggaccuggugcuggacgccgccgccgccgcccacagagccggcaucagaaucuucgccgugggcgugggcgaggcccugaaggaggagcuggaggagaucgccagcgagcccaagagcgcccacguguuccacgugagcgacuucaacgccaucgacaagaucagaggcaagcugagaagaagacugugcgagaacgugcugugccccagcgugagaguggagggcgacagauucaagcacaccaacggcggcaccaaggagaucaccggcuucgaccugauggaccuguucagcgugaaggagauccugggcaagagagagaacggcgcccagagcagcuacgugagaaugggcagcuuccccguggugcagagcaccgaggacguguucccccagggccugcccgacgaguacgccuucgugaccaccuucagauucagaaagaccagcagaaaggaggacugguacaucuggcaggugaucgaccaguacagcaucccccaggugagcaucagacuggacggcgagaacaaggccguggaguacaacgccgugggcgccaugaaggacgccgugagagugguguucagaggcagcagagugaacgaccuguucgacagagacuggcacaagauggcccugagcauccaggcccagaacgugagccugcacaucgacugcgcccuggugcagacccugcccaucgaggagagagagaacaucgacauccagggcaagaccgugaucggcaagagacuguacgacagcgugcccaucgacuucgaccugcagagaaucgugaucuacugcgacagcagacacgccgagcuggagaccugcugcgacauccccagcggccccugccaggugaccguggugaccgagccccccccccccccccccccccagagaccccccacccccggcagcgagcagaucggcuuccugaagaccaucaacugcagcugccccgccggcgagaagggcgagaugggcguggccggccccaugggccugcccggccccaagggcgacaucggcgccaucggccccgugggcgcccccggccccaagggcgagaagggcgacgugggcaucggccccuucggccagggcgagaagggcgagaagggcagccugggccugcccggcccccccggcagagacggcagcaagggcaugagaggcgagcccggcgagcugggcgagcccggccugcccggcgaggugggcaugagaggcccccagggcccccccggccugcccggcccccccggcagagugggcgcccccggccugcagggcgagagaggcgagaagggcaccagaggcgagaagggcgagagaggccuggacggcuuccccggcaagcccggcgacaccggccagcagggcagacccggccccagcggcguggccggcccccagggcgagaagggcgacgugggccccgccggcccccccggcgugcccggcagcguggugcagcaggagggccugaagggcgagcagggcgcccccggccccagaggccaccagggcgcccccggcccccccggcgccagaggccccaucggccccgagggcagagacggcccccccggccugcagggccugagaggcaagaagggcgacaugggcccccccggcauccccggccugcugggccugcagggcccccccggcccccccggcgugcccggcccccccggccccggcggcagccccggccugcccggcgagaucggcuuccccggcaagcccggcccccccggccccaccggcccccccggcaaggacggccccaacggcccccccggcccccccggcaccaagggcgagcccggcgagagaggcgaggacggccugcccggcaagcccggccugagaggcgagaucggcgagcagggccuggccggcagacccggcgagaagggcgaggccggccugcccggcgcccccggcuuccccggcgugagaggcgagaagggcgaccagggcgagaagggcgagcugggccugcccggccugaagggcgacagaggcgagaagggcgaggccggccccgccggcccccccggccugcccggcaccaccagccuguucaccccccaccccagaaugcccggcgagcagggccccaagggcgagaagggcgaccccggccugcccggcgagcccggccugcagggcagacccggcgagcugggcccccagggccccaccggcccccccggcgccaagggccaggagggcgcccacggcgcccccggcgccgccggcaaccccggcgcccccggccacgugggcgcccccggccccagcggcccccccggcagcgugggcgcccccggccugagaggcacccccggcaaggacggcgagagaggcgagaagggcgccgccggcgaggagggcagccccggccccgugggccccagaggcgaccccggcgcccccggccugcccggcccccccggcaagggcaaggacggcgagcccggccugagaggcagccccggccugcccggcccccugggcaccaaggccgccugcggcaaggugagaggcagcgagaacugcgcccugggcggccagugcgugaagggcgacagaggcgcccccggcauccccggcagccccggcagcagaggcgaccccggcaucggcguggccggcccccccggccccagcggcccccccggcgacaagggcagccccggcagcagaggccugcccggcuuccccggcccccagggccccgccggcagagacggcgcccccggcaaccccggcgagagaggcccccccggcaagcccggccugagcagccugcugagccccggcgacaucaaccugcuggccaaggacgugugcaacgacugcccccccggcccccccggccugcccggccugcccggcuucaagggcgacaagggcgugcccggcaagcccggcagagagggcaccgagggcaagaagggcgaggccggcccccccggccugcccggcccccccggcaucgccggcccccagggcagccagggcgagagaggcgccgacggcgaggugggccagaagggcgaccagggccaccccggcgugcccggcuucaugggcccccccggcaaccccggcccccccggcgccgacggcaucgccggcgccgccggcccccccggcauccagggcagccccggcaaggagggcccccccggcccccagggccccagcggccugcccggcauccccggcgaggagggcaaggagggcagagacggcaagcccggcccccccggcgagcccggcaaggccggcgagcccggccugcccggccccgagggcgccagaggcccccccggcuucaagggccacaccggcgacagcggcgcccccggccccagaggcgagagcggcgccaugggccugcccggccaggagggccugcccggcaaggacggcgacaccggccccaccggcccccagggcccccagggccccagaggcccccccggcaagaacggcagccccggcagccccggcgagcccggccccagcggcacccccggccagaagggcagcaagggcgagaacggcagccccggccugcccggcuuccugggccccagaggcccccccggcgagcccggcgagaagggcgugcccggcaaggagggcgugcccggcaagcccggcgagcccggcuucaagggcgagagaggcgaccccggcaucaagggcgacaagggcccccccggcggcaagggccagcccggcgaccccggcauccccggccacaagggccacaccggccugaugggcccccagggccugcccggcgagaacggccccgugggcccccccggcccccccggccagcccggcuuccccggccugagaggcgagagccccagcauggagacccugagaagacugauccaggaggagcugggcaagcagcuggagaccagacuggccuaccugcuggcccagaugccccccgccuacaugaagagcagccagggcagacccggcccccccggcccccccggcaaggacggccugcccggcagagccggccccaugggcgagcccggcagacccggccagggcggccuggagggccccagcggccccaucggccccaagggcgagagaggcgccaagggcgaccccggcgcccccggcgugggccugagaggcgagaugggcccccccggcauccccggccagcccggcgagcccggcuacgccaaggacggccugcccggcauccccggcccccagggcgagaccggccccgccggccaccccggccugcccggcccccccggcccccccggccagugcgaccccagccagugcgccuacuucgccagccuggccgccagacccggcaacgugaagggccccuaa

SEQ ID NO: 15465 - RNA, 1623 nt, Artificial Sequence
  COL23A1__Homo_sapiens__NP_775736
augggccccggcgagagagccggcggcggcggcgacgccggcaagggcaacgccgccggcggcggcggcggcggcagaagcgccaccaccgccggcagcagagccgugagcgcccugugccugcugcugagcgugggcagcgccgccgccugccugcugcugggcgugcaggccgccgcccugcagggcagaguggccgcccuggaggaggagagagagcugcugagaagagccggcccccccggcgcccuggacgccugggccgagccccaccuggagagacugcugagagagaagcuggacggccuggccaagaucagaaccgccagagaggcccccagcgagugcgugugcccccccggcccccccggcagaagaggcaagcccggcagaagaggcgaccccggcccccccggccagagcggcagagacggcuaccccggcccccugggccuggacggcaagcccggccugcccggccccaagggcgagaagggcgcccccggcgacuucggccccagaggcgaccagggccaggacggcgccgccggcccccccggcccccccggcccccccggcgccagaggcccccccggcgacaccggcaaggacggccccagaggcgcccagggccccgccggccccaagggcgagcccggccaggacggcgagaugggccccaagggcccccccggccccaagggcgagcccggcgugcccggcaagaagggcgacgacggcacccccagccagcccggcccccccggccccaagggcgagcccggcagcaugggccccagaggcgagaacggcguggacggcgcccccggccccaagggcgagcccggccacagaggcaccgacggcgccgccggccccagaggcgcccccggccugaagggcgagcagggcgacaccguggugaucgacuacgacggcagaauccuggacgcccugaagggcccccccggcccccagggcccccccggcccccccggcauccccggcgccaagggcgagcugggccugcccggcgcccccggcaucgacggcgagaagggccccaagggccagaagggcgaccccggcgagcccggccccgccggccugaagggcgaggccggcgagaugggccugagcggccugcccggcgccgacggccugaagggcgagaagggcgagagcgccagcgacagccugcaggagagccuggcccagcugaucguggagcccggcccccccggcccccccggcccccccggccccaugggccugcagggcauccagggccccaagggccuggacggcgccaagggcgagaagggcgccagcggcgagagaggccccagcggccugcccggccccgugggcccccccggccugaucggccugcccggcaccaagggcgagaagggcagacccggcgagcccggccuggacggcuuccccggccccagaggcgagaagggcgacagaagcgagagaggcgagaagggcgagagaggcgugcccggcagaaagggcgugaagggccagaagggcgagcccggcccccccggccuggaccagcccugccccgugggccccgacggccugcccgugcccggcugcuggcacaaguaa

SEQ ID NO: 15466 - RNA, 5091 nt, Artificial Sequence
  COL24A1__Homo_sapiens__XP_011539493
augcaccugagagcccacagaaccagaagaggcaaggugagccccaccgccaagaccaagagccugcugcacuucaucgugcugugcguggccggcgugguggugcacgcccaggagcagggcaucgacauccugcaccagcugggccugggcggcaaggacgugagacacagcagccccgccaccgccgugcccagcgccagcaccccccugccccagggcgugcaccugaccgagagcggcgugaucuucaagaacgacgccuacaucgagacccccuucgugaagauccugcccgugaaccugggccagcccuucaccauccugaccggccugcagagccacagagugaacaacgccuuccuguucagcaucagaaacaagaacagacugcagcugggcgugcagcugcugcccaagaagcugguggugcacaucagaggcaagcagcccgccguguucaacuacagcgugcacgacgagcaguggcacagcuucgccaucaccaucagaaaccagagcgugagcauguucguggagugcggcaagaaguacuucagcaccgagaccauccccgaggugcagaccuucgacagcaacagcguguucacccugggcagcaugaacaacaacagcauccacuucgagggcaucgugugccagcuggacaucauccccagcgccgaggccagcgccgacuacugcagauacgugaagcagcagugcagacaggccgacaaguaccagcccgagaccagcauccccugcaccacccugauccccaccaagauccccgagcacagccccccccccaagcuguucgccgagaaggugcugagcgaggacaccuucaccgagggcaagagcauccccaacaucaucaagaacgacagcgagaccguguacaagagacaggagcaccagaucagcagaagccagcugagcagccugcagagcggcaacgugagcgccguggaccugaccaaccacggcauccaggccaaggagaugaucaccgaggaggacacccagaccaacuucagccugagcgugaccacccacagaaucagcgaggccaagaugaacaccaaggagaaguucagcagccugcugaacaugagcgacaacaucacccagcacgacgacagagugaccggccugagccuguucaagaagaugcccagcauccugccccagaucaagcaggacaccaucaccaaccugaagaaggccaucaccgccaaccugcacaccaacgagcugauggagaugcagcccauccugaacaccagccugcacagagugaccaacgagcccagcguggacaaccaccuggaccugagaaaggagggcgaguucuaccccgacgccaccuaccccaucgagaacagcuacgagaccgagcuguacgacuacuacuacuacgaggaccugaacaccaugcuggagauggaguaccugagaggccccaagggcgacaccggcccccccggcccccccggccccgccggcauccccggccccagcggcaagagaggccccagaggcauccccggcccccacggcaaccccggccugcccggccugcccggccccaagggccccaagggcgaccccggcuucagccccggccagcccgugcccggcgagaagggcgaccagggccugagcggccugaugggcccccccggcaugcagggcgacaagggccugaagggccaccccggccugcccggccugcccggcgagcagggcauccccggcuucgccggcaacaucggcagccccggcuaccccggcagacagggccuggccggccccgagggcaaccccggccccaagggcgcccagggcuucaucggcagccccggcgaggccggccagcugggccccgagggcgagagaggcauccccggcaucagaggcaagaagggcuucaagggcagacagggcuuccccggcgacuucggcgacagaggccccgccggccuggacggcagccccggccuggugggcggcaccggcccccccggcuuccccggccugagaggcagcgugggccccgugggccccaucggccccgccggcauccccggccccaugggccugagcggcaacaagggccugcccggcaucaagggcgacaagggcgagcagggcaccgccggcgagcugggcgagcccggcuaccccggcgacaagggcgccgugggccugcccggcccccccggcaugagaggcaagagcggccccagcggccagaccggcgaccccggccugcagggccccagcggcccccccggccccgagggcuuccccggcgacaucggcauccccggccagaacggccccgagggccccaagggccugcugggcaacagaggcccccccggcccccccggccugaagggcacccagggcgaggagggccccaucggcgccuucggcgagcugggccccagaggcaagcccggccagaagggcuacgccggcgagcccggccccgagggccugaagggcgaggugggcgaccagggcaacaucggcaagaucggcgagaccggccccgugggccugcccggcgaggugggcaugaccggcagcaucggcgagaagggcgagagaggcagccccggcccccugggcccccagggcgagaagggcgugaugggcuaccccggcccccccggcgugcccggccccaucggcccccugggccugcccggcagcagaggccccgacggccugcugggcgagcagggcauccagggcgccaagggcgagaagggcgaccagggcaagagaggcccccacggccugaucggcaagaccggcaaccccggcgagagaggcuuccagggcaagcccggccugcagggccugcccggcagcaccggcgacagaggccugcccggcgagcccggccugagaggccugcagggcgacgugggcccccccggcgagaugggcauggagggcccccccggcaccgagggcgagagcggccugcagggcgagcccggcgccaagggcgacgugggcaccgccggcagcgugggcggcaccggcgagcccggccugagaggcgagcccggcgcccccggcgaggagggccugcagggcaaggacggccugaagggcgugcccggcggcagaggccugcccggcgaggacggcgagaagggcgagaugggccugcccggcaucaucggcccccugggcagaagcggccagaccggccugcccggccccgagggcaucgugggcauccccggccagagaggcagacccggcaagaagggcgacaagggccagaucggccccaccggcgaggugggcagcagaggcccccccggcaagaucggcaagagcggccccaagggcgccagaggcaccagaggcgccgugggccaccugggccugaugggccccgacggcgagcccggcauccccggcuacagaggccaccagggccagcccggccccagcggccugcccggccccaagggcgagaagggcuaccccggcgaggacagcaccgugcugggcccccccggccccagaggcgagcccggccccgugggcgaccagggcgagagaggcgagcccggcgccgagggcuacaagggccacgugggcgugcccggccugagaggcgccaccggccagcagggcccccccggcgagcccggcgaccagggcgagcagggccugaagggcgagagaggcagcgagggcaacaagggcaagaagggcgcccccggccccagcggcaagcccggcauccccggccugcagggccugcugggccccaagggcauccagggcuaccacggcgccgacggcaucagcggcaaccccggcaagaucggcccccccggcaagcagggccugcccggcaucagaggcggccccggcagaaccggccuggccggcgcccccggcccccccggcgugaagggcagcagcggccugcccggcagccccggcauccagggccccaagggcgagcagggccugcccggccagcccggcauccagggcaagagaggccacagaggcgcccagggcgaccagggccccugcggcgaccccggccugaagggccagcccggcgaguacggcgugcagggccugaccggcuuccagggcuuccccggccccaagggccccgagggcgacgccggcaucgugggcaucagcggccccaagggccccaucggccacagaggcaacaccggcccccugggcagagagggcaucaucggccccaccggcagaaccggccccagaggcgagaagggcuucagaggcgagaccggcccccagggccccagaggccagcccggcccccccggcccccccggcgcccccggccccagaaagcagauggacaucaacgccgccauccaggcccugaucgagagcaacaccgcccugcagauggagagcuaccagaacaccgaggugacccugaucgaccacagcgaggagaucuucaagacccugaacuaccugagcaaccugcugcacagcaucaagaacccccugggcaccagagacaaccccgccagaaucugcaaggaccugcugaacugcgagcagaaggugagcgacggcaaguacuggaucgaccccaaccugggcugccccagcgacgccaucgagguguucugcaacuucagcgccggcggccagaccugccugccccccgugagcgugaccaagcuggaguucggcgugggcaaggugcagaugaacuuccugcaccugcugagcagcgaggccacccacaucaucaccauccacugccugaacacccccagauggaccagcacccagaccagcggccccggccugcccaucggcuucaagggcuggaacggccagaucuucaaggugaacacccugcuggagcccaaggugcugagcgacgacugcaagauccaggacggcagcuggcacaaggccaccuuccuguuccacacccaggagcccaaccagcugcccgugaucgaggugcagaagcugccccaccugaagaccgagagaaaguacuacaucgacagcagcagcgugugcuuccuguaa

SEQ ID NO: 15467 - RNA, 1938 nt, Artificial Sequence
  COL25A1__Homo_sapiens__NP_001243003
augcugcugaagaagcacgccggcaagggcggcggcagagagcccagaagcgaggaccccacccccgccgagcagcacugcgccagaaccaugccccccugcgccgugcuggccgcccugcugagcgugguggccguggugagcugccuguaccugggcgugaagaccaacgaccugcaggccagaaucgccgcccuggagagcgccaagggcgcccccagcauccaccugcugcccgacacccuggaccaccugaagaccauggugcaggagaagguggagagacugcuggcccagaagagcuacgagcacauggccaagaucagaaucgccagagaggcccccagcgagugcaacugccccgccggcccccccggcaagagaggcaagagaggcagaagaggcgagagcggcccccccggccagcccggcccccagggcccccccggccccaagggcgacaagggcgagcagggcgaccagggccccagaggccugcccggcuuccccaccguggccgcccugcacagcaaccagauccugaccgugaagggcgaccagggccaggccggcccccccggcccccccggcccccccggccccagaggcccccccggcgacaccggcaaggacggccccagaggcaugcccggcgugcccggcgagcccggcaagcccggcgagcagggccugaugggcccccugggcccccccggccagaagggcagcaucggcgcccccggcauccccggcaugaacggccagaagggcgagcccggccugcccggcgccgugggccagaacggcauccccggccccaagggcgagcccggcgagcagggcgagaagggcgacgccggcgagaacggccccaagggcgacaccggcgagaagggcgaccccggcagcagcgccgccggcaucaagggcgagcccggcgagagcggcagacccggccagaagggcgagcccggccugcccggccugcccggccugcccggcaucaagggcgagcccggcuucaucggcccccagggcgagcccggccugcccggccugcccggcaccaagggcgagagaggcgaggccggcccccccggcagaggcgagagaggcgagcccggcgcccccggccccaagggcgacagaggcgagaagggcgacagcggcgcccagggccccagaggcccccccggccagaagggcgaccagggcgccaccgagaucaucgacuacaacggcaaccugcacgaggcccugcagggcccccccggcccccccggcccccagggccugcagggccccaagggcgagcagggcagccccggcauccccggcauggacggcgagcagggccugaagggcagcaagggcgacaugggcgaccccggcaugaccggcgagaagggcggcaucggccugcccggccugcccggcgccaacggcaugaagggcgagaagggcgacagcggcaugcccggcccccagggccccagcaucaucggcccccccggcccccccggcccccacggcccccccggccccaugggcccccacggccugcccggccccaagggcgagcccggccugaacggcgugaagggccugaagggcgagcccggccagaagggcgacagaggcccccugggccugcccggcgccagcggccuggacggcaagcccggcagcagaggcaccgacggccccaugggcccccacggccccgccggccccaagggcgagagaggcgagaagggcgccaugggcgagcccggccccagaggccccuacggccugcccggcuuccccggccccagaggcgagaagggcgaccugggcgagaagggcgagaaggugaccagccccagccagcacgugcccugccugauccugcugcugcugagcgcccugcuguucagccugugcgacagcaucuaa

SEQ ID NO: 15468 - RNA, 1326 nt, Artificial Sequence
  COL26A1__Homo_sapiens__NP_001265492
augaagcuggcccugcugcugcccugggccugcugcugccugugcggcagcgcccuggccaccggcuuccuguaccccuucagcgccgccgcccugcagcagcacggcuaccccgagcccggcgccggcagccccggcagcggcuacgccagcagaagacacuggugccaccacaccgugaccagaaccgugagcugccaggugcagaacggcagcgagaccguggugcagagaguguaccagagcugcagauggcccggccccugcgccaaccuggugagcuacagaacccugaucagacccaccuacagagugagcuacagaaccgugaccgugcuggaguggagaugcugccccggcuucaccggcagcaacugcgacgaggagugcaugaacugcaccagacugagcgacaugagcgagagacugaccacccuggaggccaaggugcugcugcuggaggccgccgagagacccagcagccccgacaacgaccugcccgcccccgagagcaccccccccaccuggaacgaggacuuccugcccgacgccaucccccuggcccaccccgugcccagacagagaagacccaccggccccgccggcccccccggccagaccggcccccccggccccgccggcccccccggcagcaagggcgacagaggccagaccggcgagaagggccccgccggcccccccggccugcugggcccccccggccccagaggccugcccggcgagaugggcagacccggcccccccggcccccccggccccgccggcaaccccggccccagccccaacagcccccagggcgcccuguacagccugcagccccccaccgacaaggacaacggcgacagcagacuggccagcgccaucguggacaccgugcuggccggcgugcccggccccagaggcccccccggcccccccggcccccccggccccagaggcccccccggcccccccggcacccccggcagccagggccuggccggcgagagaggcaccgugggccccagcggcgagcccggcgugaagggcgaggagggcgagaaggccgccaccgccgagggcgagggcgugcagcagcugagagaggcccugaagauccuggccgagagagugcugauccuggagcacaugaucggcauccacgacccccuggccagccccgagggcggcagcggccaggacgccgcccugagagccaaccugaagaugaagagaggcggcgcccagcccgacggcgugcuggccgcccugcugggccccgaccccggccagaagagcguggaccaggccagcagcagaaaguaa

SEQ ID NO: 15469 - RNA, 5583 nt, Artificial Sequence
  COL27A1__Homo_sapiens__NP_116277
augggcgccggcagcgccagaggcgccagaggcaccgccgccgccgccgccgccagaggcggcggcuuccuguucagcuggauccuggugagcuucgccugccaccuggccagcacccagggcgcccccgaggacguggacauccugcagagacugggccugagcuggaccaaggccggcagccccgccccccccggcgugauccccuuccagagcggcuucaucuucacccagagagccagacugcaggcccccaccggcaccgugauccccgccgcccugggcaccgagcuggcccuggugcugagccugugcagccacagagugaaccacgccuuccuguucgccgugagaagccagaagagaaagcugcagcugggccugcaguuccugcccggcaagaccguggugcaccugggcagcagaagaagcguggccuucgaccuggacaugcacgacggcagauggcaccaccuggcccuggagcugagaggcagaaccgugacccuggugaccgccugcggccagagaagagugcccgugcugcugcccuuccacagagaccccgcccuggaccccggcggcagcuuccuguucggcaagaugaacccccacgccgugcaguucgagggcgcccugugccaguucagcaucuaccccgugacccagguggcccacaacuacugcacccaccugagaaagcagugcggccaggccgacaccuaccagagcccccugggcccccuguucagccaggacagcggcagacccuucaccuuccagagcgaccuggcccugcugggccuggagaaccugaccaccgccacccccgcccugggcagccugcccgccggcagaggccccagaggcaccguggcccccgccacccccaccaagccccagagaaccagccccaccaacccccaccagcacauggccgugggcggccccgcccagaccccccugcugcccgccaagcugagcgccagcaacgcccuggaccccaugcugcccgccagcgugggcggcagcaccagaacccccagacccgccgccgcccagcccagccagaagaucaccgccaccaagauccccaagagccugcccaccaagcccagcgcccccagcaccagcaucgugcccaucaagagcccccaccccacccagaagaccgcccccagcagcuucaccaagagcgcccugcccacccagaagcaggugccccccaccagcagacccgugcccgccagagugagcagacccgccgagaagcccauccagagaaaccccggcaugcccagaccccccccccccagcaccagaccccugccccccaccaccagcagcagcaagaagcccauccccacccuggccagaaccgaggccaagaucaccagccacgccagcaagcccgccagcgccagaaccagcacccacaagcccccccccuucaccgcccugagcagcagccccgcccccacccccggcagcaccagaagcaccagaccccccgccaccauggugccccccaccagcggcaccagcacccccagaaccgcccccgccgugcccacccccggcagcgcccccaccggcagcaagaagcccaucggcagcgaggccagcaagaaggccggccccaagagcagccccagaaagcccgugccccugagacccggcaaggccgccagagacgugccccugagcgaccugaccaccagacccagccccagacagccccagcccagccagcagaccacccccgcccuggugcuggcccccgcccaguuccugagcagcagccccagacccaccagcagcggcuacagcaucuuccaccuggccggcagcacccccuucccccugcugaugggcccccccggccccaagggcgacugcggccugcccggcccccccggccugcccggccugcccggcauccccggcgccagaggccccagaggcccccccggccccuacggcaaccccggccugcccggcccccccggcgccaagggccagaagggcgaccccggccugagccccggcaaggcccacgacggcgccaagggcgacaugggccugcccggccugagcggcaaccccggcccccccggcagaaagggccacaagggcuaccccggccccgccggccaccccggcgagcagggccagcccggccccgagggcagccccggcgccaagggcuaccccggcagacagggccugcccggccccgugggcgaccccggccccaagggcagcagaggcuacaucggccugcccggccuguucggccugcccggcagcgacggcgagagaggccugcccggcgugcccggcaagagaggcaagaugggcaugcccggcuuccccggcguguucggcgagagaggcccccccggccuggacggcaaccccggcgagcugggccugcccggcccccccggcgugcccggccugaucggcgaccugggcgugcugggccccaucggcuaccccggccccaagggcaugaagggccugaugggcagcgugggcgagcccggccugaagggcgacaagggcgagcagggcgugcccggcgugagcggcgaccccggcuuccagggcgacaagggcagccagggccugcccggcuuccccggcgccagaggcaagcccggcccccugggcaaggugggcgacaagggcagcaucggcuuccccggcccccccggccccgagggcuuccccggcgacaucggcccccccggcgacaacggccccgagggcaugaagggcaagcccggcgccagaggccugcccggccccagaggccagcugggccccgagggcgacgagggccccaugggcccccccggcgcccccggccuggagggccagcccggcagaaagggcuuccccggcagacccggccuggacggcgugaagggcgagcccggcgaccccggcagacccggccccgugggcgagcagggcuucaugggcuucaucggccuggugggcgagcccggcaucgugggcgagaagggcgacagaggcaugaugggcccccccggcgugcccggccccaagggcagcaugggccaccccggcaugcccggcggcaugggcacccccggcgagcccggcccccagggcccccccggcagcagaggcccccccggcaugagaggcgccaagggcagaagaggccccagaggccccgacggccccgccggcgagcagggcagcagaggccugaagggcccccccggcccccagggcagacccggcagacccggccagcagggcguggccggcgagagaggccaccugggcagcagaggcuuccccggcauccccggccccagcggcccccccggcaccaagggccugcccggcgagcccggcccccagggcccccagggccccaucggcccccccggcgagaugggccccaagggcccccccggcgccgugggcgagcccggccugcccggcgaggccggcaugaagggcgaccugggcccccugggcacccccggcgagcagggccugaucggccagagaggcgagcccggccuggagggcgacagcggccccaugggccccgacggccugaagggcgacagaggcgaccccggccccgacggcgagcacggcgagaagggccaggagggccugaugggcgaggacggcccccccggcccccccggcgugaccggcgugagaggccccgagggcaagagcggcaagcagggcgagaagggcagaaccggcgccaagggcgccaagggcuaccagggccagcugggcgagaugggcgugcccggcgaccccggcccccccggcacccccggccccaagggcagcagaggcagccugggccccaccggcgcccccggcagaaugggcgcccagggcgagcccggccuggccggcuacgacggccacaagggcaucgugggcccccugggcccccccggccccaagggcgagaagggcgagcagggcgaggacggcaaggccgagggcccccccggcccccccggcgacagaggccccgugggcgacagaggcgacagaggcgagcccggcgaccccggcuaccccggccaggagggcgugcagggccugagaggcaagcccggccagcagggccagcccggccaccccggccccagaggcuggcccggccccaagggcagcaagggcgccgagggccccaagggcaagcagggcaaggccggcgcccccggcagaagaggcgugcagggccugcagggccugcccggccccagaggcguggugggcagacagggccuggagggcaucgccggccccgacggccugcccggcagagacggccaggccggccagcagggcgagcagggcgacgacggcgaccccggccccaugggccccgccggcaagagaggcaaccccggcguggccggccugcccggcgcccagggcccccccggcuucaagggcgagagcggccugcccggccagcugggcccccccggcaagagaggcaccgagggcagaaccggccugcccggcaaccagggcgagcccggcagcaagggccagcccggcgacagcggcgagaugggcuuccccggcauggccggccuguucggccccaagggcccccccggcgacaucggcuucaagggcauccagggccccagaggcccccccggccugaugggcaaggagggcaucgugggcccccugggcauccugggccccagcggccugcccggccccaagggcgacaagggcagcagaggcgacuggggccugcagggccccagaggcccccccggccccagaggcagacccggcccccccggcccccccggcggccccauccagcugcagcaggacgaccugggcgccgccuuccagaccuggauggacaccagcggcgcccugagacccgagagcuacagcuaccccgacagacuggugcuggaccagggcggcgagaucuucaagacccugcacuaccugagcaaccugauccagagcaucaagaccccccugggcaccaaggagaaccccgccagagugugcagagaccugauggacugcgagcagaagaugguggacggcaccuacuggguggaccccaaccugggcugcagcagcgacaccaucgaggugagcugcaacuucacccacggcggccagaccugccugaagcccaucaccgccagcaagguggaguucgccaucagcagagugcagaugaacuuccugcaccugcugagcagcgaggugacccagcacaucaccauccacugccugaacaugaccguguggcaggagggcaccggccagacccccgccaagcaggccgugagauucagagccuggaacggccagaucuucgaggccggcggccaguucagacccgaggugagcauggacggcugcaaggugcaggacggcagauggcaccagacccuguucaccuucagaacccaggacccccagcagcugcccaucaucagcguggacaaccugccccccgccagcagcggcaagcaguacagacuggaggugggccccgccugcuuccuguaa

SEQ ID NO: 15470 - RNA, 3378 nt, Artificial Sequence
  COL28A1__Homo_sapiens__XP_011513662
auguggaacagauacuucguguucuaccugcugcugcugagcgccuucaccagccagaccgugagcggccagagaaagaagggccccaagagcaaccugcuggccagaaagagcgacgugcagggcagcaucugcuucaucgacaucguguucaucguggacagcagcgagagcagcaagaucgcccuguucgacaagcagaaggacuucguggacagccugagcgacaagaucuuccagcugacccccggcagaagccuggaguacgacaucaagcuggccgcccugcaguucagcagcagcgugcagaucgacccccccuucagcagcuggaaggaccugcagaccuucaagcagaaggugaagagcaugaaccugaucggccagggcaccuucagcuacuacgccaucagcaacgccaccagacugcugaagagagagggcagaaaggacggcgugaagguggugcugcugaugaccgacggcaucgaccaccccaagaaccccgacgugcagagcaucagcgaggacgccagaaucagcggcaucagcuucaucaccaucgcccugagcaccguggugaacgaggccaagcugagacugaucagcggcgacagcagcagcgagcccacccugcugcugagcgaccccacccugguggacaagauccaggacagacuggacauccuguucgagaagaagugcgagagaaagaucugcgagugcgagaagggcgaccccggcgaccccggcccccccggcacccacggcaaccccggcaucaagggcgagagaggccccaagggcaaccccggcaacgcccagaagggcgaggccggcgagagaggccccggcggcauccccggcuacaagggcgacaagggcgagagaggcgagugcggcaagcccggcaucaagggcgacaagggcagccccggccccuacggccccaagggccccagaggcauccagggcaucaccggcccccccggcgaccccggccccaagggcuuccagggcaacaagggcgagcccggcccccccggccccuacggcagccccggcgcccccggcaucggccagcagggcaucaagggcgagagaggccaggagggcagacccggcgcccccggccccaucggcgugggcgagcccggccagcccggccccagaggccccgagggcgugcccggcgagagaggccugcccggcgagggcuuccccggccccaagggcgagaagggcagcgagggccccaccggcccccagggccugcagggccugagcaucaagggcgagaagggcgacaucggccccgugggcccccagggccccaugggcauccccggcaucggcagccagggcgagcagggcauccagggccccaucggcccccccggcccccagggccccgccggccagggccugcccggcagcaagggcgaggugggccagaugggccccaccggccccagaggccccgugggcaucggcgugcagggccccaagggcgagcccggcagcaucggccugcccggccagcccggcgugcccggcgaggacggcgccgccggcaagaagggcgaggccggccugcccggcgccagaggccccgagggcccccccggcaagggccagcccggccccaagggcgacgagggcaagaagggcagcaagggcaaccagggccagagaggccugcccggccccgagggccccaagggcgagcccggcaucaugggccccuucggcaugcccggcaccagcauccccggcccccccggccccaagggcgacagaggcggccccggcauccccggcuucaagggcgagcccggccugagcaucagaggccccaagggcgugcagggccccagaggccccgugggcgcccccggccugaagggcgacggcuaccccggcgugcccggccccagaggccugcccggcccccccggccccaugggccugagaggcgugggcgacaccggcgccaagggcgagcccggcgugagaggcccccccggccccagcggccccagaggcgugggcacccagggccccaagggcgacaccggccagaagggccugcccggcccccccggcccccccggcuacggcagccagggcaucaagggcgagcagggcccccagggcuuccccggccccaagggcaccaugggccacggccugcccggccagaagggcgagcacggcgagagaggcgacgugggcaagaagggcgacaagggcgagaucggcgagcccggcagccccggcaagcagggccugcagggccccaagggcgaccugggccugaccaaggaggagaucaucaagcugaucaccgagaucugcggcugcggccccaagugcaaggagaccccccuggagcugguguucgugaucgacagcagcgagagcgugggccccgagaacuuccagaucaucaagaacuucgugaagaccauggccgacagaguggcccuggaccuggccaccgccagaaucggcaucaucaacuacagccacaagguggagaagguggccaaccugaagcaguucagcagcaaggacgacuucaagcuggccguggacaacaugcaguaccugggcgagggcaccuacaccgccaccgcccugcaggccgccaacgacauguucgaggacgccagacccggcgugaagaagguggcccuggugaucaccgacggccagaccgacagcagagacaaggagaagcugaccgagguggugaagaacgccagcgacaccaacguggagaucuucgugaucggcguggugaagaagaacgaccccaacuucgagaucuuccacaaggagaugaaccugaucgccaccgaccccgagcacguguaccaguucgacgacuucuucacccugcaggacacccugaagcagaagcuguuccagaagaucugcgaggacuucgacagcuaccuggugcagaucuucggcagcagcagcccccagcccggcuucggcaugagcggcgaggagcugagcgagagcacccccgagccccagaaggagaucagcgagagccugagcgugaccagagaccaggacgaggacgacaaggcccccgagcccaccugggccgacgaccugcccgccaccaccagcagcgaggccaccaccacccccagaccccugcugagcacccccguggacggcgccgaggaccccagaugccuggaggcccugaagcccggcaacugcggcgaguacguggugagaugguacuacgacaagcaggugaacagcugcgccagauucugguucagcggcugcaacggcagcggcaacagauucaacagcgagaaggagugccaggagaccugcauccagggcuaa

SEQ ID NO: 15471 - RNA, 4464 nt, Artificial Sequence
  COL2A1__Homo_sapiens__NP_001835
augaucagacugggcgccccccagacccuggugcugcugacccugcugguggccgccgugcugagaugccagggccaggacgugcaggaggccggcagcugcgugcaggacggccagagauacaacgacaaggacguguggaagcccgagcccugcagaaucugcgugugcgacaccggcaccgugcugugcgacgacaucaucugcgaggacgugaaggacugccugagccccgagauccccuucggcgagugcugccccaucugccccaccgaccuggccaccgccagcggccagcccggccccaagggccagaagggcgagcccggcgacaucaaggacaucgugggccccaagggcccccccggcccccagggccccgccggcgagcagggccccagaggcgacagaggcgacaagggcgagaagggcgcccccggccccagaggcagagacggcgagcccggcacccccggcaaccccggcccccccggcccccccggcccccccggcccccccggccugggcggcaacuucgccgcccagauggccggcggcuucgacgagaaggccggcggcgcccagcugggcgugaugcagggccccaugggccccaugggccccagaggcccccccggccccgccggcgcccccggcccccagggcuuccagggcaaccccggcgagcccggcgagcccggcgugagcggccccaugggccccagaggcccccccggcccccccggcaagcccggcgacgacggcgaggccggcaagcccggcaaggccggcgagagaggcccccccggcccccagggcgccagaggcuuccccggcacccccggccugcccggcgugaagggccacagaggcuaccccggccuggacggcgccaagggcgaggccggcgcccccggcgugaagggcgagagcggcagccccggcgagaacggcagccccggccccaugggccccagaggccugcccggcgagagaggcagaaccggccccgccggcgccgccggcgccagaggcaacgacggccagcccggccccgccggcccccccggccccgugggccccgccggcggccccggcuuccccggcgcccccggcgccaagggcgaggccggccccaccggcgccagaggccccgagggcgcccagggccccagaggcgagcccggcacccccggcagccccggccccgccggcgccagcggcaaccccggcaccgacggcauccccggcgccaagggcagcgccggcgcccccggcaucgccggcgcccccggcuuccccggccccagaggcccccccggcccccagggcgccaccggcccccugggccccaagggccagaccggcgagcccggcaucgccggcuucaagggcgagcagggccccaagggcgagcccggccccgccggcccccagggcgcccccggccccgccggcgaggagggcaagagaggcgccagaggcgagcccggcggcgugggccccaucggcccccccggcgagagaggcgcccccggcaacagaggcuuccccggccaggacggccuggccggccccaagggcgcccccggcgagagaggccccagcggccuggccggccccaagggcgccaacggcgaccccggcagacccggcgagcccggccugcccggcgccagaggccugaccggcagacccggcgacgccggcccccagggcaaggugggccccagcggcgcccccggcgaggacggcagacccggcccccccggcccccagggcgccagaggccagcccggcgugaugggcuuccccggccccaagggcgccaacggcgagcccggcaaggccggcgagaagggccugcccggcgcccccggccugagaggccugcccggcaaggacggcgagaccggcgccgccggcccccccggccccgccggccccgccggcgagagaggcgagcagggcgcccccggccccagcggcuuccagggccugcccggcccccccggcccccccggcgagggcggcaagcccggcgaccagggcgugcccggcgaggccggcgcccccggccuggugggccccagaggcgagagaggcuuccccggcgagagaggcagccccggcgcccagggccugcagggccccagaggccugcccggcacccccggcaccgacggccccaagggcgccagcggccccgccggcccccccggcgcccagggcccccccggccugcagggcaugcccggcgagagaggcgccgccggcaucgccggccccaagggcgacagaggcgacgugggcgagaagggccccgagggcgcccccggcaaggacggcggcagaggccugaccggccccaucggcccccccggccccgccggcgccaacggcgagaagggcgaggugggcccccccggccccgccggcagcgccggcgccagaggcgcccccggcgagagaggcgagaccggcccccccggccccgccggcuucgccggcccccccggcgccgacggccagcccggcgccaagggcgagcagggcgaggccggccagaagggcgacgccggcgcccccggcccccagggccccagcggcgcccccggcccccagggccccaccggcgugaccggccccaagggcgccagaggcgcccagggcccccccggcgccaccggcuuccccggcgccgccggcagagugggcccccccggcagcaacggcaaccccggcccccccggcccccccggccccagcggcaaggacggccccaagggcgccagaggcgacagcggcccccccggcagagccggcgagcccggccugcagggccccgccggcccccccggcgagaagggcgagcccggcgacgacggccccagcggcgccgagggcccccccggcccccagggccuggccggccagagaggcaucgugggccugcccggccagagaggcgagagaggcuuccccggccugcccggccccagcggcgagcccggcaagcagggcgcccccggcgccagcggcgacagaggcccccccggccccgugggcccccccggccugaccggccccgccggcgagcccggcagagagggcagccccggcgccgacggcccccccggcagagacggcgccgccggcgugaagggcgacagaggcgagaccggcgccgugggcgcccccggcgcccccggcccccccggcagccccggccccgccggccccaccggcaagcagggcgacagaggcgaggccggcgcccagggccccaugggccccagcggccccgccggcgccagaggcauccagggcccccagggccccagaggcgacaagggcgaggccggcgagcccggcgagagaggccugaagggccacagaggcuucaccggccugcagggccugcccggcccccccggccccagcggcgaccagggcgccagcggccccgccggccccagcggccccagaggcccccccggccccgugggccccagcggcaaggacggcgccaacggcauccccggccccaucggcccccccggccccagaggcagaagcggcgagaccggccccgccggcccccccggcaaccccggcccccccggcccccccggcccccccggccccggcaucgacaugagcgccuucgccggccugggccccagagagaagggccccgacccccugcaguacaugagagccgaccaggccgccggcggccugagacagcacgacgccgagguggacgccacccugaagagccugaacaaccagaucgagagcaucagaagccccgagggcagcagaaagaaccccgccagaaccugcagagaccugaagcugugccaccccgaguggaagagcggcgacuacuggaucgaccccaaccagggcugcacccuggacgccaugaagguguucugcaacauggagaccggcgagaccugcguguaccccaaccccgccaacgugcccaagaagaacugguggagcagcaagagcaaggagaagaagcacaucugguucggcgagaccaucaacggcggcuuccacuucagcuacggcgacgacaaccuggcccccaacaccgccaacgugcagaugaccuuccugagacugcugagcaccgagggcagccagaacaucaccuaccacugcaagaacagcaucgccuaccuggacgaggccgccggcaaccugaagaaggcccugcugauccagggcagcaacgacguggagaucagagccgagggcaacagcagauucaccuacaccgcccugaaggacggcugcaccaagcacaccggcaaguggggcaagaccgugaucgaguacagaagccagaagaccagcagacugcccaucaucgacaucgcccccauggacaucggcggccccgagcaggaguucggcguggacaucggccccgugugcuuccuguaa

SEQ ID NO: 15472 - RNA, 4401 nt, Artificial Sequence
  COL3A1__Homo_sapiens__NP_000081
augaugagcuucgugcagaagggcagcuggcugcugcuggcccugcugcaccccaccaucauccuggcccagcaggaggccguggagggcggcugcagccaccugggccagagcuacgccgacagagacguguggaagcccgagcccugccagaucugcgugugcgacagcggcagcgugcugugcgacgacaucaucugcgacgaccaggagcuggacugccccaaccccgagauccccuucggcgagugcugcgccgugugcccccagccccccaccgcccccaccagaccccccaacggccagggcccccagggccccaagggcgaccccggcccccccggcauccccggcagaaacggcgaccccggcauccccggccagcccggcagccccggcagccccggcccccccggcaucugcgagagcugccccaccggcccccagaacuacagcccccaguacgacagcuacgacgugaagagcggcguggccgugggcggccuggccggcuaccccggccccgccggcccccccggcccccccggcccccccggcaccagcggccaccccggcagccccggcagccccggcuaccagggcccccccggcgagcccggccaggccggccccagcggcccccccggcccccccggcgccaucggccccagcggccccgccggcaaggacggcgagagcggcagacccggcagacccggcgagagaggccugcccggcccccccggcaucaagggccccgccggcauccccggcuuccccggcaugaagggccacagaggcuucgacggcagaaacggcgagaagggcgagaccggcgcccccggccugaagggcgagaacggccugcccggcgagaacggcgcccccggccccaugggccccagaggcgcccccggcgagagaggcagacccggccugcccggcgccgccggcgccagaggcaacgacggcgccagaggcagcgacggccagcccggcccccccggcccccccggcaccgccggcuuccccggcagccccggcgccaagggcgaggugggccccgccggcagccccggcagcaacggcgcccccggccagagaggcgagcccggcccccagggccacgccggcgcccagggcccccccggcccccccggcaucaacggcagccccggcggcaagggcgagaugggccccgccggcauccccggcgcccccggccugaugggcgccagaggcccccccggccccgccggcgccaacggcgcccccggccugagaggcggcgccggcgagcccggcaagaacggcgccaagggcgagcccggccccagaggcgagagaggcgaggccggcauccccggcgugcccggcgccaagggcgaggacggcaaggacggcagccccggcgagcccggcgccaacggccugcccggcgccgccggcgagagaggcgcccccggcuucagaggccccgccggccccaacggcauccccggcgagaagggccccgccggcgagagaggcgcccccggccccgccggccccagaggcgccgccggcgagcccggcagagacggcgugcccggcggccccggcaugagaggcaugcccggcagccccggcggccccggcagcgacggcaagcccggcccccccggcagccagggcgagagcggcagacccggcccccccggccccagcggccccagaggccagcccggcgugaugggcuuccccggccccaagggcaacgacggcgcccccggcaagaacggcgagagaggcggccccggcggccccggcccccagggcccccccggcaagaacggcgagaccggcccccagggcccccccggccccaccggccccggcggcgacaagggcgacaccggcccccccggcccccagggccugcagggccugcccggcaccggcggcccccccggcgagaacggcaagcccggcgagcccggccccaagggcgacgccggcgcccccggcgcccccggcggcaagggcgacgccggcgcccccggcgagagaggcccccccggccuggccggcgcccccggccugagaggcggcgccggcccccccggccccgagggcggcaagggcgccgccggcccccccggcccccccggcgccgccggcacccccggccugcagggcaugcccggcgagagaggcggccugggcagccccggccccaagggcgacaagggcgagcccggcggccccggcgccgacggcgugcccggcaaggacggccccagaggccccaccggccccaucggcccccccggccccgccggccagcccggcgacaagggcgagggcggcgcccccggccugcccggcaucgccggccccagaggcagccccggcgagagaggcgagaccggcccccccggccccgccggcuuccccggcgcccccggccagaacggcgagcccggcggcaagggcgagagaggcgcccccggcgagaagggcgagggcggcccccccggcguggccggcccccccggcggcagcggccccgccggcccccccggcccccagggcgugaagggcgagagaggcagccccggcggccccggcgccgccggcuuccccggcgccagaggccugcccggcccccccggcagcaacggcaaccccggcccccccggccccagcggcagccccggcaaggacggcccccccggccccgccggcaacaccggcgcccccggcagccccggcgugagcggccccaagggcgacgccggccagcccggcgagaagggcagccccggcgcccagggcccccccggcgcccccggcccccugggcaucgccggcaucaccggcgccagaggccuggccggcccccccggcaugcccggccccagaggcagccccggcccccagggcgugaagggcgagagcggcaagcccggcgccaacggccugagcggcgagagaggcccccccggcccccagggccugcccggccuggccggcaccgccggcgagcccggcagagacggcaaccccggcagcgacggccugcccggcagagacggcagccccggcggcaagggcgacagaggcgagaacggcagccccggcgcccccggcgcccccggccaccccggcccccccggccccgugggccccgccggcaagagcggcgacagaggcgagagcggccccgccggccccgccggcgcccccggccccgccggcagcagaggcgcccccggcccccagggccccagaggcgacaagggcgagaccggcgagagaggcgccgccggcaucaagggccacagaggcuuccccggcaaccccggcgcccccggcagccccggccccgccggccagcagggcgccaucggcagccccggccccgccggccccagaggccccgugggccccagcggcccccccggcaaggacggcaccagcggccaccccggccccaucggcccccccggccccagaggcaacagaggcgagagaggcagcgagggcagccccggccaccccggccagcccggcccccccggcccccccggcgcccccggccccugcugcggcggcgugggcgccgccgccaucgccggcaucggcggcgagaaggccggcggcuucgcccccuacuacggcgacgagcccauggacuucaagaucaacaccgacgagaucaugaccagccugaagagcgugaacggccagaucgagagccugaucagccccgacggcagcagaaagaaccccgccagaaacugcagagaccugaaguucugccaccccgagcugaagagcggcgaguacuggguggaccccaaccagggcugcaagcuggacgccaucaagguguucugcaacauggagaccggcgagaccugcaucagcgccaacccccugaacgugcccagaaagcacugguggaccgacagcagcgccgagaagaagcacgugugguucggcgagagcauggacggcggcuuccaguucagcuacggcaaccccgagcugcccgaggacgugcuggacgugcagcuggccuuccugagacugcugagcagcagagccagccagaacaucaccuaccacugcaagaacagcaucgccuacauggaccaggccagcggcaacgugaagaaggcccugaagcugaugggcagcaacgagggcgaguucaaggccgagggcaacagcaaguucaccuacaccgugcuggaggacggcugcaccaagcacaccggcgaguggagcaagaccguguucgaguacagaaccagaaaggccgugagacugcccaucguggacaucgcccccuacgacaucggcggccccgaccaggaguucggcguggacgugggccccgugugcuuccuguaa

SEQ ID NO: 15473 - RNA, 1560 nt, Artificial Sequence
  COL4A1__Homo_sapiens__NP_001290039
augggccccagacugagcguguggcugcugcugcugcccgccgcccugcugcugcacgaggagcacagcagagccgccgccaagggcggcugcgccggcagcggcugcggcaagugcgacugccacggcgugaagggccagaagggcgagagaggccugcccggccugcagggcgugaucggcuuccccggcaugcagggccccgagggcccccagggcccccccggccagaagggcgacaccggcgagcccggccugcccggcaccaagggcaccagaggcccccccggcgccagcggcuaccccggcaaccccggccugcccggcauccccggccaggacggcccccccggcccccccggcauccccggcugcaacggcaccaagggcgagagaggcccccugggcccccccggccugcccggcuucgccggcaaccccggcccccccggccugcccggcaugaagggcgaccccggcgagauccugggccacgugcccggcaugcugcugaagggcgagagaggcuuccccggcauccccggcacccccggcccccccggccugcccggccugcagggccccgugggcccccccggcuucaccggcccccccggcccccccggcccccccggcccccccggcgagaagggccagaugggccugagcuuccagggccccaagggcgacaagggcgaccagggcgugagcggcccccccggcgugcccggccaggcccaggugcaggagaagggcgacuucgccaccaagggcgagaagggccagaagggcgagcccggcuuccagggcaugcccggcgugggcgagaagggcgagcccggcaagcccggccccagaggcaagcccggcaaggacggcgacaagggcgagaagggcagccccggcuuccccggcgagcccggcuaccccggccugaucggcagacagggcccccagggcgagaagggcgaggccggcccccccggcccccccggcaucgugaucggcaccggcccccugggcgagaagggcgagagaggcuaccccggcacccccggccccagaggcgagcccggccccaagggcuuccccggccugcccggccagcccggcccccccggccugcccgugcccggccaggccggcgcccccggcuuccccggcgagagaggcgagaagggcgacagaggcuuccccggcaccagccugcccggccccagcggcagagacggccugcccggcccccccggcagccccggcccccccggccagcccggcuacaccaacggcaucguggagugccagcccggcccccccggcgaccagggcccccccggcauccccggccagcccggcuucaucggcgagaucggcgagaagggccagaagggcgagagcugccugaucugcgacaucgacggcuacagaggcccccccggcccccagggcccccccggcgagaucggcuuccccggccagcccggcgccaagggcgacagaggccugcccggcagagacggcguggccggcgugccccugcuguuccagauccacaaguaa

SEQ ID NO: 15474 - RNA, 5139 nt, Artificial Sequence
  COL4A2__Homo_sapiens__NP_001837
augggcagagaccagagagccguggccggccccgcccugagaagauggcugcugcugggcaccgugaccgugggcuuccuggcccagagcgugcuggccggcgugaagaaguucgacgugcccugcggcggcagagacugcagcggcggcugccagugcuaccccgagaagggcggcagaggccagcccggccccgugggcccccagggcuacaacggcccccccggccugcagggcuuccccggccugcagggcagaaagggcgacaagggcgagagaggcgcccccggcgugaccggccccaagggcgacgugggcgccagaggcgugagcggcuuccccggcgccgacggcauccccggccaccccggccagggcggccccagaggcagacccggcuacgacggcugcaacggcacccagggcgacagcggcccccagggcccccccggcagcgagggcuucaccggcccccccggcccccagggccccaagggccagaagggcgagcccuacgcccugcccaaggaggagagagacagauacagaggcgagcccggcgagcccggccuggugggcuuccagggcccccccggcagacccggccacgugggccagaugggccccgugggcgcccccggcagacccggcccccccggcccccccggccccaagggccagcagggcaacagaggccugggcuucuacggcgugaagggcgagaagggcgacgugggccagcccggccccaacggcauccccagcgacacccugcaccccaucaucgcccccaccggcgugaccuuccaccccgaccaguacaagggcgagaagggcagcgagggcgagcccggcaucagaggcaucagccugaagggcgaggagggcaucaugggcuuccccggccugagaggcuaccccggccugagcggcgagaagggcagccccggccagaagggcagcagaggccuggacggcuaccagggccccgacggccccagaggccccaagggcgaggccggcgaccccggcccccccggccugcccgccuacagcccccaccccagccuggccaagggcgccagaggcgaccccggcuuccccggcgcccagggcgagcccggcagccagggcgagcccggcgaccccggccugcccggcccccccggccugagcaucggcgacggcgaccagagaagaggccugcccggcgagaugggccccaagggcuucaucggcgaccccggcauccccgcccuguacggcggcccccccggccccgacggcaagagaggcccccccggcccccccggccugcccggcccccccggccccgacggcuuccuguucggccugaagggcgccaagggcagagccggcuuccccggccugcccggcagccccggcgccagaggccccaagggcuggaagggcgacgccggcgagugcagaugcaccgagggcgacgaggccaucaagggccugcccggccugcccggccccaagggcuucgccggcaucaacggcgagcccggcagaaagggcgacagaggcgaccccggccagcacggccugcccggcuuccccggccugaagggcgugcccggcaacaucggcgcccccggccccaagggcgccaagggcgacagcagaaccaucaccaccaagggcgagagaggccagcccggcgugcccggcgugcccggcaugaagggcgacgacggcagccccggcagagacggccuggacggcuuccccggccugcccggcccccccggcgacggcaucaagggcccccccggcgaccccggcuaccccggcauccccggcaccaagggcacccccggcgagaugggcccccccggccugggccugcccggccugaagggccagagaggcuuccccggcgacgccggccugcccggcccccccggcuuccugggcccccccggccccgccggcacccccggccagaucgacugcgacaccgacgugaagagagccgugggcggcgacagacaggaggccauccagcccggcugcaucggcggccccaagggccugcccggccugcccggcccccccggccccaccggcgccaagggccugagaggcauccccggcuucgccggcgccgacggcggccccggccccagaggccugcccggcgacgccggcagagagggcuuccccggcccccccggcuucaucggccccagaggcagcaagggcgccgugggccugcccggccccgacggcagccccggccccaucggccugcccggccccgacggcccccccggcgagagaggccugcccggcgaggugcugggcgcccagcccggccccagaggcgacgccggcgugcccggccagcccggccugaagggccugcccggcgacagaggcccccccggcuucagaggcagccagggcaugcccggcaugcccggccugaagggccagcccggccugcccggccccagcggccagcccggccuguacggcccccccggccugcacggcuuccccggcgcccccggccaggagggcccccugggccugcccggcauccccggcagagagggccugcccggcgacagaggcgaccccggcgacaccggcgcccccggccccgugggcaugaagggccugagcggcgacagaggcgacgccggcuucaccggcgagcagggccaccccggcagccccggcuucaagggcaucgacggcaugcccggcacccccggccugaagggcgacagaggcagccccggcauggacggcuuccagggcaugcccggccugaagggcagacccggcuuccccggcagcaagggcgaggccggcuucuucggcauccccggccugaagggccuggccggcgagcccggcuucaagggcagcagaggcgaccccggcccccccggccccccccccgugauccugcccggcaugaaggacaucaagggcgagaagggcgacgagggccccaugggccugaagggcuaccugggcgccaagggcauccagggcaugcccggcauccccggccugagcggcauccccggccugcccggcagacccggccacaucaagggcgugaagggcgacaucggcgugcccggcauccccggccugcccggcuuccccggcguggccggcccccccggcaucaccggcuuccccggcuucaucggcagcagaggcgacaagggcgcccccggcagagccggccuguacggcgagaucggcgccaccggcgacuucggcgacaucggcgacaccaucaaccugcccggcagacccggccugaagggcgagagaggcaccaccggcauccccggccugaagggcuucuucggcgagaagggcaccgagggcgacaucggcuuccccggcaucaccggcgugaccggcgugcagggcccccccggccugaagggccagaccggcuuccccggccugaccggcccccccggcagccagggcgagcugggcagaaucggccugcccggcggcaagggcgacgacggcuggcccggcgcccccggccugcccggcuuccccggccugagaggcaucagaggccugcacggccugcccggcaccaagggcuuccccggcagccccggcagcgacauccacggcgaccccggcuuccccggcccccccggcgagagaggcgaccccggcgaggccaacacccugcccggccccgugggcgugcccggccagaagggcgaccagggcgcccccggcgagagaggcccccccggcagccccggccugcagggcuuccccggcaucaccccccccagcaacaucagcggcgcccccggcgacaagggcgcccccggcaucuucggccugaagggcuacagaggcccccccggcccccccggcagcgccgcccugcccggcagcaagggcgacaccggcaaccccggcgcccccggcacccccggcaccaagggcugggccggcgacagcggcccccagggcagacccggcguguucggccugcccggcgagaagggccccagaggcgagcagggcuucaugggcaacaccggccccaccggcgccgugggcgacagaggccccaagggccccaagggcgaccccggcuuccccggcgcccccggcaccgugggcgcccccggcaucgccggcaucccccagaagaucgccgugcagcccggcaccgugggcccccagggcagaagaggcccccccggcgcccccggcgagaugggcccccagggcccccccggcgagcccggcuucagaggcgcccccggcaaggccggcccccagggcagaggcggcgugagcgccgugcccggcuucagaggcgacgagggccccaucggccaccagggccccaucggccaggagggcgcccccggcagacccggcagccccggccugcccggcaugcccggcagaagcgugagcaucggcuaccugcuggugaagcacagccagaccgaccaggagcccaugugccccgugggcaugaacaagcuguggagcggcuacagccugcuguacuucgagggccaggagaaggcccacaaccaggaccugggccuggccggcagcugccuggccagauucagcaccaugcccuuccuguacugcaaccccggcgacgugugcuacuacgccagcagaaacgacaagagcuacuggcugagcaccaccgccccccugcccaugaugcccguggccgaggacgagaucaagcccuacaucagcagaugcagcgugugcgaggcccccgccaucgccaucgccgugcacagccaggacgugagcaucccccacugccccgccggcuggagaagccuguggaucggcuacagcuuccugaugcacaccgccgccggcgacgagggcggcggccagagccuggugagccccggcagcugccuggaggacuucagagccacccccuucaucgagugcaacggcggcagaggcaccugccacuacuacgccaacaaguacagcuucuggcugaccaccauccccgagcagagcuuccagggcagccccagcgccgacacccugaaggccggccugaucagaacccacaucagcagaugccaggugugcaugaagaaccuguaa

SEQ ID NO: 15475 - RNA, 2259 nt, Artificial Sequence
  COL4A3BP__Homo_sapiens__NP_001123577
augcagcacagcugcauccccaccccccccagccccuucagcgccccccccgccuuccugcccguggugaccagagagagcagaagaggccugagcagcggcggcagcgccggcagaaacgccggcgugaccgccaccgccgccgccgccgacggcuggaagggcagacugcccagcccccuggugcugcugcccagaagcgccagaugccaggccagaagaagaagaggcggcagaaccagcagccugcugcugcugccccccacccccgagagagcccuguucgccagccccagccccgaccccagccccagaggccugggcgccagcagcggcgccgccgagggcgccggcgccggccugcugcugggcugcagagccagcaugagcgacaaccagagcuggaacagcagcggcagcgaggaggaccccgagaccgagagcggcccccccguggagagaugcggcgugcugagcaaguggaccaacuacauccacggcuggcaggacagauggguggugcugaagaacaacgcccugagcuacuacaagagcgaggacgagaccgaguacggcugcagaggcagcaucugccugagcaaggccgugaucaccccccacgacuucgacgagugcagauucgacaucagcgugaacgacagcgugugguaccugagagcccaggaccccgaccacagacagcaguggaucgacgccaucgagcagcacaagaccgagagcggcuacggcagcgagagcagccugagaagacacggcagcauggugagccuggugagcggcgccagcggcuacagcgccaccagcaccagcagcuucaagaagggccacagccugagagagaagcuggccgagauggagaccuucagagacauccugugcagacagguggacacccugcagaaguacuucgacgccugcgccgacgccgugagcaaggacgagcugcagagagacaaggugguggaggacgacgaggacgacuuccccaccaccagaagcgacggcgacuuccugcacagcaccaacggcaacaaggagaagcuguucccccacgugacccccaagggcaucaacggcaucgacuucaagggcgaggccaucaccuucaaggccaccaccgccggcauccuggccacccugagccacugcaucgagcugauggugaagagagaggacagcuggcagaagagacuggacaaggagaccgagaagaagagaagaaccgaggaggccuacaagaacgccaugaccgagcugaagaagaagagccacuucggcggccccgacuacgaggagggccccaacagccugaucaacgaggaggaguucuucgacgccguggaggccgcccuggacagacaggacaagaucgaggagcagagccagagcgagaaggugagacugcacuggcccaccagccugcccagcggcgacgccuucagcagcgugggcacccacagauucgugcagaagcccuacagcagaagcagcagcaugagcagcaucgaccuggugagcgccagcgacgacgugcacagauucagcagccagguggaggagauggugcagaaccacaugaccuacagccugcaggacgugggcggcgacgccaacuggcagcuggugguggaggagggcgagaugaagguguacagaagagagguggaggagaacggcaucgugcuggacccccugaaggccacccacgccgugaagggcgugaccggccacgaggugugcaacuacuucuggaacguggacgugagaaacgacugggagaccaccaucgagaacuuccacgugguggagacccuggccgacaacgccaucaucaucuaccagacccacaagagaguguggcccgccagccagagagacgugcuguaccugagcgugaucagaaagauccccgcccugaccgagaacgaccccgagaccuggaucgugugcaacuucagcguggaccacgacagcgccccccugaacaacagaugcgugagagccaagaucaacguggccaugaucugccagacccuggugagcccccccgagggcaaccaggagaucagcagagacaacauccugugcaagaucaccuacguggccaacgugaaccccggcggcugggcccccgccagcgugcugagagccguggccaagagagaguaccccaaguuccugaagagauucaccagcuacgugcaggagaagaccgccggcaagcccauccuguucuaa

SEQ ID NO: 15476 - RNA, 5013 nt, Artificial Sequence
  COL4A3__Homo_sapiens__NP_000082
augagcgccagaaccgcccccagaccccaggugcugcugcugccccugcugcuggugcugcuggccgccgcccccgccgccagcaagggcugcgugugcaaggacaagggccagugcuucugcgacggcgccaagggcgagaagggcgagaagggcuuccccggcccccccggcagccccggccagaagggcuucaccggccccgagggccugcccggcccccagggccccaagggcuuccccggccugcccggccugaccggcagcaagggcgugagaggcaucagcggccugcccggcuucagcggcagccccggccugcccggcacccccggcaacaccggccccuacggccuggugggcgugcccggcugcagcggcagcaagggcgagcagggcuuccccggccugcccggcacccugggcuaccccggcauccccggcgccgccggccugaagggccagaagggcgcccccgccaaggaggaggacaucgagcuggacgccaagggcgaccccggccugcccggcgcccccggcccccagggccugcccggcccccccggcuuccccggccccgugggcccccccggcccccccggcuucuucggcuuccccggcgccaugggccccagaggccccaagggccacaugggcgagagagugaucggccacaagggcgagagaggcgugaagggccugaccggcccccccggcccccccggcaccgugaucgugacccugaccggccccgacaacagaaccgaccugaagggcgagaagggcgacaagggcgccaugggcgagcccggcccccccggccccagcggccugcccggcgagagcuacggcagcgagaagggcgcccccggcgaccccggccugcagggcaagcccggcaaggacggcgugcccggcuuccccggcagcgagggcgugaagggcaacagaggcuuccccggccugaugggcgaggacggcaucaagggccagaagggcgacaucggcccccccggcuucagaggccccaccgaguacuacgacaccuaccaggagaagggcgacgagggcacccccggcccccccggccccagaggcgccagaggcccccagggccccagcggcccccccggcgugcccggcagccccggcagcagcagacccggccugagaggcgcccccggcuggcccggccugaagggcagcaagggcgagagaggcagacccggcaaggacgccaugggcacccccggcagccccggcugcgccggcagccccggccugcccggcagccccggcccccccggcccccccggcgacaucguguucagaaagggcccccccggcgaccacggccugcccggcuaccugggcagccccggcauccccggcguggacggccccaagggcgagcccggccugcugugcacccagugccccuacauccccggcccccccggccugcccggccugcccggccugcacggcgugaagggcauccccggcagacagggcgccgccggccugaagggcagccccggcagccccggcaacaccggccugcccggcuuccccggcuuccccggcgcccagggcgaccccggccugaagggcgagaagggcgagacccugcagcccgagggccaggugggcgugcccggcgaccccggccugagaggccagcccggcagaaagggccuggacggcauccccggcacccccggcgugaagggccugcccggccccaagggcgagcuggcccugagcggcgagaagggcgaccagggcccccccggcgaccccggcagccccggcagccccggccccgccggccccgccggcccccccggcuacggcccccagggcgagcccggccugcagggcacccagggcgugcccggcgcccccggcccccccggcgaggccggccccagaggcgagcugagcgugagcacccccgugcccggcccccccggcccccccggcccccccggccaccccggcccccagggcccccccggcauccccggcagccugggcaagugcggcgaccccggccugcccggccccgacggcgagcccggcauccccggcaucggcuuccccggcccccccggccccaagggcgaccagggcuuccccggcaccaagggcagccugggcugccccggcaagaugggcgagcccggccugcccggcaagcccggccugcccggcgccaagggcgagcccgccguggccaugcccggcggccccggcacccccggcuuccccggcgagagaggcaacagcggcgagcacggcgagaucggccugcccggccugcccggccugcccggcacccccggcaacgagggccuggacggccccagaggcgaccccggccagcccggcccccccggcgagcagggcccccccggcagaugcaucgagggccccagaggcgcccagggccugcccggccugaacggccugaagggccagcagggcagaagaggcaagaccggccccaagggcgaccccggcauccccggccuggacagaagcggcuuccccggcgagaccggcagccccggcauccccggccaccagggcgagaugggcccccugggccagagaggcuaccccggcaaccccggcauccugggcccccccggcgaggacggcgugaucggcaugaugggcuuccccggcgccaucggcccccccggcccccccggcaaccccggcacccccggccagagaggcagccccggcauccccggcgugaagggccagagaggcacccccggcgccaagggcgagcagggcgacaagggcaaccccggccccagcgagaucagccacgugaucggcgacaagggcgagcccggccugaagggcuucgccggcaaccccggcgagaagggcaacagaggcgugcccggcaugcccggccugaagggccugaagggccugcccggccccgccggcccccccggccccagaggcgaccugggcagcaccggcaaccccggcgagcccggccugagaggcauccccggcagcaugggcaacaugggcaugcccggcagcaagggcaagagaggcacccugggcuuccccggcagagccggcagacccggccugcccggcauccacggccugcagggcgacaagggcgagcccggcuacagcgagggcaccagacccggcccccccggccccaccggcgaccccggccugcccggcgacaugggcaagaagggcgagaugggccagcccggcccccccggccaccugggccccgccggccccgagggcgcccccggcagccccggcagccccggccugcccggcaagcccggcccccacggcgaccugggcuucaagggcaucaagggccugcugggcccccccggcaucagaggcccccccggccugcccggcuuccccggcagccccggccccaugggcaucagaggcgaccagggcagagacggcauccccggccccgccggcgagaagggcgagaccggccugcugagagccccccccggccccagaggcaaccccggcgcccagggcgccaagggcgacagaggcgcccccggcuuccccggccugcccggcagaaagggcgccaugggcgacgccggccccagaggccccaccggcaucgagggcuuccccggcccccccggccugcccggcgccaucauccccggccagaccggcaacagaggcccccccggcagcagaggcagccccggcgcccccggcccccccggcccccccggcagccacgugaucggcaucaagggcgacaagggcagcaugggccaccccggccccaagggcccccccggcaccgccggcgacaugggcccccccggcagacugggcgcccccggcacccccggccugcccggccccagaggcgaccccggcuuccagggcuuccccggcgugaagggcgagaagggcaaccccggcuuccugggcagcaucggcccccccggccccaucggccccaagggcccccccggcgugagaggcgaccccggcacccugaagaucaucagccugcccggcagccccggcccccccggcacccccggcgagcccggcaugcagggcgagcccggcccccccggcccccccggcaaccugggccccugcggccccagaggcaagcccggcaaggacggcaagcccggcacccccggccccgccggcgagaagggcaacaagggcagcaagggcgagcccggccccgccggcagcgacggccugcccggccugaagggcaagagaggcgacagcggcagccccgccaccuggaccaccagaggcuucguguucaccagacacagccagaccaccgccauccccagcugccccgagggcaccgugccccuguacagcggcuucagcuuccuguucgugcagggcaaccagagagcccacggccaggaccugggcacccugggcagcugccugcagagauucaccaccaugcccuuccuguucugcaacgugaacgacgugugcaacuucgccagcagaaacgacuacagcuacuggcugagcacccccgcccugaugcccaugaacauggcccccaucaccggcagagcccuggagcccuacaucagcagaugcaccgugugcgagggccccgccaucgccaucgccgugcacagccagaccaccgacaucccccccugcccccacggcuggaucagccuguggaagggcuucagcuucaucauguucaccagcgccggcagcgagggcaccggccaggcccuggccagccccggcagcugccuggaggaguucagagccagccccuuccuggagugccacggcagaggcaccugcaacuacuacagcaacagcuacagcuucuggcuggccagccugaaccccgagagaauguucagaaagcccauccccagcaccgugaaggccggcgagcuggagaagaucaucagcagaugccaggugugcaugaagaagagacacuaa

SEQ ID NO: 15477 - RNA, 5073 nt, Artificial Sequence
  COL4A4__Homo_sapiens__XP_005246338
auguggagccugcacaucgugcugaugagaugcagcuucagacugaccaagagccuggccaccggccccuggagccugauccugauccuguucagcgugcaguacguguacggcagcggcaagaaguacaucggccccugcggcggcagagacugcagcgugugccacugcgugcccgagaagggcagcagaggcccccccggcccccccggcccccagggccccaucggcccccugggcgcccccggccccaucggccugagcggcgagaagggcaugagaggcgacagaggcccccccggcgccgccggcgacaagggcgacaagggccccaccggcgugcccggcuuccccggccuggacggcauccccggccaccccggcccccccggccccagaggcaagcccggcaugagcggccacaacggcagcagaggcgaccccggcuuccccggcggcagaggcgcccugggccccggcggcccccugggccaccccggcgagaagggcgagaagggcaacagcguguucauccugggcgccgugaagggcauccagggcgacagaggcgaccccggccugcccggccugcccggcagcuggggcgccggcggccccgccggccccaccggcuaccccggcgagcccggccuggugggcccccccggccagcccggcagacccggccugaagggcaaccccggcgugggcgugaagggccagaugggcgaccccggcgaggugggccagcagggcagccccggccccacccugcugguggagccccccgacuucugccuguacaagggcgagaagggcaucaagggcauccccggcauggugggccugcccggcccccccggcagaaagggcgagagcggcaucggcgccaagggcgagaagggcauccccggcuuccccggccccagaggcgaccccggcagcuacggcagccccggcuuccccggccugaagggcgagcugggccuggugggcgaccccggccuguucggccugaucggccccaagggcgaccccggcaacagaggccaccccggcccccccggcgugcuggugacccccccccugccccugaagggcccccccggcgaccccggcuuccccggcagauacggcgagaccggcgacgugggcccccccggcccccccggccugcugggcagacccggcgaggccugcgccggcaugaucggcccccccggcccccagggcuuccccggccugcccggccugcccggcgaggccggcauccccggcagacccgacagcgcccccggcaagcccggcaagcccggcagccccggccugcccggcgcccccggccugcagggccugcccggcagcagcgugaucuacugcagcgugggcaaccccggcccccagggcaucaagggcaaggugggcccccccggcggcagaggccccaagggcgagaagggcaacgagggccugugcgccugcgagcccggccccaugggcccccccggcccccccggccugcccggcagacagggcagcaagggcgaccugggccugcccggcuggcugggcaccaagggcgaccccggcccccccggcgccgagggcccccccggccugcccggcaagcacggcgccagcggcccccccggcaacaagggcgccaagggcgacaugguggugagcagagugaagggccacaagggcgagagaggccccgacggcccccccggcuuccccggccagcccggcagccacggcagagacggccacgccggcgagaagggcgaccccggcccccccggcgaccacgaggacgccacccccggcggcaagggcuuccccggcccccugggcccccccggcaaggccggccccgugggcccccccggccugggcuuccccggcccccccggcgagagaggccaccccggcgugcccggccaccccggcgugagaggccccgacggccugaagggccagaagggcgacaccaucagcugcaacgugaccuaccccggcagacacggcccccccggcuucgacggcccccccggccccaagggcuuccccggcccccagggcgcccccggccugagcggcagcgacggccacaagggcagacccggcacccccggcaccgccgagauccccggcccccccggcuucagaggcgacaugggcgaccccggcuucggcggcgagaagggcagcagccccgugggcccccccggcccccccggcagccccggcgugaacggccagaagggcauccccggcgaccccgccuucggccaccugggcccccccggcaagagaggccugagcggcgugcccggcaucaagggccccagaggcgaccccggcugccccggcgccgagggccccgccggcauccccggcuuccugggccugaagggccccaagggcagagagggccacgccggcuuccccggcgugcccggcccccccggccacagcugcgagagaggcgcccccggcauccccggccagcccggccugcccggcuaccccggcagccccggcgcccccggcggcaagggccagcccggcgacgugggcccccccggccccgccggcaugaagggccugcccggccugcccggcagacccggcgcccacggcccccccggccugcccggcauccccggccccuucggcgacgacggccugcccggcccccccggccccaagggccccagaggccugcccggcuuccccggcuuccccggcgagagaggcaagcccggcgccgagggcugccccggcgccaagggcgagcccggcgagaagggcaugagcggccugcccggcgacagaggccugagaggcgccaagggcgccaucggcccccccggcgacgagggcgagauggccaucaucagccagaagggcacccccggcgagcccggcccccccggcgacgacggcuuccccggcgagagaggcgacaagggcacccccggcaugcagggcagaagaggcgagcccggcagauacggcccccccggcuuccacagaggcgagcccggcgagaagggccagcccggcccccccggcccccccggcccccccggcagcaccggccugagaggcuucaucggcuuccccggccugcccggcgaccagggcgagcccggcagccccggcccccccggcuucagcggcaucgacggcgccagaggccccaagggcaacaagggcgaccccgccagccacuucggcccccccggccccaagggcgagcccggcagccccggcugccccggccacuucggcgccagcggcgagcagggccugcccggcauccagggccccagaggcagccccggcagacccggcccccccggcagcagcggcccccccggcugccccggcgaccacggcaugcccggccugagaggccagcccggcgagaugggcgaccccggccccagaggccugcagggcgaccccggcauccccggcccccccggcaucaagggccccagcggcagccccggccugaacggccugcacggccugaagggccagaagggcaccaagggcgccagcggccugcacgacgugggcccccccggccccgugggcauccccggccugaagggcgagagaggcgaccccggcagccccggcaucagcccccccggccccagaggcaagaagggcccccccggcccccccggcagcagcggcccccccggccccgccggcgccaccggcagagcccccaaggacauccccgaccccggcccccccggcgaccagggcccccccggccccgacggccccagaggcgcccccggcccccccggccugcccggcagcguggaccugcugagaggcgagcccggcgacugcggccugcccggcccccccggcccccccggcccccccggcccccccggcuacaagggcuuccccggcugcgacggcaaggacggccagaagggccccgugggcuuccccggcccccagggcccccacggcuuccccggcccccccggcgagaagggccugcccggcccccccggcagaaagggccccaccggccugcccggccccagaggcgagcccggcccccccgccgacguggacgacugccccagaauccccggccugcccggcgcccccggcaugagaggccccgagggcgccaugggccugcccggcaugagaggccccagcggccccggcugcaagggcgagcccggccuggacggcagaagaggcguggacggcgugcccggcagccccggcccccccggcagaaagggcgacaccggcgaggacggcuaccccggcggccccggcccccccggccccaucggcgaccccggccccaagggcuucggccccggcuaccugggcggcuuccugcuggugcugcacagccagaccgaccaggagcccaccugcccccugggcaugcccagacuguggaccggcuacagccugcuguaccuggagggccaggagaaggcccacaaccaggaccugggccuggccggcagcugccugcccguguucagcacccugcccuucgccuacugcaacauccaccaggugugccacuacgcccagagaaacgacagaagcuacuggcuggccagcgccgccccccugcccaugaugccccugagcgaggaggccaucagacccuacgugagcagaugcgccgugugcgaggcccccgcccaggccguggccgugcacagccaggaccagagcaucccccccugcccccagaccuggagaagccuguggaucggcuacagcuuccugaugcacaccggcgccggcgaccagggcggcggccaggcccugaugagccccggcagcugccuggaggacuucagagccgcccccuuccuggagugccagggcagacagggcaccugccacuucuucgccaacaaguacagcuucuggcugaccaccgugaaggccgaccugcaguucagcagcgcccccgcccccgacacccugaaggagagccaggcccagagacagaagaucagcagaugccaggugugcgugaaguacagcuaa

SEQ ID NO: 15478 - RNA, 5058 nt, Artificial Sequence
  COL4A5__Homo_sapiens__NP_000486
augaagcugagaggcgugagccuggccgccggccuguuccugcuggcccugagccuguggggccagcccgccgaggccgccgccugcuacggcugcagccccggcagcaagugcgacugcagcggcaucaagggcgagaagggcgagagaggcuuccccggccuggagggccaccccggccugcccggcuuccccggccccgagggcccccccggccccagaggccagaagggcgacgacggcauccccggcccccccggccccaagggcaucagaggcccccccggccugcccggcuuccccggcacccccggccugcccggcaugcccggccacgacggcgcccccggcccccagggcauccccggcugcaacggcaccaagggcgagagaggcuuccccggcagccccggcuuccccggccugcagggcccccccggcccccccggcauccccggcaugaagggcgagcccggcagcaucaucaugagcagccugcccggccccaagggcaaccccggcuaccccggcccccccggcauccagggccugcccggccccaccggcauccccggccccaucggcccccccggcccccccggccugaugggcccccccggcccccccggccugcccggccccaagggcaacaugggccugaacuuccagggccccaagggcgagaagggcgagcagggccugcagggcccccccggcccccccggccagaucagcgagcagaagagacccaucgacguggaguuccagaagggcgaccagggccugcccggcgacagaggcccccccggcccccccggcaucagaggcccccccggcccccccggcggcgagaagggcgagaagggcgagcagggcgagcccggcaagagaggcaagcccggcaaggacggcgagaacggccagcccggcauccccggccugcccggcgaccccggcuaccccggcgagcccggcagagacggcgagaagggccagaagggcgacaccggcccccccggcccccccggccuggugauccccagacccggcaccggcaucaccaucggcgagaagggcaacaucggccugcccggccugcccggcgagaagggcgagagaggcuuccccggcauccagggcccccccggccugcccggcccccccggcgccgccgugaugggcccccccggcccccccggcuuccccggcgagagaggccagaagggcgacgagggcccccccggcaucagcauccccggcccccccggccuggacggccagcccggcgcccccggccugcccggcccccccggccccgccggcccccacaucccccccagcgacgagaucugcgagcccggcccccccggcccccccggcagccccggcgacaagggccugcagggcgagcagggcgugaagggcgacaagggcgacaccugcuucaacugcaucggcaccggcaucagcggcccccccggccagcccggccugcccggccugcccggcccccccggcagccugggcuuccccggccagaagggcgagaagggccaggccggcgccaccggccccaagggccugcccggcauccccggcgcccccggcgcccccggcuuccccggcagcaagggcgagcccggcgacauccugaccuuccccggcaugaagggcgacaagggcgagcugggcagccccggcgcccccggccugcccggccugcccggcacccccggccaggacggccugcccggccugcccggccccaagggcgagcccggcggcaucaccuucaagggcgagagaggcccccccggcaaccccggccugcccggccugcccggcaacaucggccccaugggcccccccggcuucggcccccccggccccgugggcgagaagggcauccagggcguggccggcaaccccggccagcccggcauccccggccccaagggcgaccccggccagaccaucacccagcccggcaagcccggccugcccggcaaccccggcagagacggcgacgugggccugcccggcgaccccggccugcccggccagcccggccugcccggcauccccggcagcaagggcgagcccggcauccccggcaucggccugcccggcccccccggccccaagggcuuccccggcauccccggcccccccggcgcccccggcacccccggcagaaucggccuggagggcccccccggcccccccggcuuccccggccccaagggcgagcccggcuucgcccugcccggcccccccggcccccccggccugcccggcuucaagggcgcccugggccccaagggcgacagaggcuuccccggcccccccggcccccccggcagaaccggccuggacggccugcccggccccaagggcgacgugggccccaacggccagcccggccccaugggcccccccggccugcccggcaucggcgugcagggcccccccggcccccccggcauccccggccccaucggccagcccggccugcacggcauccccggcgagaagggcgaccccggcccccccggccuggacgugcccggcccccccggcgagagaggcagccccggcauccccggcgcccccggccccaucggcccccccggcagccccggccugcccggcaaggccggcgccagcggcuuccccggcaccaagggcgagaugggcaugaugggcccccccggcccccccggcccccugggcauccccggcagaagcggcgugcccggccugaagggcgacgacggccugcagggccagcccggccugcccggccccaccggcgagaagggcagcaagggcgagcccggccugcccggcccccccggccccauggaccccaaccugcugggcagcaagggcgagaagggcgagcccggccugcccggcauccccggcgugagcggccccaagggcuaccagggccugcccggcgaccccggccagcccggccugagcggccagcccggccugcccggcccccccggccccaagggcaaccccggccugcccggccagcccggccugaucggcccccccggccugaagggcaccaucggcgacaugggcuuccccggcccccagggcguggagggcccccccggccccagcggcgugcccggccagcccggcagccccggccugcccggccagaagggcgacaagggcgaccccggcaucagcagcaucggccugcccggccugcccggccccaagggcgagcccggccugcccggcuaccccggcaaccccggcaucaagggcagcgugggcgaccccggccugcccggccugcccggcacccccggcgccaagggccagcccggccugcccggcuuccccggcacccccggcccccccggccccaagggcaucagcggcccccccggcaaccccggccugcccggcgagcccggccccgugggcggcggcggccaccccggccagcccggcccccccggcgagaagggcaagcccggccaggacggcauccccggccccgccggccagaagggcgagcccggccagcccggcuucggcaaccccggcccccccggccugcccggccugagcggccagaagggcgacggcggccugcccggcauccccggcaaccccggccugcccggccccaagggcgagcccggcuuccacggcuuccccggcgugcagggcccccccggcccccccggcagccccggccccgcccuggagggccccaagggcaaccccggcccccagggcccccccggcagacccggccugcccggccccgagggcccccccggccugcccggcaacggcggcaucaagggcgagaagggcaaccccggccagcccggccugcccggccugcccggccugaagggcgaccagggcccccccggccugcagggcaaccccggcagacccggccugaacggcaugaagggcgaccccggccugcccggcgugcccggcuuccccggcaugaagggccccagcggcgugcccggcagcgccggccccgagggcgagcccggccugaucggcccccccggcccccccggccugcccggccccagcggccagagcaucaucaucaagggcgacgccggcccccccggcauccccggccagcccggccugaagggccugcccggcccccagggcccccagggccugcccggccccaccggcccccccggcgaccccggcagaaacggccugcccggcuucgacggcgccggcggcagaaagggcgaccccggccugcccggccagcccggcaccagaggccuggacggcccccccggccccgacggccugcagggcccccccggcccccccggcaccagcagcguggcccacggcuuccugaucaccagacacagccagaccaccgacgccccccagugcccccagggcacccugcagguguacgagggcuucagccugcuguacgugcagggcaacaagagagcccacggccaggaccugggcaccgccggcagcugccugagaagauucagcaccaugcccuucauguucugcaacaucaacaacgugugcaacuucgccagcagaaacgacuacagcuacuggcugagcacccccgagcccaugcccaugagcaugcagccccugaagggccagagcauccagcccuucaucagcagaugcgccgugugcgaggcccccgccguggugaucgccgugcacagccagaccauccagaucccccacugcccccagggcugggacagccuguggaucggcuacagcuucaugaugcacaccagcgccggcgccgagggcagcggccaggcccuggccagccccggcagcugccuggaggaguucagaagcgcccccuucaucgagugccacggcagaggcaccugcaacuacuacgccaacagcuacagcuucuggcuggccaccguggacgugagcgacauguucagcaagccccagagcgagacccugaaggccggcgaccugagaaccagaaucagcagaugccaggugugcaugaagagaaccuaa

SEQ ID NO: 15479 - RNA, 5001 nt, Artificial Sequence
  COL4A6__Homo_sapiens__NP_001274688
augcaccccggccuguggcugcugcuggugacccugugccugaccgaggagcuggccgccgccggcgagaagagcuacggcaagcccugcggcggccaggacugcagcggcagcugccagugcuuccccgagaagggcgccagaggcagacccggccccaucggcauccagggccccaccggcccccagggcuucaccggcagcaccggccugagcggccugaagggcgagagaggcuuccccggccugcugggccccuacggccccaagggcgacaagggccccaugggcgugcccggcuuccugggcaucaacggcauccccggccaccccggccagcccggccccagaggcccccccggccuggacggcugcaacggcacccagggcgccgugggcuuccccggccccgacggcuaccccggccugcugggcccccccggccugcccggccagaagggcagcaagggcgaccccgugcuggcccccggcagcuucaagggcaugaagggcgaccccggccugcccggccuggacggcaucaccggcccccagggcgcccccggcuuccccggcgccgugggccccgccggcccccccggccugcagggcccccccggcccccccggcccccugggccccgacggcaacaugggccugggcuuccagggcgagaagggcgugaagggcgacgugggccugcccggccccgccggccccccccccagcaccggcgagcuggaguucaugggcuuccccaagggcaagaagggcagcaagggcgagcccggccccaagggcuuccccggcaucagcggcccccccggcuuccccggccugggcaccaccggcgagaagggcgagaagggcgagaagggcauccccggccugcccggccccagaggccccaugggcagcgagggcgugcagggcccccccggccagcagggcaagaagggcacccugggcuuccccggccugaacggcuuccagggcaucgagggccagaagggcgacaucggccugcccggccccgacguguucaucgacaucgacggcgccgugaucagcggcaaccccggcgaccccggcgugcccggccugcccggccugaagggcgacgagggcauccagggccugagaggccccagcggcgugcccggccugcccgcccugagcggcgugcccggcgcccugggcccccagggcuuccccggccugaagggcgaccagggcaaccccggcagaaccaccaucggcgccgccggccugcccggcagagacggccugcccggcccccccggcccccccggcccccccagccccgaguucgagaccgagacccugcacaacaaggagagcggcuuccccggccugagaggcgagcagggccccaagggcaaccugggccugaagggcaucaagggcgacagcggcuucugcgccugcgacggcggcgugcccaacaccggcccccccggcgagcccggcccccccggccccuggggccugaucggccugcccggccugaagggcgccagaggcgacagaggcagcggcggcgcccagggccccgccggcgcccccggccuggugggcccccugggccccagcggccccaagggcaagaagggcgagcccauccugagcaccauccagggcaugcccggcgacagaggcgacagcggcagccagggcuucagaggcgugaucggcgagcccggcaaggacggcgugcccggccugcccggccugcccggccugcccggcgacggcggccagggcuuccccggcgagaagggccugcccggccugcccggcgagaagggccaccccggcccccccggccugcccggcaacggccugcccggccugcccggccccagaggccugcccggcgacaagggcaaggacggccugcccggccagcagggccugcccggcagcaagggcaucacccugcccugcaucauccccggcagcuacggccccagcggcuuccccggcacccccggcuuccccggccccaagggcagcagaggccugcccggcacccccggccagcccggcagcagcggcagcaagggcgagcccggcagccccggccuggugcaccugcccgagcugcccggcuuccccggccccagaggcgagaagggccugcccggcuuccccggccugcccggcaaggacggccugcccggcaugaucggcagccccggccugcccggcagcaagggcgccaccggcgacaucuucggcgccgagaacggcgcccccggcgagcagggccugcagggccugaccggccacaagggcuuccugggcgacagcggccugcccggccugaagggcgugcacggcaagcccggccugcugggccccaagggcgagagaggcagccccggcacccccggccaggugggccagcccggcacccccggcagcagcggccccuacggcaucaagggcaagagcggccugcccggcgcccccggcuuccccggcaucagcggccaccccggcaagaagggcaccagaggcaagaagggcccccccggcagcaucgugaagaagggccugcccggccugaagggccugcccggcaaccccggccuggugggccugaagggcagccccggcagccccggcguggccggccugcccgcccugagcggccccaagggcgagaagggcagcgugggcuucgugggcuuccccggcauccccggccugcccggcauccccggcaccagaggccugaagggcauccccggcagcaccggcaagaugggccccagcggcagagccggcacccccggcgagaagggcgacagaggcaaccccggccccgugggcauccccagccccagaagacccaugagcaaccuguggcugaagggcgacaagggcagccagggcagcgccggcagcaacggcuuccccggccccagaggcgacaagggcgaggccggcagacccggcccccccggccugcccggcgcccccggccugcccggcaucaucaagggcgugagcggcaagcccggcccccccggcuucaugggcaucagaggccugcccggccugaagggcagcagcggcaucaccggcuuccccggcaugcccggcgagagcggcagccagggcaucagaggcagccccggccugcccggcgccagcggccugcccggccugaagggcgacaacggccagaccguggagaucagcggcagccccggccccaagggccagcccggcgagagcggcuucaagggcaccaagggcagagacggccugaucggcaacaucggcuuccccggcaacaagggcgaggacggcaaggugggcgugagcggcgacgugggccugcccggcgcccccggcuuccccggcguggccggcaugagaggcgagcccggccugcccggcagcagcggccaccagggcgccaucggcccccugggcagccccggccugaucggccccaagggccccagcaucaccggcgugcccggccccgccggccugcccggccccaagggcgagaagggcuaccccggcaucggcaucggcgcccccggcaagcccggccugagaggccagaagggcgacagaggcuuccccggccugcagggccccgccggccugcccggcgcccccggcaucagccugcccagccugaucgccggccagcccggcgaccccggcagacccggccuggacggcgagagaggcagacccggccccgccggcccccccggcccccccggccccagcagcaaccagggcgacaccggcgaccccggcuuccccggcauccccggccccaagggccccaagggcgaccagggcauccccggcuucagcggccugcccggcgagcugggccugaagggcaugagaggcgagcccggcuucaugggcacccccggcaaggugggcccccccggcgaccccggcuuccccggcaugaagggcaaggccggccccagaggcagcagcggccugcagggcgaccccggccagacccccaccgccgaggccgugcaggugccccccggcccccugggccugcccggcaucgacggcauccccggccugaccggcgaccccggcgcccagggccccgugggccugcagggcagcaagggccugcccggcauccccggcaaggacggccccagcggccugcccggcccccccggcgcccugggcgaccccggccugcccggccugcagggcccccccggcuucgagggcgcccccggccagcagggccccuucggcaugcccggcaugcccggccagagcaugagagugggcuacacccuggugaagcacagccagagcgagcaggugccccccugccccaucggcaugagccagcugugggugggcuacagccugcuguucguggagggccaggagaaggcccacaaccaggaccugggcuucgccggcagcugccugcccagauucagcaccaugcccuucaucuacugcaacaucaacgaggugugccacuacgccagaagaaacgacaagagcuacuggcugagcaccaccgcccccauccccaugaugcccgugagccagacccagaucccccaguacaucagcagaugcagcgugugcgaggcccccagccaggccaucgccgugcacagccaggacaucaccaucccccagugcccccugggcuggagaagccuguggaucggcuacagcuuccugaugcacaccgccgccggcgccgagggcggcggccagagccuggugagccccggcagcugccuggaggacuucagagccacccccuucaucgagugcagcggcgccagaggcaccugccacuacuucgccaacaaguacagcuucuggcugaccaccguggaggagagacagcaguucggcgagcugcccgugagcgagacccugaaggccggccagcugcacaccagagugagcagaugccaggugugcaugaagagccuguaa

SEQ ID NO: 15480 - RNA, 5517 nt, Artificial Sequence
  COL5A1__Homo_sapiens__NP_000084
auggacgugcacaccagauggaaggccagaagcgcccugagacccggcgccccccugcugcccccccugcugcugcugcugcugugggcccccccccccagcagagccgcccagcccgccgaccugcugaaggugcuggacuuccacaaccugcccgacggcaucaccaagaccaccggcuucugcgccaccagaagaagcagcaagggccccgacguggccuacagagugaccaaggacgcccagcugagcgcccccaccaagcagcuguaccccgccagcgccuuccccgaggacuucagcauccugaccaccgugaaggccaagaagggcagccaggccuuccuggugagcaucuacaacgagcagggcauccagcagaucggccuggagcugggcagaagccccguguuccuguacgaggaccacaccggcaagcccggccccgaggacuacccccuguucagaggcaucaaccugagcgacggcaaguggcacagaaucgcccugagcgugcacaagaagaacgugacccugauccuggacugcaagaagaagaccaccaaguuccuggacagaagcgaccaccccaugaucgacaucaacggcaucaucguguucggcaccagaauccuggacgaggagguguucgagggcgacauccagcagcugcuguucgugagcgaccacagagccgccuacgacuacugcgagcacuacagccccgacugcgacaccgccgugcccgacaccccccagagccaggaccccaaccccgacgaguacuacaccgagggcgacggcgagggcgagaccuacuacuacgaguaccccuacuacgaggaccccgaggaccugggcaaggagcccacccccagcaagaagcccguggaggccgccaaggagaccaccgaggugcccgaggagcugacccccacccccaccgaggccgcccccaugcccgagaccagcgagggcgccggcaaggaggaggacgugggcaucggcgacuacgacuacgugcccagcgaggacuacuacacccccagccccuacgacgaccugaccuacggcgagggcgaggagaaccccgaccagcccaccgaccccggcgccggcgccgagauccccaccagcaccgccgacaccagcaacagcagcaaccccgcccccccccccggcgagggcgccgacgaccuggagggcgaguucaccgaggagaccaucagaaaccuggacgagaacuacuacgaccccuacuacgaccccaccagcagccccagcgagaucggccccggcaugcccgccaaccaggacaccaucuacgagggcaucggcggccccagaggcgagaagggccagaagggcgagcccgccaucaucgagcccggcaugcugaucgagggcccccccggccccgagggccccgccggccugcccggcccccccggcaccaugggccccaccggccaggugggcgaccccggcgagagaggcccccccggcagacccggccugcccggcgccgacggccugcccggcccccccggcaccaugcugaugcugcccuucagauucggcggcggcggcgacgccggcagcaagggccccauggugagcgcccaggagagccaggcccaggccauccugcagcaggccagacuggcccugagaggccccgccggccccaugggccugaccggcagacccggccccgugggcccccccggcagcggcggccugaagggcgagcccggcgacgugggcccccagggccccagaggcgugcagggcccccccggccccgccggcaagcccggcagaagaggcagagccggcagcgacggcgccagaggcaugcccggccagaccggccccaagggcgacagaggcuucgacggccuggccggccugcccggcgagaagggccacagaggcgaccccggccccagcggcccccccggcccccccggcgacgacggcgagagaggcgacgacggcgaggugggccccagaggccugcccggcgagcccggccccagaggccugcugggccccaagggcccccccggcccccccggcccccccggcgugaccggcauggacggccagcccggccccaagggcaacgugggcccccagggcgagcccggcccccccggccagcagggcaaccccggcgcccagggccugcccggcccccagggcgccaucggcccccccggcgagaagggcccccugggcaagcccggccugcccggcaugcccggcgccgacggcccccccggccaccccggcaaggagggcccccccggcgagaagggcggccagggcccccccggcccccagggccccaucggcuaccccggccccagaggcgugaagggcgccgacggcaucagaggccugaagggcaccaagggcgagaagggcgaggacggcuuccccggcuucaagggcgacaugggcaucaagggcgacagaggcgagaucggcccccccggccccagaggcgaggacggccccgagggccccaagggcagaggcggccccaacggcgaccccggcccccugggcccccccggcgagaagggcaagcugggcgugcccggccugcccggcuaccccggcagacagggccccaagggcagcaucggcuuccccggcuuccccggcgccaacggcgagaagggcggcagaggcacccccggcaagcccggccccagaggccagagaggccccaccggccccagaggcgagagaggccccagaggcaucaccggcaagcccggccccaagggcaacagcggcggcgacggccccgccggcccccccggcgagagaggccccaacggcccccagggccccaccggcuuccccggccccaagggcccccccggcccccccggcaaggacggccugcccggccaccccggccagagaggcgagaccggcuuccagggcaagaccggcccccccggcccccccggcguggugggcccccagggccccaccggcgagaccggccccaugggcgagagaggccaccccggcccccccggcccccccggcgagcagggccugcccggccuggccggcaaggagggcaccaagggcgaccccggccccgccggccugcccggcaaggacggcccccccggccugagaggcuuccccggcgacagaggccugcccggccccgugggcgcccugggccugaagggcaacgagggcccccccggcccccccggccccgccggcagccccggcgagagaggccccgccggcgccgccggccccaucggcauccccggcagacccggcccccagggcccccccggccccgccggcgagaagggcgcccccggcgagaagggcccccagggccccgccggcagagacggccugcagggccccgugggccugcccggccccgccggccccgugggcccccccggcgaggacggcgacaagggcgagaucggcgagcccggccagaagggcagcaagggcgacaagggcgagcagggcccccccggccccaccggcccccagggccccaucggccagcccggccccagcggcgccgacggcgagcccggccccagaggccagcagggccuguucggccagaagggcgacgagggccccagaggcuuccccggcccccccggccccgugggccugcagggccugcccggcccccccggcgagaagggcgagaccggcgacgugggccagaugggcccccccggcccccccggccccagaggccccagcggcgcccccggcgccgacggcccccagggcccccccggcggcaucggcaaccccggcgccgugggcgagaagggcgagcccggcgaggccggcgagcccggccugcccggcgagggcggcccccccggccccaagggcgagagaggcgagaagggcgagagcggccccagcggcgccgccggcccccccggccccaagggcccccccggcgacgacggccccaagggcagccccggccccgugggcuuccccggcgaccccggcccccccggcgagcccggccccgccggccaggacggcccccccggcgacaagggcgacgacggcgagcccggccagaccggcagccccggccccaccggcgagcccggccccagcggcccccccggcaagagaggcccccccggccccgccggccccgagggcagacagggcgagaagggcgccaagggcgaggccggccuggagggcccccccggcaagaccggccccaucggcccccagggcgcccccggcaagcccggccccgacggccugagaggcauccccggccccgugggcgagcagggccugcccggcagccccggccccgacggcccccccggccccaugggcccccccggccugcccggccugaagggcgacagcggccccaagggcgagaagggccaccccggccugaucggccugaucggcccccccggcgagcagggcgagaagggcgacagaggccugcccggcccccagggcagcagcggccccaagggcgagcagggcaucaccggccccagcggccccaucggcccccccggcccccccggccugcccggcccccccggccccaagggcgccaagggcagcagcggccccaccggccccaagggcgaggccggccaccccggcccccccggcccccccggcccccccggcgaggugauccagccccugcccauccaggccagcagaaccagaagaaacaucgacgccagccagcugcuggacgacggcaacggcgagaacuacguggacuacgccgacggcauggaggagaucuucggcagccugaacagccugaagcuggagaucgagcagaugaagagaccccugggcacccagcagaaccccgccagaaccugcaaggaccugcagcugugccaccccgacuuccccgacggcgaguacuggguggaccccaaccagggcugcagcagagacagcuucaagguguacugcaacuucaccgccggcggcagcaccugcguguuccccgacaagaagagcgagggcgccagaaucaccagcuggcccaaggagaaccccggcagcugguucagcgaguucaagagaggcaagcugcugagcuacguggacgccgagggcaaccccgugggcguggugcagaugaccuuccugagacugcugagcgccagcgcccaccagaacgugaccuaccacugcuaccagagcguggccuggcaggacgccgccaccggcagcuacgacaaggcccugagauuccugggcagcaacgacgaggagaugagcuacgacaacaaccccuacaucagagcccugguggacggcugcgccaccaagaagggcuaccagaagaccgugcuggagaucgacacccccaagguggagcaggugcccaucguggacaucauguucaacgacuucggcgaggccagccagaaguucggcuucgaggugggccccgccugcuucaugggcuaa

SEQ ID NO: 15481 - RNA, 4500 nt, Artificial Sequence
  COL5A2__Homo_sapiens__NP_000384
augauggccaacugggccgaggccagaccccugcugauccugaucgugcugcugggccaguucgugagcaucaaggcccaggaggaggacgaggacgagggcuacggcgaggagaucgccugcacccagaacggccagauguaccugaacagagacaucuggaagcccgcccccugccagaucugcgugugcgacaacggcgccauccugugcgacaagaucgagugccaggacgugcuggacugcgccgaccccgugaccccccccggcgagugcugccccgugugcagccagacccccggcggcggcaacaccaacuucggcagaggcagaaagggccagaagggcgagcccggccuggugcccguggugaccggcaucagaggcagacccggccccgccggcccccccggcagccagggccccagaggcgagagaggccccaagggcagacccggccccagaggcccccagggcaucgacggcgagcccggcgugcccggccagcccggcgcccccggcccccccggccaccccagccaccccggccccgacggccugagcagacccuucagcgcccagauggccggccuggacgagaagagcggccugggcagccaggugggccugaugcccggcagcgugggccccgugggccccagaggcccccagggccugcagggccagcagggcggcgccggccccaccggcccccccggcgagcccggcgaccccggccccaugggccccaucggcagcagaggccccgagggcccccccggcaagcccggcgaggacggcgagcccggcagaaacggcaaccccggcgaggugggcuucgccggcagccccggcgccagaggcuuccccggcgcccccggccugcccggccugaagggccacagaggccacaagggccuggagggccccaagggcgaggugggcgcccccggcagcaagggcgaggccggccccaccggccccaugggcgccaugggcccccugggccccagaggcaugcccggcgagagaggcagacugggcccccagggcgcccccggccagagaggcgcccacggcaugcccggcaagcccggccccaugggcccccugggcauccccggcagcagcggcuuccccggcaaccccggcaugaagggcgaggccggccccaccggcgccagaggccccgagggcccccagggccagagaggcgagaccggcccccccggccccgugggcagccccggccugcccggcgccaucggcaccgacggcacccccggcgccaagggccccaccggcagccccggcaccagcggcccccccggcagcgccggcccccccggcagccccggcccccagggcagcaccggcccccagggcaucagaggccagcccggcgaccccggcgugcccggcuucaagggcgaggccggccccaagggcgagcccggcccccacggcauccagggccccaucggcccccccggcgaggagggcaagagaggccccagaggcgaccccggcaccgugggcccccccggccccgugggcgagagaggcgcccccggcaacagaggcuuccccggcagcgacggccugcccggccccaagggcgcccagggcgagagaggccccgugggcagcagcggccccaagggcagccagggcgaccccggcagacccggcgagcccggccugcccggcgccagaggccugaccggcaaccccggcgugcagggccccgagggcaagcugggcccccugggcgcccccggcgaggacggcagacccggcccccccggcagcaucggcaucagaggccagcccggcagcaugggccugcccggccccaagggcagcagcggcgaccccggcaagcccggcgaggccggcaacgccggcgugcccggccagagaggcgcccccggcaaggacggcgaggugggccccagcggccccgugggcccccccggccuggccggcgagagaggcgagcagggcccccccggccccaccggcuuccagggccugcccggcccccccggcccccccggcgagggcggcaagcccggcgaccagggcgugcccggcgaccccggcgccgugggcccccugggccccagaggcgagagaggcaaccccggcgagagaggcgagcccggcaucaccggccugcccggcgagaagggcauggccggcggccacggccccgacggccccaagggcagccccggccccagcggcacccccggcgacaccggcccccccggccugcagggcaugcccggcgagagaggcaucgccggcacccccggccccaagggcgacagaggcggcaucggcgagaagggcgccgagggcaccgccggcaacgacggcgccagaggccugcccggcccccugggcccccccggccccgccggccccaccggcgagaagggcgagcccggccccagaggccuggugggcccccccggcagcagaggcaaccccggcagcagaggcgagaacggccccaccggcgccgugggcuucgccggcccccagggccccgacggccagcccggcgugaagggcgagcccggcgagcccggccagaagggcgacgccggcagccccggcccccagggccuggccggcagccccggcccccacggccccaacggcgugcccggccugaagggcggcagaggcacccagggcccccccggcgccaccggcuuccccggcagcgccggcagagugggcccccccggccccgccggcgcccccggccccgccggcccccugggcgagcccggcaaggagggcccccccggccugagaggcgaccccggcagccacggcagagugggcgacagaggccccgccggcccccccggcggccccggcgacaagggcgaccccggcgaggacggccagcccggccccgacggcccccccggccccgccggcaccaccggccagagaggcaucgugggcaugcccggccagagaggcgagagaggcaugcccggccugcccggccccgccggcacccccggcaaggugggccccaccggcgccaccggcgacaagggcccccccggccccgugggcccccccggcagcaacggccccgugggcgagcccggccccgagggccccgccggcaacgacggcacccccggcagagacggcgccgugggcgagagaggcgacagaggcgaccccggccccgccggccugcccggcagccagggcgcccccggcacccccggccccgugggcgcccccggcgacgccggccagagaggcgaccccggcagcagaggccccaucggcccccccggcagagccggcaagagaggccugcccggcccccagggccccagaggcgacaagggcgaccacggcgacagaggcgacagaggccagaagggccacagaggcuucaccggccugcagggccugcccggcccccccggccccaacggcgagcagggcagcgccggcauccccggccccuucggccccagaggcccccccggccccgugggccccagcggcaaggagggcaaccccggcccccugggccccaucggcccccccggcgugagaggcagcgugggcgaggccggccccgagggcccccccggcgagcccggcccccccggcccccccggcccccccggccaccugaccgccgcccugggcgacaucaugggccacuacgacgagagcaugcccgacccccugcccgaguucaccgaggaccaggccgcccccgacgacaagaacaagaccgaccccggcgugcacgccacccugaagagccugagcagccagaucgagaccaugagaagccccgacggcagcaagaagcaccccgccagaaccugcgacgaccugaagcugugccacagcgccaagcagagcggcgaguacuggaucgaccccaaccagggcagcguggaggacgccaucaagguguacugcaacauggagaccggcgagaccugcaucagcgccaaccccagcagcgugcccagaaagaccuggugggccagcaagagccccgacaacaagcccgugugguacggccuggacaugaacagaggcagccaguucgccuacggcgaccaccagagccccaacaccgccaucacccagaugaccuuccugagacugcugagcaaggaggccagccagaacaucaccuacaucugcaagaacagcgugggcuacauggacgaccaggccaagaaccugaagaaggccguggugcugaagggcgccaacgaccuggacaucaaggccgagggcaacaucagauucagauacaucgugcugcaggacaccugcagcaagagaaacggcaacgugggcaagaccguguucgaguacagaacccagaacguggccagacugcccaucaucgaccuggcccccguggacgugggcggcaccgaccaggaguucggcguggagaucggccccgugugcuucguguaa

SEQ ID NO: 15482 - RNA, 5238 nt, Artificial Sequence
  COL5A3__Homo_sapiens__NP_056534
augggcaacagaagagaccugggccagcccagagccggccugugccugcugcuggccgcccugcagcugcugcccggcacccaggccgaccccguggacgugcugaaggcccugggcgugcagggcggccaggccggcgugcccgagggccccggcuucugcccccagagaacccccgagggcgacagagccuucagaaucggccaggccagcacccugggcauccccaccugggagcuguuccccgagggccacuuccccgagaacuucagccugcugaucacccugagaggccagcccgccaaccagagcgugcugcugagcaucuacgacgagagaggcgccagacagcugggccuggcccugggccccgcccugggccugcugggcgaccccuucagaccccugccccagcaggugaaccugaccgacggcagauggcacagaguggccgugagcaucgacggcgagauggugacccugguggccgacugcgaggcccagccccccgugcugggccacggccccagauucaucagcaucgccggccugaccgugcugggcacccaggaccugggcgagaagaccuucgagggcgacauccaggagcugcugaucagccccgacccccaggccgccuuccaggccugcgagagauaccugcccgacugcgacaaccuggcccccgccgccaccguggccccccagggcgagcccgagacccccagacccagaagaaagggcaagggcaagggcagaaagaagggcagaggcagaaagggcaagggcagaaagaagaacaaggagaucuggaccagcagccccccccccgacagcgccgagaaccagaccagcaccgacauccccaagaccgagacccccgcccccaaccugccccccacccccaccccccugguggugaccagcaccgugaccaccggccugaacgccaccauccuggagagaagccuggaccccgacagcggcaccgagcugggcacccuggagaccaaggccgccagagaggacgaggagggcgacgacagcaccaugggccccgacuucagagccgccgaguaccccagcagaacccaguuccagaucuuccccggcgccggcgagaagggcgccaagggcgagcccgccgugaucgagaagggccagcaguucgagggcccccccggcgcccccggcccccagggcguggugggccccagcggcccccccggcccccccggcuuccccggcgaccccggcccccccggccccgccggccugcccggcauccccggcaucgacggcaucagaggcccccccggcaccgugaucaugaugcccuuccaguucgccggcggcagcuucaagggcccccccgugagcuuccagcaggcccaggcccaggccgugcugcagcagacccagcugagcaugaagggcccccccggccccgugggccugaccggcagacccggccccgugggccugcccggccaccccggccugaagggcgaggagggcgccgagggcccccagggccccagaggccugcagggcccccacggcccccccggcagagugggcaagaugggcagacccggcgccgacggcgccagaggccugcccggcgacaccggccccaagggcgacagaggcuucgacggccugcccggccugcccggcgagaagggccagagaggcgacuucggccacgugggccagcccggcccccccggcgaggacggcgagagaggcgccgagggcccccccggccccaccggccaggccggcgagcccggccccagaggccugcugggccccagaggcagccccggccccaccggcagacccggcgugaccggcaucgacggcgcccccggcgccaagggcaacgugggcccccccggcgagcccggcccccccggccagcagggcaaccacggcagccagggccugcccggcccccagggccugaucggcacccccggcgagaagggcccccccggcaaccccggcauccccggccugcccggcagcgacggcccccugggccaccccggccacgagggccccaccggcgagaagggcgcccagggcccccccggcagcgccggcccccccggcuaccccggccccagaggcgugaagggcaccagcggcaacagaggccugcagggcgagaagggcgagaagggcgaggacggcuuccccggcuucaagggcgacgugggccugaagggcgaccagggcaagcccggcgcccccggccccagaggcgaggacggccccgagggccccaagggccaggccggccaggccggcgaggagggcccccccggcagcgccggcgagaagggcaagcugggcgugcccggccugcccggcuaccccggcagacccggccccaagggcagcaucggcuuccccggcccccugggccccaucggcgagaagggcaagagcggcaagaccggccagcccggccuggagggcgagagaggcccccccggcagcagaggcgagagaggccagcccggcgccaccggccagcccggccccaagggcgacgugggccaggacggcgcccccggcauccccggcgagaagggccugcccggccugcagggcccccccggcuuccccggccccaagggcccccccggccaccagggcaaggacggcagacccggccaccccggccagagaggcgagcugggcuuccagggccagaccggcccccccggccccgccggcgugcugggcccccagggcaagaccggcgaggugggcccccugggcgagagaggcccccccggcccccccggcccccccggcgagcagggccugcccggccuggagggcagagagggcgccaagggcgagcugggcccccccggcccccugggcaaggagggccccgccggccugagaggcuuccccggccccaagggcggccccggcgaccccggccccaccggccugaagggcgacaagggcccccccggccccgugggcgccaacggcagccccggcgagagaggcccccugggccccgccggcggcaucggccugcccggccagagcggcagcgagggccccgugggccccgccggcaagaagggcagcagaggcgagagaggcccccccggccccaccggcaaggacggcauccccggcccccugggcccccugggcccccccggcgccgccggccccagcggcgaggagggcgacaagggcgacgugggcgcccccggccacaagggcagcaagggcgacaagggcgacgccggcccccccggccagcccggcaucagaggccccgccggccaccccggcccccccggcgccgacggcgcccagggcagaagaggcccccccggccuguucggccagaagggcgacgacggcgugagaggcuucgugggcgugaucggcccccccggccugcagggccugcccggcccccccggcgagaagggcgaggugggcgacgugggcagcaugggcccccacggcgcccccggccccagaggcccccagggccccaccggcagcgagggcacccccggccugcccggcggcgugggccagcccggcgccgugggcgagaagggcgagagaggcgacgccggcgaccccggcccccccggcgcccccggcauccccggccccaagggcgacaucggcgagaagggcgacagcggccccagcggcgccgccggcccccccggcaagaagggcccccccggcgaggacggcgccaagggcagcgugggccccaccggccugcccggcgaccugggcccccccggcgaccccggcgugagcggcaucgacggcagccccggcgagaagggcgaccccggcgacgugggcggccccggcccccccggcgccagcggcgagcccggcgcccccggcccccccggcaagagaggccccagcggccacaugggcagagagggcagagagggcgagaagggcgccaagggcgagcccggccccgacggcccccccggcagaaccggccccaugggcgccagaggcccccccggcagagugggccccgagggccugagaggcauccccggccccgugggcgagcccggccugcugggcgcccccggccagaugggcccccccggcccccugggccccagcggccugcccggccugaagggcgacaccggccccaagggcgagaagggccacaucggccugaucggccugaucggcccccccggcgaggccggcgagaagggcgaccagggccugcccggcgugcagggcccccccggccccaagggcgaccccggcccccccggccccaucggcagccugggccaccccggcccccccggcguggccggcccccugggccagaagggcagcaagggcagccccggcagcaugggccccagaggcgacaccggccccgccggcccccccggcccccccggcgcccccgccgagcugcacggccugagaagaagaagaagauucgugcccgugccccugcccgugguggagggcggccuggaggaggugcuggccagccugaccagccugagccuggagcuggagcagcugagaagaccccccggcaccgccgagagacccggccuggugugccacgagcugcacagaaaccacccccaccugcccgacggcgaguacuggaucgaccccaaccagggcugcgccagagacagcuucagaguguucugcaacuucaccgccggcggcgagaccugccuguaccccgacaagaaguucgagaucgugaagcuggccagcuggagcaaggagaagcccggcggcugguacagcaccuucagaagaggcaagaaguucagcuacguggacgccgacggcagccccgugaacguggugcagcugaacuuccugaagcugcugagcgccaccgccagacagaacuucaccuacagcugccagaacgccgccgccuggcuggacgaggccaccggcgacuacagccacagcgccagauuccugggcaccaacggcgaggagcugagcuucaaccagaccaccgccgccaccgugagcgugccccaggacggcugcagacugagaaagggccagaccaagacccuguucgaguucagcagcagcagagccggcuuccugccccugugggacguggccgccaccgacuucggccagaccaaccagaaguucggcuucgagcugggccccgugugcuucagcagcuaa

SEQ ID NO: 15483 - RNA, 3087 nt, Artificial Sequence
  COL6A1__Homo_sapiens__NP_001839
augagagccgccagagcccugcugccccugcugcugcaggccugcuggaccgccgcccaggacgagcccgagacccccagagccguggccuuccaggacugccccguggaccuguucuucgugcuggacaccagcgagagcguggcccugagacugaagcccuacggcgcccugguggacaaggugaagagcuucaccaagagauucaucgacaaccugagagacagauacuacagaugcgacagaaaccugguguggaacgccggcgcccugcacuacagcgacgagguggagaucauccagggccugaccagaaugcccggcggcagagacgcccugaagagcagcguggacgccgugaaguacuucggcaagggcaccuacaccgacugcgccaucaagaagggccuggagcagcugcuggugggcggcagccaccugaaggagaacaaguaccugaucguggugaccgacggccacccccuggagggcuacaaggagcccugcggcggccuggaggacgccgugaacgaggccaagcaccugggcgugaagguguucagcguggccaucacccccgaccaccuggagcccagacugagcaucaucgccaccgaccacaccuacagaagaaacuucaccgccgccgacuggggccagagcagagacgccgaggaggccaucagccagaccaucgacaccaucguggacaugaucaagaacaacguggagcaggugugcugcagcuucgagugccagcccgccagaggcccccccggccugagaggcgaccccggcuucgagggcgagagaggcaagcccggccugcccggcgagaagggcgaggccggcgaccccggcagacccggcgaccugggccccgugggcuaccagggcaugaagggcgagaagggcagcagaggcgagaagggcagcagaggccccaagggcuacaagggcgagaagggcaagagaggcaucgacggcguggacggcgugaagggcgagaugggcuaccccggccugcccggcugcaagggcagccccggcuucgacggcauccagggcccccccggccccaagggcgaccccggcgccuucggccugaagggcgagaagggcgagcccggcgccgacggcgaggccggcagacccggcagcagcggccccagcggcgacgagggccagcccggcgagcccggcccccccggcgagaagggcgaggccggcgacgagggcaaccccggccccgacggcgcccccggcgagagaggcggccccggcgagagaggccccagaggcacccccggcaccagaggccccagaggcgaccccggcgaggccggcccccagggcgaccagggcagagagggccccgugggcgugcccggcgaccccggcgaggccggccccaucggccccaagggcuacagaggcgacgagggcccccccggcagcgagggcgccagaggcgcccccggccccgccggcccccccggcgaccccggccugaugggcgagagaggcgaggacggccccgccggcaacggcaccgagggcuuccccggcuuccccggcuaccccggcaacagaggcgcccccggcaucaacggcaccaagggcuaccccggccugaagggcgacgagggcgaggccggcgaccccggcgacgacaacaacgacaucgcccccagaggcgugaagggcgccaagggcuacagaggccccgagggcccccagggcccccccggccaccagggcccccccggccccgacgagugcgagauccuggacaucaucaugaagaugugcagcugcugcgagugcaagugcggccccaucgaccugcuguucgugcuggacagcagcgagagcaucggccugcagaacuucgagaucgccaaggacuucguggugaaggugaucgacagacugagcagagacgagcuggugaaguucgagcccggccagagcuacgccggcguggugcaguacagccacagccagaugcaggagcacgugagccugagaagccccagcaucagaaacgugcaggagcugaaggaggccaucaagagccugcaguggauggccggcggcaccuucaccggcgaggcccugcaguacaccagagaccagcugcugccccccagccccaacaacagaaucgcccuggugaucaccgacggcagaagcgacacccagagagacaccaccccccugaacgugcugugcagccccggcauccagguggugagcgugggcaucaaggacguguucgacuucauccccggcagcgaccagcugaacgugaucagcugccagggccuggcccccagccagggcagacccggccugagccuggugaaggagaacuacgccgagcugcuggaggacgccuuccugaagaacgugaccgcccagaucugcaucgacaagaagugccccgacuacaccugccccaucaccuucagcagccccgccgacaucaccauccugcuggacggcagcgccagcgugggcagccacaacuucgacaccaccaagagauucgccaagagacuggccgagagauuccugaccgccggcagaaccgaccccgcccacgacgugagaguggccguggugcaguacagcggcaccggccagcagagacccgagagagccagccugcaguuccugcagaacuacaccgcccuggccagcgccguggacgccauggacuucaucaacgacgccaccgacgugaacgacgcccugggcuacgugaccagauucuacagagaggccagcagcggcgccgccaagaagagacugcugcuguucagcgacggcaacagccagggcgccacccccgccgccaucgagaaggccgugcaggaggcccagagagccggcaucgagaucuucguggugguggugggcagacaggugaacgagccccacaucagagugcuggugaccggcaagaccgccgaguacgacguggccuacggcgagagccaccuguucagagugcccagcuaccaggcccugcugagaggcguguuccaccagaccgugagcagaaagguggcccugggcuaa

SEQ ID NO: 15484 - RNA, 2757 nt, Artificial Sequence
  COL6A2__Homo_sapiens__NP_478054
augcugcagggcaccugcagcgugcugcugcuguggggcauccugggcgccauccaggcccagcagcaggaggugaucagccccgacaccaccgagagaaacaacaacugccccgagaagaccgacugccccauccacguguacuucgugcuggacaccagcgagagcgugaccaugcagagccccaccgacauccugcuguuccacaugaagcaguucgugccccaguucaucagccagcugcagaacgaguucuaccuggaccagguggcccugagcuggagauacggcggccugcacuucagcgaccagguggagguguucagcccccccggcagcgacagagccagcuucaucaagaaccugcagggcaucagcagcuucagaagaggcaccuucaccgacugcgcccuggccaacaugaccgagcagaucagacaggacagaagcaagggcaccgugcacuucgccguggugaucaccgacggccacgugaccggcagccccugcggcggcaucaagcugcaggccgagagagccagagaggagggcaucagacuguucgccguggcccccaaccagaaccugaaggagcagggccugagagacaucgccagcaccccccacgagcuguacagaaacgacuacgccaccaugcugcccgacagcaccgagaucgaccaggacaccaucaacagaaucaucaaggugaugaagcacgaggccuacggcgagugcuacaaggugagcugccuggagauccccggccccagcggccccaagggcuacagaggccagaagggcgccaagggcaacaugggcgagcccggcgagcccggccagaagggcagacagggcgaccccggcaucgagggccccaucggcuuccccggccccaagggcgugcccggcuucaagggcgagaagggcgaguucggcgccgacggcagaaagggcgcccccggccuggccggcaagaacggcaccgacggccagaagggcaagcugggcagaaucggcccccccggcugcaagggcgaccccggcaacagaggccccgacggcuaccccggcgaggccggcagccccggcgagagaggcgaccagggcggcaagggcgaccccggcagacccggcagaagaggcccccccggcgagaucggcgccaagggcagcaagggcuaccagggcaacagcggcgcccccggcagccccggcgugaagggcgccaagggcggccccggccccagaggccccaagggcgagcccggcagaagaggcgaccccggcaccaagggcagccccggcagcgacggccccaagggcgagaagggcgaccccggccccgagggccccagaggccuggccggcgaggugggcaacaagggcgccaagggcgacagaggccugcccggccccagaggcccccagggcgcccugggcgagcccggcaagcagggcagcagaggcgaccccggcgacgccggccccagaggcgacagcggccagcccggccccaagggcgaccccggcagacccggcuucagcuaccccggccccagaggcgcccccggcgagaagggcgagcccggccccagaggccccgagggcggcagaggcgacuucggccugaagggcgagcccggcagaaagggcgagaagggcgagcccgccgaccccggcccccccggcgagcccggccccagaggccccagaggcgugcccggccccgagggcgagcccggcccccccggcgaccccggccugaccgagugcgacgugaugaccuacgugagagagaccugcggcugcugcgacugcgagaagagaugcggcgcccuggacgugguguucgugaucgacagcagcgagagcaucggcuacaccaacuucacccuggagaagaacuucgugaucaacguggugaacagacugggcgccaucgccaaggaccccaagagcgagaccggcaccagagugggcguggugcaguacagccacgagggcaccuucgaggccauccagcuggacgacgagagaaucgacagccugagcagcuucaaggaggccgugaagaaccuggaguggaucgccggcggcaccuggacccccagcgcccugaaguucgccuacgacagacugaucaaggagagcagaagacagaagaccagaguguucgccguggugaucaccgacggcagacacgaccccagagacgacgaccugaaccugagagcccugugcgacagagacgugaccgugaccgccaucggcaucggcgacauguuccacgagaagcacgagagcgagaaccuguacagcaucgccugcgacaagccccagcaggugagaaacaugacccuguucagcgaccugguggccgagaaguucaucgacgacauggaggacgugcugugccccgacccccagaucgugugccccgaccugcccugccagaccgacgcccccuggcccggcggcgagccccccgugaccuuccugagaaccgaggagggccccgacgccaccuuccccagaaccaucccccugauccagcagcugcugaacgccaccgagcugacccaggaccccgccgccuacagccagcugguggccgugcugguguacaccgccgagagagccaaguucgccaccggcguggagagacaggacuggauggagcuguucaucgacaccuucaagcuggugcacagagacaucgugggcgaccccgagaccgcccuggcccugugcuaa

SEQ ID NO: 15485 - RNA, 9534 nt, Artificial Sequence
  COL6A3__Homo_sapiens__NP_004360
augagaaagcacagacaccugccccugguggccguguucugccuguuccugagcggcuuccccaccacccacgcccagcagcagcaggccgacgugaagaacggcgccgccgccgacaucaucuuccugguggacagcagcuggaccaucggcgaggagcacuuccagcuggugagagaguuccuguacgacguggugaagagccuggccgugggcgagaacgacuuccacuucgcccuggugcaguucaacggcaacccccacaccgaguuccugcugaacaccuacagaaccaagcaggaggugcugagccacaucagcaacaugagcuacaucggcggcaccaaccagaccggcaagggccuggaguacaucaugcagagccaccugaccaaggccgccggcagcagagccggcgacggcgugccccaggugaucguggugcugaccgacggccacagcaaggacggccuggcccugcccagcgccgagcugaagagcgccgacgugaacguguucgccaucggcguggaggacgccgacgagggcgcccugaaggagaucgccagcgagccccugaacaugcacauguucaaccuggagaacuucaccagccugcacgacaucgugggcaaccuggugagcugcgugcacagcagcgugagccccgagagagccggcgacaccgagacccugaaggacaucaccgcccaggacagcgccgacaucaucuuccugaucgacggcagcaacaacaccggcagcgugaacuucgccgugauccuggacuuccuggugaaccugcuggagaagcugcccaucggcacccagcagaucagagugggcguggugcaguucagcgacgagcccagaaccauguucagccuggacaccuacagcaccaaggcccaggugcugggcgccgugaaggcccugggcuucgccggcggcgagcuggccaacaucggccuggcccuggacuucgugguggagaaccacuucaccagagccggcggcagcagaguggaggagggcgugccccaggugcuggugcugaucagcgccggccccagcagcgacgagaucagauacggcgugguggcccugaagcaggccagcguguucagcuucggccugggcgcccaggccgccagcagagccgagcugcagcacaucgccaccgacgacaaccugguguucaccgugcccgaguucagaagcuucggcgaccugcaggagaagcugcugcccuacaucgugggcguggcccagagacacaucgugcugaagccccccaccaucgugacccaggugaucgaggugaacaagagagacaucguguuccugguggacggcagcagcgcccugggccuggccaacuucaacgccaucagagacuucaucgccaaggugauccagagacuggagaucggccaggaccugauccagguggccguggcccaguacgccgacaccgugagacccgaguucuacuucaacacccaccccaccaagagagaggugaucaccgccgugagaaagaugaagccccuggacggcagcgcccuguacaccggcagcgcccuggacuucgugagaaacaaccuguucaccagcagcgccggcuacagagccgccgagggcauccccaagcugcuggugcugaucaccggcggcaagagccuggacgagaucagccagcccgcccaggagcugaagagaagcagcaucauggccuucgccaucggcaacaagggcgccgaccaggccgagcuggaggagaucgccuucgacagcagccugguguucauccccgccgaguucagagccgccccccugcagggcaugcugcccggccugcuggccccccugagaacccugagcggcacccccgaggugcacagcaacaagagagacaucaucuuccugcuggacggcagcgccaacgugggcaagaccaacuuccccuacgugagagacuucgugaugaaccuggugaacagccuggacaucggcaacgacaacaucagagugggccuggugcaguucagcgacacccccgugaccgaguucagccugaacaccuaccagaccaagagcgacauccugggccaccugagacagcugcagcugcagggcggcagcggccugaacaccggcagcgcccugagcuacguguacgccaaccacuucaccgaggccggcggcagcagaaucagagagcacgugccccagcugcugcugcugcugaccgccggccagagcgaggacagcuaccugcaggccgccaacgcccugaccagagccggcauccugaccuucugcgugggcgccagccaggccaacaaggccgagcuggagcagaucgccuucaaccccagccugguguaccugauggacgacuucagcagccugcccgcccugccccagcagcugauccagccccugaccaccuacgugagcggcggcguggaggaggugccccuggcccagcccgagagcaagagagacauccuguuccuguucgacggcagcgccaaccuggugggccaguuccccguggugagagacuuccuguacaagaucaucgacgagcugaacgugaagcccgagggcaccagaaucgccguggcccaguacagcgacgacgugaagguggagagcagauucgacgagcaccagagcaagcccgagauccugaaccuggugaagagaaugaagaucaagaccggcaaggcccugaaccugggcuacgcccuggacuacgcccagagauacaucuucgugaagagcgccggcagcagaaucgaggacggcgugcugcaguuccuggugcugcugguggccggcagaagcagcgacagaguggacggccccgccagcaaccugaagcagagcggcguggugcccuucaucuuccaggccaagaacgccgaccccgccgagcuggagcagaucgugcugagccccgccuucauccuggccgccgagagccugcccaagaucggcgaccugcacccccagaucgugaaccugcugaagagcgugcacaacggcgcccccgcccccgugagcggcgagaaggacgugguguuccugcuggacggcagcgagggcgugagaagcggcuucccccugcugaaggaguucgugcagagagugguggagagccuggacgugggccaggacagagugagaguggccguggugcaguacagcgacagaaccagacccgaguucuaccugaacagcuacaugaacaagcaggacguggugaacgccgugagacagcugacccugcugggcggccccacccccaacaccggcgccgcccuggaguucgugcugagaaacauccuggugagcagcgccggcagcagaaucaccgagggcgugccccagcugcugaucgugcugaccgccgacagaagcggcgacgacgugagaaaccccagcgugguggugaagagaggcggcgccgugcccaucggcaucggcaucggcaacgccgacaucaccgagaugcagaccaucagcuucauccccgacuucgccguggccauccccaccuucagacagcugggcaccgugcagcaggugaucagcgagagagugacccagcugaccagagaggagcugagcagacugcagcccgugcugcagccccugcccagccccggcgugggcggcaagagagacgugguguuccugaucgacggcagccagagcgccggccccgaguuccaguacgugagaacccugaucgagagacugguggacuaccuggacgugggcuucgacaccaccagaguggccgugauccaguucagcgacgaccccaagguggaguuccugcugaacgcccacagcagcaaggacgaggugcagaacgccgugcagagacugagacccaagggcggcagacagaucaacgugggcaacgcccuggaguacgugagcagaaacaucuucaagagaccccugggcagcagaaucgaggagggcgugccccaguuccuggugcugaucagcagcggcaagagcgacgacgagguggacgaccccgccguggagcugaagcaguucggcguggcccccuucaccaucgccagaaacgccgaccaggaggagcuggugaagaucagccugagccccgaguacguguucagcgugagcaccuucagagagcugcccagccuggagcagaagcugcugacccccaucaccacccugaccagcgagcagauccagaagcugcuggccagcaccagauaccccccccccgccguggagagcgacgccgccgacaucguguuccugaucgacagcagcgagggcgugagacccgacggcuucgcccacaucagagacuucgugagcagaaucgugagaagacugaacaucggccccagcaaggugagagugggcguggugcaguucagcaacgacguguuccccgaguucuaccugaagaccuacagaagccaggcccccgugcuggacgccaucagaagacugagacugagaggcggcagcccccugaacaccggcaaggcccuggaguucguggccagaaaccuguucgugaagagcgccggcagcagaaucgaggacggcgugccccagcaccuggugcuggugcugggcggcaagagccaggacgacgugagcagauucgcccaggugaucagaagcagcggcaucgugagccugggcgugggcgacagaaacaucgacagaaccgagcugcagaccaucaccaacgaccccagacugguguucaccgugagagaguucagagagcugcccaacaucgaggagagaaucaugaacagcuucggccccagcgccgccacccccgccccccccggcguggacacccccccccccagcagacccgagaagaagaaggccgacaucguguuccugcuggacggcagcaucaacuucagaagagacagcuuccaggaggugcugagauucgugagcgagaucguggacaccguguacgaggacggcgacagcauccaggugggccuggugcaguacaacagcgaccccaccgacgaguucuuccugaaggacuucagcaccaagagacagaucaucgacgccaucaacaaggugguguacaagggcggcagacacgccaacaccaaggugggccuggagcaccugagagugaaccacuucgugcccgaggccggcagcagacuggaccagagagugccccagaucgccuucgugaucaccggcggcaagagcguggaggacgcccaggacgugagccuggcccugacccagagaggcgugaagguguucgccgugggcgugagaaacaucgacagcgaggaggugggcaagaucgccagcaacagcgccaccgccuucagagugggcaacgugcaggagcugagcgagcugagcgagcaggugcuggagacccugcacgacgccaugcacgagacccugugccccggcgugaccgacgccgccaaggccugcaaccuggacgugauccugggcuucgacggcagcagagaccagaacguguucguggcccagaagggcuucgagagcaagguggacgccauccugaacagaaucagccagaugcacagagugagcugcagcggcggcagaagccccaccgugagagugagcgugguggccaacacccccagcggccccguggaggccuucgacuucgacgaguaccagcccgagaugcuggagaaguucagaaacaugagaagccagcaccccuacgugcugaccgaggacacccugaagguguaccugaacaaguucagacagagcagccccgacagcgugaagguggugauccacuucaccgacggcgccgacggcgaccuggccgaccugcacagagccagcgagaaccugagacaggagggcgugagagcccugauccuggugggccuggagagaguggugaaccuggagagacugaugcaccuggaguucggcagaggcuucauguacgacagaccccugagacugaaccugcuggaccuggacuacgagcuggccgagcagcuggacaacaucgccgagaaggccugcugcggcgugcccugcaagugcagcggccagagaggcgacagaggccccaucggcagcaucggccccaagggcauccccggcgaggacggcuacagaggcuaccccggcgacgagggcggccccggcgagagaggcccccccggcgugaacggcacccagggcuuccagggcugccccggccagagaggcgugaagggcagcagaggcuuccccggcgagaagggcgaggugggcgagaucggccuggacggccuggacggcgaggacggcgacaagggccugcccggcagcagcggcgagaagggcaaccccggcagaagaggcgacaagggccccagaggcgagaagggcgagagaggcgacgugggcaucagaggcgaccccggcaaccccggccaggacagccaggagagaggccccaagggcgagaccggcgaccugggccccaugggcgugcccggcagagacggcgugcccggcggccccggcgagaccggcaagaacggcggcuucggcagaagaggcccccccggcgccaagggcaacaagggcggccccggccagcccggcuucgagggcgagcagggcaccagaggcgcccagggccccgccggccccgccggcccccccggccugaucggcgagcagggcaucagcggccccagaggcagcggcggcgccgccggcgcccccggcgagagaggcagaaccggcccccugggcagaaagggcgagcccggcgagcccggccccaagggcggcaucggcaacagaggccccagaggcgagaccggcgacgacggcagagacggcgugggcagcgagggcagaagaggcaagaagggcgagagaggcuuccccggcuaccccggccccaagggcaaccccggcgagcccggccugaacggcaccaccggccccaagggcaucagaggcagaagaggcaacagcggcccccccggcaucgugggccagaagggcgaccccggcuaccccggccccgccggccccaagggcaacagaggcgacagcaucgaccagugcgcccugauccagagcaucaaggacaagugccccugcugcuacggcccccuggagugccccguguuccccaccgagcuggccuucgcccuggacaccagcgagggcgugaaccaggacaccuucggcagaaugagagacguggugcugagcaucgugaacgaccugaccaucgccgagagcaacugccccagaggcgccagaguggccguggugaccuacaacaacgaggugaccaccgagaucagauucgccgacagcaagagaaagagcgugcugcuggacaagaucaagaaccugcagguggcccugaccagcaagcagcagagccuggagaccgccaugagcuucguggccagaaacaccuucaagagagugagaaacggcuuccugaugagaaagguggccguguucuucagcaacacccccaccagagccagcccccagcugagagaggccgugcugaagcugagcgacgccggcaucaccccccuguuccugaccagacaggaggacagacagcugaucaacgcccugcagaucaacaacaccgccgugggccacgcccuggugcugcccgccggcagagaccugaccgacuuccuggagaacgugcugaccugccacgugugccuggacaucugcaacaucgaccccagcugcggcuucggcagcuggagacccagcuucagagacagaagagccgccggcagcgacguggacaucgacauggccuucauccuggacagcgccgagaccaccacccuguuccaguucaacgagaugaagaaguacaucgccuaccuggugagacagcuggacaugagccccgaccccaaggccagccagcacuucgccagaguggccguggugcagcacgcccccagcgagagcguggacaacgccagcaugccccccgugaagguggaguucagccugaccgacuacggcagcaaggagaagcugguggacuuccugagcagaggcaugacccagcugcagggcaccagagcccugggcagcgccaucgaguacaccaucgagaacguguucgagagcgcccccaaccccagagaccugaagaucguggugcugaugcugaccggcgaggugcccgagcagcagcuggaggaggcccagagagugauccugcaggccaagugcaagggcuacuucuucguggugcugggcaucggcagaaaggugaacaucaaggagguguacaccuucgccagcgagcccaacgacguguucuucaagcugguggacaagagcaccgagcugaacgaggagccccugaugagauucggcagacugcugcccagcuucgugagcagcgagaacgccuucuaccugagccccgacaucagaaagcagugcgacugguuccagggcgaccagcccaccaagaaccuggugaaguucggccacaagcaggugaacgugcccaacaacgugaccagcagccccaccagcaaccccgugaccaccaccaagcccgugaccaccaccaagcccgugaccaccaccaccaagcccgugaccaccaccaccaagcccgugaccaucaucaaccagcccagcgugaagcccgccgccgccaagcccgcccccgccaagcccguggccgccaagcccguggccaccaagauggccaccgugagaccccccguggccgugaagcccgccaccgccgccaagcccguggccgccaagcccgccgccgugagaccccccgccgccgccgccgccaagcccguggccaccaagcccgaggugcccagaccccaggccgccaagcccgccgccaccaagcccgccaccaccaagcccauggugaagaugagcagagaggugcagguguucgagaucaccgagaacagcgccaagcugcacugggagagagccgagccccccggccccuacuucuacgaccugaccgugaccagcgcccacgaccagagccuggugcugaagcagaaccugaccgugaccgacagagugaucggcggccugcuggccggccagaccuaccacguggccguggugugcuaccugagaagccaggugagagccaccuaccacggcagcuucagcaccaagaagagccagcccccccccccccagcccgccagaagcgccagcagcagcaccaucaaccugauggugagcaccgagccccuggcccugaccgagaccgacaucugcaagcugcccaaggacgagggcaccugcagagacuucauccugaagugguacuacgaccccaacaccaagagcugcgccagauucugguacggcggcugcggcggcaacgagaacaaguucggcagccagaaggagugcgagaaggugugcgcccccgugcuggccaagcccggcgugaucagcgugaugggcaccuaa

SEQ ID NO: 15486 - RNA, 7845 nt, Artificial Sequence
  COL6A5__Homo_sapiens__NP_001265227
augaagauccugcugaucaucuucgugcugaucaucuggaccgagacccuggccgaccagagccccggccccggccccguguacgccgacgugguguuccugguggacagcagcgaccaccugggccccaagagcuuccccuucgugaagaccuucaucaacaagaugaucaacagccugcccaucgaggccaacaaguacagaguggcccuggcccaguacagcgacgaguuccacagcgaguuccaccugagcaccuucaagggcagaagccccaugcugaaccaccugaagaagaacuuccaguucaucggcggcagccugcagaucggcaaggcccugcaggaggcccacagaaccuacuucagcgcccccaucaacggcagagacagaaagcaguucccccccauccugguggugcuggccagcgccgagagcgaggacgagguggaggaggccagcaaggcccugcagaaggacggcgugaagaucaucagcgugggcgugcagaaggccagcgaggagaaccugaaggccauggccaccagccacuuccacuucaaccugagaaccaucagagaccugagcaccuucagccagaacaugacccagaucaucaaggacgugaccaaguacaaggagggcgccguggacgccgacaugcaggugcacuuccccaucagcugccagaaggacagccuggccgaccugguguuccugguggacgagagccugggcaccggcggcaaccugagacaccugcagaccuuccuggagaacaucaccagcagcauggacgugaaggagaacugcaugagacugggccugaugagcuacagcaacagcgccaagaccaucagcuuccugaagagcagcaccacccagagcgaguuccagcagcagaucaagaaccugagcauccaggugggcaagagcaacaccggcgccgccaucgaccagaugagaagagacggcuucagcgagagcuacggcagcagaagagcccagggcgugccccagaucgccgugcuggugacccacagacccagcgacgacgaggugcacgacgccgcccugaaccugagacuggaggacgugaacguguucgcccugagcauccagggcgccaacaacacccagcuggaggagaucgugagcuacccccccgagcagaccaucagcacccugaagagcuacgccgaccuggagaccuacagcaccaaguuccugaagaagcugcagaacgagaucuggagccagaucagcaccuacgccgagcagagaaaccuggacaagaccggcugcguggacaccaaggaggccgacauccacuuccugaucgacggcagcagcagcauccaggagaagcaguucgagcagaucaagagauucaugcuggaggugaccgagauguucagcaucggccccgacaaggugagagugggcguggugcaguacagcgacgacaccgagguggaguucuacaucaccgacuacagcaacgacaucgaccugagaaaggccaucuucaacaucaagcagcugaccggcggcaccuacaccggcaaggcccuggacuacauccugcagaucaucaagaacggcaugaaggacagaaugagcaaggugcccugcuaccugaucgugcugaccgacggcaugagcaccgacagagugguggagcccgccaagagacugagagccgagcagaucaccgugcacgccgugggcaucggcgccgccaacaagaucgagcugcaggagaucgccggcaaggaggagagagugagcuucggccagaacuucgacgcccugaagagcaucaagaacgagguggugagagagaucugcgccgagaagggcugcgaggacaugaaggccgacaucauguuccugguggacagcagcuggagcaucggcaacgagaacuucagaaagaugaagaucuucaugaagaaccugcugaccaagauccagaucggcgccgacaagacccagaucggcguggugcaguucagcgacaagaccaaggaggaguuccagcugaacagauacuucacccagcaggagaucagcgacgccaucgacagaaugagccugaucaacgagggcacccugaccggcaaggcccugaacuucgugggccaguacuucacccacagcaagggcgccagacugggcgccaagaaguuccugauccugaucaccgacggcguggcccaggacgacgugagagaccccgccagaauccugagaggcaaggacgugaccaucuucagcgugggcguguacaacgccaacagaagccagcuggaggagaucagcggcgacagcagccugguguuccacguggagaacuucgaccaccugaaggcccuggagagaaagcugaucuucagagugugcgcccugcacgacugcaagagaaucacccugcuggacgugguguucgugcuggaccacagcggcagcaucaagaagcaguaccaggaccacaugaucaaccugaccauccaccuggugaagaaggccgacgugggcagagacagagugcaguucggcgcccugaaguacagcgaccagcccaacauccuguucuaccugaacaccuacagcaacagaagcgccaucaucgagaaccugagaaagagaagagacaccggcggcaacaccuacaccgccaaggcccugaagcacgccaacgcccuguucaccgaggagcacggcagcagaaucaagcagaacgugaagcagaugcugaucgugaucaccgacggcgagagccacgaccacgaccagcugaacgacaccgcccuggagcugagaaacaagggcaucaccaucuucgccgugggcgugggcaaggccaaccagaaggagcuggagggcauggccggcaacaagaacaacaccaucuacguggacaacuucgacaagcugaaggacguguucacccuggugcaggagagaaugugcaccgaggcccccgaggugugccaccugcaggaggccgacgugaucuuccugugcgacggcagcgacagagugagcaacagcgacuucgugaccaugaccaccuuccugagcgaccugaucgacaacuucgacauccagagccagagaaugaagaucggcauggcccaguucggcagcaacuaccagagcaucaucgagcugaagaacagccugaccaagacccaguggaagacccagauccagaacgugagcaagagcggcggcuuccccagaaucgacuucgcccugaagaaggugagcaacauguucaaccugcacgccggcggcagaagaaacgccggcgugccccagacccugguggugaucaccagcggcgaccccagauacgacguggccgacgccgugaagacccugaaggaccugggcaucugcgugcuggugcugggcaucggcgacguguacaaggagcaccugcugcccaucaccggcaacagcgagaagaucaucaccuuccaggacuucgacaagcugaagaacguggacgugaagaagagaaucaucagagagaucugccagagcugcggcaagaccaacugcuucauggacaucguggugggcuucgacaucagcacccacgugcagggccagccccuguuccagggccacccccagcuggagagcuaccugcccggcauccuggaggacaucagcagcaucaagggcgugagcugcggcgccggcaccgaggcccaggugagccuggccuucaaggugaacagcgaccagggcuuccccgccaaguuccagaucuaccagaaggccguguucgacagccugcugcaggugaacgugagcggccccacccaccugaacgcccaguuccugagaagccugugggacaccuucaaggacaagagcgccagcagaggccaggugcugcugaucuucagcgacggccugcagagcgagagcaacaucaugcuggagaaccagagcgacagacugagagaggccggccuggacgcccugcugguggugagccugaacaccaccgcccaccacgaguucagcagcuucgaguucggcaagagauucgacuacagaacccaccugaccaucggcaugagagagcugggcaagaagcugagccaguaccugggcaacaucgccgagagaaccugcugcugcaccuucugcaagugccccggcauccccggcccccacggcaccagaggccugcaggccaugaagggcagccagggccugaagggcagcagaggccacagaggcgaggacggcaaccccggcgugagaggcgacaccggcccccagggcgacaagggcaucgccggcugccccggcgccuggggccagaagggccugaagggcuucagcggccccaagggcggccacggcgacgacggcaucgacggccuggacggcgaggagggcugccacggcuuccccggcaucaagggcgagaagggcgaccccggcagccagggcagccccggcagcagaggcgcccccggccaguacggcgagaagggcuuccccggcgaccccggcaaccccggccagaacaacaacaucaagggccagaagggcagcaagggcgagcagggcagacagggcagaagcggccagaagggcgugcagggcagccccagcagcagaggcagcagaggcagagagggccagagaggccugagaggcgugagcggcgagcccggcaaccccggccccaccggcacccugggcgccgagggccugcagggcccccagggcagccagggcaaccccggcagaaagggcgagaagggcagccagggccagaagggcccccagggcagccccggccugaugggcgccaagggcagcaccggcagacccggccugcugggcaagaagggcgagcccggccugcccggcgaccugggccccgugggccagaccggccagagaggcagacagggcgacagcggcauccccggcuacggccagaugggcagaaagggcgugaagggccccagaggcuuccccggcgacgccggccagaagggcgacaucggcaaccccggcauccccggcggccccggccccaagggcuucagaggccuggcccugaccgugggccugaagggcgaggagggcagcagaggccugcccggcccccccggccagagaggcaucaagggcauggccggccagcccguguacagccagugcgaccugaucagauuccugagagagcacagccccugcuggaaggagaagugccccgccuaccccaccgagcugguguucgcccuggacaacagcuacgacgugaccgaggagagcuucaacaagaccagagacaucaucaccagcaucgugaacgaccugaacaucagagagaacaacugccccgugggcgccagaguggccauggugagcuacaacagcggcaccagcuaccugaucagauggagcgacuacaacagaaagaagcagcugcugcagcagcugagccagaucaaguaccaggacaccaccgagcccagagacgugggcaacgccaugagauucgugaccagaaacguguucaagagaaccuacgccggcgccaacgugagaagaguggccguguucuucagcaacggccagaccgccagcagaagcagcaucaucaccgccaccauggaguucagcgcccuggacaucagccccaccguguucgccuucgacgagagaguguuccuggaggccuucggcuucgacaacaccggcaccuuccaggugauccccgugccccccaacggcgagaaccagacccuggagagacugagaagaugcgcccugugcuacgacaagugcuuccccaacgccugcaucagagaggccuuccugcccgaggacagcuacauggacgugguguuccugaucgacaacagcagaaacaucgccaaggacgaguucaaggccgugaaggcccuggugagcagcgugaucgacaacuucaacaucgccagcgacccccugaucagcgacagcggcgacagaaucgcccugcugagcuacagccccugggagagcagcagaagaaagaugggcaccgugaagaccgaguucgacuucaucaccuacgacaaccagcugcugaugaagaaccacauccagaccagcuuccagcagcugaacggcgaggccaccaucggcagagcccugcuguggaccaccgagaaccuguuccccgagacccccuaccugagaaagcacaaggugaucuucguggugagcgccggcgagaacuacgagagaaaggaguucgugaagaugauggcccugagagccaagugccagggcuacgugaucuucgugaucagccugggcagcaccagaaaggacgacauggaggagcuggccagcuacccccuggaccagcaccugauccagcugggcagaauccacaagcccgaccugaacuacaucgccaaguuccugaagcccuuccuguacagcgugagaagaggcuucaaccaguaccccccccccaugcuggaggacgccugcagacugaucaaccugggcggcgagaacauccagaacgacggcuuccaguucgugaccgagcugcaggaggacuuccugggcggcaacggcuucaucggccaggagcugaacagcggcagagagagccccuucgugaagaccgaggacaacggcagcgacuaccugguguaccugcccagccagauguucgagccccagaagcugaugaucaacuacgagaaggaccagaagagcgccgagaucgccagccugaccagcggccacgagaacuacggcagaaaggaggagcccgaccacaccuacgagcccggcgacgugagccugcaggaguacuacauggacguggccuuccugaucgacgccagccagagagugggcagcgacgaguucaaggaggugaaggccuucaucaccagcgugcuggacuacuuccacaucgcccccaccccccugaccagcacccugggcgacagaguggccgugcugagcuacagcccccccggcuacaugcccaacaccgaggagugccccguguaccuggaguucgaccuggugaccuacaacagcauccaccagaugaagcaccaccugcaggacagccagcagcugaacggcgacguguucaucggccacgcccugcaguggaccaucgacaacguguucgugggcacccccaaccugagaaagaacaaggugaucuucgugaucagcgccggcgagaccaacagccuggacaaggacgugcugagaaacgugagccugagagccaagugccagggcuacagcaucuucguguucagcuucggccccaagcacaacgacaaggagcuggaggagcuggccagccacccccuggaccaccaccuggugcagcugggcagaacccacaagcccgacuggaacuacaucaucaaguucgugaagcccuucgugcaccugaucagaagagccaucaacaaguaccccaccgaggacaugaaggccaccugcgugaacaugaccagccccaaccccgagaacggcggcaccgagaacaccgugcugcugcugcccggcaucuacgagaucaagaccgagaacggcgaccuguucgacgaguucgacagccaggcccagcaccugcuggugcugggcaacaaccacagcagcggcagcgagaccgccaccgaccugaugcagaagcuguaccugcuguucagcaccgagaagcuggccaugaaggacaaggagaaggcccaccuggaggagaucagcgcccuggugguggacaagcagcaggagaaggaggacggcgaggacaccagaagcagcuaa

SEQ ID NO: 15487 - RNA, 8835 nt, Artificial Sequence
  COL7A1__Homo_sapiens__NP_000085
augacccugagacugcugguggccgcccugugcgccggcauccuggccgaggcccccagagugagagcccagcacagagagagagugaccugcaccagacuguacgccgccgacaucguguuccugcuggacggcagcagcagcaucggcagaagcaacuucagagaggugagaagcuuccuggagggccuggugcugcccuucagcggcgccgccagcgcccagggcgugagauucgccaccgugcaguacagcgacgaccccagaaccgaguucggccuggacgcccugggcagcggcggcgacgugaucagagccaucagagagcugagcuacaagggcggcaacaccagaaccggcgccgccauccugcacguggccgaccacguguuccugccccagcuggccagacccggcgugcccaaggugugcauccugaucaccgacggcaagagccaggaccugguggacaccgccgcccagagacugaagggccagggcgugaagcuguucgccgugggcaucaagaacgccgaccccgaggagcugaagagaguggccagccagcccaccagcgacuucuucuucuucgugaacgacuucagcauccugagaacccugcugccccuggugagcagaagagugugcaccaccgccggcggcgugcccgugaccagaccccccgacgacagcaccagcgcccccagagaccuggugcugagcgagcccagcagccagagccugagagugcaguggaccgccgccagcggccccgugaccggcuacaaggugcaguacaccccccugaccggccugggccagccccugcccagcgagagacaggaggugaacgugcccgccggcgagaccagcgugagacugagaggccugagaccccugaccgaguaccaggugaccgugaucgcccuguacgccaacagcaucggcgaggccgugagcggcaccgccagaaccaccgcccuggagggccccgagcugaccauccagaacaccaccgcccacagccugcugguggccuggagaagcgugcccggcgccaccggcuacagagugaccuggagagugcugagcggcggccccacccagcagcaggagcugggccccggccagggcagcgugcugcugagagaccuggagcccggcaccgacuacgaggugaccgugagcacccuguucggcagaagcgugggccccgccaccagccugauggccagaaccgacgccagcguggagcagacccugagacccgugauccugggccccaccagcauccugcugagcuggaaccuggugcccgaggccagaggcuacagacuggaguggagaagagagaccggccuggagcccccccagaagguggugcugcccagcgacgugaccagauaccagcuggacggccugcagcccggcaccgaguacagacugacccuguacacccugcuggagggccacgagguggccacccccgccaccguggugcccaccggccccgagcugcccgugagccccgugaccgaccugcaggccaccgagcugcccggccagagagugagagugagcuggagccccgugcccggcgccacccaguacagaaucaucgugagaagcacccagggcguggagagaacccuggugcugcccggcagccagaccgccuucgaccuggacgacgugcaggccggccugagcuacaccgugagagugagcgccagagugggccccagagagggcagcgccagcgugcugaccgugagaagagagcccgagaccccccuggccgugcccggccugagagugguggugagcgacgccaccagagugagaguggccuggggccccgugcccggcgccagcggcuucagaaucagcuggagcaccggcagcggccccgagagcagccagacccugccccccgacagcaccgccaccgacaucaccggccugcagcccggcaccaccuaccagguggccgugagcgugcugagaggcagagaggagggccccgccgccgugaucguggccagaaccgacccccugggccccgugagaaccgugcacgugacccaggccagcagcagcagcgugaccaucaccuggaccagagugcccggcgccaccggcuacagagugagcuggcacagcgcccacggccccgagaagagccagcuggugagcggcgaggccaccguggccgagcuggacggccuggagcccgacaccgaguacaccgugcacgugagagcccacguggccggcguggacggcccccccgccagcgugguggugagaaccgcccccgagcccgugggcagagugagcagacugcagauccugaacgccagcagcgacgugcugagaaucaccugggugggcgugaccggcgccaccgccuacagacuggccuggggcagaagcgagggcggccccaugagacaccagauccugcccggcaacaccgacagcgccgagaucagaggccuggagggcggcgugagcuacagcgugagagugaccgcccuggugggcgacagagagggcacccccgugagcaucguggugaccaccccccccgaggccccccccgcccugggcacccugcacguggugcagagaggcgagcacagccugagacugagaugggagcccgugcccagagcccagggcuuccugcugcacuggcagcccgagggcggccaggagcagagcagagugcugggccccgagcugagcagcuaccaccuggacggccuggagcccgccacccaguacagagugagacugagcgugcugggccccgccggcgagggccccagcgccgaggugaccgccagaaccgagagccccagagugcccagcaucgagcugagagugguggacaccagcaucgacagcgugacccuggccuggacccccgugagcagagccagcagcuacauccugagcuggagaccccugagaggccccggccaggaggugcccggcagcccccagacccugcccggcaucagcagcagccagagagugaccggccuggagcccggcgugagcuacaucuucagccugacccccgugcuggacggcgugagaggccccgaggccagcgugacccagacccccgugugccccagaggccuggccgacgugguguuccugccccacgccacccaggacaacgcccacagagccgaggccaccagaagagugcuggagagacuggugcuggcccugggcccccugggcccccaggccgugcaggugggccugcugagcuacagccacagacccagcccccuguucccccugaacggcagccacgaccugggcaucauccugcagagaaucagagacaugcccuacauggaccccagcggcaacaaccugggcaccgccguggugaccgcccacagauacaugcuggcccccgacgcccccggcagaagacagcacgugcccggcgugauggugcugcugguggacgagccccugagaggcgacaucuucagccccaucagagaggcccaggccagcggccugaacguggugaugcugggcauggccggcgccgaccccgagcagcugagaagacuggcccccggcauggacagcgugcagaccuucuucgccguggacgacggccccagccuggaccaggccgugagcggccuggccaccgcccugugccaggccagcuucaccacccagcccagacccgagcccugccccguguacugccccaagggccagaagggcgagcccggcgagaugggccugagaggccaggugggcccccccggcgaccccggccugcccggcagaaccggcgcccccggcccccagggcccccccggcagcgccaccgccaagggcgagagaggcuuccccggcgccgacggcagacccggcagccccggcagagccggcaaccccggcacccccggcgcccccggccugaagggcagccccggccugcccggccccagaggcgaccccggcgagagaggccccagaggccccaagggcgagcccggcgcccccggccaggugaucggcggcgagggccccggccugcccggcagaaagggcgaccccggccccagcggcccccccggccccagaggcccccugggcgaccccggccccagaggcccccccggccugcccggcaccgccaugaagggcgacaagggcgacagaggcgagagaggcccccccggccccggcgagggcggcaucgcccccggcgagcccggccugcccggccugcccggcagccccggcccccagggccccgugggcccccccggcaagaagggcgagaagggcgacagcgaggacggcgcccccggccugcccggccagcccggcagccccggcgagcagggccccagaggcccccccggcgccaucggccccaagggcgacagaggcuuccccggcccccugggcgaggccggcgagaagggcgagagaggcccccccggccccgccggcagcagaggccugcccggcguggccggcagacccggcgccaagggccccgagggcccccccggccccaccggcagacagggcgagaagggcgagcccggcagacccggcgaccccgccguggugggccccgccguggccggccccaagggcgagaagggcgacgugggccccgccggccccagaggcgccaccggcgugcagggcgagagaggcccccccggccuggugcugcccggcgaccccggccccaagggcgaccccggcgacagaggccccaucggccugaccggcagagccggcccccccggcgacagcggcccccccggcgagaagggcgaccccggcagacccggcccccccggccccgugggccccagaggcagagacggcgaggugggcgagaagggcgacgagggcccccccggcgaccccggccugcccggcaaggccggcgagagaggccugagaggcgcccccggcgugagaggccccgugggcgagaagggcgaccagggcgaccccggcgaggacggcagaaacggcagccccggcagcagcggccccaagggcgacagaggcgagcccggcccccccggcccccccggcagacugguggacaccggccccggcgccagagagaagggcgagcccggcgacagaggccaggagggccccagaggccccaagggcgaccccggccugcccggcgcccccggcgagagaggcaucgagggcuucagaggcccccccggcccccagggcgaccccggcgugagaggccccgccggcgagaagggcgacagaggcccccccggccuggacggcagaagcggccuggacggcaagcccggcgccgccggccccagcggccccaacggcgccgccggcaaggccggcgaccccggcagagacggccugcccggccugagaggcgagcagggccugcccggccccagcggcccccccggccugcccggcaagcccggcgaggacggcaagcccggccugaacggcaagaacggcgagcccggcgaccccggcgaggacggcagaaagggcgagaagggcgacagcggcgccagcggcagagagggcagagacggccccaagggcgagagaggcgcccccggcauccugggcccccagggcccccccggccugcccggccccgugggcccccccggccagggcuuccccggcgugcccggcggcaccggccccaagggcgacagaggcgagaccggcagcaagggcgagcagggccugcccggcgagagaggccugagaggcgagcccggcagcgugcccaacguggacagacugcuggagaccgccggcaucaaggccagcgcccugagagagaucguggagaccugggacgagagcagcggcagcuuccugcccgugcccgagagaagaagaggccccaagggcgacagcggcgagcagggcccccccggcaaggagggccccaucggcuuccccggcgagagaggccugaagggcgacagaggcgaccccggcccccagggcccccccggccuggcccugggcgagagaggcccccccggccccagcggccuggccggcgagcccggcaagcccggcauccccggccugcccggcagagccggcggcgugggcgaggccggcagacccggcgagagaggcgagagaggcgagaagggcgagagaggcgagcagggcagagacggcccccccggccugcccggcacccccggcccccccggcccccccggccccaaggugagcguggacgagcccggccccggccugagcggcgagcagggcccccccggccugaagggcgccaagggcgagcccggcagcaacggcgaccagggccccaagggcgacagaggcgugcccggcaucaagggcgacagaggcgagcccggccccagaggccaggacggcaaccccggccugcccggcgagagaggcauggccggccccgagggcaagcccggccugcagggccccagaggcccccccggccccgugggcggccacggcgaccccggcccccccggcgcccccggccuggccggccccgccggcccccagggccccagcggccugaagggcgagcccggcgagaccggcccccccggcagaggccugaccggccccaccggcgccgugggccugcccggcccccccggccccagcggccuggugggcccccagggcagccccggccugcccggccaggugggcgagaccggcaagcccggcgcccccggcagagacggcgccagcggcaaggacggcgacagaggcagccccggcgugcccggcagccccggccugcccggccccgugggccccaagggcgagcccggccccaccggcgcccccggccaggccguggugggccugcccggcgccaagggcgagaagggcgcccccggcggccuggccggcgaccuggugggcgagcccggcgccaagggcgacagaggccugcccggccccagaggcgagaagggcgaggccggcagagccggcgagcccggcgaccccggcgaggacggccagaagggcgcccccggccccaagggcuucaagggcgaccccggcgugggcgugcccggcagccccggcccccccggcccccccggcgugaagggcgaccugggccugcccggccugcccggcgcccccggcguggugggcuuccccggccagaccggccccagaggcgagaugggccagcccggccccagcggcgagagaggccuggccggcccccccggcagagagggcauccccggcccccugggcccccccggcccccccggcagcgugggcccccccggcgccagcggccugaagggcgacaagggcgaccccggcgugggccugcccggccccagaggcgagagaggcgagcccggcaucagaggcgaggacggcagacccggccaggagggccccagaggccugaccggcccccccggcagcagaggcgagagaggcgagaagggcgacgugggcagcgccggccugaagggcgacaagggcgacagcgccgugauccugggcccccccggccccagaggcgccaagggcgacaugggcgagagaggccccagaggccuggacggcgacaagggccccagaggcgacaacggcgaccccggcgacaagggcagcaagggcgagcccggcgacaagggcagcgccggccugcccggccugagaggccugcugggcccccagggccagcccggcgccgccggcauccccggcgaccccggcagccccggcaaggacggcgugcccggcaucagaggcgagaagggcgacgugggcuucaugggccccagaggccugaagggcgagagaggcgugaagggcgccugcggccuggacggcgagaagggcgacaagggcgaggccggcccccccggcagacccggccuggccggccacaagggcgagaugggcgagcccggcgugcccggccagagcggcgcccccggcaaggagggccugaucggccccaagggcgacagaggcuucgacggccagcccggccccaagggcgaccagggcgagaagggcgagagaggcacccccggcaucggcggcuuccccggccccagcggcaacgacggcagcgccggcccccccggcccccccggcagcgugggccccagaggccccgagggccugcagggccagaagggcgagagaggcccccccggcgagagaguggugggcgcccccggcgugcccggcgcccccggcgagagaggcgagcagggcagacccggccccgccggccccagaggcgagaagggcgaggccgcccugaccgaggacgacaucagaggcuucgugagacaggagaugagccagcacugcgccugccagggccaguucaucgccagcggcagcagaccccugcccagcuacgccgccgacaccgccggcagccagcugcacgccgugcccgugcugagagugagccacgccgaggaggaggagagagugccccccgaggacgacgaguacagcgaguacagcgaguacagcguggaggaguaccaggaccccgaggcccccugggacagcgacgaccccugcagccugccccuggacgagggcagcugcaccgccuacacccugagaugguaccacagagccgugaccggcagcaccgaggccugccaccccuucguguacggcggcugcggcggcaacgccaacagauucggcaccagagaggccugcgagagaagaugcccccccagaguggugcagagccagggcaccggcaccgcccaggacuaa

SEQ ID NO: 15488 - RNA, 2235 nt, Artificial Sequence
  COL8A1__Homo_sapiens__NP_065084
auggccgugcugcccggcccccugcagcugcugggcgugcugcugaccaucagccugagcagcaucagacugauccaggccggcgccuacuacggcaucaagccccugcccccccagauccccccccagaugcccccccagaucccccaguaccagccccugggccagcaggugccccacaugccccuggccaaggacggccuggccaugggcaaggagaugccccaccugcaguacggcaaggaguacccccaccugccccaguacaugaaggagauccagcccgcccccagaaugggcaaggaggccgugcccaagaagggcaaggagaucccccuggccagccugagaggcgagcagggccccagaggcgagcccggccccagaggcccccccggcccccccggccugcccggccacggcauccccggcaucaagggcaagcccggcccccagggcuaccccggcgugggcaagcccggcaugcccggcaugcccggcaagcccggcgccaugggcaugcccggcgccaagggcgagaucggccagaagggcgagaucggccccaugggcauccccggcccccagggcccccccggcccccacggccugcccggcaucggcaagcccggcggccccggccugcccggccagcccggccccaagggcgacagaggccccaagggccugcccggcccccagggccugagaggccccaagggcgacaagggcuucggcaugcccggcgcccccggcgugaagggcccccccggcaugcacggcccccccggccccgugggccugcccggcgugggcaagcccggcgugaccggcuuccccggcccccagggcccccugggcaagcccggcgcccccggcgagcccggcccccagggccccaucggcgugcccggcgugcagggcccccccggcauccccggcaucggcaagcccggccaggacggcauccccggccagcccggcuuccccggcggcaagggcgagcagggccugcccggccugcccggcccccccggccugcccggcaucggcaagcccggcuuccccggccccaagggcgacagaggcaugggcggcgugcccggcgcccugggccccagaggcgagaagggccccaucggcgcccccggcaucggcggcccccccggcgagcccggccugcccggcauccccggccccaugggcccccccggcgccaucggcuuccccggccccaagggcgagggcggcaucgugggcccccagggcccccccggccccaagggcgagcccggccugcagggcuuccccggcaagcccggcuuccugggcgaggugggcccccccggcaugagaggccugcccggccccaucggccccaagggcgaggccggccagaagggcgugcccggccugcccggcgugcccggccugcugggccccaagggcgagcccggcauccccggcgaccagggccugcagggcccccccggcauccccggcaucggcggccccagcggccccaucggcccccccggcauccccggccccaagggcgagcccggccugcccggcccccccggcuuccccggcaucggcaagcccggcguggccggccugcacggcccccccggcaagcccggcgcccugggcccccagggccagcccggccugcccggcccccccggcccccccggcccccccggcccccccgccgugaugccccccaccccccccccccagggcgaguaccugcccgacaugggccugggcaucgacggcgugaagcccccccacgccuacggcgccaagaagggcaagaacggcggccccgccuacgagaugcccgccuucaccgccgagcugaccgcccccuucccccccgugggcgcccccgugaaguucaacaagcugcuguacaacggcagacagaacuacaacccccagaccggcaucuucaccugcgaggugcccggcguguacuacuucgccuaccacgugcacugcaagggcggcaacguguggguggcccuguucaagaacaacgagcccgugauguacaccuacgacgaguacaagaagggcuuccuggaccaggccagcggcagcgccgugcugcugcugagacccggcgacagaguguuccugcagaugcccagcgagcaggccgccggccuguacgccggccaguacgugcacagcagcuucagcggcuaccugcuguaccccauguaa

SEQ ID NO: 15489 - RNA, 1917 nt, Artificial Sequence
  COL8A2__Homo_sapiens__NP_001281276
augccccugccccugcugcccauggaccugaagggcgagcccggcccccccggcaagcccggccccagaggcccccccggcccccccggcuuccccggcaagcccggcaugggcaagcccggccugcacggccagcccggccccgccggcccccccggcuucagcagaaugggcaaggccggcccccccggccugcccggcaaggugggcccccccggccagcccggccugagaggcgagcccggcaucagaggcgaccagggccugagaggcccccccggcccccccggccugcccggccccagcggcaucaccauccccggcaagcccggcgcccagggcgugcccggcccccccggcuuccagggcgagcccggcccccagggcgagcccggcccccccggcgacagaggccugaagggcgacaacggcgugggccagcccggccugcccggcgcccccggccagggcggcgcccccggcccccccggccugcccggccccgccggccugggcaagcccggccuggacggccugcccggcgcccccggcgacaagggcgagagcggcccccccggcgugcccggccccagaggcgagcccggcgccgugggccccaagggcccccccggcguggacggcgugggcgugcccggcgccgccggccugcccggcccccagggccccagcggcgccaagggcgagcccggcaccagaggcccccccggccugaucggccccaccggcuacggcaugcccggccugcccggccccaagggcgacagaggccccgccggcgugcccggccugcugggcgacagaggcgagcccggcgaggacggcgagcccggcgagcagggcccccagggccugggcggcccccccggccugcccggcagcgccggccugcccggcagaagaggcccccccggccccaagggcgaggccggccccggcggcccccccggcgugcccggcaucagaggcgaccagggccccagcggccuggccggcaagcccggcgugcccggcgagagaggccugcccggcgcccacggcccccccggccccaccggccccaagggcgagcccggcuucaccggcagacccggcggccccggcguggccggcgcccugggccagaagggcgaccugggccugcccggccagcccggccugagaggccccagcggcauccccggccugcagggccccgccggccccaucggcccccagggccugcccggccugaagggcgagcccggccugcccggcccccccggcgagggcagagccggcgagcccggcaccgccggccccaccggcccccccggcgugcccggcagccccggcaucaccggcccccccggcccccccggcccccccggcccccccggcgcccccggcgccuucgacgagaccggcaucgccggccugcaccugcccaacggcggcguggagggcgccgugcugggcaagggcggcaagccccaguucggccugggcgagcugagcgcccacgccacccccgccuucaccgccgugcugaccagccccuuccccgccagcggcaugcccgugaaguucgacagaacccuguacaacggccacagcggcuacaaccccgccaccggcaucuucaccugccccgugggcggcguguacuacuucgccuaccacgugcacgugaagggcaccaacguguggguggcccuguacaagaacaacgugcccgccaccuacaccuacgacgaguacaagaagggcuaccuggaccaggccagcggcggcgccgugcugcagcugagacccaacgaccaggugugggugcagaugcccagcgaccaggccaacggccuguacagcaccgaguacauccacagcagcuucagcggcuuccugcugugccccaccuaa

SEQ ID NO: 15490 - RNA, 2766 nt, Artificial Sequence
  COL9A1__Homo_sapiens__NP_001842
augaagaccugcuggaagauccccguguucuucuucgugugcagcuuccuggagcccugggccagcgccgccgugaagagaagacccagauuccccgugaacagcaacagcaacggcggcaacgagcugugccccaagaucagaaucggccaggacgaccugcccggcuucgaccugaucagccaguuccagguggacaaggccgccagcagaagagccauccagagaguggugggcagcgccacccugcagguggccuacaagcugggcaacaacguggacuucagaauccccaccagaaaccuguaccccagcggccugcccgaggaguacagcuuccugaccaccuucagaaugaccggcagcacccugaagaagaacuggaacaucuggcagauccaggacagcagcggcaaggagcaggugggcaucaagaucaacggccagacccagagcgugguguucagcuacaagggccuggacggcagccugcagaccgccgccuucagcaaccugagcagccuguucgacagccaguggcacaagaucaugaucggcguggagagaagcagcgccacccuguucguggacugcaacagaaucgagagccugcccaucaagcccagaggccccaucgacaucgacggcuucgccgugcugggcaagcuggccgacaacccccaggugagcgugcccuucgagcugcaguggaugcugauccacugcgacccccugagacccagaagagagaccugccacgagcugcccgccagaaucacccccagccagaccaccgacgagagaggcccccccggcgagcagggcccccccggcccccccggcccccccggcgugcccggcaucgacggcaucgacggcgacagaggccccaagggcccccccggcccccccggccccgccggcgagcccggcaagcccggcgcccccggcaagcccggcacccccggcgccgacggccugaccggccccgacggcagccccggcagcaucggcagcaagggccagaagggcgagcccggcgugcccggcagcagaggcuuccccggcagaggcauccccggcccccccggcccccccggcaccgccggccugcccggcgagcugggcagagugggccccgugggcgaccccggcagaagaggcccccccggcccccccggcccccccggccccagaggcaccaucggcuuccacgacggcgacccccugugccccaacgccugcccccccggcagaagcggcuaccccggccugcccggcaugagaggccacaagggcgccaagggcgagaucggcgagcccggcagacagggccacaagggcgaggagggcgaccagggcgagcugggcgaggugggcgcccagggcccccccggcgcccagggccugagaggcaucaccggcaucgugggcgacaagggcgagaagggcgccagaggccuggacggcgagcccggcccccagggccugcccggcgcccccggcgaccagggccagagaggcccccccggcgaggccggccccaagggcgacagaggcgccgagggcgccagaggcauccccggccugcccggccccaagggcgacaccggccugcccggcguggacggcagagacggcauccccggcaugcccggcaccaagggcgagcccggcaagcccggcccccccggcgacgccggccugcagggccugcccggcgugcccggcauccccggcgccaagggcguggccggcgagaagggcagcaccggcgcccccggcaagcccggccagaugggcaacagcggcaagcccggccagcagggcccccccggcgaggugggccccagaggcccccagggccugcccggcagcagaggcgagcugggccccgugggcagccccggccugcccggcaagcugggcagccugggcagccccggccugcccggccugcccggcccccccggccugcccggcaugaagggcgacagaggcguggugggcgagcccggccccaagggcgagcagggcgccagcggcgaggagggcgaggccggcgagagaggcgagcugggcgacaucggccugcccggccccaagggcagcgccggcaaccccggcgagcccggccugagaggccccgagggcagcagaggccugcccggcguggagggccccagaggcccccccggccccagaggcgugcagggcgagcagggcgccaccggccugcccggcgugcagggcccccccggcagagcccccaccgaccagcacaucaagcaggugugcaugagagugauccaggagcacuucgccgagauggccgccagccugaagagacccgacagcggcgccaccggccugcccggcagacccggcccccccggcccccccggcccccccggcgagaacggcuuccccggccagaugggcaucagaggccugcccggcaucaagggcccccccggcgcccugggccugagaggccccaagggcgaccugggcgagaagggcgagagaggcccccccggcagaggccccaacggccugcccggcgccaucggccugcccggcgaccccggccccgccagcuacggcagaaacggcagagacggcgagagaggcccccccggcguggccggcauccccggcgugcccggcccccccggcccccccggccugcccggcuucugcgagcccgccagcugcaccaugcaggccggccagagagccuucaacaagggccccgaccccuaa

SEQ ID NO: 15491 - RNA, 1215 nt, Artificial Sequence
  COL9A2__Homo_sapiens__XP_011539020
auggccgccgccaccgccagccccagaagccugcuggugcugcugcaggugguggugcuggcccuggcccagaucagaggcccccccggcgagagaggcccccccggcccccccggcccccccggcgugcccggcagcgacggcaucgacggcgacaacggcccccccggcaaggccggcccccccggccccaagggcgagcccggcaaggccggccccgacggccccgacggcaagcccggcaucgacggccugaccggcgccaagggcgagcccggccccaugggcauccccggcgugaagggccagcccggccugcccggcccccccggccugcccggccccggcuucgccggcccccccggcccccccggccccgugggccugcccggcgagaucggcaucagaggccccaagggcgaccccggccccgacggccccagcggcccccccggcccccccggcaagcccggcagacccggcaccauccagggccuggagggcagcgccgacuuccuggugagagacgagugccccaccaacugcccccccggcaugaagggcccccccggccugcagggcgugaagggccacgccggcaagagaggcauccugggcgaccccggccaccagggcaagcccggccccaagggcgacgugggcgccagcggcgagcagggcauccccggcccccccggcccccagggcaucagaggcuaccccggcauggccggccccaagggcgagaccggcccccacggcuacaagggcauggugggcgccaucggcgccaccggcccccccggcgaggagggccccagaggcccccccggcagagccggcgagaagggcgacgagggcagccccggcaucagaggcccccagggcaucaccggccccaagggcgccaccggcccccccggcaucaacggcaaggacggcacccccggcacccccggcaugaagggcagcgccggccaggccggccagcccggcagccccggccaccagggccuggccacccccggccccggcagacaggccauccugugcgccccccugcugugccaccacugcggcaacgugcagcugagcagcagcugcagaggcuggaccuucugcugcagcgcccccaccggcggcggcaaccuggacuggggcugggaggccaagcagcaggugcacggcgcccccagcugccagggcagaaacuaa

SEQ ID NO: 15492 - RNA, 2055 nt, Artificial Sequence
  COL9A3__Homo_sapiens__NP_001844
auggccggccccagagccugcgccccccugcugcugcugcugcugcugggcgagcugcuggccgccgccggcgcccagagagugggccugcccggcccccccggcccccccggcccccccggcaagcccggccaggacggcaucgacggcgaggccggcccccccggccugcccggcccccccggccccaagggcgcccccggcaagcccggcaagcccggcgaggccggccugcccggccugcccggcguggacggccugaccggcagagacggcccccccggccccaagggcgcccccggcgagagaggcagccugggcccccccggcccccccggccugggcggcaagggccugcccggcccccccggcgaggccggcgugagcggcccccccggcggcaucggccugagaggcccccccggccccagcggccugcccggccugcccggcccccccggcccccccggcccccccggccaccccggcgugcugcccgagggcgccaccgaccugcagugccccagcaucugcccccccggcccccccggcccccccggcaugcccggcuucaagggccccaccggcuacaagggcgagcagggcgaggugggcaaggacggcgagaagggcgaccccggcccccccggccccgccggccugcccggcagcgugggccugcagggccccagaggccugagaggccugcccggcccccugggcccccccggcgacagaggccccaucggcuucagaggcccccccggcauccccggcgcccccggcaaggccggcgacagaggcgagagaggccccgagggcuucagaggccccaagggcgaccugggcagacccggccccaagggcacccccggcguggccggccccagcggcgagcccggcaugcccggcaaggacggccagaacggcgugcccggccuggacggccagaagggcgaggccggcagaaacggcgcccccggcgagaagggccccaacggccugcccggccugcccggcagagccggcagcaagggcgagaagggcgagagaggcagagccggcgagcugggcgaggccggccccagcggcgagcccggcgugcccggcgacgccggcaugcccggcgagagaggcgaggccggccacagaggcagcgccggcgcccugggcccccagggcccccccggcgcccccggcgugagaggcuuccagggccagaagggcagcaugggcgaccccggccugcccggcccccagggccugagaggcgacgugggcgacagaggccccggcggcgccgccggccccaagggcgaccagggcaucgccggcagcgacggccugcccggcgacaagggcgagcugggccccagcggccuggugggccccaagggcgagagcggcagcagaggcgagcugggccccaagggcacccagggccccaacggcaccagcggcgugcagggcgugcccggcccccccggcccccugggccugcagggcgugcccggcgugcccggcaucaccggcaagcccggcgugcccggcaaggaggccagcgagcagagaaucagagagcugugcggcggcaugaucagcgagcagaucgcccagcuggccgcccaccugagaaagccccuggcccccggcagcaucggcagacccggccccgccggcccccccggcccccccggcccccccggcagcaucggccaccccggcgccagaggcccccccggcuacagaggccccaccggcgagcugggcgaccccggccccagaggcaaccagggcgacagaggcgacaagggcgccgccggcgccggccuggacggccccgagggcgaccagggcccccagggcccccagggcgugcccggcaccagcaaggacggccaggacggcgcccccggcgagcccggcccccccggcgaccccggccugcccggcgccaucggcgcccagggcacccccggcaucugcgacaccagcgccugccagggcgccgugcugggcggcgugggcgagaagagcggcagcagaagcagcuaa

SEQ ID NO: 15493 - RNA, 375 nt, Artificial Sequence
  COLCA1__Homo_sapiens__NP_001289574
auggagagcugcagcguggcccaggccggcgugcugaccagccccuucauguggagauggaccggcauggccggcgcccugagcgcccuggacaacaccaucgaggacgacgccgacgaccagcugcccugcggcgagggcagacccggcugggugagaggcgagcugcugggcagccagggcgugugcaaggacagcaaggaccuguucgugcccaccagcagcagccuguacggcugcuucugcgugggccuggugagcggcauggccaucagcgugcugcugcuggccagcgacuucagaaagcuggacuucagcagacccgagcccugcuucgagaaggaggccagccugugguucguggcccagcacuaa

SEQ ID NO: 15494 - RNA, 465 nt, Artificial Sequence
  COLCA2__Homo_sapiens__NP_001258386
augcaccccgagccccugcugaacagcacccagagcgccccccaccacuuccccgacagcuuccaggccacccccuucugcuucaaccagagccugauccccggcagccccagcaacagcagcauccugagcggcagccuggacuacagcuacagccccgugcagcugcccagcuacgcccccgagaacuacaacagccccgccagccuggacaccagaaccugcggcuacccccccgaggaccacagcuaccagcaccugagcagccacgcccaguacagcugcuucagcagcgccaccaccagcaucugcuacugcgccagcugcgaggccgaggaccuggacgcccugcaggccgccgaguacuucuaccccagcaccgacugcguggacuucgcccccagcgccgccgccaccagcgacuucuacaagagagagaccaacugcgacaucugcuacagcuaa

SEQ ID NO: 15495 - RNA, 834 nt, Artificial Sequence
  COLEC10__Homo_sapiens__NP_006429
augaacggcuucgccagccugcugagaagaaaccaguucauccugcuggugcuguuccugcugcagauccagagccugggccuggacaucgacagcagacccaccgccgaggugugcgccacccacaccaucagccccggccccaagggcgacgacggcgagaagggcgaccccggcgaggagggcaagcacggcaaggugggcagaaugggccccaagggcaucaagggcgagcugggcgacaugggcgaccagggcaacaucggcaagaccggccccaucggcaagaagggcgacaagggcgagaagggccugcugggcauccccggcgagaagggcaaggccggcaccgugugcgacugcggcagauacagaaaguucgugggccagcuggacaucagcaucgccagacugaagaccagcaugaaguucgugaagaacgugaucgccggcaucagagagaccgaggagaaguucuacuacaucgugcaggaggagaagaacuacagagagagccugacccacugcagaaucagaggcggcaugcuggccaugcccaaggacgaggccgccaacacccugaucgccgacuacguggccaagagcggcuucuucagaguguucaucggcgugaacgaccuggagagagagggccaguacauguucaccgacaacaccccccugcagaacuacagcaacuggaacgagggcgagcccagcgaccccuacggccacgaggacugcguggagaugcugagcagcggcagauggaacgacaccgagugccaccugaccauguacuucgugugcgaguucaucaagaagaagaaguaa

SEQ ID NO: 15496 - RNA, 744 nt, Artificial Sequence
  COLEC11__Homo_sapiens__NP_001242912
augagaggcaaccuggcccuggugggcgugcugaucagccuggccuuccugagccugcugcccagcggccacccccagcccgccggcgacgacgccugcagcgugcagauccuggugcccggccugaagggcgacgccggcgagaagggcgacaagggcgcccccggcagacccggcagagugggccccaccggcgagaagggcgagaagggcgacagcggcgacaucggcccccccggccccaacggcgagcccggccugcccugcgagugcagccagcugagaaaggccaucggcgagauggacaaccaggugagccagcugaccagcgagcugaaguucaucaagaacgccguggccggcgugagagagaccgagagcaagaucuaccugcuggugaaggaggagaagagauacgccgacgcccagcugagcugccagggcagaggcggcacccugagcaugcccaaggacgaggccgccaacggccugauggccgccuaccuggcccaggccggccuggccagaguguucaucggcaucaacgaccuggagaaggagggcgccuucguguacagcgaccacagccccaugagaaccuucaacaaguggagaagcggcgagcccaacaacgccuacgacgaggaggacugcguggagaugguggccagcggcggcuggaacgacguggccugccacaccaccauguacuucaugugcgaguucgacaaggagaacauguaa

SEQ ID NO: 15497 - RNA, 2229 nt, Artificial Sequence
  COLEC12__Homo_sapiens__NP_569057
augaaggacgacuucgccgaggaggaggaggugcagagcuucggcuacaagagauucggcauccaggagggcacccagugcaccaagugcaagaacaacugggcccugaaguucagcaucauccugcuguacauccugugcgcccugcugaccaucaccguggccauccugggcuacaaggugguggagaagauggacaacgugaccggcggcauggagaccagcagacagaccuacgacgacaagcugaccgccguggagagcgaccugaagaagcugggcgaccagaccggcaagaaggccaucagcaccaacagcgagcugagcaccuucagaagcgacauccuggaccugagacagcagcugagagagaucaccgagaagaccagcaagaacaaggacacccuggagaagcugcaggccagcggcgacgcccugguggacagacagagccagcugaaggagacccuggagaacaacagcuuccugaucaccaccgugaacaagacccugcaggccuacaacggcuacgugaccaaccugcagcaggacaccagcgugcugcagggcaaccugcagaaccagauguacagccacaacguggugaucaugaaccugaacaaccugaaccugacccaggugcagcagagaaaccugaucaccaaccugcagagaagcguggacgacaccagccaggccauccagagaaucaagaacgacuuccagaaccugcagcagguguuccugcaggccaagaaggacaccgacuggcugaaggagaaggugcagagccugcagacccuggccgccaacaacagcgcccuggccaaggccaacaacgacacccuggaggacaugaacagccagcugaacagcuucaccggccagauggagaacaucaccaccaucagccaggccaacgagcagaaccugaaggaccugcaggaccugcacaaggacgccgagaacagaaccgccaucaaguucaaccagcuggaggagagauuccagcuguucgagaccgacaucgugaacaucaucagcaacaucagcuacaccgcccaccaccugagaacccugaccagcaaccugaacgaggugagaaccaccugcaccgacacccugaccaagcacaccgacgaccugaccagccugaacaacacccuggccaacaucagacuggacagcgugagccugagaaugcagcaggaccugaugagaagcagacuggacaccgagguggccaaccugagcgugaucauggaggagaugaagcugguggacagcaagcacggccagcugaucaagaacuucaccauccugcagggcccccccggccccagaggccccagaggcgacagaggcagccagggcccccccggccccaccggcaacaagggccagaagggcgagaagggcgagcccggcccccccggccccgccggcgagagaggccccaucggccccgccggcccccccggcgagagaggcggcaagggcagcaagggcagccagggccccaagggcagcagaggcagccccggcaagcccggcccccagggccccagcggcgaccccggcccccccggcccccccggcaaggagggccugcccggcccccagggcccccccggcuuccagggccugcagggcaccgugggcgagcccggcgugcccggccccagaggccugcccggccugcccggcgugcccggcaugcccggccccaagggcccccccggcccccccggccccagcggcgccguggugccccuggcccugcagaacgagcccacccccgcccccgaggacaacggcugccccccccacuggaagaacuucaccgacaagugcuacuacuucagcguggagaaggagaucuucgaggacgccaagcuguucugcgaggacaagagcagccaccugguguucaucaacaccagagaggagcagcaguggaucaagaagcagauggugggcagagagagccacuggaucggccugaccgacagcgagagagagaacgaguggaaguggcuggacggcaccagccccgacuacaagaacuggaaggccggccagcccgacaacuggggccacggccacggccccggcgaggacugcgccggccugaucuacgccggccaguggaacgacuuccagugcgaggacgugaacaacuucaucugcgagaaggacagagagaccgugcugagcagcgcccuguaa

SEQ ID NO: 15498 - RNA, 1665 nt, Artificial Sequence
  COLGALT2__Homo_sapiens__NP_001290349
auggccgccagacccgccgccacccuggccuggagccugcugcugcugagcagcgcccugcugagagagggcugcagagccagauucguggccgagagagacagcgaggacgacggcgaggagcccgugguguuccccgagagcccccugcagagccccaccgugcugguggccgugcuggccagaaacgccgcccacacccugccccacuuccugggcugccuggagagacuggacuaccccaagagcagaauggccaucugggccgccaccgaccacaacguggacaacaccaccgagaucuucagagaguggcugaagaacgugcagagacuguaccacuacguggaguggagacccauggacgagcccgagagcuaccccgacgagaucggccccaagcacuggcccaccagcagauucgcccacgugaugaagcugagacaggccgcccugagaaccgccagagagaaguggagcgacuacauccuguucaucgacguggacaacuuccugaccaacccccagacccugaaccugcugaucgccgagaacaagaccaucguggcccccaugcuggagagcagaggccuguacagcaacuucuggugcggcaucacccccaagggcuucuacaagagaacccccgacuacgugcagaucagagaguggaagagaaccggcugcuuccccgugcccauggugcacagcaccuuccugaucgaccugagaaaggaggccagcgacaagcugaccuucuaccccccccaccaggacuacaccuggaccuucgacgacaucaucguguucgccuucagcagcagacaggccggcauccagauguaccugugcaacagagagcacuacggcuaccugcccaucccccugaagccccaccagacccugcaggaggacaucgagaaccugauccacgugcagaucgaggccaugaucgacagaccccccauggagcccagccaguacgugagcguggugcccaaguaccccgacaagaugggcuucgacgagaucuucaugaucaaccugaagagaagaaaggacagaagagacagaaugcugagaacccuguacgagcaggagaucgaggugaagaucguggaggccguggacggcaaggcccugaacaccagccagcugaaggcccugaacaucgagaugcugcccggcuacagagaccccuacagcagcagaccccugaccagaggcgagaucggcugcuuccugagccacuacagcguguggaaggaggugaucgacagagagcuggagaagacccuggugaucgaggacgacgugagauucgagcaccaguucaagaagaagcugaugaagcugauggacaacaucgaccaggcccagcuggacugggagcugaucuacaucggcagaaagagaaugcaggugaaggagcccgagaaggccgugcccaacguggccaaccugguggaggccgacuacagcuacuggacccugggcuacgugaucagccuggagggcgcccagaagcuggugggcgccaaccccuucggcaagaugcugcccguggacgaguuccugcccgugauguacaacaagcaccccgugcugcugagcagcccccacugccaccuguuccagacccugagcgacgacugccagagauaa

SEQ ID NO: 15499 - RNA, 1368 nt, Artificial Sequence
  COLQ__Homo_sapiens__NP_005668
augguggugcugaaccccaugacccugggcaucuaccugcagcuguucuuccugagcaucgugagccagcccaccuucaucaacagcgugcugcccaucagcgccgcccugcccagccuggaccagaagaagagaggcggccacaaggccugcugccugcugaccccccccccccccccccuguuccccccccccuucuucagaggcggcagaagcccccugcugagccccgacaugaagaaccugaugcuggagcuggagaccagccagagccccugcaugcagggcagccugggcagccccggcccccccggcccccagggcccccccggccugcccggcaagaccggccccaagggcgagaagggcgagcugggcagacccggcagaaagggcagacccggcccccccggcgugcccggcaugcccggccccaucggcuggcccggccccgagggccccagaggcgagaagggcgaccugggcaugaugggccugcccggcagcagaggccccaugggcagcaagggcuaccccggcagcagaggcgagaagggcagcagaggcgagaagggcgaccugggccccaagggcgagaagggcuuccccggcuuccccggcaugcugggccagaagggcgagaugggccccaagggcgagcccggcaucgccggccacagaggccccaccggcagacccggcaagagaggcaagcagggccagaagggcgacagcggcgugaugggcccccccggcaagcccggccccagcggccagcccggcagacccggcccccccggccccccccccgccggccagcugaucaugggccccaagggcgagagaggcuuccccggcccccccggcagaugccugugcggccccaccaugaacgugaacaaccccagcuacggcgagagcguguacggccccagcagccccagagugcccgugaucuucguggugaacaaccaggaggagcuggagagacugaacacccagaacgccaucgccuucagaagagaccagagaagccuguacuucaaggacagccugggcuggcugcccauccagcugacccccuucuaccccguggacuacaccgccgaccagcacggcaccugcggcgacggccugcugcagcccggcgaggagugcgacgacggcaacagcgacgugggcgacgacugcaucagaugccacagagccuacugcggcgacggccacagacacgagggcguggaggacugcgacggcagcgacuucggcuaccugaccugcgagaccuaccugcccggcagcuacggcgaccugcagugcacccaguacugcuacaucgacagcacccccugcagauacuucaccuaa

SEQ ID NO: 15500 - RNA, 609 nt, Artificial Sequence
  COMMD10__Homo_sapiens__NP_057228
auggccgugcccgccgcccugauccugagagagagccccagcaugaagaaggccgugagccugaucaacgccaucgacaccggcagauuccccagacugcugaccagaauccugcagaagcugcaccugaaggccgagagcagcuucagcgaggaggaggaggagaagcugcaggccgccuucagccuggagaagcaggaccugcaccuggugcuggagaccaucagcuucauccuggagcaggccguguaccacaacgugaagcccgccgcccugcagcagcagcuggagaacauccaccugagacaggacaaggccgaggccuucgugaacaccuggagcagcaugggccaggagaccguggagaaguucagacagagaauccuggcccccugcaagcuggagaccgugggcuggcagcugaaccugcagauggcccacagcgcccaggccaagcugaagagcccccaggccgugcugcagcugggcgugaacaacgaggacagcaagagccuggagaaggugcugguggaguucagccacaaggagcuguucgacuucuacaacaagcuggagaccauccaggcccagcuggacagccugaccuaa

SEQ ID NO: 15501 - RNA, 573 nt, Artificial Sequence
  COMMD1__Homo_sapiens__NP_689729
auggccgccggcgagcuggagggcggcaagccccugagcggccugcugaacgcccuggcccaggacaccuuccacggcuaccccggcaucaccgaggagcugcugagaagccagcuguaccccgaggugccccccgaggaguucagacccuuccuggccaagaugagaggcauccugaagagcaucgccagcgccgacauggacuucaaccagcuggaggccuuccugaccgcccagaccaagaagcagggcggcaucaccagcgaccaggccgccgugaucagcaaguucuggaagagccacaagaccaagaucagagagagccugaugaaccagagcagauggaacagcggccugagaggccugagcuggagaguggacggcaagagccagagcagacacagcgcccagauccacacccccguggccaucaucgagcuggagcugggcaaguacggccaggagagcgaguuccugugccuggaguucgacgaggugaaggugaaccagauccugaagacccugagcgagguggaggagagcaucagcacccugaucagccagcccaacuaa

SEQ ID NO: 15502 - RNA, 1410 nt, Artificial Sequence
  COMMD3-BMI1__Homo_sapiens__NP_001190991
auggagcugagcgagagcgugcagaagggcuuccagaugcuggccgaccccagaagcuucgacagcaacgccuucacccugcugcugagagccgccuuccagagccugcuggacgcccaggccgacgaggccgugcuggaccaccccgaccugaagcacaucgaccccguggugcugaagcacugccacgccgccgccgccaccuacauccuggaggccggcaagcacagagccgacaagagcacccugagcaccuaccuggaggacugcaaguucgacagagagagaaucgagcuguucugcaccgaguaccagaacaacaagaacagccuggagauccugcugggcagaacccugaucccccaccccauccagagacuggugcugguggccgccuggaacaacuacagaaucuucuaccaggccgagaugcacagaaccaccagaaucaagaucaccgagcugaacccccaccugaugugcgugcugugcggcggcuacuucaucgacgccaccaccaucaucgagugccugcacagcuucugcaagaccugcaucgugagauaccuggagaccagcaaguacugccccaucugcgacgugcaggugcacaagaccagaccccugcugaacaucagaagcgacaagacccugcaggacaucguguacaagcuggugcccggccuguucaagaacgagaugaagagaagaagagacuucuacgccgcccaccccagcgccgacgccgccaacggcagcaacgaggacagaggcgagguggccgacgaggacaagagaaucaucaccgacgacgagaucaucagccugagcaucgaguucuucgaccagaacagacuggacagaaaggugaacaaggacaaggagaagagcaaggaggaggugaacgacaagagauaccugagaugccccgccgccaugaccgugaugcaccugagaaaguuccugagaagcaagauggacauccccaacaccuuccagaucgacgugauguacgaggaggagccccugaaggacuacuacacccugauggacaucgccuacaucuacaccuggagaagaaacggcccccugccccugaaguacagagugagacccaccugcaagagaaugaagaucagccaccagagagacggccugaccaacgccggcgagcuggagagcgacagcggcagcgacaaggccaacagccccgccggcggcauccccagcaccagcagcugccugcccagccccagcacccccgugcagagcccccacccccaguucccccacaucagcagcaccaugaacggcaccagcaacagccccagcggcaaccaccagagcagcuucgccaacagacccagaaagagcagcgugaacggcagcagcgccaccagcagcggcuaa

SEQ ID NO: 15503 - RNA, 675 nt, Artificial Sequence
  COMMD5__Homo_sapiens__NP_054785
augagcgccgugggcgccgccacccccuaccugcaccaccccggcgacagccacagcggcagagugagcuuccugggcgcccagcugccccccgagguggccgccauggccagacugcugggcgaccuggacagaagcaccuucagaaagcugcugaaguucguggugagcagccugcagggcgaggacugcagagaggccgugcagagacugggcgugagcgccaaccugcccgaggagcagcugggcgcccugcuggccggcaugcacacccugcugcagcaggcccugagacugccccccaccagccugaagcccgacaccuucagagaccagcugcaggagcugugcaucccccaggaccuggugggcgaccuggccagcgugguguucggcagccagagaccccugcuggacagcguggcccagcagcagggcgccuggcugccccacguggccgacuucagauggagaguggacguggccaucagcaccagcgcccuggccagaagccugcagcccagcgugcugaugcagcugaagcugagcgacggcagcgccuacagauucgaggugcccaccgccaaguuccaggagcugagauacagcguggcccuggugcugaaggagauggccgaccuggagaagagaugcgagagaagacugcaggacuaa

SEQ ID NO: 15504 - RNA, 600 nt, Artificial Sequence
  COMMD7__Homo_sapiens__NP_001092809
augggcagacugcacugcaccgaggaccccgugcccgaggccgugggcggcgacaugcagcagcugaaccagcugggcgcccaguucagcgcccugaccgaggugcuguuccacuuccugaccgagcccaaggagguggagagauuccuggcccagcugagcgaguucgccaccaccaaccagaucagccugggcagccugagaagcaucgugaagagccugcugcuggugcccaacggcgcccugaagaagagccugaccgccaagcaggugcaggccgacuucaucacccugggccugagcgaggagaaggccaccuacuucagcgagaaguggaagcagaacgcccccacccuggccagaugggccaucggccagacccugaugaucaaccagcugaucgacauggaguggaaguucggcgugaccagcggcagcagcgagcuggagaaggugggcagcaucuuccugcagcugaagcugguggugaagaagggcaaccagaccgagaacguguacaucgagcugacccugccccaguucuacagcuuccugcacgagauggagagagugagaaccagcauggagugcuucugcuaa

SEQ ID NO: 15505 - RNA, 2274 nt, Artificial Sequence
  COMP__Homo_sapiens__NP_000086
auggugcccgacaccgccugcgugcugcugcugacccuggccgcccugggcgccagcggccagggccagagcccccugggcagcgaccugggcccccagaugcugagagagcugcaggagaccaacgccgcccugcaggacgugagagagcugcugagacagcaggugagagagaucaccuuccugaagaacaccgugauggagugcgacgccugcggcaugcagcagagcgugagaaccggccugcccagcgugagaccccugcugcacugcgcccccggcuucugcuuccccggcguggccugcauccagaccgagagcggcgccagaugcggccccugccccgccggcuucaccggcaacggcagccacugcaccgacgugaacgagugcaacgcccaccccugcuuccccagagugagaugcaucaacaccagccccggcuucagaugcgaggccugcccccccggcuacagcggccccacccaccagggcgugggccuggccuucgccaaggccaacaagcaggugugcaccgacaucaacgagugcgagaccggccagcacaacugcgugcccaacagcgugugcaucaacaccagaggcagcuuccagugcggccccugccagcccggcuucgugggcgaccaggccagcggcugccagagaagagcccagagauucugccccgacggcagccccagcgagugccacgagcacgccgacugcgugcuggagagagacggcagcagaagcugcgugugcgccgugggcugggccggcaacggcauccugugcggcagagacaccgaccuggacggcuuccccgacgagaagcugagaugccccgagagacagugcagaaaggacaacugcgugaccgugcccaacagcggccaggaggacguggacagagacggcaucggcgacgccugcgaccccgacgccgacggcgacggcgugcccaacgagaaggacaacugcccccuggugagaaaccccgaccagagaaacaccgacgaggacaaguggggcgacgccugcgacaacugcagaagccagaagaacgacgaccagaaggacaccgaccaggacggcagaggcgacgccugcgacgacgacaucgacggcgacagaaucagaaaccaggccgacaacugccccagagugcccaacagcgaccagaaggacagcgacggcgacggcaucggcgacgccugcgacaacugcccccagaagagcaaccccgaccaggccgacguggaccacgacuucgugggcgacgccugcgacagcgaccaggaccaggacggcgacggccaccaggacagcagagacaacugccccaccgugcccaacagcgcccaggaggacagcgaccacgacggccagggcgacgccugcgacgacgacgacgacaacgacggcgugcccgacagcagagacaacugcagacuggugcccaaccccggccaggaggacgccgacagagacggcgugggcgacgugugccaggacgacuucgacgccgacaaggugguggacaagaucgacgugugccccgagaacgccgaggugacccugaccgacuucagagccuuccagaccguggugcuggaccccgagggcgacgcccagaucgaccccaacuggguggugcugaaccagggcagagagaucgugcagaccaugaacagcgaccccggccuggccgugggcuacaccgccuucaacggcguggacuucgagggcaccuuccacgugaacaccgugaccgacgacgacuacgccggcuucaucuucggcuaccaggacagcagcagcuucuacguggugauguggaagcagauggagcagaccuacuggcaggccaaccccuucagagccguggccgagcccggcauccagcugaaggccgugaagagcagcaccggccccggcgagcagcugagaaacgcccuguggcacaccggcgacaccgagagccaggugagacugcuguggaaggaccccagaaacgugggcuggaaggacaagaagagcuacagaugguuccugcagcacagaccccaggugggcuacaucagagugagauucuacgagggccccgagcugguggccgacagcaacguggugcuggacaccaccaugagaggcggcagacugggcguguucugcuucagccaggagaacaucaucugggccaaccugagauacagaugcaacgacaccauccccgaggacuacgagacccaccagcugagacaggccuaa

SEQ ID NO: 15506 - RNA, 816 nt, Artificial Sequence
  COMT__Homo_sapiens__NP_001128634
augcccgaggcccccccccugcugcuggccgccgugcugcugggccuggugcugcugguggugcugcugcugcugcugagacacuggggcuggggccugugccugaucggcuggaacgaguucauccugcagcccauccacaaccugcugaugggcgacaccaaggagcagagaauccugaaccacgugcugcagcacgccgagcccggcaacgcccagagcgugcuggaggccaucgacaccuacugcgagcagaaggagugggccaugaacgugggcgacaagaagggcaagaucguggacgccgugauccaggagcaccagcccagcgugcugcuggagcugggcgccuacugcggcuacagcgccgugagaauggccagacugcugagccccggcgccagacugaucaccaucgagaucaaccccgacugcgccgccaucacccagagaaugguggacuucgccggcgugaaggacaaggugacccugguggugggcgccagccaggacaucaucccccagcugaagaagaaguacgacguggacacccuggacaugguguuccuggaccacuggaaggacagauaccugcccgacacccugcugcuggaggagugcggccugcugagaaagggcaccgugcugcuggccgacaacgugaucugccccggcgcccccgacuuccuggcccacgugagaggcagcagcugcuucgagugcacccacuaccagagcuuccuggaguacagagaggugguggacggccuggagaaggccaucuacaagggccccggcagcgaggccggccccuaa

SEQ ID NO: 15507 - RNA, 3702 nt, Artificial Sequence
  COPA__Homo_sapiens__NP_001091868
augcugaccaaguucgagaccaagagcgccagagugaagggccugagcuuccaccccaagagacccuggauccugaccagccugcacaacggcgugauccagcugugggacuacagaaugugcacccugaucgacaaguucgacgagcacgacggccccgugagaggcaucgacuuccacaagcagcagccccuguucgugagcggcggcgacgacuacaagaucaagguguggaacuacaagcugagaagaugccuguucacccugcugggccaccuggacuacaucagaaccaccuucuuccaccacgaguaccccuggauccugagcgccagcgacgaccagaccaucagaguguggaacuggcagagcagaaccugcgugugcgugcugaccggccacaaccacuacgugaugugcgcccaguuccaccccaccgaggaccugguggugagcgccagccuggaccagaccgugagagugugggacaucagcggccugagaaagaagaaccugagccccggcgccguggagagcgacgugagaggcaucaccggcguggaccuguucggcaccaccgacgccguggugaagcacgugcuggagggccacgacagaggcgugaacugggccgccuuccaccccaccaugccccugaucgugagcggcgccgacgacagacaggugaagaucuggagaaugaacgagagcaaggccugggagguggacaccugcagaggccacuacaacaacgugagcugcgccguguuccaccccagacaggagcugauccugagcaacagcgaggacaagagcaucagagugugggacaugagcaagagaaccggcgugcagaccuucagaagagaccacgacagauucugggugcuggccgcccaccccaaccugaaccuguucgccgccggccacgacggcggcaugaucguguucaagcuggagagagagagacccgccuacgccgugcacggcaacaugcugcacuacgugaaggacagauuccugagacagcuggacuucaacagcagcaaggacguggccgugaugcagcugagaagcggcagcaaguuccccguguucaacaugagcuacaaccccgccgagaacgccgugcugcugugcaccagagccagcaaccuggagaacagcaccuacgaccuguacaccauccccaaggacgccgacagccagaaccccgacgcccccgagggcaagagaagcagcggccugaccgccguguggguggccagaaacagauucgccgugcuggacagaaugcacagccugcugaucaagaaccugaagaacgagaucaccaagaaggugcaggugcccaacugcgacgagaucuucuacgccggcaccggcaaccugcugcugagagacgccgacagcaucacccuguucgacgugcagcagaagagaacccuggccagcgugaagaucagcaaggugaaguacgugaucuggagcgccgacaugagccacguggcccugcuggccaagcacgagcacagcugcccccugccccugaccgccaucgugaucugcaacagaaagcuggacgcccugugcaacauccacgagaacaucagagugaagagcggcgccugggacgagagcggcguguucaucuacaccaccagcaaccacaucaaguacgccgugaccaccggcgaccacggcaucaucagaacccuggaccugcccaucuacgugaccagagugaagggcaacaacguguacugccuggacagagagugcagacccagagugcugaccaucgaccccaccgaguucaaguucaagcuggcccugaucaacagaaaguacgacgaggugcugcacauggugagaaacgccaagcuggugggccagagcaucaucgccuaccugcagaagaagggcuaccccgagguggcccugcacuucgugaaggacgagaagaccagauucagccuggcccuggagugcggcaacaucgagaucgcccuggaggccgccaaggcccuggacgacaagaacugcugggagaagcugggcgagguggcccugcugcagggcaaccaccagaucguggagaugugcuaccagagaaccaagaacuucgacaagcugagcuuccuguaccugaucaccggcaaccuggagaagcugagaaagaugaugaagaucgccgagaucagaaaggacaugagcggccacuaccagaacgcccuguaccugggcgacgugagcgagagagugagaauccugaagaacugcggccagaagagccuggccuaccugaccgccgccacccacggccuggacgaggaggccgagagccugaaggagaccuucgaccccgagaaggagaccauccccgacaucgaccccaacgccaagcugcugcagccccccgcccccaucaugccccuggacaccaacuggccccugcugaccgugagcaagggcuucuucgagggcaccaucgccagcaagggcaagggcggcgcccuggccgccgacaucgacaucgacaccgugggcaccgagggcuggggcgaggacgccgagcugcagcuggacgaggacggcuucguggaggccaccgagggccugggcgacgacgcccugggcaagggccaggaggagggcggcggcugggacguggaggaggaccuggagcugccccccgagcuggacaucagccccggcgccgccggcggcgccgaggacggcuucuucgugccccccaccaagggcaccagccccacccagaucuggugcaacaacagccagcugcccguggaccacauccuggccggcagcuucgagaccgccaugagacugcugcacgaccaggugggcgugauccaguucggccccuacaagcagcuguuccugcagaccuacgccagaggcagaaccaccuaccaggcccugcccugccugcccagcauguacggcuaccccaacagaaacuggaaggacgccggccugaagaacggcgugcccgccgugggccugaagcugaacgaccugauccagagacugcagcugugcuaccagcugaccaccgugggcaaguucgaggaggccguggagaaguucagaagcauccugcugagcgugccccugcuggugguggacaacaagcaggagaucgccgaggcccagcagcugaucaccaucugcagagaguacaucgugggccugagcguggagaccgagagaaagaagcugcccaaggagacccuggagcagcagaagagaaucugcgagauggccgccuacuucacccacagcaaccugcagcccgugcacaugauccuggugcugagaaccgcccugaaccuguucuucaagcugaagaacuucaagaccgccgccaccuucgccagaagacugcuggagcugggccccaagcccgagguggcccagcagaccagaaagauccugagcgccugcgagaagaaccccaccgacgccuaccagcugaacuacgacaugcacaaccccuucgacaucugcgccgccagcuacagacccaucuacagaggcaagcccguggagaagugcccccugagcggcgccugcuacagccccgaguucaagggccagaucugcagagugaccaccgugaccgagaucggcaaggacgugaucggccugagaaucagcccccugcaguucagauaa

SEQ ID NO: 15508 - RNA, 2862 nt, Artificial Sequence
  COPB1__Homo_sapiens__NP_057535
augaccgccgccgagaacgugugcuacacccugaucaacgugcccauggacagcgagccccccagcgagaucagccugaagaacgaccuggagaagggcgacgugaagagcaagaccgaggcccugaagaaggugaucaucaugauccugaacggcgagaagcugcccggccugcugaugaccaucaucagauucgugcugccccugcaggaccacaccaucaagaagcugcugcugguguucugggagaucgugcccaagaccacccccgacggcagacugcugcacgagaugauccuggugugcgacgccuacagaaaggaccugcagcaccccaacgaguucaucagaggcagcacccugagauuccugugcaagcugaaggaggccgagcugcuggagccccugaugcccgccaucagagccugccuggagcacagacacagcuacgugagaagaaacgccgugcuggccaucuacaccaucuacagaaacuucgagcaccugauccccgacgcccccgagcugauccacgacuuccuggugaacgagaaggacgccagcugcaagagaaacgccuucaugaugcugauccacgccgaccaggacagagcccuggacuaccugagcaccugcaucgaccaggugcagaccuucggcgacauccugcagcuggugaucguggagcugaucuacaaggugugccacgccaaccccagcgagagagccagauucaucagaugcaucuacaaccugcugcagagcagcagccccgccgugaaguacgaggccgccggcacccuggugacccugagcagcgcccccaccgccaucaaggccgccgcccagugcuacaucgaccugaucaucaaggagagcgacaacaacgugaagcugaucgugcuggacagacugaucgagcugaaggagcaccccgcccacgagagagugcugcaggaccuggugauggacauccugagagugcugagcacccccgaccuggaggugagaaagaagacccugcagcuggcccuggaccuggugagcagcagaaacguggaggagcuggugaucgugcugaagaaggaggugaucaagaccaacaacgugagcgagcacgaggacaccgacaaguacagacagcugcuggugagaacccugcacagcugcagcgugagauuccccgacauggccgccaacgugauccccgugcugauggaguuccugagcgacaacaacgaggccgccgccgccgacgugcuggaguucgugagagaggccauccagagauucgacaaccugagaaugcugaucguggagaagaugcuggagguguuccacgccaucaagagcgugaagaucuacagaggcgcccuguggauccugggcgaguacugcagcaccaaggaggacauccagagcgugaugaccgagaucagaagaagccugggcgagauccccaucguggagagcgagaucaagaaggaggccggcgagcugaagcccgaggaggagaucaccgugggccccgugcagaagcuggugaccgagaugggcaccuacgccacccagagcgcccugagcagcagcagacccaccaagaaggaggaggacagacccccccugagaggcuuccugcuggacggcgacuucuucguggccgccagccuggccaccacccugaccaagaucgcccugagauacguggcccuggugcaggagaagaagaagcagaacagcuucguggccgaggccaugcugcugauggccaccauccugcaccugggcaagagcagccugcccaagaagcccaucaccgacgacgacguggacagaaucagccugugccugaaggugcugagcgagugcagcccccugaugaacgacaucuucaacaaggagugcagacagagccugagccacaugcugagcgccaagcuggaggaggagaagcugagccagaagaaggagagcgagaagagaaacgugaccgugcagcccgacgaccccaucagcuucaugcagcugaccgccaagaacgagaugaacugcaaggaggaccaguuccagcugagccugcuggccgccaugggcaacacccagagaaaggaggccgccgacccccuggccagcaagcugaacaaggugacccagcugaccggcuucagcgaccccguguacgccgaggccuacgugcacgugaaccaguacgacaucgugcuggacgugcugguggugaaccagaccagcgacacccugcagaacugcacccuggagcuggccacccugggcgaccugaagcugguggagaagcccagcccccugacccuggccccccacgacuucgccaacaucaaggccaacgugaagguggccagcaccgagaacggcaucaucuucggcaacaucguguacgacgugagcggcgccgccagcgacagaaacugcguggugcugagcgacauccacaucgacaucauggacuacauccagcccgccaccugcaccgacgccgaguucagacagaugugggccgaguucgagugggagaacaaggugaccgugaacaccaacaugguggaccugaacgacuaccugcagcacauccugaagagcaccaacaugaagugccugacccccgagaaggcccugagcggcuacugcggcuucauggccgccaaccuguacgccagaagcaucuucggcgaggacgcccuggccaacgugagcaucgagaagcccauccaccagggccccgacgccgccgugaccggccacaucagaaucagagccaagagccagggcauggcccugagccugggcgacaagaucaaccugagccagaagaagaccagcaucuaa

SEQ ID NO: 15509 - RNA, 2721 nt, Artificial Sequence
  COPB2__Homo_sapiens__NP_004757
augccccugagacuggacaucaagagaaagcugaccgccagaagcgacagagugaagagcguggaccugcaccccaccgagcccuggaugcuggccagccuguacaacggcagcgugugcguguggaaccacgagacccagacccuggugaagaccuucgaggugugcgaccugcccgugagagccgccaaguucguggccagaaagaacuggguggugaccggcgccgacgacaugcagaucagaguguucaacuacaacacccuggagagagugcacauguucgaggcccacagcgacuacaucagaugcaucgccgugcaccccacccagcccuucauccugaccagcagcgacgacaugcugaucaagcugugggacugggacaagaaguggagcugcagccagguguucgagggccacacccacuacgugaugcagaucgugaucaaccccaaggacaacaaccaguucgccagcgccagccuggacagaaccaucaagguguggcagcugggcagcagcagccccaacuucacccuggagggccacgagaagggcgugaacugcaucgacuacuacagcggcggcgacaagcccuaccugaucagcggcgccgacgacagacuggugaagaucugggacuaccagaacaagaccugcgugcagacccuggagggccacgcccagaacgugagcugcgccagcuuccaccccgagcugcccaucaucaucaccggcagcgaggacggcaccgugagaaucuggcacagcagcaccuacagacuggagagcacccugaacuacggcauggagagaguguggugcguggccagccugagaggcagcaacaacguggcccugggcuacgacgagggcagcaucaucgugaagcugggcagagaggagcccgccaugagcauggacgccaacggcaagaucaucugggccaagcacagcgaggugcagcaggccaaccugaaggccaugggcgacgccgagaucaaggacggcgagagacugccccuggccgugaaggacaugggcagcugcgagaucuacccccagaccauccagcacaaccccaacggcagauucgugguggugugcggcgacggcgaguacaucaucuacaccgccauggcccugagaaacaagagcuucggcagcgcccaggaguucgccugggcccacgacagcagcgaguacgccaucagagagagcaacagcaucgugaagaucuucaagaacuucaaggagaagaagagcuucaagcccgacuucggcgccgagagcaucuacggcggcuuccugcugggcgugagaagcgugaacggccuggccuucuacgacugggacaacaccgagcugaucagaagaaucgagauccagcccaagcacaucuucuggagcgacagcggcgagcuggugugcaucgccaccgaggagagcuucuucauccugaaguaccugagcgagaaggugcuggccgcccaggagacccacgagggcgugaccgaggacggcaucgaggacgccuucgaggugcugggcgagauccaggagaucgugaagaccggccugugggugggcgacugcuucaucuacaccagcagcgugaacagacugaacuacuacgugggcggcgagaucgugaccaucgcccaccuggacagaaccauguaccugcugggcuacauccccaaggacaacagacuguaccugggcgacaaggagcugaacaucaucagcuacagccugcuggugagcgugcuggaguaccagaccgccgugaugagaagagacuucagcauggccgacaaggugcugcccaccauccccaaggagcagagaaccagaguggcccacuuccuggagaagcagggcuucaagcagcaggcccugaccgugagcaccgaccccgagcacagauucgagcuggcccugcagcugggcgagcugaagaucgccuaccagcuggccguggaggccgagagcgagcagaaguggaagcagcuggccgagcuggccaucagcaagugccaguucggccuggcccaggagugccugcaccacgcccaggacuacggcggccugcugcugcuggccaccgccagcggcaacgccaacauggugaacaagcuggccgagggcgccgagagagacggcaagaacaacguggccuucaugagcuacuuccugcagggcaagguggacgccugccuggagcugcugaucagaaccggcagacugcccgaggccgccuuccuggccagaaccuaccugcccagccaggugagcagaguggugaagcuguggagagagaaccugagcaaggugaaccagaaggccgccgagagccuggccgaccccaccgaguacgagaaccuguuccccggccugaaggaggccuucgugguggaggagugggugaaggagacccacgccgaccuguggcccgccaagcaguacccccuggugacccccaacgaggagagaaacgugauggaggagggcaaggacuuccagcccagcagaagcaccgcccagcaggagcuggacggcaagcccgccagccccacccccgugaucguggccagccacaccgccaacaaggaggagaagagccugcuggagcuggagguggaccuggacaaccuggagcuggaggacaucgacaccaccgacaucaaccuggacgaggacauccuggacgacuaa

SEQ ID NO: 15510 - RNA, 927 nt, Artificial Sequence
  COPE__Homo_sapiens__NP_009194
auggccccccccgcccccggccccgccagcggcggcagcggcgagguggacgagcuguucgacgugaagaacgccuucuacaucggcagcuaccagcagugcaucaacgaggcccagagagugaagcugagcagccccgagagagacguggagagagacguguuccuguacagagccuaccuggcccagagaaaguucggcguggugcuggacgagaucaagcccagcagcgcccccgagcugcaggccgugagaauguucgccgacuaccuggcccacgagagcagaagagacagcaucguggccgagcuggacagagagaugagcagaagcguggacgugaccaacaccaccuuccugcugauggccgccagcaucuaccugcacgaccagaaccccgacgccgcccugagagcccugcaccagggcgacagccuggagugcaccgccaugaccgugcagauccugcugaagcuggacagacuggaccuggccagaaaggagcugaagagaaugcaggaccuggacgaggacgccacccugacccagcuggccaccgccugggugagccuggccaccggcggcgagaagcugcaggacgccuacuacaucuuccaggagauggccgacaagugcagccccacccugcugcugcugaacggccaggccgccugccacauggcccagggcagaugggaggccgccgagggccugcugcaggaggcccuggacaaggacagcggcuaccccgagacccuggugaaccugaucgugcugagccagcaccugggcaagccccccgaggugaccaacagauaccugagccagcugaaggacgcccacagaagccaccccuucaucaaggaguaccaggccaaggagaacgacuucgacagacuggugcugcaguacgcccccagcgccuaa

SEQ ID NO: 15511 - RNA, 2181 nt, Artificial Sequence
  COPG2__Homo_sapiens__NP_001276962
augaucaagaaguucgacaagaaggacgaggagagcggcagcggcagcaaccccuuccagcaccuggagaagagcgccgugcugcaggaggccagaaucuucaacgagacccccaucaaccccagaagaugccugcacauccugaccaagauccuguaccugcugaaccagggcgagcacuucggcaccaccgaggccaccgaggccuucuucgccaugaccagacuguuccagagcaacgaccagacccugagaagaaugugcuaccugaccaucaaggagauggccaccaucagcgaggacgugaucaucgugaccagcagccugaccaaggacaugaccggcaaggaggacguguacagaggccccgccaucagagcccugugcagaaucaccgacggcaccaugcugcaggccaucgagagauacaugaagcaggccaucguggacaaggugagcagcgugagcagcagcgcccuggugagcagccugcacaugaugaagaucagcuacgacguggugaagagauggaucaacgaggcccaggaggccgccagcagcgacaacaucauggugcaguaccacgcccugggcgugcuguaccaccugagaaagaacgacagacuggccgugagcaagaugcugaacaaguucaccaagagcggccugaagagccaguucgccuacugcaugcugaucagaaucgccagcagacugcugaaggagaccgaggacggccacgagagcccccuguucgacuucaucgagagcugccugagaaacaagcacgagauggugaucuacgaggccgccagcgccaucauccaccugcccaacugcaccgccagagagcuggcccccgccgugagcgugcugcagcuguucugcagcagccccaagcccgcccugagauacgccgccgugagaacccugaacaagguggccaugaagcaccccagcgccgugaccgccugcaaccuggaccuggagaaccugaucaccgacagcaacagaagcaucgccacccuggccaucaccacccugcugaagaccggcagcgagagcagcguggacagacugaugaagcagaucagcagcuucgugagcgagaucagcgacgaguucaagguggugguggugcaggccaucagcgcccugugccagaaguaccccagaaagcacagcgugaugaugaccuuccugagcaacaugcugagagacgacggcggcuucgaguacaagagagccaucguggacugcaucaucagcaucguggaggagaaccccgagagcaaggaggccggccuggcccaccugugcgaguucaucgaggacugcgagcacaccgugcuggccaccaagauccugcaccugcugggcaaggagggccccagaacccccgugcccagcaaguacaucagauucaucuucaacagaguggugcuggagaacgaggccgugagagccgccgccgugagcgcccuggccaaguucggcgcccagaacgagagccugcugcccagcauccuggugcugcugcagagaugcaugauggacaccgacgacgaggugagagacagagccaccuucuaccugaacgugcugcagcagagacagauggcccugaacgccaccuacaucuucaacggccugaccgugagcgugcccggcauggagaaggcccugcaccaguacacccuggagcccagcgagaagcccuucgacaugaagagcaucccccuggccauggcccccguguucgagcagaaggccgagaucacccugguggccaccaagcccgagaagcuggcccccagcagacaggacaucuuccaggagcagcuggccgccauccccgaguuccugaacaucggcccccuguucaagagcagcgagcccgugcagcugaccgaggccgagaccgaguacuucgugagaugcaucaagcacauguucaccaaccacaucguguuccaguucgacugcaccaacacccugaacgaccagcugcuggagaaggugaccgugcagauggagcccagcgacagcuacgaggugcugagcugcauccccgcccccagccugcccuacaaccagcccggcaucugcuacacccuggugagacugcccgacgacgaccccaccgccggcaccaacccccagaagggcggcgacaccuaa

SEQ ID NO: 15512 - RNA, 555 nt, Artificial Sequence
  COPRS__Homo_sapiens__NP_060875
auggaccugcaggccgccggcgcccaggcccagggcgccgccgagcccagcagaggccccccccugcccagcgccagaggcgccccccccagccccgaggccggcuucgccaccgccgaccacagcagccaggagagagagaccgagaaggccauggacagacuggccagaggcacccagagcauccccaacgacagccccgccagaggcgagggcacccacagcgaggaggagggcuucgccauggacgaggaggacagcgacggcgagcugaacaccugggagcugagcgagggcaccaacugcccccccaaggagcagcccggcgaccuguucaacgaggacugggacagcgagcugaaggccgaccagggcaaccccuacgacgccgacgacauccaggagagcaucagccaggagcugaagcccugggugugcugcgccccccagggcgacaugaucuacgaccccagcuggcaccacccccccccccugauccccuacuacagcaagaugguguucgagaccggccaguucgacgacgccgaggacuaa

SEQ ID NO: 15513 - RNA, 1353 nt, Artificial Sequence
  COPS2__Homo_sapiens__NP_001137359
augagcgacauggaggacgacuucaugugcgacgacgaggaggacuacgaccuggaguacagcgaggacagcaacagcgagcccaacguggaccuggagaaccaguacuacaacagcaaggcccugaaggaggacgaccccaaggccgcccugagcagcuuccagaaggugcuggagcuggagggcgagaagggcgaguggggcuucaaggcccugaagcagaugaucaagaucaacuucaagcugaccaacuuccccgagaugaugaacagauacaagcagcugcugaccuacaucagaagcgccgugaccagaaacuacagcgagaagagcaucaacagcauccuggacuacaucagcaccagcaagcagaacagcgacuuccugugccagauggaccugcugcaggaguucuacgagaccacccuggaggcccugaaggacgccaagaacgacagacugugguucaagaccaacaccaagcugggcaagcuguaccuggagagagaggaguacggcaagcugcagaagauccugagacagcugcaccagagcugccagaccgacgacggcgaggacgaccugaagaagggcacccagcugcuggagaucuacgcccuggagauccagauguacaccgcccagaagaacaacaagaagcugaaggcccuguacgagcagagccugcacaucaagagcgccaucccccacccccugaucaugggcgugaucagagagugcggcggcaagaugcaccugagagagggcgaguucgagaaggcccacaccgacuucuucgaggccuucaagaacuacgacgagagcggcagccccagaagaaccaccugccugaaguaccuggugcuggccaacaugcugaugaagagcggcaucaaccccuucgacagccaggaggccaagcccuacaagaacgaccccgagauccuggccaugaccaaccuggugagcgccuaccagaacaacgacaucaccgaguucgagaagauccugaagaccaaccacagcaacaucauggacgaccccuucaucagagagcacaucgaggagcugcugagaaacaucagaacccaggugcugaucaagcugaucaagcccuacaccagaauccacauccccuucaucagcaaggagcugaacaucgacguggccgacguggagagccugcuggugcagugcauccuggacaacaccauccacggcagaaucgaccaggugaaccagcugcuggagcuggaccaccagaagagaggcggcgccagauacaccgcccuggacaaguggaccaaccagcugaacagccugaaccaggccguggugagcaagcuggccuaa

SEQ ID NO: 15514 - RNA, 1212 nt, Artificial Sequence
  COPS3__Homo_sapiens__NP_001186054
augacccagcugugcgagcugaucaacaagagcggcgagcugcuggccaagaaccugagccaccuggacaccgugcugggcgcccuggacgugcaggagcacagccugggcgugcuggccgugcuguucgugaaguucagcaugcccagcgugcccgacuucgagacccuguucagccaggugcagcuguucaucagcaccugcaacggcgagcacaucagauacgccaccgacaccuucgccggccugugccaccagcugaccaacgcccugguggagagaaagcagccccugagaggcaucggcauccugaagcaggccaucgacaagaugcagaugaacaccaaccagcugaccagcauccacgccgaccugugccagcugugccugcuggccaagugcuucaagcccgcccugcccuaccuggacguggacaugauggacaucugcaaggagaacggcgccuacgacgccaagcacuuccugugcuacuacuacuacggcggcaugaucuacaccggccugaagaacuucgagagagcccuguacuucuacgagcaggccaucaccacccccgccauggccgugagccacaucaugcuggagagcuacaagaaguacauccuggugagccugauccugcugggcaaggugcagcagcugcccaaguacaccagccagaucgugggcagauucaucaagccccugagcaacgccuaccacgagcuggcccagguguacagcaccaacaaccccagcgagcugagaaaccuggugaacaagcacagcgagaccuucaccagagacaacaacaugggccuggugaagcagugccugagcagccuguacaagaagaacauccagagacugaccaagaccuuccugacccugagccugcaggacauggccagcagagugcagcugagcggcccccaggaggccgagaaguacgugcugcacaugaucgaggacggcgagaucuucgccagcaucaaccagaaggacggcauggugagcuuccacgacaaccccgagaaguacaacaaccccgccaugcugcacaacaucgaccaggagaugcugaagugcaucgagcuggacgagagacugaaggccauggaccaggagaucaccgugaacccccaguucgugcagaagagcaugggcagccaggaggacgacagcggcaacaagcccagcagcuacagcuaa

SEQ ID NO: 15515 - RNA, 1059 nt, Artificial Sequence
  COPS4__Homo_sapiens__NP_001244935
auggccgccgccgugagacaggaccuggcccagcugaugaacagcagcggcagccacaaggaccuggccggcaaguacagacagauccuggagaaggccauccagcugagcggcgccgagcagcuggaggcccugaaggccuucguggaggccauggugaacgagaacgugagccuggugaucagcagacagcugcugaccgacuucugcacccaccugcccaaccugcccgacagcaccgccaaggagaucuaccacuucacccuggagaagauccagcccagagugaucagcuucgaggagcagguggccagcaucagacagcaccuggccagcaucuacgagaaggaggaggacuggagaaacgccgcccaggugcuggugggcaucccccuggagaccggccagaagcaguacaacguggacuacaagcuggagaccuaccugaagaucgccagacuguaccuggaggacgacgaccccgugcaggccgaggccuacaucaacagagccagccugcugcagaacgagagcaccaacgagcagcugcagauccacuacaaggugugcuacgccagagugcuggacuacagaagaaaguucaucgaggccgcccagagauacaacgagcugagcuacaagaccaucgugcacgagagcgagagacuggaggcccugaagcacgcccugcacugcaccauccuggccagcgccggccagcagagaagcagaaugcuggccacccuguucaaggacgagagaugccagcagcuggccgccuacggcauccuggagaagauguaccuggacagaaucaucagaggcaaccagcugcaggaguucgccgccaugcugaugccccaccagaaggccaccaccgccgacggcagcagcauccuggacagagccgugaucgagcacaaccugcugagcgccagcaagcuguacaacaacaucaccuucgaggagcugggcgcccugcuggagauccccgccgccaagcacgagaagcccugccagagaggcaucagcagaagcaaccacuucgugagcaaguaa

SEQ ID NO: 15516 - RNA, 1005 nt, Artificial Sequence
  COPS5__Homo_sapiens__NP_006828
auggccgccagcggcagcggcauggcccagaagaccugggagcuggccaacaacaugcaggaggcccagagcaucgacgagaucuacaaguacgacaagaagcagcagcaggagauccuggccgccaagcccuggaccaaggaccaccacuacuucaaguacugcaagaucagcgcccuggcccugcugaagauggugaugcacgccagaagcggcggcaaccuggaggugaugggccugaugcugggcaagguggacggcgagaccaugaucaucauggacagcuucgcccugcccguggagggcaccgagaccagagugaacgcccaggccgccgccuacgaguacauggccgccuacaucgagaacgccaagcaggugggcagacuggagaacgccaucggcugguaccacagccaccccggcuacggcugcuggcugagcggcaucgacgugagcacccagaugcugaaccagcaguuccaggagcccuucguggccguggugaucgaccccaccagaaccaucagcgccggcaaggugaaccugggcgccuucagaaccuaccccaagggcuacaagccccccgacgagggccccagcgaguaccagaccaucccccugaacaagaucgaggacuucggcgugcacugcaagcaguacuacgcccuggaggugagcuacuucaagagcagccuggacagaaagcugcuggagcugcuguggaacaaguacugggugaacacccugagcagcagcagccugcugaccaacgccgacuacaccaccggccagguguucgaccugagcgagaagcuggagcagagcgaggcccagcugggcagaggcagcuucaugcugggccuggagacccacgacagaaagagcgaggacaagcuggccaaggccaccagagacagcugcaagaccaccaucgaggccauccacggccugaugagccaggugaucaaggacaagcuguucaaccagaucaacaucagcuaa

SEQ ID NO: 15517 - RNA, 984 nt, Artificial Sequence
  COPS6__Homo_sapiens__NP_006824
auggccgccgccgccgccgccgccgccgccaccaacggcaccggcggcagcagcggcauggagguggacgccgccguggugcccagcgugauggccugcggcgugaccggcagcgugagcguggcccugcacccccuggugauccugaacaucagcgaccacuggaucagaaugagaagccaggagggcagacccgugcaggugaucggcgcccugaucggcaagcaggagggcagaaacaucgaggugaugaacagcuucgagcugcugagccacaccguggaggagaagaucaucaucgacaaggaguacuacuacaccaaggaggagcaguucaagcagguguucaaggagcuggaguuccugggcugguacaccaccggcggcccccccgaccccagcgacauccacgugcacaagcaggugugcgagaucaucgagagcccccuguuccugaagcugaaccccaugaccaagcacaccgaccugcccgugagcguguucgagagcgugaucgacaucaucaacggcgaggccaccaugcuguucgccgagcugaccuacacccuggccaccgaggaggccgagagaaucggcguggaccacguggccagaaugaccgccaccggcagcggcgagaacagcaccguggccgagcaccugaucgcccagcacagcgccaucaagaugcugcacagcagagugaagcugauccuggaguacgugaaggccagcgaggccggcgaggugcccuucaaccacgagauccugagagaggccuacgcccugugccacugccugcccgugcugagcaccgacaaguucaagaccgacuucuacgaccagugcaacgacgugggccugauggccuaccugggcaccaucaccaagaccugcaacaccaugaaccaguucgugaacaaguucaacgugcuguacgacagacagggcaucggcagaagaaugagaggccuguucuucuaa

SEQ ID NO: 15518 - RNA, 828 nt, Artificial Sequence
  COPS7A__Homo_sapiens__XP_005253752
augagcgccgaggugaaggugaccggccagaaccaggagcaguuccugcugcuggccaagagcgccaagggcgccgcccuggccacccugauccaccaggugcuggaggcccccggcguguacguguucggcgagcugcuggacaugcccaacgugagagagcuggccgagagcgacuucgccagcaccuucagacugcugaccguguucgccuacggcaccuacgccgacuaccuggccgaggccagaaaccugcccccccugaccgaggcccagaagaacaagcugagacaccugagcguggugacccuggccgccaaggugaagugcauccccuacgccgugcugcuggaggcccuggcccugagaaacgugagacagcuggaggaccuggugaucgaggccguguacgccgacgugcugagaggcagccuggaccagagaaaccagagacuggagguggacuacagcaucggcagagacauccagagacaggaccugagcgccaucgccagaacccugcaggaguggugcgugggcugcgagguggugcugagcggcaucgaggagcaggugagcagagccaaccagcacaaggagcagcagcugggccugaagcagcagaucgagagcgagguggccaaccugaagaagaccaucaaggugaccaccgccgccgccgccgccgccaccagccaggaccccgagcagcaccugaccgagcugagagagcccgcccccggcaccaaccagagacagcccagcaagaaggccagcaagggcaagggccugagaggcagcgccaagaucuggagcaagagcaacuaa

SEQ ID NO: 15519 - RNA, 630 nt, Artificial Sequence
  COPS8__Homo_sapiens__NP_006701
augcccguggccgugauggccgagagcgccuucagcuucaagaagcugcuggaccagugcgagaaccaggagcuggaggcccccggcggcaucgccaccccccccguguacggccagcugcuggcccuguaccugcugcacaacgacaugaacaacgccagauaccuguggaagagaaucccccccgccaucaagagcgccaacagcgagcugggcggcaucuggagcgugggccagagaaucuggcagagagacuuccccggcaucuacaccaccaucaacgcccaccaguggagcgagaccgugcagcccaucauggaggcccugagagacgccaccagaagaagagccuucgcccuggugagccaggccuacaccagcaucaucgccgacgacuucgccgccuucgugggccugcccguggaggaggccgugaagggcauccuggagcagggcuggcaggccgacagcaccaccagaauggugcugcccagaaagcccguggccggcgcccuggacgugagcuucaacaaguucaucccccugagcgagcccgcccccgugccccccauccccaacgagcagcagcuggccagacugaccgacuacguggccuuccuggagaacuaa

SEQ ID NO: 15520 - RNA, 633 nt, Artificial Sequence
  COPZ2__Homo_sapiens__NP_057513
augcagagacccgaggccuggcccagaccccaccccggcgagggcgccgccgccgcccaggccggcggccccgccccccccgccagagccggcgagcccagcggccugagacugcaggagcccagccuguacaccaucaaggccguguucauccuggacaacgacggcagaagacugcuggccaaguacuacgacgacaccuuccccagcaugaaggagcagaugguguucgagaagaacguguucaacaagaccagcagaaccgagagcgagaucgccuucuucggcggcaugaccaucguguacaagaacagcaucgaccuguuccuguacguggugggcagcagcuacgagaacgagcugaugcugaugagcgugcugaccugccuguucgagagccugaaccacaugcugagaaagaacguggagaagagauggcugcuggagaacauggacggcgccuuccuggugcuggacgagaucguggacggcggcgugauccuggagagcgacccccagcaggugauccagaaggugaacuucagagccgacgacggcggccugaccgagcagagcguggcccaggugcugcagagcgccaaggagcagaucaaguggagccugcugaaguaa

SEQ ID NO: 15521 - RNA, 1266 nt, Artificial Sequence
  COQ2__Homo_sapiens__NP_056512
augacccccaucagccaggugagaaugagaaagggcagcgcccacaccgccgcccagcccggcagacugggccugcaccccgccggcgccaccgcccacgccugcagaggcaugaccagcaucagagccagacccggccugaccagcgccaugcugggcagcagagccgccggcuucgccagaggccugagagccguggcccuggccuggcugcccggcuggagaggcagaagcuucgcccuggccagagccgccggcgccccccacggcggcgaccugcagccccccgccugccccgagcccagaggcagacagcugagccugagcgccgccgccgugguggacagcgcccccagaccccugcagcccuaccugagacugaugagacuggacaagcccaucggcaccuggcugcuguaccugcccugcaccuggagcaucggccuggccgccgagcccggcugcuuccccgacugguacaugcugagccuguucggcaccggcgccauccugaugagaggcgccggcugcaccaucaacgacaugugggaccaggacuacgacaagaaggugaccagaaccgccaacagacccaucgccgccggcgacaucagcaccuuccagagcuucguguuccugggcggccagcugacccuggcccugggcgugcugcugugccugaacuacuacagcaucgcccugggcgccggcagccugcugcuggugaucaccuacccccugaugaagagaaucagcuacuggccccagcuggcccugggccugaccuucaacuggggcgcccugcugggcuggagcgccaucaagggcagcugcgaccccagcgugugccugccccuguacuucagcggcgugauguggacccugaucuacgacaccaucuacgcccaccaggacaagagagacgacgugcugaucggccugaagagcaccgcccugagauucggcgagaacaccaagcccuggcugagcggcuucagcguggccaugcugggcgcccugagccuggugggcgugaacagcggccagaccgcccccuacuacgccgcccugggcgccgugggcgcccaccugacccaccagaucuacacccuggacauccacagacccgaggacugcuggaacaaguucaucagcaacagaacccugggccugaucguguuccugggcaucgugcugggcaaccuguggaaggagaagaagaccgacaagaccaagaagggcaucgagaacaagaucgagaacuaa

SEQ ID NO: 15522 - RNA, 1110 nt, Artificial Sequence
  COQ3__Homo_sapiens__NP_059117
auguggagcggcagaaagcugggcagcagcggcggcugguuccugagagugcugggccccggcggcugcaacaccaaggccgccagaccccugaucagcagcgccguguacgugaagaaccagcugagcggcacccugcagaucaagcccggcguguucaacgaguacagaaccaucugguucaagagcuacagaaccaucuucagcugccugaacagaaucaagagcuucagauaccccugggccagacuguacagcaccagccagaccaccguggacagcggcgaggugaagaccuuccuggcccuggcccacaaguggugggacgagcagggcguguacgccccccugcacagcaugaacgaccugagagugcccuucaucagagacaaccugcugaagaccauccccaaccaccagcccggcaagccccugcugggcaugaagauccuggacgugggcugcggcggcggccugcugaccgagccccugggcagacugggcgccagcgugaucggcaucgaccccguggacgagaacaucaagaccgcccagugccacaagagcuucgaccccgugcuggacaagagaaucgaguacagagugugcagccuggaggagaucguggaggagaccgccgagaccuucgacgccgugguggccagcgaggugguggagcacgugaucgaccuggagaccuuccugcagugcugcugccaggugcugaagcccggcggcagccuguucaucaccaccaucaacaagacccagcugagcuacgcccugggcaucguguucagcgagcagaucgccagcaucgugcccaagggcacccacaccugggagaaguucgugagccccgagacccuggagagcauccuggagagcaacggccugagcgugcagaccguggugggcaugcuguacaaccccuucagcggcuacuggcacuggagcgagaacaccagccugaacuacgccgccuacgccgugaagagcagagugcaggagcaccccgccagcgccgaguucgugcugaagggcgagaccgaggagcugcaggccaacgccugcaccaaccccgccgugcacgagaagcugaagaaguaa

SEQ ID NO: 15523 - RNA, 798 nt, Artificial Sequence
  COQ4__Homo_sapiens__NP_057119
auggccacccugcugagacccgugcugagaagacugugcggccugcccggccugcagagacccgccgccgagaugccccugagagccagaagcgacggcgccggcccccuguacagccaccaccugcccaccagcccccugcagaaggcccugcuggccgccggcagcgccgccauggcccuguacaaccccuacagacacgacaugguggccgugcugggcgagaccaccggccacagaacccugaaggugcugagagaccagaugagaagagaccccgagggcgcccagauccugcaggagagacccagaaucagcaccagcacccuggaccugggcaagcugcagagccugcccgagggcagccugggcagagaguaccugagauuccuggacgugaacagagugagccccgacaccagagcccccaccagauucguggacgacgaggagcuggccuacgugauccagagauacagagaggugcacgacaugcugcacacccugcugggcaugcccaccaacauccugggcgagaucguggugaagugguucgaggccgugcagaccggccugcccaugugcauccugggcgccuucuucggccccaucagacugggcgcccagagccugcaggugcuggugagcgagcugauccccugggccgugcagaacggcagaagagcccccugcgugcugaaccuguacuacgagagaagaugggagcagagccugagagcccugagagaggagcugggcaucaccgccccccccaugcacgugcagggccuggccuaa

SEQ ID NO: 15524 - RNA, 984 nt, Artificial Sequence
  COQ5__Homo_sapiens__NP_115690
auggccgcccccggcagcugcgcccuguggagcuacugcggcagaggcuggagcagagccaugagaggcugccagcugcugggccugagaagcagcuggcccggcgaccugcugagcgccagacugcugagccaggagaagagagccgccgagacccacuucggcuucgagaccgugagcgaggaggagaagggcggcaagguguaccagguguucgagagcguggccaagaaguacgacgugaugaacgacaugaugagccugggcauccacagaguguggaaggaccugcugcuguggaagaugcacccccugcccggcacccagcugcuggacguggccggcggcaccggcgacaucgccuucagauuccugaacuacgugcagagccagcaccagagaaagcagaagagacagcugagagcccagcagaaccugagcugggaggagaucgccaaggaguaccagaacgaggaggacagccugggcggcagcagagugguggugugcgacaucaacaaggagaugcugaaggugggcaagcagaaggcccuggcccagggcuacagagccggccuggccugggugcugggcgacgccgaggagcugcccuucgacgacgacaaguucgacaucuacaccaucgccuucggcaucagaaacgugacccacaucgaccaggcccugcaggaggcccacagagugcugaagcccggcggcagauuccugugccuggaguucagccaggugaacaacccccugaucagcagacuguacgaccuguacagcuuccaggugauccccgugcugggcgaggugaucgccggcgacuggaagagcuaccaguaccugguggagagcaucagaagauuccccagccaggaggaguucaaggacaugaucgaggacgccggcuuccacaaggugaccuacgagagccugaccagcggcaucguggccauccacagcggcuucaagcuguaa

SEQ ID NO: 15525 - RNA, 1407 nt, Artificial Sequence
  COQ6__Homo_sapiens__NP_872282
auggccgccagacuggugagcagaugcggcgccgugagagccgccccccacagcggcccccuggugagcuggagaagauggagcggcgccagcaccgacaccguguacgacgugguggugagcggcggcggccuggugggcgccgccauggccugcgcccugggcuacgacauccacuuccacgacaagaagauccugcugcuggaggccggccccaagaaggugcuggagaagcugagcgagaccuacagcaacagagugagcagcaucagccccggcagcgccacccugcugagcagcuucggcgccugggaccacaucugcaacaugagauacagagccuucagaagaaugcaggugugggacgccugcagcgaggcccugaucauguucgacaaggacaaccuggacgacaugggcuacaucguggagaacgacgugaucaugcacgcccugaccaagcagcuggaggccgugagcgacagagugaccgugcuguacagaagcaaggccaucagauacaccuggcccugccccuuccccauggccgacagcagccccugggugcacaucacccugggcgacggcagcaccuuccagaccaagcugcugaucggcgccgacggccacaacagcggcgugagacaggccgugggcauccagaacgugagcuggaacuacgaccagagcgccgugguggccacccugcaccugagcgaggccaccgagaacaacguggccuggcagagauuccugcccagcggccccaucgcccugcugccccugagcgacacccugagcagccugguguggagcaccagccacgagcacgccgccgagcuggugagcauggacgaggagaaguucguggacgccgugaacagcgccuucuggagcgacgccgaccacaccgacuucaucgacaccgccggcgccaugcugcaguacgccgugagccugcugaagcccaccaaggugagcgccagacagcugccccccagcguggccagaguggacgccaagagcagagugcuguucccccugggccugggccacgccgccgaguacgugagacccagaguggcccugaucggcgacgccgcccacagagugcacccccuggccggccagggcgugaacaugggcuucggcgacaucagcagccuggcccaccaccugagcaccgccgccuucaacggcaaggaccugggcagcgugagccaccugaccggcuacgagaccgagagacagagacacaacaccgcccugcuggccgccaccgaccugcugaagagacuguacagcaccagcgccagcccccuggugcugcugagaaccuggggccugcaggccaccaacgccgugagcccccugaaggagcagaucauggccuucgccagcaaguaa

SEQ ID NO: 15526 - RNA, 540 nt, Artificial Sequence
  COQ7__Homo_sapiens__NP_001177912
augacccuggacaacaucagcagagccgccguggacagaaucaucagaguggaccacgccggcgaguacggcgccaacagaaucuacgccggccagauggccgugcugggcagaaccagcgugggccccgugauccagaagaugugggaccaggagaaggaccaccugaagaaguucaacgagcugauggugaccuucagagugagacccaccgugcugaugccccuguggaacgugcugggcuucgcccugggcgccggcaccgcccugcugggcaaggagggcgccauggccugcaccguggccguggaggagagcaucgcccaccacuacaacaaccagaucagaacccugauggaggaggaccccgagaaguacgaggagcugcugcagcugaucaagaaguucagagacgaggagcuggagcaccacgacaucggccuggaccacgacgccgagcuggcccccgccuacgccgugcugaagagcaucauccaggccggcugcagaguggccaucuaccugagcgagagacuguaa

SEQ ID NO: 15527 - RNA, 957 nt, Artificial Sequence
  COQ9__Homo_sapiens__NP_064708
auggccgccgccgccgugagcggcgcccugggcagagccggcuggagacugcugcagcugagaugccugcccguggccagaugcagacaggcccuggugcccagagccuuccacgccagcgccgugggccugagaagcagcgacgagcagaagcagcagccccccaacagcuucagccagcagcacagcgagacccagggcgccgagaagcccgaccccgagagcagccacagcccccccagauacaccgaccagggcggcgaggaggaggaggacuacgagagcgaggagcagcugcagcacagaauccugaccgccgcccuggaguucgugcccgcccacggcuggaccgccgaggccaucgccgagggcgcccagagccugggccugagcagcgccgccgccagcauguucggcaaggacggcagcgagcugauccugcacuucgugacccagugcaacaccagacugaccagagugcuggaggaggagcagaagcuggugcagcugggccaggccgagaagagaaagaccgaccaguuccugagagacgccguggagaccagacugagaaugcugauccccuacaucgagcacuggcccagagcccugagcauccugaugcugccccacaacauccccagcagccugagccugcugaccagcaugguggacgacauguggcacuacgccggcgaccagagcaccgacuucaacugguacaccagaagagccaugcuggccgccaucuacaacaccaccgagcuggugaugaugcaggacagcagccccgacuucgaggacaccuggagauuccuggagaacagagugaacgacgccaugaacaugggccacaccgccaagcaggugaagagcaccggcgaggcccuggugcagggccugaugggcgccgccgugacccugaagaaccugaccggccugaaccagagaagauaa

SEQ ID NO: 15528 - RNA, 3129 nt, Artificial Sequence
  CORIN__Homo_sapiens__NP_006578
augaagcagagccccgcccuggcccccgaggagagaugcagaagagccggcagccccaagcccgugcugagagccgacgacaacaacaugggcaacggcugcagccagaagcuggccaccgccaaccugcugagauuccugcugcuggugcugauccccugcaucugcgcccuggugcugcugcuggugauccugcugagcuacgugggcacccugcagaagguguacuucaagagcaacggcagcgagccccuggugaccgacggcgagauccagggcagcgacgugauccugaccaacaccaucuacaaccagagcaccguggugagcaccgcccaccccgaccagcacgugcccgccuggaccaccgacgccagccugcccggcgaccagagccacagaaacaccagcgccugcaugaacaucacccacagccagugccagaugcugcccuaccacgccacccugaccccccugcugagcguggugagaaacauggagauggagaaguuccugaaguucuucaccuaccugcacagacugagcugcuaccagcacaucaugcuguucggcugcacccuggccuuccccgagugcaucaucgacggcgacgacagccacggccugcugcccugcagaagcuucugcgaggccgccaaggagggcugcgagagcgugcugggcauggugaacuacagcuggcccgacuuccugagaugcagccaguucagaaaccagaccgagagcagcaacgugagcagaaucugcuucagcccccagcaggagaacggcaagcagcugcugugcggcagaggcgagaacuuccugugcgccagcggcaucugcauccccggcaagcugcagugcaacggcuacaacgacugcgacgacuggagcgacgaggcccacugcaacugcagcgagaaccuguuccacugccacaccggcaagugccugaacuacagccuggugugcgacggcuacgacgacugcggcgaccugagcgacgagcagaacugcgacugcaaccccaccaccgagcacagaugcggcgacggcagaugcaucgccauggagugggugugcgacggcgaccacgacugcguggacaagagcgacgaggugaacugcagcugccacagccagggccugguggagugcagaaacggccagugcauccccagcaccuuccagugcgacggcgacgaggacugcaaggacggcagcgacgaggagaacugcagcgugauccagaccagcugccaggagggcgaccagagaugccuguacaaccccugccuggacagcugcggcggcagcagccugugcgaccccaacaacagccugaacaacugcagccagugcgagcccaucacccuggagcugugcaugaaccugcccuacaacagcaccagcuaccccaacuacuucggccacagaacccagaaggaggccagcaucagcugggagagcagccuguuccccgcccuggugcagaccaacugcuacaaguaccugauguucuucagcugcaccauccuggugcccaagugcgacgugaacaccggcgagcacaucccccccugcagagcccugugcgagcacagcaaggagagaugcgagagcgugcugggcaucgugggccugcaguggcccgaggacaccgacugcagccaguuccccgaggagaacagcgacaaccagaccugccugaugcccgacgaguacguggaggagugcagccccagccacuucaagugcagaagcggccagugcgugcuggccagcagaagaugcgacggccaggccgacugcgacgacgacagcgacgaggagaacugcggcugcaaggagagagaccugugggagugccccagcaacaagcagugccugaagcacaccgugaucugcgacggcuuccccgacugccccgacuacauggacgagaagaacugcagcuucugccaggacgacgagcuggagugcgccaaccacgccugcgugagcagagaccuguggugcgacggcgaggccgacugcagcgacagcagcgacgagugggacugcgugacccugagcaucaacgugaacagcagcagcuuccugauggugcacagagccgccaccgagcaccacgugugcgccgacggcuggcaggagauccugagccagcuggccugcaagcagaugggccugggcgagcccagcgugaccaagcugauccaggagcaggagaaggagcccagauggcugacccugcacagcaacugggagagccugaacggcaccacccugcacgagcugcuggugaacggccagagcugcgagagcagaagcaagaucagccugcugugcaccaagcaggacugcggcagaagacccgccgccagaaugaacaagagaauccugggcggcagaaccagcagacccggcagauggcccuggcagugcagccugcagagcgagcccagcggccacaucugcggcugcgugcugaucgccaagaagugggugcugaccguggcccacugcuucgagggcagagagaacgccgccguguggaagguggugcugggcaucaacaaccuggaccaccccagcguguucaugcagaccagauucgugaagaccaucauccugcaccccagauacagcagagccgugguggacuacgacaucagcaucguggagcugagcgaggacaucagcgagaccggcuacgugagacccgugugccugcccaaccccgagcaguggcuggagcccgacaccuacugcuacaucaccggcuggggccacaugggcaacaagaugcccuucaagcugcaggagggcgaggugagaaucaucagccuggagcacugccagagcuacuucgacaugaagaccaucaccaccagaaugaucugcgccggcuacgagagcggcaccguggacagcugcaugggcgacagcggcggcccccuggugugcgagaagcccggcggcagauggacccuguucggccugaccagcuggggcagcgugugcuucagcaaggugcugggccccggcguguacagcaacgugagcuacuucguggaguggaucaagagacagaucuacauccagaccuuccugcugaacuaa

SEQ ID NO: 15529 - RNA, 1386 nt, Artificial Sequence
  CORO1A__Homo_sapiens__XP_011544016
augagcagacagguggugagaagcagcaaguucagacacguguucggccagcccgccaaggccgaccagugcuacgaggacgugagagugagccagaccaccugggacagcggcuucugcgccgugaaccccaaguucguggcccugaucugcgaggccagcggcggcggcgccuuccuggugcugccccugggcaagaccggcagaguggacaagaacgcccccaccgugugcggccacaccgcccccgugcuggacaucgccuggugcccccacaacgacaacgugaucgccagcggcagcgaggacugcaccgugauggugugggagauccccgacggcggccugaugcugccccugagagagcccguggugacccuggagggccacaccaagagagugggcaucguggccuggcacaccaccgcccagaacgugcugcugagcgccggcugcgacaacgugaucauggugugggacgugggcaccggcgccgccaugcugacccugggccccgaggugcaccccgacaccaucuacagcguggacuggagcagagacggcggccugaucugcaccagcugcagagacaagagagugagaaucaucgagcccagaaagggcaccgugguggccgagaaggacagaccccacgagggcaccagacccgugagagccguguucgugagcgagggcaagauccugaccaccggcuucagcagaaugagcgagagacagguggcccugugggacaccaagcaccuggaggagccccugagccugcaggagcuggacaccagcagcggcgugcugcugcccuucuucgaccccgacaccaacaucguguaccugugcggcaagggcgacagcagcaucagauacuucgagaucaccagcgaggcccccuuccugcacuaccugagcauguucagcagcaaggagagccagagaggcaugggcuacaugcccaagagaggccuggaggugaacaagugcgagaucgccagauucuacaagcugcacgagagaagaugcgagcccaucgccaugaccgugcccagaaagagcgaccuguuccaggaggaccuguacccccccaccgccggccccgaccccgcccugaccgccgaggaguggcugggcggcagagacgccggcccccugcugaucagccugaaggacggcuacgugccccccaagagcagagagcugagagugaacagaggccuggacaccggcagaagaagagccgcccccgaggccagcggcacccccagcagcgacgccgugagcagacuggaggaggagaugagaaagcugcaggccaccgugcaggagcugcagaagagacuggacagacuggaggagaccgugcaggccaaguaa

SEQ ID NO: 15530 - RNA, 1470 nt, Artificial Sequence
  CORO1B__Homo_sapiens__NP_001018080
augagcuucagaaagguggugagacagagcaaguucagacacguguucggccagcccgugaagaacgaccagugcuacgaggacaucagagugagcagagugaccugggacagcaccuucugcgccgugaaccccaaguuccuggccgugaucguggaggccagcggcggcggcgccuuccuggugcugccccugagcaagaccggcagaaucgacaaggccuaccccaccgugugcggccacaccggccccgugcuggacaucgacuggugcccccacaacgacgaggugaucgccagcggcagcgaggacugcaccgugaugguguggcagauccccgagaacggccugaccagcccccugaccgagcccgugguggugcuggagggccacaccaagagagugggcaucaucgccuggcaccccaccgccagaaacgugcugcugagcgccggcugcgacaacguggugcugaucuggaacgugggcaccgccgaggagcuguacagacuggacagccugcaccccgaccugaucuacaacgugagcuggaaccacaacggcagccuguucugcagcgccugcaaggacaagagcgugagaaucaucgaccccagaagaggcacccugguggccgagagagagaaggcccacgagggcgccagacccaugagagccaucuuccuggccgacggcaagguguucaccaccggcuucagcagaaugagcgagagacagcuggcccugugggaccccgagaaccuggaggagcccauggcccugcaggagcuggacagcagcaacggcgcccugcugcccuucuacgaccccgacaccagcgugguguacgugugcggcaagggcgacagcagcaucagauacuucgagaucaccgaggagccccccuacauccacuuccugaacaccuucaccagcaaggagccccagagaggcaugggcagcaugcccaagagaggccuggaggugagcaagugcgagaucgccagauucuacaagcugcacgagagaaagugcgagcccaucgugaugaccgugcccagaaagagcgaccuguuccaggacgaccuguaccccgacaccgccggccccgaggccgcccuggaggccgaggagugggugagcggcagagacgccgaccccauccugaucagccugagagaggccuacgugcccagcaagcagagagaccugaagaucagcagaagaaacgugcugagcgacagcagacccgccauggcccccggcagcagccaccugggcgcccccgccagcaccaccaccgccgccgacgccacccccagcggcagccuggccagagccggcgaggccggcaagcuggaggaggugaugcaggagcugagagcccugagagcccuggugaaggagcagggcgacagaaucugcagacuggaggagcagcugggcagaauggagaacggcgacgccuaa

SEQ ID NO: 15531 - RNA, 1584 nt, Artificial Sequence
  CORO1C__Homo_sapiens__NP_001098707
auguacggccccggcagccagcugggcaagagcggcaacaacagcugggccaaggagagaggcugcagcaucgccugccagggcagccugaccagcgccagacugcacgcccccagcaucggcgagagaccccugagccacaugagauggaaggacaccaugagaagaguggugagacagagcaaguucagacacguguucggccaggccgugaagaacgaccagugcuacgacgacaucagagugagcagagugaccugggacagcagcuucugcgccgugaaccccagauucguggccaucaucaucgaggccagcggcggcggcgccuuccuggugcugccccugcacaagaccggcagaaucgacaagagcuaccccaccgugugcggccacaccggccccgugcuggacaucgacuggugcccccacaacgaccaggugaucgccagcggcagcgaggacugcaccgugaugguguggcagauccccgagaacggccugacccugagccugaccgagcccguggugauccuggagggccacagcaagagagugggcaucguggccuggcaccccaccgccagaaacgugcugcugagcgccggcugcgacaacgccaucaucaucuggaacgugggcaccggcgaggcccugaucaaccuggacgacaugcacagcgacaugaucuacaacgugagcuggaacagaaacggcagccugaucugcaccgccagcaaggacaagaaggugagagugaucgaccccagaaagcaggagaucguggccgagaaggagaaggcccacgagggcgccagacccaugagagccaucuuccuggccgacggcaacguguucaccaccggcuucagcagaaugagcgagagacagcuggcccuguggaaccccaagaacaugcaggagcccaucgcccugcacgagauggacaccagcaacggcgugcugcugcccuucuacgaccccgacaccagcaucaucuaccugugcggcaagggcgacagcagcaucagauacuucgagaucaccgacgagagccccuacgugcacuaccugaacaccuucagcagcaaggagccccagagaggcaugggcuacaugcccaagagaggccuggacgugaacaagugcgagaucgccagauucuucaagcugcacgagagaaagugcgagcccaucaucaugaccgugcccagaaagagcgaccuguuccaggacgaccuguaccccgacaccgccggccccgaggccgcccuggaggccgaggagugguucgagggcaagaacgccgaccccauccugaucagccugaagcacggcuacauccccggcaagaacagagaccugaagguggugaagaagaacauccuggacagcaagcccaccgccaacaagaagugcgaccugaucagcauccccaagaagaccaccgacaccgccagcgugcagaacgaggccaagcuggacgagauccugaaggagaucaagagcaucaaggacaccaucugcaaccaggacgagagaaucagcaagcuggagcagcagauggccaagaucgccgccuaa

SEQ ID NO: 15532 - RNA, 1578 nt, Artificial Sequence
  CORO2A__Homo_sapiens__XP_011517288
augagcuggcacccccaguacagaagcagcaaguucagacacguguucggcaagcccgccagcaaggagaacugcuacgacagcgugcccaucaccagaagcgugcacgacaaccacuucugcgccgugaacccccacuucaucgccguggugaccgagugcgccggcggcggcgccuuccuggugaucccccugcaccagaccggcaagcuggacccccacuaccccaaggugugcggccacagaggcaacgugcuggacgugaaguggaaccccuucgacgacuucgagaucgccagcugcagcgaggacgccaccaucaagaucuggagcauccccaagcagcugcugaccagaaaccugaccgccuacagaaaggagcuggugggccacgccagaagagugggccugguggaguggcaccccaccgccgccaacauccuguucagcgccggcuacgacuacaaggugaugaucuggaaccuggacaccaaggagagcgugaucaccagccccaugagcaccaucagcugccaccaggacgugauccugagcaugagcuucaacaccaacggcagccugcuggccaccaccugcaaggacagaaagaucagagugaucgaccccagagccggcaccgugcugcaggaggccagcuacaagggccacagagccagcaaggugcuguuccugggcaaccugaagaagcugaugagcaccggcaccagcagauggaacaacagacagguggcccugugggaccaggacaaccugagcgugccccugauggaggaggaccuggacggcagcagcggcgugcuguuccccuucuacgacgccgacaccagcaugcuguacguggugggcaagggcgacggcaacaucagauacuacgaggugagcgccgacaagccccaccugagcuaccugaccgaguacagaagcuacaacccccagaagggcaucggcgugaugcccaagagaggccuggacgugagcagcugcgagaucuucagauucuacaagcugaucaccaccaagagccugaucgagcccaucagcaugaucgugcccagaagaagcgagagcuaccaggaggacaucuacccccccaccgccggcgcccagcccagccugaccgcccaggaguggcugagcggcaugaacagagaccccauccuggugagccugagacccggcagcgagcugcugagaccccacccccugcccgccgagagacccaucuucaacagcauggcccccgccagccccagacugcugaaccagaccgagaagcuggccgccgaggacggcuggagaagcagcagccugcuggaggagaagaugcccagaugggccgccgagcacagacuggaggagaagaagaccuggcugaccaacggcuucgacguguucgagugccccccccccaagaccgagaacgagcugcugcagauguucuacagacagcaggaggagaucagaagacugagagagcugcugacccagagagaggugcaggccaagcagcuggagcuggagaucaagaaccugagaaugggcagcgagcagcuguaa

SEQ ID NO: 15533 - RNA, 1428 nt, Artificial Sequence
  CORO2B__Homo_sapiens__NP_001177385
augagcuggagaccccaguacagaagcagcaaguucagaaacguguacggcaagguggccaacagagagcacugcuucgacggcauccccaucaccaagaacgugcacgacaaccacuucugcgccgugaacaccagauuccuggccaucgugaccgagagcgccggcggcggcagcuuccuggugaucccccuggagcagaccggcagaaucgagcccaacuaccccaaggugugcggccaccagggcaacgugcuggacaucaaguggaaccccuucaucgacaacaucaucgccagcugcagcgaggacaccagcgugagaaucugggagauccccgagggcggccugaagagaaacaugaccgaggcccugcuggagcugcacggccacagcagaagagugggccugguggaguggcaccccaccaccaacaacauccuguucagcgccggcuacgacuacaaggugcugaucuggaaccuggacgugggcgagcccgugaagaugaucgacugccacaccgacgugauccugugcaugagcuucaacaccgacggcagccugcugaccaccaccugcaaggacaagaagcugagagugaucgagcccagaagcggcagagugcugcaggaggccaacugcaagaaccacagagugaacagagugguguuccugggcaacaugaagagacugcugaccaccggcgugagcagauggaacaccagacagaucgcccugugggaccaggaggaccugagcaugccccugaucgaggaggagaucgacggccugagcggccugcuguuccccuucuacgacgccgacacccacaugcuguaccuggccggcaagggcgacggcaacaucagauacuacgagaucagcaccgagaagcccuaccugagcuaccugauggaguucagaagccccgccccccagaagggccugggcgugaugcccaagcacggccuggacgugagcgccugcgagguguucagauucuacaagcuggugacccugaagggccugaucgagcccaucagcaugaucgugcccagaagaagcgacagcuaccaggaggacaucuaccccaugacccccggcaccgagcccgcccugacccccgacgaguggcugggcggcaucaacagagaccccgugcugaugagccugaaggagggcuacaagaagagcagcaagaugguguucaaggcccccaucaaggagaagaagagcgugguggugaacggcaucgaccugcuggagaacgugccccccagaaccgagaacgagcugcugagaauguucuucagacagcaggacgagaucagaagacugaaggaggagcuggcccagaaggacaucagaaucagacagcugcagcuggagcugaagaaccugagaaacagccccaagaacugcuaa

SEQ ID NO: 15534 - RNA, 1419 nt, Artificial Sequence
  CORO6__Homo_sapiens__NP_116243
augagcagaagaguggugagacagagcaaguucagacacguguucggccaggccgccaaggccgaccaggccuacgaggacaucagagugagcaaggugaccugggacagcagcuucugcgccgugaaccccaaguuccuggccaucaucguggaggccggcggcggcggcgccuucaucgugcugccccuggccaagaccggcagaguggacaagaacuacccccuggugaccggccacaccgcccccgugcuggacaucgacuggugcccccacaacgacaacgugaucgccagcgccagcgacgacaccaccaucaugguguggcagauccccgacuacacccccaugagaaacaucaccgagcccaucaucacccuggagggccacagcaagagagugggcauccugagcuggcaccccaccgccagaaacgugcugcugagcgccggcggcgacaacgugaucaucaucuggaacgugggcaccggcgaggugcugcugagccuggacgacaugcaccccgacgugauccacagcgugugcuggaacagcaacggcagccugcuggccaccaccugcaaggacaagacccugagaaucaucgaccccagaaagggccaggugguggccgagagauucgccgcccacgagggcaugagacccaugagagccguguucaccagacagggccacaucuucaccaccggcuucaccagaaugagccagagagagcugggccugugggaccccaacaacuucgaggagcccguggcccugcaggagauggacaccagcaacggcgugcugcugcccuucuacgaccccgacagcagcaucguguaccugugcggcaagggcgacagcagcaucagauacuucgagaucaccgacgagccccccuucgugcacuaccugaacaccuucagcagcaaggagccccagagaggcaugggcuucaugcccaagagaggccuggacgugagcaagugcgagaucgccagauucuacaagcugcacgagagaaagugcgagcccaucaucaugaccgugcccagaaagagcgaccuguuccaggacgaccuguaccccgacacccccggccccgagcccgcccuggaggccgacgaguggcugagcggccaggacgccgagcccgugcugaucagccugagagacggcuacgugccccccaagcacagagagcugagagugaccaagagaaacauccuggacgugagaccccccagcggccccagaagaagccagagcgccagcgacgccccccugagccagcagcacacccuggagacccugcuggaggagaucaaggcccugagagagagagugcaggcccaggagcagagaaucaccgcccuggagaacaugcugugcgagcugguggacggcaccgacuaa

SEQ ID NO: 15535 - RNA, 2523 nt, Artificial Sequence
  CORO7__Homo_sapiens__NP_001188402
augaacagauucagagugagcaaguucagacacaccgaggccagaccccccagaagagagagcuggaucagcgacaucagagccggcaccgcccccagcugcagaaaccacaucaagagcagcugcagccugaucgccuucaacagcgacagacccggcgugcugggcaucgugccccugcagggccagggcgaggacaagagaagaguggcccaccugggcugccacagcgagcuggccgcccacggcgaccuggugcagagcgccguguggagcagagacggcgcccuggugggcaccgccugcaaggacaagcagcugagaaucuucgaccccagaaccaagcccagagccagccagagcacccaggcccacgagaacagcagagacagcagacuggccuggaugggcaccugggagcaccuggugagcaccggcuucaaccagaugagagagagagaggugaagcugugggacaccagauucuucagcagcgcccuggccagccugacccuggacaccagccugggcugccuggugccccugcuggaccccgacagcggccugcuggugcuggccggcaagggcgagagacagcuguacugcuacgagguggugccccagcagcccgcccugagccccgugacccagugcgugcuggagagcgugcugagaggcgccgcccuggugcccagacaggcccuggccgugaugagcugcgaggugcugagagugcugcagcugagcgacaccgccaucgugcccaucggcuaccacgugcccagaaaggccguggaguuccacgaggaccuguuccccgacaccgccggcugcgugcccgccaccgacccccacagcuggugggccggcgacaaccagcaggugcagaaggugagccugaaccccgccugcagaccccaccccagcuucaccagcugccuggugccccccgccgagccccugcccgacaccgcccagcccgccgugauggagacccccgugggcgacgccgacgccagcgagggcuucagcagcccccccagcagccugaccagccccagcacccccagcagccugggccccagccugagcagcaccagcggcaucggcaccagccccagccugagaagccugcagagccugcugggccccagcagcaaguucagacacgcccagggcaccgugcugcacagagacagccacaucaccaaccugaagggccugaaccugaccacccccggcgagagcgacggcuucugcgccaacaagcugagaguggccgugccccugcugagcagcggcggccagguggccgugcuggagcugagaaagcccggcagacugcccgacaccgcccugcccacccugcagaacggcgccgccgugaccgaccuggccugggaccccuucgacccccacagacuggccguggccggcgaggacgccagaaucagacuguggagagugcccgccgagggccuggaggaggugcugaccacccccgagaccgugcugaccggccacaccgagaagaucugcagccugagauuccacccccuggccgccaacgugcuggccagcagcagcuacgaccugaccgugagaaucugggaccugcaggccggcgccgacagacugaagcugcagggccaccaggaccagaucuucagccuggccuggagccccgacggccagcagcuggccaccgugugcaaggacggcagagugagaguguacagacccagaagcggccccgagccccugcaggagggccccggccccaagggcggcagaggcgccagaaucgugugggugugcgacggcagaugccugcuggugagcggcuucgacagccagagcgagagacagcugcugcuguacgaggccgaggcccuggccggcggcccccuggccgugcugggccuggacguggcccccagcacccugcugcccagcuacgaccccgacaccggccuggugcugcugaccggcaagggcgacaccagaguguuccuguacgagcugcugcccgagagccccuucuuccuggagugcaacagcuucaccagccccgacccccacaagggccuggugcugcugcccaagaccgagugcgacgugagagagguggagcugaugagaugccugagacugagacagagcagccuggagcccguggccuucagacugcccagagugagaaaggaguucuuccaggacgacguguuccccgacaccgccgugaucugggagcccgugcugagcgccgaggccuggcugcagggcgccaacggccagcccuggcugcugagccugcagccccccgacaugagccccgugagccaggcccccagagaggcccccgccagaagagcccccagcagcgcccaguaccuggaggagaagagcgaccagcagaagaaggaggagcugcugaacgccaugguggccaagcugggcaacagagaggacccccugccccaggacagcuucgagggcguggacgaggacgagugggacuaa

SEQ ID NO: 15536 - RNA, 3147 nt, Artificial Sequence
  CORO7-PAM16__Homo_sapiens__NP_001188408
augaacagauucagagugagcaaguucagacacaccgaggccagaccccccagaagagagagcuggaucagcgacaucagagccggcaccgcccccagcugcagaaaccacaucaagagcagcugcagccugaucgccuucaacagcgacagacccggcgugcugggcaucgugccccugcagggccagggcgaggacaagagaagaguggcccaccugggcugccacagcgaccuggugaccgaccuggacuucagccccuucgacgacuuccugcuggccaccggcagcgccgacagaaccgugaagcuguggagacugcccggccccggccaggcccugcccagcgcccccggcguggugcugggccccgaggaccugcccguggaggugcugcaguuccaccccaccagcgacggcauccuggugagcgccgccggcaccaccgugaaggugugggacgccgccaagcagcagccccugaccgagcuggccgcccacggcgaccuggugcagagcgccguguggagcagagacggcgcccuggugggcaccgccugcaaggacaagcagcugagaaucuucgaccccagaaccaagcccagagccagccagagcacccaggcccacgagaacagcagagacagcagacuggccuggaugggcaccugggagcaccuggugagcaccggcuucaaccagaugagagagagagaggugaagcugugggacaccagauucuucagcagcgcccuggccagccugacccuggacaccagccugggcugccuggugccccugcuggaccccgacagcggccugcuggugcuggccggcaagggcgagagacagcuguacugcuacgagguggugccccagcagcccgcccugagccccgugacccagugcgugcuggagagcgugcugagaggcgccgcccuggugcccagacaggcccuggccgugaugagcugcgaggugcugagagugcugcagcugagcgacaccgccaucgugcccaucggcuaccacgugcccagaaaggccguggaguuccacgaggaccuguuccccgacaccgccggcugcgugcccgccaccgacccccacagcuggugggccggcgacaaccagcaggugcagaaggugagccugaaccccgccugcagaccccaccccagcuucaccagcugccuggugccccccgccgagccccugcccgacaccgcccagcccgccgugauggagacccccgugggcgacgccgacgccagcgagggcuucagcagcccccccagcagccugaccagccccagcacccccagcagccugggccccagccugagcagcaccagcggcaucggcaccagccccagccugagaagccugcagagccugcugggccccagcagcaaguucagacacgcccagggcaccgugcugcacagagacagccacaucaccaaccugaagggccugaaccugaccacccccggcgagagcgacggcuucugcgccaacaagcugagaguggccgugccccugcugagcagcggcggccagguggccgugcuggagcugagaaagcccggcagacugcccgacaccgcccugcccacccugcagaacggcgccgccgugaccgaccuggccugggaccccuucgacccccacagacuggccguggccggcgaggacgccagaaucagacuguggagagugcccgccgagggccuggaggaggugcugaccacccccgagaccgugcugaccggccacaccgagaagaucugcagccugagauuccacccccuggccgccaacgugcuggccagcagcagcuacgaccugaccgugagaaucugggaccugcaggccggcgccgacagacugaagcugcagggccaccaggaccagaucuucagccuggccuggagccccgacggccagcagcuggccaccgugugcaaggacggcagagugagaguguacagacccagaagcggccccgagccccugcaggagggccccggccccaagggcggcagaggcgccagaaucgugugggugugcgacggcagaugccugcuggugagcggcuucgacagccagagcgagagacagcugcugcuguacgaggccgaggcccuggccggcggcccccuggccgugcugggccuggacguggcccccagcacccugcugcccagcuacgaccccgacaccggccuggugcugcugaccggcaagggcgacaccagaguguuccuguacgagcugcugcccgagagccccuucuuccuggagugcaacagcuucaccagccccgacccccacaagggccuggugcugcugcccaagaccgagugcgacgugagagagguggagcugaugagaugccugagacugagacagagcagccuggagcccguggccuucagacugcccagagugagaaaggaguucuuccaggacgacguguuccccgacaccgccgugaucugggagcccgugcugagcgccgaggccuggcugcagggcgccaacggccagcccuggcugcugagccugcagccccccgacaugagccccgugagccaggcccccagagaggcccccgccagaagagcccccagcagcgcccaguaccuggaggagaagagcgaccagcagaagaaggaggagcugcugaacgccaugguggccaagcugggcaacagagaggacccccugccccaggacagcuucgagggcguggacgaggacgagugggccaaguaccuggcccagaucaucgugaugggcgugcagguggugggcagagccuucgccagagcccugagacaggaguucgccgccagcagagccgccgccgacgccagaggcagagccggccacagaagcgccgccgccagcaaccugagcggccugagccugcaggaggcccagcagauccugaacgugagcaagcugagccccgaggaggugcagaagaacuacgagcaccuguucaaggugaacgacaagagcgugggcggcagcuucuaccugcagagcaagguggugagagccaaggagagacuggacgaggagcugaagauccaggcccaggaggacagagagaagggccagaugccccacaccuaa

SEQ ID NO: 15537 - RNA, 429 nt, Artificial Sequence
  COTL1__Homo_sapiens__NP_066972
auggccaccaagaucgacaaggaggccugcagagccgccuacaaccuggugagagacgacggcagcgccgugaucugggugaccuucaaguacgacggcagcaccaucgugcccggcgagcagggcgccgaguaccagcacuucauccagcagugcaccgacgacgugagacuguucgccuucgugagauucaccaccggcgacgccaugagcaagagaagcaaguucgcccugaucaccuggaucggcgagaacgugagcggccugcagagagccaagaccggcaccgacaagacccuggugaaggagguggugcagaacuucgccaaggaguucgugaucagcgacagaaaggagcuggaggaggacuucaucaagagcgagcugaagaaggccggcggcgccaacuacgacgcccagaccgaguaa

SEQ ID NO: 15538 - RNA, 720 nt, Artificial Sequence
  COX10__Homo_sapiens__XP_005256515
auggccgccagcccccacacccugagcagcagacugcugaccggcugcgugggcggcagcgugugguaccuggagagaagaaccauccaggacagcccccacaaguuccugcaccugcugagaaacgugaacaagcaguggaucaccuuccagcacuucagcuuccugaagagaauguacgugacccagcugaacagaagccacaaccagcaggugagacccaagcccgagcccguggccagccccuuccuggagaagaccagcagcggccaggccaaggccgagaucuacgagaugagaccccugagcccccccagccugagccugagcagaaagcccaacgagaaggagcugaucgagcuggagcccgacagcgugaucgaggacagcaucgacgugggcaaggagaccaaggaggagaagagauggaaggagaugaagcugcagguguacgaccugcccggcauccuggccagacugagcaagaucaagcugaccgcccugguggugagcaccaccgccgccggcuucgcccuggcccccggccccuucgacuggcccugcuuccugcugaccagcgugggcaccggccuggccagcugcgccgccaacagcaucaaccaguucuucgaggugcccuucgacagcaacaugaacagaaccaagaacagaccccuggugagaggccagaucagacagagcuucuucagcagcuucuaa

SEQ ID NO: 15539 - RNA, 693 nt, Artificial Sequence
  COX11__Homo_sapiens__NP_001156333
augggcggccuguggagacccggcuggagaugcgugcccuucugcggcuggagauggauccaccccggcagccccaccagagccgccgagagaguggagcccuuccugagacccgaguggagcggcaccggcggcgccgagagaggccugagauggcugggcaccuggaagagaugcagccugagagccagacaccccgcccugcagccccccagaagacccaagagcagcaaccccuucaccagagcccaggaggaggagagaagaagacagaacaagaccacccugaccuacguggccgccguggccgugggcaugcugggcgccagcuacgccgccgugccccuguacagacuguacugccagaccaccggccugggcggcagcgccguggccggccacgccagcgacaagaucgagaacauggugcccgugaaggacagaaucaucaagaucagcuucaacgccgacgugcacgccagccugcaguggaacuucagaccccagcagaccgagaucuacguggugcccggcgagaccgcccuggccuucuacagagccaagaaccccaccgacaagcccgugaucggcaucagcaccuacaacaucgugcccuucgaggccggccaguacuucaacaagauccaggugcugagcagcagacugcagagcugcaccgagagcaccuucuaa

SEQ ID NO: 15540 - RNA, 174 nt, Artificial Sequence
  COX14__Homo_sapiens__NP_001244062
augcccaccggcaagcagcuggccgacaucggcuacaagaccuucagcaccagcaugaugcugcugaccguguacggcggcuaccugugcagcgugagaguguaccacuacuuccaguggagaagagcccagagacaggccgccgaggagcagaagaccagcggcaucauguaa

SEQ ID NO: 15541 - RNA, 1167 nt, Artificial Sequence
  COX15__Homo_sapiens__NP_004367
augcagagacugcuguuccccccccugagagcccugaagggcagacaguaccugccccugcuggcccccagagccgcccccagagcccagugcgacugcaucagaagaccccugagacccggccaguacagcaccaucagcgagguggcccugcagagcggcagaggcaccgugagccugcccagcaaggccgccgagagaguggugggcagauggcugcuggugugcagcggcaccguggccggcgccgugauccugggcggcgugaccagacugaccgagagcggccugagcaugguggacuggcaccugaucaaggagaugaagccccccaccagccaggaggagugggaggccgaguuccagagauaccagcaguuccccgaguucaagauccugaaccacgacaugacccugaccgaguucaaguucaucugguacauggaguacagccacagaauguggggcagacuggugggccugguguacauccugcccgccgccuacuucuggagaaagggcuggcugagcagaggcaugaagggcagagugcuggcccugugcggccuggugugcuuccagggccugcugggcugguacauggugaagagcggccuggaggagaagagcgacagccacgacauccccagagugagccaguacagacuggccgcccaccugggcagcgcccuggugcuguacugcgccagccuguggaccagccugagccugcugcugcccccccacaagcugcccgagacccaccagcugcugcagcugagaagauucgcccacggcaccgccggccugguguuccugaccgcccugagcggcgccuucguggccggccuggacgccggccugguguacaacagcuuccccaagaugggcgagagcuggauccccgaggaccuguucaccuucagccccauccugagaaacguguucgagaaccccaccauggugcaguucgaccacagaauccugggcaucaccagcgugaccgccaucaccgugcuguacuuccugagcagaagaaucccccugcccagaagaaccaagauggccgccgugacccugcuggcccuggccuacacccagggccccgugcuguucaacuucaccuucaagaucagcgaccuggacgagggcaucagaaacaucuaa

SEQ ID NO: 15542 - RNA, 321 nt, Artificial Sequence
  COX16__Homo_sapiens__NP_057552
auguucgcccccgccgugaugagagccuucagaaagaacaagacccugggcuacggcgugcccaugcugcugcugaucgugggcggcagcuucggccugagagaguucagccagaucagauacgacgccgugaagagcaagauggaccccgagcuggagaagaagcugaaggagaacaagaucagccuggagagcgaguacgagaagaucaaggacagcaaguucgacgacuggaagaacaucagaggccccagacccugggaggaccccgaccugcugcagggcagaaaccccgagagccugaagaccaagaccaccuaa

SEQ ID NO: 15543 - RNA, 192 nt, Artificial Sequence
  COX17__Homo_sapiens__NP_005685
augcccggccugguggacagcaaccccgccccccccgagagccaggagaagaagccccugaagcccugcugcgccugccccgagaccaagaaggccagagacgccugcaucaucgagaagggcgaggagcacugcggccaccugaucgaggcccacaaggagugcaugagagcccugggcuucaagaucuaa

SEQ ID NO: 15544 - RNA, 1005 nt, Artificial Sequence
  COX18__Homo_sapiens__NP_001284661
augcugugcagacugggcggcagauggcugagaccccugcccgcccugcagcugugggccagagaccugccccuggcccccgugcccaccagcggcgccaagagacccacccugcccgugugggccguggcccccgugagcgccgugcacgccaacggcugguacgaggcccuggccgccagcagccccgugagaguggccgaggaggugcugcugggcgugcacgccgccaccggccugcccugguggggcagcauccugcugagcaccguggcccugagaggcgccgugacccugccccuggccgccuaccagcacuacauccuggccaagguggagaaccugcagcccgagaucaagaccaucgccagacaccugaaccaggagguggccgugagagccaaccagcugggcuggagcaagagagacgccagacugaccuaccugaagaacaugagaagacugaucagcgagcuguacgugagagacaacugccaccccuucaaggccaccgugcugguguggauccagcugcccauguggaucuucaugagcuucgcccugagaaaccugagcaccggcgccgcccacagcgaggccggcuucagcgugcaggagcagcuggccaccggcggcauccugugguuccccgaccugaccgcccccgacagcaccuggauccugcccaucagcgugggcgugaucaaccugcugaucguggagaucugcgcccugcagaagaucggcaugagcagauuccagaccuacaucaccuacuucgugagagccaugagcgugcugaugauccccaucgccgccaccgugcccagcagcaucgugcuguacuggcugugcagcagcuucgugggccugagccagaaccugcugcugagaagccccggcuucagacagcugugcagaauccccagcaccaagagcgacagcgagacccccuacaaggacaucuucgccgccuucaacaccaaguucaucagcagaaaguaa

SEQ ID NO: 15545 - RNA, 273 nt, Artificial Sequence
  COX19__Homo_sapiens__NP_001026788
augagcaccgccaugaacuucggcaccaagagcuuccagcccagaccccccgacaagggcagcuucccccuggaccaccugggcgagugcaagagcuucaaggagaaguucaugaagugccugcacaacaacaacuucgagaacgcccugugcagaaaggagagcaaggaguaccuggagugcagaauggagagaaagcugaugcugcaggagccccuggagaagcugggcuucggcgaccugaccagcggcaagagcgaggccaagaaguaa

SEQ ID NO: 15546 - RNA, 510 nt, Artificial Sequence
  COX4I1__Homo_sapiens__NP_001852
augcuggccaccagaguguucagccuggugggcaagagagccaucagcaccagcgugugcgugagagcccacgagagcguggugaagagcgaggacuucagccugcccgccuacauggacagaagagaccacccccugcccgagguggcccacgugaagcaccugagcgccagccagaaggcccugaaggagaaggagaaggccagcuggagcagccugagcauggacgagaagguggagcuguacagaaucaaguucaaggagagcuucgccgagaugaacagaggcagcaacgaguggaagaccguggugggcggcgccauguucuucaucggcuucaccgcccuggugaucauguggcagaagcacuacguguacggcccccugccccagagcuucgacaaggaguggguggccaagcagaccaagagaaugcuggacaugaaggugaaccccauccagggccuggccagcaagugggacuacgagaagaacgaguggaagaaguaa

SEQ ID NO: 15547 - RNA, 516 nt, Artificial Sequence
  COX4I2__Homo_sapiens__NP_115998
augcugcccagagccgccuggagccuggugcugagaaagggcggcggcggcagaagaggcaugcacagcagcgagggcaccaccagaggcggcggcaagaugagccccuacaccaacugcuacgcccagagauacuaccccaugcccgaggagcccuucugcaccgagcugaacgccgaggagcaggcccugaaggagaaggagaagggcagcuggacccagcugacccacgccgagaagguggcccuguacagacugcaguucaacgagaccuucgccgagaugaacagaagaagcaacgaguggaagaccgugaugggcugcguguucuucuucaucggcuucgccgcccuggugaucugguggcagagaguguacguguucccccccaagcccaucacccugaccgacgagagaaaggcccagcagcugcagagaaugcuggacaugaaggugaaccccgugcagggccuggccagcagaugggacuacgagaagaagcaguggaagaaguaa

SEQ ID NO: 15548 - RNA, 453 nt, Artificial Sequence
  COX5A__Homo_sapiens__NP_004246
augcugggcgccgcccugagaagaugcgccguggccgccaccaccagagccgaccccagaggccugcugcacagcgccagaacccccggccccgccguggccauccagagcgugagaugcuacagccacggcagccaggagaccgacgaggaguucgacgccagaugggugaccuacuucaacaagcccgacaucgacgccugggagcugagaaagggcaucaacacccuggugaccuacgacauggugcccgagcccaagaucaucgacgccgcccugagagccugcagaagacugaacgacuucgccagcaccgugagaauccuggagguggugaaggacaaggccggcccccacaaggagaucuaccccuacgugauccaggagcugagacccacccugaacgagcugggcaucagcacccccgaggagcugggccuggacaagguguaa

SEQ ID NO: 15549 - RNA, 390 nt, Artificial Sequence
  COX5B__Homo_sapiens__NP_001853
auggccagcagacugcugagaggcgccggcacccuggccgcccaggcccugagagccagaggccccagcggcgccgccgccaugagaagcauggccagcggcggcggcgugcccaccgacgaggagcaggccaccggccuggagagagagaucaugcuggccgccaagaagggccuggaccccuacaacgugcuggcccccaagggcgccagcggcaccagagaggaccccaaccuggugcccagcaucagcaacaagagaaucgugggcugcaucugcgaggaggacaacaccagcguggugugguucuggcugcacaagggcgaggcccagagaugccccagaugcggcgcccacuacaagcuggugccccagcagcuggcccacuaa

SEQ ID NO: 15550 - RNA, 330 nt, Artificial Sequence
  COX6A1__Homo_sapiens__NP_004364
auggccguggugggcgugagcagcgugagcagacugcugggcagaagcagaccccagcugggcagacccaugagcagcggcgcccacggcgaggagggcagcgccagaauguggaagacccugaccuucuucguggcccugcccggcguggccgugagcaugcugaacguguaccugaagagccaccacggcgagcacgagagacccgaguucaucgccuacccccaccugagaaucagaaccaagcccuuccccuggggcgacggcaaccacacccuguuccacaacccccacgugaacccccugcccaccggcuacgaggacgaguaa

SEQ ID NO: 15551 - RNA, 294 nt, Artificial Sequence
  COX6A2__Homo_sapiens__NP_005196
auggcccugccccugagaccccugaccagaggccuggccagcgccgccaagggcggccacggcggcgccggcgccagaaccuggagacugcugaccuucgugcuggcccugcccagcguggcccugugcaccuucaacagcuaccugcacagcggccacagacccagacccgaguucagacccuaccagcaccugagaaucagaaccaagcccuaccccuggggcgacggcaaccacacccuguuccacaacagccacgugaacccccugcccaccggcuacgagcaccccuaa

SEQ ID NO: 15552 - RNA, 261 nt, Artificial Sequence
  COX6B1__Homo_sapiens__NP_001854
auggccgaggacauggagaccaagaucaagaacuacaagaccgcccccuucgacagcagauuccccaaccagaaccagaccagaaacugcuggcagaacuaccuggacuuccacagaugccagaaggccaugaccgccaagggcggcgacaucagcgugugcgagugguaccagagaguguaccagagccugugccccaccagcugggugaccgacugggacgagcagagagccgagggcaccuuccccggcaagaucuaa

SEQ ID NO: 15553 - RNA, 228 nt, Artificial Sequence
  COX6C__Homo_sapiens__NP_004365
auggcccccgaggugcugcccaagcccagaaugagaggccugcuggccagaagacugagaaaccacauggccguggccuucgugcugagccugggcguggccgcccuguacaaguucagaguggccgaccagagaaagaaggccuacgccgacuucuacagaaacuacgacgugaugaaggacuucgaggagaugagaaaggccggcaucuuccagagcgugaaguaa

SEQ ID NO: 15554 - RNA, 240 nt, Artificial Sequence
  COX7A1__Homo_sapiens__NP_001855
augcaggcccugagagugagccaggcccugaucagaagcuucagcagcaccgccagaaacagauuccagaacagagugagagagaagcagaagcuguuccaggaggacaacgacaucccccuguaccugaagggcggcaucguggacaacauccuguacagagugaccaugacccugugccugggcggcaccguguacagccuguacagccugggcugggccagcuuccccagaaacuaa

SEQ ID NO: 15555 - RNA, 348 nt, Artificial Sequence
  COX7A2__Homo_sapiens__XP_011533748
augcacacccaggacagcgagguggugcccgugcccgccuggcccuucagccuggugguguucagcugcggcggcugcuggagcgugaccgccaagaugcugagaaaccugcuggcccugagacagaucggccagagaaccaucagcaccgccagcagaagacacuucaagaacaaggugcccgagaagcagaagcuguuccaggaggacgacgagaucccccuguaccugaagggcggcguggccgacgcccugcuguacagagccaccaugauccugaccgugggcggcaccgccuacgccaucuacgagcuggccguggccagcuuccccaagaagcaggaguaa

SEQ ID NO: 15556 - RNA, 345 nt, Artificial Sequence
  COX7A2L__Homo_sapiens__NP_001305965
auguacuacaaguucagcggcuucacccagaagcuggccggcgccugggccagcgaggccuacagcccccagggccugaagcccguggugagcaccgaggccccccccaucaucuucgccacccccaccaagcugaccagcgacagcaccguguacgacuacgccggcaagaacaaggugcccgagcugcagaaguucuuccagaaggccgacggcgugcccguguaccugaagagaggccugcccgaccagaugcuguacagaaccaccauggcccugaccgugggcggcaccaucuacugccugaucgcccuguacauggccagccagcccaagaacaaguaa

SEQ ID NO: 15557 - RNA, 246 nt, Artificial Sequence
  COX7B2__Homo_sapiens__XP_005248113
augauguucccccuggccagaaacgcccugagcagccugaagauccagagcauccugcagagcauggccagacacagccacgugaagcacagccccgacuuccacgacaaguacggcaacgccgugcuggccagcggcaccgccuucugcguggccaccuggguguucaccgccacccagaucggcaucgaguggaaccugagccccgugggcagagugacccccaaggaguggaagcaccaguaa

SEQ ID NO: 15558 - RNA, 243 nt, Artificial Sequence
  COX7B__Homo_sapiens__NP_001857
auguucccccuggugaagagcgcccugaacagacugcaggugagaagcauccagcagaccauggccagacagagccaccagaagagaacccccgacuuccacgacaaguacggcaacgccgugcuggccagcggcgccaccuucugcaucgugaccuggaccuacguggccacccaggugggcaucgaguggaaccugagccccgugggcagagugacccccaaggaguggagaaaccaguaa

SEQ ID NO: 15559 - RNA, 192 nt, Artificial Sequence
  COX7C__Homo_sapiens__NP_001858
augcugggccagagcaucagaagauucaccaccagcguggugagaagaagccacuacgaggagggccccggcaagaaccugcccuucagcguggagaacaaguggagccugcuggccaagaugugccuguacuucggcagcgccuucgccacccccuuccugguggugagacaccagcugcugaagaccuaa

SEQ ID NO: 15560 - RNA, 210 nt, Artificial Sequence
  COX8A__Homo_sapiens__NP_004065
augagcgugcugaccccccugcugcugagaggccugaccggcagcgccagaagacugcccgugcccagagccaagauccacagccugccccccgagggcaagcugggcaucauggagcuggccgugggccugaccagcugcuucgugaccuuccugcugcccgccggcuggauccugagccaccuggagaccuacagaagacccgaguaa

SEQ ID NO: 15561 - RNA, 1260 nt, Artificial Sequence
  CPA1__Homo_sapiens__NP_001859
augagaggccugcuggugcugagcgugcugcugggcgccguguucggcaaggaggacuucgugggccaccaggugcugagaaucagcguggccgacgaggcccaggugcagaaggugaaggagcuggaggaccuggagcaccugcagcuggacuucuggagaggccccgcccaccccggcagccccaucgacgugagagugcccuuccccagcauccaggccgugaagaucuuccuggagagccacggcaucagcuacgagaccaugaucgaggacgugcagagccugcuggacgaggagcaggagcagauguucgccuucagaagcagagccagaagcaccgacaccuucaacuacgccaccuaccacacccuggaggagaucuacgacuuccuggaccugcugguggccgagaacccccaccuggugagcaagauccagaucggcaacaccuacgagggcagacccaucuacgugcugaaguucagcaccggcggcagcaagagacccgccaucuggaucgacaccggcauccacagcagagagugggugacccaggccagcggcgugugguucgccaagaagaucacccaggacuacggccaggacgccgccuucaccgccauccuggacacccuggacaucuuccuggagaucgugaccaaccccgacggcuucgccuucacccacagcaccaacagaauguggagaaagaccagaagccacaccgccggcagccugugcaucggcguggaccccaacagaaacugggacgccggcuucggccugagcggcgccagcagcaaccccugcagcgagaccuaccacggcaaguucgccaacagcgagguggaggugaagagcaucguggacuucgugaaggaccacggcaacaucaaggccuucaucagcauccacagcuacagccagcugcugauguaccccuacggcuacaagaccgagcccgugcccgaccaggacgagcuggaccagcugagcaaggccgccgugaccgcccuggccagccuguacggcaccaaguucaacuacggcagcaucaucaaggccaucuaccaggccagcggcagcaccaucgacuggaccuacagccagggcaucaaguacagcuucaccuucgagcugagagacaccggcagauacggcuuccugcugcccgccagccagaucauccccaccgccaaggagaccuggcuggcccugcugaccaucauggagcacacccugaaccaccccuacuaa

SEQ ID NO: 15562 - RNA, 1260 nt, Artificial Sequence
  CPA2__Homo_sapiens__NP_001860
auggccaugagacugauccuguucuucggcgcccuguucggccacaucuacugccuggagaccuucgugggcgaccaggugcuggagaucgugcccagcaacgaggagcagaucaagaaccugcugcagcuggaggcccaggagcaccugcagcuggacuucuggaagagccccaccacccccggcgagaccgcccacgugagagugcccuucgugaacgugcaggccgugaagguguuccuggagagccagggcaucgccuacagcaucaugaucgaggacgugcaggugcugcuggacaaggagaacgaggagaugcuguucaacagaagaagagagagaagcggcaacuucaacuucggcgccuaccacacccuggaggagaucagccaggagauggacaaccugguggccgagcaccccggccuggugagcaaggugaacaucggcagcagcuucgagaacagacccaugaacgugcugaaguucagcaccggcggcgacaagcccgccaucuggcuggacgccggcauccacgccagagagugggugacccaggccaccgcccuguggaccgccaacaagaucgugagcgacuacggcaaggaccccagcaucaccagcauccuggacgcccuggacaucuuccugcugcccgugaccaaccccgacggcuacguguucagccagaccaagaacagaauguggagaaagaccagaagcaaggugagcggcagccugugcgugggcguggaccccaacagaaacugggacgccggcuucggcggccccggcgccagcagcaaccccugcagcgacagcuaccacggccccagcgccaacagcgagguggaggugaagagcaucguggacuucaucaagagccacggcaaggugaaggccuucaucacccugcacagcuacagccagcugcugauguuccccuacggcuacaagugcaccaagcuggacgacuucgacgagcugagcgagguggcccagaaggccgcccagagccugagaagccugcacggcaccaaguacaaggugggccccaucugcagcgugaucuaccaggccagcggcggcagcaucgacuggagcuacgacuacggcaucaaguacagcuucgccuucgagcugagagacaccggcagauacggcuuccugcugcccgccagacagauccugcccaccgccgaggagaccuggcugggccugaaggccaucauggagcacgugagagaccaccccuacuaa

SEQ ID NO: 15563 - RNA, 1254 nt, Artificial Sequence
  CPA3__Homo_sapiens__NP_001861
augagacugauccugcccgugggccugaucgccaccacccuggccaucgcccccgugagauucgacagagagaagguguucagagugaagccccaggacgagaagcaggccgacaucaucaaggaccuggccaagaccaacgagcuggacuucugguaccccggcgccacccaccacguggccgccaacaugaugguggacuucagagugagcgagaaggagagccaggccauccagagcgcccuggaccagaacaagaugcacuacgagauccugauccacgaccugcaggaggagaucgagaagcaguucgacgugaaggaggacauccccggcagacacagcuacgccaaguacaacaacugggagaagaucguggccuggaccgagaagaugauggacaaguaccccgagauggugagcagaaucaagaucggcagcaccguggaggacaacccccuguacgugcugaagaucggcgagaagaacgagagaagaaaggccaucuucaccgacugcggcauccacgccagagagugggugagccccgccuucugccagugguucguguaccaggccaccaagaccuacggcagaaacaagaucaugaccaagcugcuggacagaaugaacuucuacauccugcccguguucaacguggacggcuacaucuggagcuggaccaagaacagaauguggagaaagaacagaagcaagaaccagaacagcaagugcaucggcaccgaccugaacagaaacuucaacgccagcuggaacagcauccccaacaccaacgaccccugcgccgacaacuacagaggcagcgcccccgagagcgagaaggagaccaaggccgugaccaacuucaucagaagccaccugaacgagaucaagguguacaucaccuuccacagcuacagccagaugcugcuguuccccuacggcuacaccagcaagcugccccccaaccacgaggaccuggccaagguggccaagaucggcaccgacgugcugagcaccagauacgagaccagauacaucuacggccccaucgagagcaccaucuaccccaucagcggcagcagccuggacugggccuacgaccugggcaucaagcacaccuucgccuucgagcugagagacaagggcaaguucggcuuccugcugcccgagagcagaaucaagcccaccugcagagagaccaugcuggccgugaaguucaucgccaaguacauccugaagcacaccagcuaa

SEQ ID NO: 15564 - RNA, 1167 nt, Artificial Sequence
  CPA4__Homo_sapiens__NP_001156918
augagauggauccuguucaucggcgcccugaucggcagcagcaucugcggccaggagaaguucuucggcgaccaggugcugagaaucaacgugagaaacggcgacgagaucagcaagcugagccagcuggugaacagcaacaaccugaagcugaacuucuggaagagccccagcagcuucaacagacccguggacgugcuggugcccagcgugagccugcaggccuucaagagcuuccugagaagccagggccuggaguacgccgugaccaucgaggaccugcagaucuaccacgagauggacaacaucgccgccgacuuccccgaccuggccagaagagugaagaucggccacagcuucgagaacagacccauguacgugcugaaguucagcaccggcaagggcgugagaagacccgccguguggcugaacgccggcauccacagcagagaguggaucagccaggccaccgccaucuggaccgccagaaagaucgugagcgacuaccagagagaccccgccaucaccagcauccuggagaagauggacaucuuccugcugcccguggccaaccccgacggcuacguguacacccagacccagaacagacuguggagaaagaccagaagcagaaaccccggcagcagcugcaucggcgccgaccccaacagaaacuggaacgccagcuucgccggcaagggcgccagcgacaaccccugcagcgagguguaccacggcccccacgccaacagcgagguggaggugaagagcgugguggacuucauccagaagcacggcaacuucaagggcuucaucgaccugcacagcuacagccagcugcugauguaccccuacggcuacagcgugaagaaggcccccgacgccgaggagcuggacaagguggccagacuggccgccaaggcccuggccagcgugagcggcaccgaguaccaggugggccccaccugcaccaccguguaccccgccagcggcagcagcaucgacugggccuacgacaacggcaucaaguucgccuucaccuucgagcugagagacaccggcaccuacggcuuccugcugcccgccaaccagaucauccccaccgccgaggagaccuggcugggccugaagaccaucauggagcacgugagagacaaccuguacuaa

SEQ ID NO: 15565 - RNA, 1314 nt, Artificial Sequence
  CPA6__Homo_sapiens__NP_065094
augaagugccugggcaagagaagaggccaggccgccgccuuccugccccugugcuggcuguuccugaagauccugcagcccggccacagccaccuguacaacaacagauacgccggcgacaaggugaucagauucauccccaagaccgaggaggaggccuacgcccugaagaagaucagcuaccagcugaagguggaccuguggcagcccagcagcaucagcuacgugagcgagggcaccgugaccgacgugcacaucccccagaacggcagcagagcccugcuggccuuccugcaggaggccaacauccaguacaaggugcugaucgaggaccugcagaagacccuggagaagggcagcagccugcacacccagagaaacagaagaagccugagcggcuacaacuacgagguguaccacagccuggaggagauccagaacuggaugcaccaccugaacaagacccacagcggccugauccacauguucagcaucggcagaagcuacgagggcagaagccuguucauccugaagcugggcagaagaagcagacugaagagagccguguggaucgacugcggcauccacgccagagaguggaucggccccgccuucugccagugguucgugaaggaggcccugcugaccuacaagagcgaccccgccaugagaaagaugcugaaccaccuguacuucuacaucaugcccguguucaacguggacggcuaccacuucagcuggaccaacgacagauucuggagaaagaccagaagcagaaacagcagauucagaugcagaggcguggacgccaacagaaacuggaaggugaaguggugcgacgagggcgccagcaugcaccccugcgacgacaccuacugcggccccuuccccgagagcgagcccgaggugaaggccguggccaacuuccugagaaagcacagaaagcacaucagagccuaccugagcuuccacgccuacgcccagaugcugcuguaccccuacagcuacaaguacgccaccauccccaacuucagaugcguggagagcgccgccuacaaggccgugaacgcccugcagagcguguacggcgugagauacagauacggccccgccagcaccacccuguacgugagcagcggcagcagcauggacugggccuacaagaacggcauccccuacgccuucgccuucgagcugagagacaccggcuacuucggcuuccugcugcccgagaugcugaucaagcccaccugcaccgagaccaugcuggccgugaagaacaucaccaugcaccugcugaagaagugccccuaa

SEQ ID NO: 15566 - RNA, 5799 nt, Artificial Sequence
  CPAMD8__Homo_sapiens__NP_056507
auggcccccggcgcccugagaggcggcugcgagcagagagcccccggcggcggcgccagaaccgccgcccugggccccuggcccuggcccagccccggccccgcccccagccccggcgccgccccccccagaagcagaaagaugagcggcgcccugcuguggccccugcugccccugcugcugcugcugcugagcgccagagacggcgugagagccgcccagccccaggcccccggcuaccugaucgccgcccccagcguguucagagccggcguggaggaggugaucagcgugaccaucuucaacagccccagagaggugaccgugcaggcccagcugguggcccagggcgagcccguggugcagagccagggcgccauccuggacaagggcaccaucaagcugaaggugcccaccggccugagaggccaggcccugcugaagguguggggcagaggcuggcaggccgaggagggcccccuguuccacaaccagaccagcgugaccguggacggcagaggcgccagcguguucauccagaccgacaagcccguguacagaccccagcacagagugcugaucagcaucuucaccgugagccccaaccugagacccgugaacgagaagcuggaggccuacauccuggaccccagaggcagcagaaugaucgaguggagacaccugaagcccuucugcugcggcaucaccaacaugagcuucccccugagcgaccagcccgugcugggcgagugguucaucuucguggagaugcagggccacgccuacaacaagagcuucgaggugcagaaguacgugcugcccaaguucgagcugcugaucgacccccccagauacauccaggaccuggacgccugcgagaccggcaccgugagagccagauacaccuucggcaagcccguggccggcgcccugaugaucaacaugaccgugaacggcgugggcuacuacagccacgaggugggcagacccgugcugagaaccaccaagauccugggcagcagagacuucgacaucugcgugagagacaugauccccgccgacgugcccgagcacuucagaggcagagugagcaucugggccauggugaccagcguggacggcagccagcagguggccuucgacgacagcacccccgugcagagacagcugguggacaucagauacagcaaggacaccagaaagcaguucaagcccggccuggccuacgugggcaagguggagcugagcuaccccgacggcagccccgccgagggcgugaccgugcagaucaaggccgagcugacccccaaggacaacaucuacaccagcgagguggugagccagagaggccuggugggcuucgagauccccagcauccccaccagcgcccagcacguguggcuggagaccaaggugauggcccugaacggcaagcccgugggcgcccaguaccugcccagcuaccugagccugggcagcugguacagccccagccagugcuaccugcagcugcagccccccagccacccccugcaggugggcgaggaggccuacuucagcgugaagagcaccugccccugcaacuucacccuguacuacgagguggccgccagaggcaacaucgugcugagcggccagcagcccgcccacaccacccagcagagaagcaagagagccgcccccgcccuggagaagcccaucagacugacccaccugagcgagaccgagcccccccccgcccccgaggccgagguggacgugugcgugaccagccugcaccuggccgugacccccagcauggugccccugggcagacugcugguguucuacgugagagagaacggcgagggcguggccgacagccugcaguucgccguggagaccuucuucgagaaccaggugagcgugaccuacagcgccaacgagacccagcccggcgaggugguggaccugagaaucagagccgccagaggcagcugcgugugcguggccgccguggacaagagcguguaccugcugagaagcggcuucagacugacccccgcccagguguuccaggagcuggaggacuacgacgugagcgacagcuucggcgugagcagagaggacggccccuucuggugggccggccugaccgcccagagaagaagaagaagcagcguguuccccuggcccuggggcaucaccaaggacagcggcuucgccuucaccgagaccggccugguggugaugaccgacagagugagccugaaccacagacaggacggcggccuguacaccgacgaggccgugcccgccuuccagccccacaccggcagccugguggccguggcccccagcagacacccccccagaaccgagaagagaaagagaaccuucuuccccgagaccuggaucuggcacugccugaacaucagcgaccccagcggcgagggcacccugagcgugaaggugcccgacagcaucaccagcugggugggcgaggccguggcccugagcaccagccagggccugggcaucgccgagcccagccugcugaagaccuucaagcccuucuucguggacuucaugcugcccgcccugaucaucagaggcgagcaggugaagaucccccugagcguguacaacuacaugggcaccugcgccgagguguacaugaagcugagcgugcccaagggcauccaguucgugggccaccccggcaagagacacgugaccaagaagaugugcguggcccccggcgaggccgagcccaucuggguggugcugagcuucagcgaccugggccugaacaacaucaccgccaaggcccuggccuacggcgacaccaacugcugcagagacggcagaagcagcaagcaccccgaggagaaccacgccgacagaagagugcccaucggcguggaccacgugagaagaagcgugaugguggaggccgagggcgugcccagagccuacaccuacagcgccuucuucugccccagcgagagagugcacaucagcacccccaacaaguacgaguuccaguacgugcagagaccccugagacugaccagauucgacguggccgugagagcccacaacgacgccagaguggcccugagcagcggcccccaggacaccgccggcaugaucgagaucgugcugggcggccaccagaacaccagaagcuggaucagcaccagcaagaugggcgagcccguggccagcgcccacaccgccaagauccugagcugggacgaguucagaaccuucuggaucagcuggagaggcggccugauccaggugggccacggccccgagcccagcaacgagagcgugaucguggccuggacccugcccagaccccccgaggugcaguucaucggcuucagcaccggcuggggcagcaugggcgaguucagaaucuggagaaagauggagguggacgagagcuacagcgaggccuucacccugggcgugccccacggcgccauccccggcagcgagagagccaccgccagcaucaucggcgacgugaugggccccacccugaaccaccugaacaaccugcugagacugcccuucggcugcggcgagcagaacaugauccacuucgcccccaacguguucgugcugaaguaccugcagaagacccagcagcugagccccgagguggagagagagaccaccgacuaccuggugcagggcuaccagagacagcugaccuacaagagacaggacggcagcuacagcgccuucggcgagagagacgccagcggcagcauguggcugaccgccuucgugcugaagagcuucgcccaggccagaagcuucaucuucguggaccccagagagcuggccgccgccaagagcuggaucauccagcagcagcaggccgacggcagcuuccuggccgugggcagagugcugaacaaggacauccagggcggcauccacggcaccgugccccugaccgccuacguggugguggcccugcuggagaccggcaccgccagcgaggaggagagaggcagcaccgacaaggccagacacuuccuggagagcgccgccccccuggccauggaccccuacagcugcgcccugaccaccuacgcccugacccugcugagaagccccgccgcccccgaggcccugagaaagcugagaagccuggccaucaugagagacggcgugacccacuggagccugagcaacagcugggacguggacaagggcaccuuccugagcuucagcgacagagugagccagagcguggugagcgccgagguggagaugaccgccuacgcccugcugaccuacacccugcugggcgacguggccgccgcccugcccguggugaaguggcugagccagcagagaaacgcccugggcggcuucagcagcacccaggacaccugcguggcccugcaggcccuggccgaguacgccauccugagcuacgccggcggcaucaaccugaccgugagccuggccagcaccaaccuggacuaccaggagaccuucgagcugcacagaaccaaccagaaggugcugcagaccgccgccauccccagccugcccaccggccuguucgugagcgccaagggcgacggcugcugccugaugcagaucgacgugaccuacaacgugcccgaccccguggccaagcccgccuuccagcugcuggugagccugcaggagcccgaggcccagggcagacccccccccaugcccgccagcgccgccgagggcagcagaggcgacuggccccccgccgacgacgacgaccccgccgccgaccagcaccaccaggaguacaaggugaugcuggaggugugcaccagauggcugcacgccggcagcagcaacauggccgugcuggaggugccccugcugagcggcuucagagccgacaucgagagccuggagcagcugcugcuggacaagcacaugggcaugaagagauacgagguggccggcagaagagugcuguucuacuucgacgagauccccagcagaugccugaccugcgugagauucagagcccugagagagugcguggugggcagaaccagcgcccugcccgugagcguguacgacuacuacgagcccgccuucgaggccaccagauucuacaacgugagcacccacagcccccuggccagagagcugugcgccggccccgccugcaacgagguggagagagcccccgccagaggccccggcugguuccccggcgagagcggccccgccguggcccccgaggagggcgccgccaucgccagaugcggcugcgaccacgacugcggcgcccagggcaaccccgugugcggcagcgacggcgugguguacgccagcgccugcagacugagagaggccgccugcagacaggccgccccccuggagcccgccccccccagcugcugcgcccuggagcagagacugcccgccagcagcagcagcaccuacggcgacgaccuggccagcguggcccccggcccccugcagcaggacgugaagcugaacggcgccggccuggagguggaggacagcgaccccgagcccgagggcgaggccgaggacagagugaccgccggccccagaccccccgugagcagcggcaaccuggagagcagcacccagagcgccagccccuuccacagauggggccagacccccgccccccagagacacagcggcagaguggugggcgcccacagacccggccugcugagccccguguucguguacagccccgccuuccagagcggcggcgaggagggccuguggaugagcaacaccugcacccugagauaa

SEQ ID NO: 15567 - RNA, 1254 nt, Artificial Sequence
  CPB1__Homo_sapiens__NP_001862
augcuggcccugcuggugcuggugaccguggcccuggccagcgcccaccacggcggcgagcacuucgagggcgagaagguguucagagugaacguggaggacgagaaccacaucaacaucaucagagagcuggccagcaccacccagaucgacuucuggaagcccgacagcgugacccagaucaagccccacagcaccguggacuucagagugaaggccgaggacaccgugaccguggagaacgugcugaagcagaacgagcugcaguacaaggugcugaucagcaaccugagaaacgugguggaggcccaguucgacagcagagugagagccaccggccacagcuacgagaaguacaacaagugggagaccaucgaggccuggacccagcagguggccaccgagaaccccgcccugaucagcagaagcgugaucggcaccaccuucgagggcagagccaucuaccugcugaaggugggcaaggccggccagaacaagcccgccaucuucauggacugcggcuuccacgccagagaguggaucagccccgccuucugccagugguucgugagagaggccgugagaaccuacggcagagagauccaggugaccgagcugcuggacaagcuggacuucuacgugcugcccgugcugaacaucgacggcuacaucuacaccuggaccaagagcagauucuggagaaagaccagaagcacccacaccggcagcagcugcaucggcaccgaccccaacagaaacuucgacgccggcuggugcgagaucggcgccagcagaaaccccugcgacgagaccuacugcggccccgccgccgagagcgagaaggagaccaaggcccuggccgacuucaucagaaacaagcugagcagcaucaaggccuaccugaccauccacagcuacagccagaugaugaucuaccccuacagcuacgccuacaagcugggcgagaacaacgccgagcugaacgcccuggccaaggccaccgugaaggagcuggccagccugcacggcaccaaguacaccuacggccccggcgccaccaccaucuaccccgccgccggcggcagcgacgacugggccuacgaccagggcaucagauacagcuucaccuucgagcugagagacaccggcagauacggcuuccugcugcccgagagccagaucagagccaccugcgaggagaccuuccuggccaucaaguacguggccagcuacgugcuggagcaccuguacuaa

SEQ ID NO: 15568 - RNA, 1161 nt, Artificial Sequence
  CPB2__Homo_sapiens__NP_001265470
augaagcugugcagccuggccgugcuggugcccaucgugcuguucugcgagcagcacguguucgccuuccagagcggccaggugcuggccgcccugcccagaaccagcagacaggugcaggugcugcagaaccugaccaccaccuacgagaucgugcuguggcagcccgugaccgccgaccugaucgugaagaagaagcaggugcacuucuucgugaacgccagcgacguggacaacgugaaggcccaccugaacgugagcggcauccccugcagcgugcugcuggccgacguggaggaccugauccagcagcagaucagcaacgacaccgugagccccagagccagcgccagcuacuacgagcaguaccacagccugaacgagaucuacagcuggaucgaguucaucaccgagagacaccccgacaugcugaccaagauccacaucggcagcagcuucgagaaguacccccuguacgugcugaaggugagcggcaaggagcaggccgccaagaacgccaucuggaucgacugcggcauccacgccagagaguggaucagccccgccuucugccugugguucaucggccacaacagaauguggagaaagaacagaagcuucuacgccaacaaccacugcaucggcaccgaccugaacagaaacuucgccagcaagcacuggugcgaggagggcgccagcagcagcagcugcagcgagaccuacugcggccuguaccccgagagcgagcccgaggugaaggccguggccagcuuccugagaagaaacaucaaccagaucaaggccuacaucagcaugcacagcuacagccagcacaucguguuccccuacagcuacaccagaagcaagagcaaggaccacgaggagcugagccugguggccagcgaggccgugagagccaucgagaagaucagcaagaacaccagauacacccacggccacggcagcgagacccuguaccuggcccccggcggcggcgacgacuggaucuacgaccugggcaucaaguacagcuucaccaucgagcugagagacaccggcaccuacggcuuccugcugcccgagagauacaucaagcccaccugcagagaggccuucgccgccgugagcaagaucgccuggcacgugaucagaaacguguaa

SEQ ID NO: 15569 - RNA, 3402 nt, Artificial Sequence
  CPD__Homo_sapiens__NP_001186704
augagauucgugcugagcggcaaccugcacggcggcagcgugguggccagcuaccccuucgacgacagccccgagcacaaggccaccggcaucuacagcaagaccagcgacgacgagguguucaaguaccuggccaaggccuacgccagcaaccaccccaucaugaagaccggcgagccccacugccccggcgacgaggacgagaccuucaaggacggcaucaccaacggcgcccacugguacgacguggagggcggcaugcaggacuacaacuacgugugggccaacugcuucgagaucacccuggagcugagcugcugcaaguacccccccgccagccagcugagacaggagugggagaacaacagagagagccugaucacccugaucgagaaggugcacaucggcgugaagggcuucgugaaggacagcaucaccggcagcggccuggagaacgccaccaucagcguggccggcaucaaccacaacaucaccaccggcagauucggcgacuucuacagacugcuggugcccggcaccuacaaccugaccguggugcugaccggcuacaugccccugaccgugaccaacgugguggugaaggagggccccgccaccgagguggacuucagccugagacccaccgugaccagcgugauccccgacaccaccgaggccgugagcaccgccagcaccguggccauccccaacauccugagcggcaccagcagcagcuaccagcccauccagcccaaggacuuccaccaccaccacuuccccgacauggagaucuuccugagaagauucgccaacgaguaccccaacaucaccagacuguacagccugggcaagagcguggagagcagagagcuguacgugauggagaucagcgacaaccccggcgugcacgagcccggcgagcccgaguucaaguacaucggcaacaugcacggcaacgagguggugggcagagagcugcugcugaaccugaucgaguaccugugcaagaacuucggcaccgaccccgaggugaccgaccuggugcacaacaccagaauccaccugaugcccagcaugaaccccgacggcuacgagaagagccaggagggcgacagcaucagcgugaucggcagaaacaacagcaacaacuucgaccugaacagaaacuuccccgaccaguucgugcagaucaccgaccccacccagcccgagaccaucgccgugaugagcuggaugaagagcuaccccuucgugcugagcgccaaccugcacggcggcagccugguggugaacuaccccuucgacgacgacgagcagggccuggccaccuacagcaagagccccgacgacgccguguuccagcagaucgcccugagcuacagcaaggagaacagccagauguuccagggcagacccugcaagaacauguaccccaacgaguacuucccccacggcaucaccaacggcgccagcugguacaacgugcccggcggcaugcaggacuggaacuaccugcagaccaacugcuucgaggugaccaucgagcugggcugcgugaaguacccccuggagaaggagcugcccaacuucugggagcagaacagaagaagccugauccaguucaugaagcaggugcaccagggcgugagaggcuucgugcuggacgccaccgacggcagaggcauccugaacgccaccaucagcguggccgagaucaaccaccccgugaccaccuacaagaccggcgacuacuggagacugcuggugcccggcaccuacaagaucaccgccagcgccagaggcuacaaccccgugaccaagaacgugaccgugaagagcgagggcgccauccaggugaacuucacccuggugagaagcagcaccgacagcaacaacgagagcaagaagggcaagggcgccagcagcagcaccaacgacgccagcgaccccaccaccaaggaguucgagacccugaucaaggaccugagcgccgagaacggccuggagagccugaugcugagaagcagcagcaaccuggcccuggcccuguacagauaccacagcuacaaggaccugagcgaguuccugagaggccuggugaugaacuacccccacaucaccaaccugaccaaccugggccagagcaccgaguacagacacaucuggagccuggagaucagcaacaagcccaacgugagcgagcccgaggagcccaagaucagauucguggccggcauccacggcaacgcccccgugggcaccgagcugcugcuggcccuggccgaguuccugugccugaacuacaagaagaaccccgccgugacccagcugguggacagaaccagaaucgugaucgugcccagccugaaccccgacggcagagagagagcccaggagaaggacugcaccagcaagaucggccagaccaacgccagaggcaaggaccuggacaccgacuucaccaacaacgccagccagcccgagaccaaggccaucaucgagaaccugauccagaagcaggacuucagccugagcguggcccuggacggcggcagcaugcuggugaccuaccccuacgacaagcccgugcagaccguggagaacaaggagacccugaagcaccuggccagccuguacgccaacaaccaccccagcaugcacaugggccagcccagcugccccaacaagagcgacgagaacauccccggcggcgugaugagaggcgccgaguggcacagccaccugggcagcaugaaggacuacagcgugaccuacggccacugccccgagaucaccguguacaccagcugcugcuacuuccccagcgccgccagacugcccagccugugggccgacaacaagagaagccugcugagcaugcugguggaggugcacaagggcgugcacggcuucgugaaggacaagaccggcaagcccaucagcaaggccgugaucgugcugaacgagggcaucaaggugcagaccaaggagggcggcuacuuccacgugcugcuggcccccggcgugcacaacaucaucgccaucgccgacggcuaccagcagcagcacagccagguguucgugcaccacgacgccgccagcagcguggugaucguguucgacaccgacaacagaaucuucggccugcccagagagcugguggugaccgugagcggcgccaccaugagcgcccugauccugaccgccugcaucaucuggugcaucugcagcaucaagagcaacagacacaaggacggcuuccacagacugagacagcaccacgacgaguacgaggacgagaucagaaugaugagcaccggcagcaagaagagccugcugagccacgaguuccaggacgagaccgacaccgaggaggagacccuguacagcagcaagcacuaa

SEQ ID NO: 15570 - RNA, 1476 nt, Artificial Sequence
  CPEB1__Homo_sapiens__NP_001073001
augcuguuccccaccagcgcccaggagagcagcagaggccugcccgacgccaacgaccugugccugggccugcagagccugagccugaccggcugggacagacccuggagcacccaggacagcgacagcagcgcccagagcagcacccacagcgugcugagcaugcugcacaacccccugggcaacgugcugggcaagcccccccugagcuuccugccccuggacccccugggcagcgaccugguggacaaguuccccgcccccagcgugagaggcagcagacuggacaccagacccauccuggacagcagaagcagcagccccagcgacagcgacaccagcggcuucagcagcggcagcgaccaccugagcgaccugaucagcagccugagaaucagccccccccugcccuuccugagccugagcggcggcggccccagagacccccugaagaugggcgugggcagcagaauggaccaggagcaggccgcccuggccgccgugacccccagccccaccagcgccagcaagagauggcccggcgccagcguguggcccagcugggaccugcuggaggcccccaaggaccccuucagcaucgagagagaggccagacugcacagacaggccgccgccgugaacgaggccaccugcaccuggagcggccagcugccccccagaaacuacaagaaccccaucuacagcugcaagguguuccugggcggcgugcccugggacaucaccgaggccggccuggugaacaccuucagaguguucggcagccugagcguggaguggcccggcaaggacggcaagcaccccagaugcccccccaagggcaacaugcccaagggcuacguguaccugguguucgagcuggagaagagcgugagaagccugcugcaggccugcagccacgacccccugagccccgacggccugagcgaguacuacuucaagaugagcagcagaagaaugagaugcaaggaggugcaggugauccccugggugcuggccgacagcaacuucgugagaagccccagccagagacuggaccccagcagaaccguguucgugggcgcccugcacggcaugcugaacgccgaggcccuggccgccauccugaacgaccuguucggcggcgugguguacgccggcaucgacaccgacaagcacaaguaccccaucggcagcggcagagugaccuucaacaaccagagaagcuaccugaaggccgugagcgccgccuucguggagaucaagaccaccaaguucaccaagaaggugcagaucgaccccuaccuggaggacagccugugccacaucugcagcagccagcccggccccuucuucugcagagaccaggugugcuucaaguacuucugcagaagcugcuggcacuggagacacagcauggagggccugagacaccacagcccccugaugagaaaccagaagaacagagacagcagcuaa

SEQ ID NO: 15571 - RNA, 2055 nt, Artificial Sequence
  CPEB3__Homo_sapiens__NP_001171608
augcaggacgaccugcugauggacaagagcaagacccagccccagccccagcagcagcagagacagcagcagcagccccagcccgagagcagcgugagcgaggcccccagcaccccccugagcagcgagacccccaagcccgaggagaacagcgccgugcccgcccugagccccgccgccgccccccccgcccccaacggccccgacaagaugcagauggagagcccccugcugcccggccugagcuuccaccagcccccccagcagcccccccccccccaggagcccgccgcccccggcgccagccugagccccagcuucggcagcaccuggagcaccggcaccaccaacgccguggaggacagcuucuuccagggcaucacccccgugaacggcaccaugcuguuccagaacuucccccaccacgugaaccccguguucggcggcaccuucagcccccagaucggccuggcccagacccagcaccaccagcagccccccccccccgcccccgccccccagcccgcccagcccgcccagcccccccaggcccagcccccccagcagagaagaagccccgccagccccagccaggcccccuacgcccagagaagcgccgccgccgccuacggccaccagcccaucaugaccagcaagcccagcagcagcagcgccguggccgccgccgccgccgccgccgccgccagcagcgccagcagcagcuggaacacccaccagagcgugaacgccgccuggagcgcccccagcaaccccuggggcggccugcaggccggcagagaccccagaagagccgugggcgugggcgugggcgugggcgugggcgugcccagcccccugaaccccaucagcccccugaagaagcccuucagcagcaacgugaucgccccccccaaguuccccagagccgccccccugaccagcaagagcuggauggaggacaacgccuucagaaccgacaacggcaacaaccugcugcccuuccaggacagaagcagacccuacgacaccuucaaccugcacagccuggagaacagccugauggacaugaucagaaccgaccacgagccccugaagggcagaaugggcaucaacuuccaccaccccggcaccgacaacaucauggcccugaacagcagaagcagccuguuccccuucgaggacgccuuccuggacgacagccacggcgaccaggcccugagcagcggccugagcagccccaccagaugccagaacggcgagagaguggagagauacagcagaaagguguucgugggcggccugccccccgacaucgacgaggacgagaucaccgccagcuucagaagauucggcccccuggugguggacuggccccacaaggccgagagcaagagcuacuucccccccaagggcuacgccuuccugcuguuccaggaggagagcagcgugcaggcccugaucgacgccugccuggaggaggacggcaagcuguaccugugcgugagcagccccaccaucaaggacaagcccgugcagaucagacccuggaaccugagcgacagcgacuucgugauggacggcagccagccccuggaccccagaaagaccaucuucgugggcggcgugcccagaccccugagagccguggagcuggccaugaucauggacagacuguacggcggcgugugcuacgccggcaucgacaccgaccccgagcugaaguaccccaagggcgccggcagaguggccuucagcaaccagcagagcuacaucgccgccaucagcgccagauucgugcagcugcagcacaacgacaucgacaagagaguggaggugaagcccuacgugcuggacgaccagaugugcgacgagugccagggcaccagaugcggcggcaaguucgcccccuucuucugcgccaacgugaccugccugcaguacuacugcgaguacugcugggccagcauccacagcagagccggcagagaguuccacaagccccuggugaaggagggcggcgacagacccagacacgugcccuucagauggagcuaa

SEQ ID NO: 15572 - RNA, 2190 nt, Artificial Sequence
  CPEB4__Homo_sapiens__NP_085130
augggcgacuacggcuucggcgugcuggugcagagcaacaccggcaacaagagcgccuuccccgugagauuccacccccaccugcagcccccccaccaccaccagaacgccacccccagccccgccgccuucaucaacaacaacaccgccgccaacggcagcagcgccggcagcgccuggcuguuccccgcccccgccacccacaacauccaggacgagauccugggcagcgagaaggccaagagccagcagcaggagcagcaggacccccuggagaagcagcagcugagccccagccccggccaggaggccggcauccugcccgagaccgagaaggccaagagcgaggagaaccagggcgacaacagcagcgagaacggcaacggcaaggagaagaucagaaucgagagccccgugcugaccggcuucgacuaccaggaggccaccggccugggcaccagcacccagccccugaccagcagcgccagcagccugaccggcuucagcaacuggagcgccgccaucgcccccagcagcagcaccaucaucaacgaggacgccagcuucuuccaccagggcggcgugcccgccgccagcgccaacaacggcgcccugcuguuccagaacuucccccaccacgugagccccggcuucggcggcagcuucagcccccagaucggcccccugagccagcaccacccccaccacccccacuuccagcaccaccacagccagcaccagcagcagagaagaagccccgccagcccccaccccccccccuucacccacagaaacgccgccuucaaccagcugccccaccuggccaacaaccugaacaagccccccagccccuggagcagcuaccagagccccagccccacccccagcagcagcuggagccccggcggcggcggcuacggcggcuggggcggcagccagggcagagaccacagaagaggccugaacggcggcaucaccccccugaacagcaucagcccccugaagaagaacuucgccagcaaccacauccagcugcagaaguacgccagacccagcagcgccuucgcccccaagagcuggauggaggacagccugaacagagccgacaacaucuuccccuuccccgacagacccagaaccuucgacaugcacagccuggagagcagccugaucgacaucaugagagccgagaacgacaccaucaagggcagacugaacuacagcuaccccggcagcgacagcagccugcugaucaacgccagaaccuacggcagaagaagaggccagagcagccuguuccccauggaggacggcuuccuggacgacggcagaggcgaccagccccugcacagcggccugggcagcccccacugcuucagccaccagaacggcgagagaguggagagauacagcagaaagguguucgugggcggccugccccccgacaucgacgaggacgagaucaccgccagcuucagaagauucggcccccugaucguggacuggccccacaaggccgagagcaagagcuacuucccccccaagggcuacgccuuccugcuguuccaggacgagagcagcgugcaggcccugaucgacgccugcaucgaggaggacggcaagcuguaccugugcgugagcagccccaccaucaaggacaagcccgugcagaucagacccuggaaccugagcgacagcgacuucgugauggacggcagccagccccuggaccccagaaagaccaucuucgugggcggcgugcccagaccccugagagccguggagcuggccaugaucauggacagacuguacggcggcgugugcuacgccggcaucgacaccgaccccgagcugaaguaccccaagggcgccggcagaguggccuucagcaaccagcagagcuacaucgccgccaucagcgccagauucgugcagcugcagcacggcgagaucgacaagagaguggaggugaagcccuacgugcuggacgaccagcugugcgacgagugccagggcgccagaugcggcggcaaguucgcccccuucuucugcgccaacgugaccugccugcaguacuacugcgaguacugcugggccgccauccacagcagagccggcagagaguuccacaagccccuggugaaggagggcggcgacagacccagacacaucagcuucagauggaacuaa

SEQ ID NO: 15573 - RNA, 2352 nt, Artificial Sequence
  CPED1__Homo_sapiens__NP_001099003
auggugugcagacccguguuccccugcagaagaagauucugccccagacccuuccuggugggccuggugguggccaucugccuguucuaccagacccugacccugagaggcagcagaaagcugaccgccgccgcccccggcgccgugccccacaccagcaccgagacccaggccagcagaugcaagaagggcuucagccaggacaagcagugcuuccugcugagcggcaacgcccaggagaccagaaaggugaaggagagcauggagacccacuucggcagccacggcagaagagccauccuguacagaccccccuucuacagcaagaccgagcugcagcugcaccagcacauccugacccagcacggcuacaccguggugaucgccgaggagagacugaacgccggccugggccccggccugcuggagcagggcgaccugggcagcugggaccugcugaucugccugagcagcaagaaggccgagggcacccccugcaucagcaaggaggugaugugccagcugggccugcaccagaaggccaacagacugcccgagauccagcagccccugugcagaaaggagggccugugccagaucgugagaagauuccccgagcugcagcugcccgugagccccagcgugugccuggaccagggcaugcagcugaagcccagcaccagcagccaccugcugaagaccgugaagcccagaguguggaagcccggcgacuggagcagagagcagcugaacgagaccaccgugcuggccccccacgagaccaucuucagagccgaggaccugagcgugauccugaaggccuacgugcuggugaccagccugaccccccugagagccuucauccacagcaccggcaccguguggaacccccccaagaagaagagauucaccgugaagcugcagaccuucuucgagaccuuccugagagccagcagcccccagcaggccuucgacaucaugaaggaggccaucggcaagcugcugcuggccgccgagguguucagcgagaccagcacccugggccccaagaccuuccacagaugcagauucugcuuccagcugcugaccuucgacaucggcuacggcagcuucauguaccccguggugcugcaggugcacgagcaccugaacuuccaggacuacgacaacauggacuucgaggaccagaacaccgaggaguuccugcugaacgacaccuucaacuuccuguuccccaacgagagcagccugagcaucuucagcgagaucuuccagagacuguacagaagcgacguguucaagggcgagaacuaccagaaggagcugaaccagugccugagccuggaggagaucaacagcaucaugaccuucaucaaggagcugggcagccugggccaguuccagcugcuguuccccagcaccacccccggcauccagagccugaugcacgaguucuacgacguggccaaccccgugggcaaccccggcagcgugcugacccaguacuggagccugcugaacguguucgagcaguuccaguucaugaacaagaagacccagccccacccccuggaguggaacagcuucaccgaggacaagaacaucgagaagccccaggugcccuucgacgccaucgagaacaagaaggccgccgugccccagaucaagaacgagaacaaggagauccacugcagcgacgacgagaacacccccugccacaucaagcagaucuucacccacccccaccuggagcugaaccccgacuuccaccccaagaucaaggacuacuacugcgaggugcccuucgacguggugaccgugaccaucggcguggagacccccaagugccugugcaaggugcaccuguacgagcaggccggccccagcuucgccagcuacccccugggccugggcaugaacaagaucagcaucuucgugguggacgagagccccgcccacggcgagacccugaucaccuacaagcugaccaucuacagagaggacagacccagccugccccuguucgaggccuucaccgccugcggcuucgugcaggacugcggccugcugauccaccccgaggagaccugcggccugcagcccaucagcagcgacuacaucgaggccauccugcagagcgagcugaagagaugccccagcggcgacaugaagggccaguggaucgugcccugccugagcugcagcgacaacagaaccugcgacuggagagagaucaccuggcagccccacaacugccaguacggcgugcugaccaagccccagcugcagcagugccugggcggcagaaagcugggcguggacgugcagagagugcccagaagcagaaacuaa

SEQ ID NO: 15574 - RNA, 1431 nt, Artificial Sequence
  CPE__Homo_sapiens__NP_001864
auggccggcagaggcggcagcgcccugcuggcccugugcggcgcccuggccgccugcggcuggcugcugggcgccgaggcccaggagcccggcgcccccgccgccggcaugagaagaagaagaagacugcagcaggaggacggcaucagcuucgaguaccacagauaccccgagcugagagaggcccuggugagcguguggcugcagugcaccgccaucagcagaaucuacaccgugggcagaagcuucgagggcagagagcugcuggugaucgagcugagcgacaaccccggcgugcacgagcccggcgagcccgaguucaaguacaucggcaacaugcacggcaacgaggccgugggcagagagcugcugaucuuccuggcccaguaccugugcaacgaguaccagaagggcaacgagaccaucgugaaccugauccacagcaccagaauccacaucaugcccagccugaaccccgacggcuucgagaaggccgccagccagcccggcgagcugaaggacugguucgugggcagaagcaacgcccagggcaucgaccugaacagaaacuuccccgaccuggacagaaucguguacgugaacgagaaggagggcggccccaacaaccaccugcugaagaacaugaagaagaucguggaccagaacaccaagcuggcccccgagaccaaggccgugauccacuggaucauggacauccccuucgugcugagcgccaaccugcacggcggcgaccugguggccaacuaccccuacgacgagaccagaagcggcagcgcccacgaguacagcagcagccccgacgacgccaucuuccagagccuggccagagccuacagcagcuucaaccccgccaugagcgaccccaacagaccccccugcagaaagaacgacgacgacagcagcuucguggacggcaccaccaacggcggcgccugguacagcgugcccggcggcaugcaggacuucaacuaccugagcagcaacugcuucgagaucaccguggagcugagcugcgagaaguucccccccgaggagacccugaagaccuacugggaggacaacaagaacagccugaucagcuaccuggagcagauccacagaggcgugaagggcuucgugagagaccugcagggcaaccccaucgccaacgccaccaucagcguggagggcaucgaccacgacgugaccagcgccaaggacggcgacuacuggagacugcugauccccggcaacuacaagcugaccgccagcgcccccggcuaccuggccaucaccaagaagguggccgugcccuacagccccgccgccggcguggacuucgagcuggagagcuucagcgagagaaaggaggaggagaaggaggagcugauggagugguggaagaugaugagcgagacccugaacuucuaa

SEQ ID NO: 15575 - RNA, 3198 nt, Artificial Sequence
  CP__Homo_sapiens__NP_000087
augaagauccugauccugggcaucuuccuguuccugugcagcacccccgccugggccaaggagaagcacuacuacaucggcaucaucgagaccaccugggacuacgccagcgaccacggcgagaagaagcugaucagcguggacaccgagcacagcaacaucuaccugcagaacggccccgacagaaucggcagacuguacaagaaggcccuguaccugcaguacaccgacgagaccuucagaaccaccaucgagaagcccguguggcugggcuuccugggccccaucaucaaggccgagaccggcgacaagguguacgugcaccugaagaaccuggccagcagacccuacaccuuccacagccacggcaucaccuacuacaaggagcacgagggcgccaucuaccccgacaacaccaccgacuuccagagagccgacgacaagguguaccccggcgagcaguacaccuacaugcugcuggccaccgaggagcagagccccggcgagggcgacggcaacugcgugaccagaaucuaccacagccacaucgacgcccccaaggacaucgccagcggccugaucggcccccugaucaucugcaagaaggacagccuggacaaggagaaggagaagcacaucgacagagaguucguggugauguucagcgugguggacgagaacuucagcugguaccuggaggacaacaucaagaccuacugcagcgagcccgagaagguggacaaggacaacgaggacuuccaggagagcaacagaauguacagcgugaacggcuacaccuucggcagccugcccggccugagcaugugcgccgaggacagagugaagugguaccuguucggcaugggcaacgagguggacgugcacgccgccuucuuccacggccaggcccugaccaacaagaacuacagaaucgacaccaucaaccuguuccccgccacccuguucgacgccuacaugguggcccagaaccccggcgaguggaugcugagcugccagaaccugaaccaccugaaggccggccugcaggccuucuuccaggugcaggagugcaacaagagcagcagcaaggacaacaucagaggcaagcacgugagacacuacuacaucgccgccgaggagaucaucuggaacuacgcccccagcggcaucgacaucuucaccaaggagaaccugaccgcccccggcagcgacagcgccguguucuucgagcagggcaccaccagaaucggcggcagcuacaagaagcugguguacagagaguacaccgacgccagcuucaccaacagaaaggagagaggccccgaggaggagcaccugggcauccugggccccgugaucugggccgaggugggcgacaccaucagagugaccuuccacaacaagggcgccuacccccugagcaucgagcccaucggcgugagauucaacaagaacaacgagggcaccuacuacagccccaacuacaacccccagagcagaagcgugccccccagcgccagccacguggcccccaccgagaccuucaccuacgaguggaccgugcccaaggaggugggccccaccaacgccgaccccgugugccuggccaagauguacuacagcgccguggaccccaccaaggacaucuucaccggccugaucggccccaugaagaucugcaagaagggcagccugcacgccaacggcagacagaaggacguggacaaggaguucuaccuguuccccaccguguucgacgagaacgagagccugcugcuggaggacaacaucagaauguucaccaccgcccccgaccagguggacaaggaggacgaggacuuccaggagagcaacaagaugcacagcaugaacggcuucauguacggcaaccagcccggccugaccaugugcaagggcgacagcguggugugguaccuguucagcgccggcaacgaggccgacgugcacggcaucuacuucagcggcaacaccuaccuguggagaggcgagagaagagacaccgccaaccuguucccccagaccagccugacccugcacauguggcccgacaccgagggcaccuucaacguggagugccugaccaccgaccacuacaccggcggcaugaagcagaaguacaccgugaaccagugcagaagacagagcgaggacagcaccuucuaccugggcgagagaaccuacuacaucgccgccguggagguggagugggacuacagcccccagagagagugggagaaggagcugcaccaccugcaggagcagaacgugagcaacgccuuccuggacaagggcgaguucuacaucggcagcaaguacaagaaggugguguacagacaguacaccgacagcaccuucagagugcccguggagagaaaggccgaggaggagcaccugggcauccugggcccccagcugcacgccgacgugggcgacaaggugaagaucaucuucaagaacauggccaccagacccuacagcauccacgcccacggcgugcagaccgagagcagcaccgugacccccacccugcccggcgagacccugaccuacguguggaagauccccgagagaagcggcgccggcaccgaggacagcgccugcauccccugggccuacuacagcaccguggaccaggugaaggaccuguacagcggccugaucggcccccugaucgugugcagaagacccuaccugaagguguucaaccccagaagaaagcuggaguucgcccugcuguuccugguguucgacgagaacgagagcugguaccuggacgacaacaucaagaccuacagcgaccaccccgagaaggugaacaaggacgacgaggaguucaucgagagcaacaagaugcacgccaucaacggcagaauguucggcaaccugcagggccugaccaugcacgugggcgacgaggugaacugguaccugaugggcaugggcaacgagaucgaccugcacaccgugcacuuccacggccacagcuuccaguacaagcacagaggcguguacagcagcgacguguucgacaucuuccccggcaccuaccagacccuggagauguuccccagaacccccggcaucuggcugcugcacugccacgugaccgaccacauccacgccggcauggagaccaccuacaccgugcugcagaacgaggacaccaagagcggcuaa

SEQ ID NO: 15576 - RNA, 405 nt, Artificial Sequence
  CPLX1__Homo_sapiens__NP_006642
auggaguucgugaugaagcaggcccugggcggcgccaccaaggacaugggcaagaugcugggcggcgacgaggagaaggaccccgacgccgccaagaaggaggaggagagacaggaggcccugagacaggccgaggaggagagaaaggccaaguacgccaagauggaggccgagagagaggccgugagacagggcaucagagacaaguacggcaucaagaagaaggaggagagagaggccgaggcccaggccgccauggaggccaacagcgagggcagccugaccagacccaagaaggccaucccccccggcugcggcgacgagguggaggaggaggacgagagcauccuggacaccgugaucaaguaccugcccggcccccugcaggacaugcugaagaaguaa

SEQ ID NO: 15577 - RNA, 405 nt, Artificial Sequence
  CPLX2__Homo_sapiens__XP_011532721
auggacuucgugaugaagcaggcccugggcggcgccaccaaggacaugggcaagaugcugggcggcgaggaggagaaggaccccgacgcccagaagaaggaggaggagagacaggaggcccugagacagcaggaggaggagagaaaggccaagcacgccagaauggaggccgagagagagaaggugagacagcagaucagagacaaguacggccugaagaagaaggaggagaaggaggccgaggagaaggccgcccuggagcagcccugcgagggcagccugaccagacccaagaaggccauccccgccggcugcggcgacgaggaggaggaggaggaggagagcauccuggacaccgugcugaaguaccugcccggcccccugcaggacauguucaagaaguaa

SEQ ID NO: 15578 - RNA, 477 nt, Artificial Sequence
  CPLX3__Homo_sapiens__NP_001025176
auggccuucauggugaagaccauggugggcggccagcugaagaaccugaccggcagccugggcggcggcgaggacaagggcgacggcgacaagagcgccgccgaggcccagggcaugagcagagaggaguacgaggaguaccagaagcagcugguggaggagaagauggagagagacgcccaguucacccagagaaaggccgagagagccacccugagaagccacuucagagacaaguacagacugcccaagaacgagaccgacgagagccagauccagauggccggcggcgacguggagcugcccagagagcuggccaagaugaucgaggaggacaccgaggaggaggaggagaaggccagcgugcugggccagcuggccagccugcccggccugaaccugggcagccugaaggacaaggcccaggccacccugggcgaccugaagcagagcgccgagaagugccacgugauguaa

SEQ ID NO: 15579 - RNA, 483 nt, Artificial Sequence
  CPLX4__Homo_sapiens__NP_857637
auggccuuccugaugaagagcaugaucagcaaccaggugaagaaccugggcuucggcggcggcagcgaggagaacaaggaggagggcggcgccagcgaccccgccgccgcccagggcaugaccagagaggaguacgaggaguaccagaagcagaugaucgaggagaagauggagagagacgccgccuucacccagaagaaggccgagagagccugccugagagugcaccugagagagaaguacagacugcccaagagcgagauggacgagaaccagauccagauggccggcgacgacguggaccugcccgaggaccugagaaagaugguggacgaggaccaggaggaggaggaggacaaggacagcauccugggccagauccagaaccugcagaacauggaccuggacaccaucaaggagaaggcccaggccaccuucaccgagaucaagcagaccgccgagcagaagugcagcgugauguaa

SEQ ID NO: 15580 - RNA, 1332 nt, Artificial Sequence
  CPM__Homo_sapiens__NP_001005502
auggacuuccccugccuguggcugggccugcugcugccccugguggccgcccuggacuucaacuaccacagacaggagggcauggaggccuuccugaagaccguggcccagaacuacagcagcgugacccaccugcacagcaucggcaagagcgugaagggcagaaaccugugggugcugguggugggcagauuccccaaggagcacagaaucggcauccccgaguucaaguacguggccaacaugcacggcgacgagaccgugggcagagagcugcugcugcaccugaucgacuaccuggugaccagcgacggcaaggaccccgagaucaccaaccugaucaacagcaccagaauccacaucaugcccagcaugaaccccgacggcuucgaggccgugaagaagcccgacugcuacuacagcaucggcagagagaacuacaaccaguacgaccugaacagaaacuuccccgacgccuucgaguacaacaacgugagcagacagcccgagaccguggccgugaugaaguggcugaagaccgagaccuucgugcugagcgccaaccugcacggcggcgcccugguggccagcuaccccuucgacaacggcgugcaggccaccggcgcccuguacagcagaagccugacccccgacgacgacguguuccaguaccuggcccacaccuacgccagcagaaaccccaacaugaagaagggcgacgagugcaagaacaagaugaacuuccccaacggcgugaccaacggcuacagcugguacccccugcagggcggcaugcaggacuacaacuacaucugggcccagugcuucgagaucacccuggagcugagcugcugcaaguaccccagagaggagaagcugcccagcuucuggaacaacaacaaggccagccugaucgaguacaucaagcaggugcaccugggcgugaagggccagguguucgaccagaacggcaacccccugcccaacgugaucguggaggugcaggacagaaagcacaucugccccuacagaaccaacaaguacggcgaguacuaccugcugcugcugcccggcagcuacaucaucaacgugaccgugcccggccacgacccccacaucaccaaggugaucauccccgagaagagccagaacuucagcgcccugaagaaggacauccugcugcccuuccagggccagcuggacagcauccccgugagcaaccccagcugccccaugaucccccuguacagaaaccugcccgaccacagcgccgccaccaagcccagccuguuccuguuccuggugagccugcugcacaucuucuucaaguaa

SEQ ID NO: 15581 - RNA, 1419 nt, Artificial Sequence
  CPN1__Homo_sapiens__XP_011537601
augagcgaccugcugagcguguuccugcaccugcugcugcuguucaagcugguggcccccgugaccuucagacaccacagauacgacgaccuggugagaacccuguacaaggugcagaacgagugccccggcaucaccagaguguacagcaucggcagaagcguggagggcagacaccuguacgugcuggaguucagcgaccaccccggcauccacgagccccuggagcccgaggugaaguacgugggcaacaugcacggcaacgaggcccugggcagagagcugaugcugcagcugagcgaguuccugugcgaggaguucagaaacagaaaccagagaaucgugcagcugauccaggacaccagaauccacauccugcccagcaugaaccccgacggcuacgagguggccgccgcccagggccccaacaagcccggcuaccuggugggcagaaacaacgccaacggcguggaccugaacagaaacuuccccgaccugaacaccuacaucuacuacaacgagaaguacggcggccccaaccaccaccugccccugcccgacaacuggaagagccagccccagcuggcccugcacagacagccccuggccagcagccagguggagcccgagaccagagccgugaucagauggaugcacagcuucaacuucgugcugagcgccaaccugcacggcggcgccgugguggccaacuaccccuacgacaagagcuucgagcacagagugagaggcgugagaagaaccgccagcacccccacccccgacgacaagcuguuccagaagcuggccaagguguacagcuacgcccacggcuggauguuccagggcuggaacugcggcgacuacuuccccgacggcaucaccaacggcgccagcugguacagccugagcaagggcaugcaggacuucaacuaccugcacaccaacugcuucgagaucacccuggagcugagcugcgacaaguucccccccgaggaggagcugcagagagaguggcugggcaacagagaggcccugauccaguuccuggagcaggugcaccagggcaucaagggcauggugcuggacgagaacuacaacaaccuggccaacgccgugaucagcgugagcggcaucaaccacgacgugaccagcggcgaccacggcgacuacuucagacugcugcugcccggcaucuacaccgugagcgccaccgcccccggcuacgaccccgagaccgugaccgugaccgugggccccgccgagcccacccuggugaacuuccaccugaagagaagcaucccccaggugagccccgugagaagagcccccagcagaagacacggcgugagagccaaggugcagccccaggccagaaagaaggagauggagaugagacagcugcagagaggccccgccuaa

SEQ ID NO: 15582 - RNA, 1638 nt, Artificial Sequence
  CPN2__Homo_sapiens__NP_001278917
augcugcccggcgccuggcugcuguggaccagccugcugcugcuggccagacccgcccagcccugccccaugggcugcgacugcuucgugcaggagguguucugcagcgacgaggagcuggccaccgugccccuggacaucccccccuacaccaagaacaucaucuucguggagaccagcuucaccacccuggagaccagagccuucggcagcaaccccaaccugaccaaggugguguuccugaacacccagcugugccaguucagacccgacgccuucggcggccugcccagacuggaggaccuggaggugaccggcagcagcuuccugaaccugagcaccaacaucuucagcaaccugaccagccugggcaagcugacccugaacuucaacaugcuggaggcccugcccgagggccuguuccagcaccuggccgcccuggagagccugcaccugcagggcaaccagcugcaggcccugcccagaagacuguuccagccccugacccaccugaagacccugaaccuggcccagaaccugcuggcccagcugcccgaggagcuguuccacccccugaccagccugcagacccugaagcugagcaacaacgcccugagcggccugccccagggcguguucggcaagcugggcagccugcaggagcuguuccuggacagcaacaacaucagcgagcugcccccccagguguucagccagcuguucugccuggagagacuguggcugcagagaaacgccaucacccaccugccccugagcaucuucgccagccugggcaaccugaccuuccugagccugcaguggaacaugcugagagugcugcccgccggccuguucgcccacacccccugccuggugggccugagccugacccacaaccagcuggagaccguggccgagggcaccuucgcccaccugagcaaccugagaagccugaugcugagcuacaacgccaucacccaccugcccgccggcaucuucagagaccuggaggagcuggugaagcuguaccugggcagcaacaaccugaccgcccugcaccccgcccuguuccagaaccugagcaagcuggagcugcugagccugagcaagaaccagcugaccacccugcccgagggcaucuucgacaccaacuacaaccuguucaaccuggcccugcacggcaaccccuggcagugcgacugccaccuggccuaccuguucaacuggcugcagcaguacaccgacagacugcugaacauccagaccuacugcgccggccccgccuaccugaagggccagguggugcccgcccugaacgagaagcagcuggugugccccgugaccagagaccaccugggcuuccaggugaccuggcccgacgagagcaaggccggcggcagcugggaccuggccgugcaggagagagccgccagaagccagugcaccuacagcaaccccgagggcaccguggugcuggccugcgaccaggcccagugcagauggcugaacgugcagcugagcccccagcagggcagccugggccugcaguacaacgccagccaggagugggaccugagaagcagcugcggcagccugagacugaccgugagcaucgaggccagagccgccggccccuaa

SEQ ID NO: 15583 - RNA, 1611 nt, Artificial Sequence
  CPNE1__Homo_sapiens__NP_001185792
auggcccacugcgugacccuggugcagcugagcaucagcugcgaccaccugaucgacaaggacaucggcagcaagagcgacccccugugcgugcugcugcaggacgugggcggcggcagcugggccgagcugggcagaaccgagagagugagaaacugcagcagccccgaguucagcaagacccugcagcuggaguacagauucgagaccgugcagaagcugagauucggcaucuacgacaucgacaacaagacccccgagcugagagacgacgacuuccugggcggcgccgagugcagccugggccagaucgugagcagccaggugcugacccugccccugaugcugaagcccggcaagcccgccggcagaggcaccaucaccgugagcgcccaggagcugaaggacaacagaguggugaccauggagguggaggccagaaaccuggacaagaaggacuuccugggcaagagcgaccccuuccuggaguucuucagacagggcgacggcaaguggcaccugguguacagaagcgaggugaucaagaacaaccugaaccccaccuggaagagauucagcgugcccgugcagcacuucugcggcggcaaccccagcacccccauccaggugcagugcagcgacuacgacagcgacggcagccacgaccugaucggcaccuuccacaccagccuggcccagcugcaggccgugcccgccgaguucgagugcauccaccccgagaagcagcagaagaagaagagcuacaagaacagcggcaccaucagagugaagaucugcagaguggagaccgaguacagcuuccuggacuacgugaugggcggcugccagaucaacuucaccgugggcguggacuucaccggcagcaacggcgaccccagcagccccgacagccugcacuaccugagccccaccggcgugaacgaguaccugauggcccuguggagcgugggcagcguggugcaggacuacgacagcgacaagcuguuccccgccuucggcuucggcgcccaggugccccccgacuggcaggugagccacgaguucgcccugaacuucaaccccagcaaccccuacugcgccggcauccagggcaucguggacgccuacagacaggcccugccccaggugagacuguacggccccaccaacuucgcccccaucaucaaccacguggccagauucgccgcccaggccgcccaccagggcaccgccagcuacuucaugcugcugcugcugaccgacggcgccgugaccgacguggaggccaccagagaggccguggugagagccagcaaccugcccaugagcgugaucaucgugggcgugggcggcgccgacuucgaggccauggagcagcuggacgccgacggcggcccccugcacaccagaagcggccaggccgccgccagagacaucgugcaguucgugcccuacagaagauuccagaacgcccccagagaggcccuggcccagaccgugcuggccgaggugcccacccagcuggugagcuacuucagagcccagggcugggccccccugaagccccugccccccagcgccaaggaccccgcccaggccccccaggccuaa

SEQ ID NO: 15584 - RNA, 1647 nt, Artificial Sequence
  CPNE2__Homo_sapiens__NP_689940
auggcccacauccccagcggcggcgcccccgccgccggcgccgcccccaugggcccccaguacugcgugugcaagguggagcugagcgugagcggccagaaccugcuggacagagacgugaccagcaagagcgaccccuucugcgugcuguucaccgagaacaacggcagauggaucgaguacgacagaaccgagaccgccaucaacaaccugaaccccgccuucagcaagaaguucgugcuggacuaccacuucgaggaggugcagaagcugaaguucgcccuguucgaccaggacaagagcagcaugagacuggacgagcacgacuuccugggccaguucagcugcagccugggcaccaucgugagcagcaagaagaucaccagaccccugcugcugcugaacgacaagcccgccggcaagggccugaucaccaucgccgcccaggagcugagcgacaacagagugaucacccugagccuggccggcagaagacuggacaagaaggaccuguucggcaagagcgaccccuuccuggaguucuacaagcccggcgacgacggcaaguggaugcuggugcacagaaccgaggugaucaaguacacccuggaccccguguggaagcccuucaccgugccccuggugagccugugcgacggcgacauggagaagcccauccaggugaugugcuacgacuacgacaacgacggcggccacgacuucaucggcgaguuccagaccagcgugagccagaugugcgaggccagagacagcgugccccuggaguucgagugcaucaaccccaagaagcagagaaagaagaagaacuacaagaacagcggcaucaucauccugagaagcugcaagaucaacagagacuacagcuuccuggacuacauccugggcggcugccagcugauguucaccgugggcaucgacuucaccgccagcaacggcaacccccuggaccccagcagccugcacuacaucaaccccaugggcaccaacgaguaccugagcgccaucugggccgugggccagaucauccaggacuacgacagcgacaagauguuccccgcccugggcuucggcgcccagcugccccccgacuggaaggugagccacgaguucgccaucaacuucaaccccaccaaccccuucugcagcggcguggacggcaucgcccaggccuacagcgccugccugccccacaucagauucuacggccccaccaacuucagccccaucgugaaccacguggccagauucgccgcccaggccacccagcagagaaccgccacccaguacuucauccugcugaucaucaccgacggcgugaucagcgacauggaggagaccagacacgccguggugcaggccagcaagcugcccaugagcaucaucaucgugggcgugggcaacgccgacuucgccgccauggaguuccuggacggcgacagcagaaugcugagaagccacaccggcgaggaggccgccagagacaucgugcaguucgugcccuucagagaguucagaaacgccgccaaggagacccuggccaaggccgugcuggccgagcugccccagcagguggugcaguacuucaagcacaagaaccugccccccaccaacagcgagcccgccuaa

SEQ ID NO: 15585 - RNA, 1614 nt, Artificial Sequence
  CPNE3__Homo_sapiens__NP_003900
auggccgcccagugcgugaccaagguggcccugaacgugagcugcgccaaccugcuggacaaggacaucggcagcaagagcgacccccugugcgugcuguuccugaacaccagcggccagcagugguacgagguggagagaaccgagagaaucaagaacugccugaacccccaguucagcaagaccuucaucaucgacuacuacuucgagguggugcagaagcugaaguucggcguguacgacaucgacaacaagaccaucgagcugagcgacgacgacuuccugggcgagugcgagugcacccugggccagaucgugagcagcaagaagcugaccagaccccuggugaugaagaccggcagacccgccggcaagggcagcaucaccaucagcgccgaggagaucaaggacaacagaguggugcuguucgagauggaggccagaaagcuggacaacaaggaccuguucggcaagagcgaccccuaccuggaguuccacaagcagaccagcgacggcaacuggcugauggugcacagaaccgagguggugaagaacaaccugaaccccguguggagacccuucaagaucagccugaacagccugugcuacggcgacauggacaagaccaucaagguggagugcuacgacuacgacaacgacggcagccacgaccugaucggcaccuuccagaccaccaugaccaagcugaaggaggccagcagaagcagccccguggaguucgagugcaucaacgagaagaagagacagaagaagaagagcuacaagaacagcggcgugaucagcgugaagcagugcgagaucaccguggagugcaccuuccuggacuacaucaugggcggcugccagcugaacuucaccgugggcguggacuucaccggcagcaacggcgaccccagaagccccgacagccugcacuacaucagccccaacggcgugaacgaguaccugaccgcccuguggagcgugggccuggugauccaggacuacgacgccgacaagauguuccccgccuucggcuucggcgcccagauccccccccaguggcaggugagccacgaguuccccaugaacuucaaccccagcaaccccuacugcaacggcauccagggcaucguggaggccuacagaagcugccugccccagaucaagcuguacggccccaccaacuucagccccaucaucaaccacguggccagauucgccgccgccgccacccagcagcagaccgccagccaguacuucgugcugcugaucaucaccgacggcgugaucaccgaccuggacgagaccagacaggccaucgugaacgccagcagacugcccaugagcaucaucaucgugggcgugggcggcgccgacuucagcgccauggaguuccuggacggcgacggcggcagccugagaagcccccugggcgagguggccaucagagacaucgugcaguucgugcccuucagacaguuccagaacgcccccaaggaggcccuggcccagugcgugcuggccgagaucccccagcagguggugggcuacuucaacaccuacaagcugcugccccccaagaaccccgccaccaagcagcagaagcaguaa

SEQ ID NO: 15586 - RNA, 1728 nt, Artificial Sequence
  CPNE4__Homo_sapiens__NP_001276041
auggccguggagcccagcagcagcgagagcaucaagagaagagccggcagaagaaugaagaagaugagcaacaucuacgagagcgccgccaacacccugggcaucuucaacagccccugccugaccaagguggagcugagaguggccugcaagggcaucagcgacagagacgcccugagcaagcccgaccccugcgugauccugaagaugcagagccacggccagugguucgagguggacagaaccgaggugaucagaaccugcaucaaccccguguacagcaagcuguucaccguggacuucuacuucgaggaggugcagagacugagauucgaggugcacgacaucagcagcaaccacaacggccugaaggaggccgacuuccugggcggcauggagugcacccugggccagaucgugagccagagaaagcugagcaagagccugcugaagcacggcaacaccgccggcaagagcagcaucaccgugaucgccgaggagcugagcggcaacgacgacuacguggagcuggccuucaacgccagaaagcuggacgacaaggacuucuucagcaagagcgaccccuuccuggagaucuucagaaugaacgacgacgccacccagcagcuggugcacagaaccgagguggugaugaacaaccugagccccgccuggaagagcuucaaggugagcgugaacagccugugcagcggcgaccccgacagaagacugaagugcaucgugugggacugggacagcaacggcaagcacgacuucaucggcgaguucaccagcaccuucaaggagaugagaggcgccauggagggcaagcaggugcagugggagugcaucaaccccaaguacaaggccaagaagaagaacuacaagaacagcggcaccgugauccugaaccugugcaagauccacaagaugcacagcuuccuggacuacaucaugggcggcugccagauccaguucaccguggccaucgacuucaccgccagcaacggcgaccccagaaacagcugcagccugcacuacauccaccccuaccagcccaacgaguaccugaaggcccugguggccgugggcgagaucugccaggacuacgacagcgacaagauguuccccgccuucggcuucggcgccagaaucccccccgaguacaccgugagccacgacuucgccaucaacuucaacgaggacaaccccgagugcgccggcauccagggcgugguggaggccuaccagagcugccugcccaagcugcagcuguacggccccaccaacaucgcccccaucauccagaagguggccaagagcgccagcgaggagaccaacaccaaggaggccagccaguacuucauccugcugauccugaccgacggcgugaucaccgacauggccgacaccagagaggccaucgugcacgccagccaccugcccaugagcgugaucaucgugggcgugggcaacgccgacuucagcgacaugcagaugcuggacggcgacgacggcauccugagaagccccaagggcgagcccgugcugagagacaucgugcaguucgugcccuucagaaacuucaagcacgccagccccgccgcccuggccaagagcgugcuggccgaggugcccaaccaggugguggacuacuacaacggcaagggcaucaagcccaagugcagcagcgagauguacgagagcagcagaacccuggcccccuaa

SEQ ID NO: 15587 - RNA, 1902 nt, Artificial Sequence
  CPNE7__Homo_sapiens__NP_055242
augagcgccggcagcgagagaggcgccgccgccacccccggcggccugcccgcccccugcgccagcaagguggagcugagacugagcugcagacaccugcuggacagagacccccugaccaagagcgaccccagcguggcccugcugcagcaggcccagggccagugggugcaggugggcagaaccgagguggugagaagcagccugcaccccguguucagcaagguguucaccguggacuacuacuucgaggaggugcagagacugagauucgagguguacgacacccacggccccagcggcuucagcugccaggaggacgacuuccugggcggcauggagugcacccugggccagcccgcccagaaguggcugcugcagguggugaugagagugagcguggacgugcugggccccgccggccacugcgccaagcacuuccugugcugcaccgagagcagccaccuggccagaaccggccccagcuuccugcugagauacgacgaccugugccugcccugggccaccgccggcgccgugagaugguggaccugcagaggcggccacacccagggcuggcagaucguggcccagaagaaggugaccagaccccugcugcugaaguucggcagaaacgccggcaagagcaccaucaccgugaucgccgaggacaucagcggcaacaacggcuacguggagcugagcuucagagccagaaagcuggacgacaaggaccuguucagcaagagcgaccccuuccuggagcuguacagagugaacgacgaccagggccugcagcugguguacagaaccgagguggugaagaacaaccugaaccccgugugggaggccuucaaggugagccugagcagccugugcagcugcgaggagaccagaccccugaagugccuggugugggacuacgacagcagaggcaagcacgacuucaucggcgaguucagcaccaccuucgaggagaugcagaaggccuucgaggagggccaggcccagugggacugcgugaaccccaaguacaagcagaagagaagaagcuacaagaacagcggcgugguggugcuggccgaccugaaguuccacagaguguacagcuuccuggacuacaucaugggcggcugccagauccacuucaccguggccaucgacuucaccgccagcaacggcgaccccagaaacagcugcagccugcacuacaucaaccccuaccagcccaacgaguaccugaaggcccuggugagcgugggcgagaucugccaggacuacgacagcgacaagagauucagcgcccugggcuucggcgccagaaucccccccaaguacgaggugagccacgacuucgccaucaacuucaaccccgaggacgacgagugcgagggcauccagggcgugguggaggccuaccagaacugccugcccagagugcagcuguacggccccaccaacguggcccccaucaucagcaagguggccagaguggccgccgccgaggagagcaccggcaaggccagccaguacuacauccugcugauccugaccgacggcguggugaccgacauggccgacaccagagaggccaucgugagagccagcagacugcccaugagcaucaucaucgugggcgugggcaacgccgacuucaccgacaugcaggugcuggacggcgacgacggcgugcugagaagccccagaggcgagcccgcccugagagacaucgugcaguucgugcccuucagagagcugaagaacgccagccccgccgcccuggccaagugcgugcuggccgaggugcccaagcaggugguggaguacuacagccacagaggccugccccccagaagccugggcgugcccgccggcgaggccagccccggcugcacccccuaa

SEQ ID NO: 15588 - RNA, 1695 nt, Artificial Sequence
  CPNE8__Homo_sapiens__NP_705898
auggacagcagauacaacagcaccgccggcaucggcgaccugaaccagcugagcgccgccauccccgccaccagaguggaggugagcgugagcugcagaaaccugcuggacagagacaccuucagcaagagcgaccccaucugcgugcuguacgugcagggcgugggcaacaaggaguggagagaguucggcagaaccgaggugaucgacaacacccugaaccccgacuucgugagaaaguucauccuggacuacuucuucgaggagagagagaaccugagauucgaccuguacgacguggacagcaagagccccaaccugagcaagcacgacuuccugggccagguguucugcacccugggcgagaucgugggcagccagggcagcagacuggagaagcccaucgugggcauccccggcaagaagugcggcaccaucauccugaccgccgaggagcugaacugcugcagagacgccgugcugaugcaguucugcgccaacaagcuggacaagaaggacuucuucggcaagagcgaccccuuccugguguucuacagaagcaacgaggacggcagcuucaccaucugccacaagaccgagguggugaagaacacccugaaccccguguggcaggccuucaagaucagcgugagagcccugugcaacggcgacuacgacagaaccaucaagguggagguguacgacugggacagagacggcagccacgacuucaucggcgaguucaccaccagcuacagagagcugagcagaggccagagccaguucaacguguacgagguggugaaccccaagaagaagggcaagaagaagaaguacaccaacagcggcaccgugacccugcugagcuuccugguggagaccgaggugagcuuccuggacuacaucaagggcggcacccagaucaacuucaccguggccaucgacuucaccgccagcaacggcaaccccgcccagcccaccagccugcacuacaugaaccccuaccagcugaacgccuacggcauggcccugaaggccgugggcgagaucgugcaggacuacgacagcgacaagauguuccccgcccugggcuucggcgccaagcugccccccgacggcagaaucagccacgaguucgcccugaacggcaacccccagaaccccuacugcgacggcaucgagggcgugauggaggccuacuacagaagccugaagagcgugcagcuguacggccccaccaacuucgcccccgugaucaaccacguggccagauacgccagcagcgugaaggacggcagccaguacuucgugcugcugaucgugaccgacggcgugaucagcgacauggcccagaccaaggagagcaucgugaacgccagcaagcugcccaugagcaucaucaucgugggcgugggccccgccgaguucgacgccaugguggagcuggacggcgacgacgugagagugagcagcagaggcaaguacgccgagagagacaucgugcaguucgugcccuucagagacuacaucgacagaagcggcaaccacauccugagcauggccagacuggccaaggacgugcuggccgagauccccgagcaguuccugagcuacaugagagccagaggcaucaagcccagccccgcccccccccccuacaccccccccacccacgugcugcagacccagaucuaa

SEQ ID NO: 15589 - RNA, 1125 nt, Artificial Sequence
  CPO__Homo_sapiens__XP_011508929
augaagccccugcuggagacccuguaccugcugggcaugcuggugcccggcggccugggcuacgacagaagccuggcccagcacagacaggagaucguggacaagagcgugagccccuggagccuggagaccuacagcuacaacaucuaccaccccaugggcgagaucuacgaguggaugagagagaucagcgagaaguacaaggagguggugacccagcacuuccugggcgugaccuacgagacccaccccauguacuaccugaagaucagccagcccagcggcaaccccaagaagaucaucuggauggacugcggcauccacgccagagaguggaucgcccccgccuucugccagugguucgugaaggagauccugcagaaccacaaggacaacagcagcaucagaaagcugcugagaaaccuggacuucuacgugcugcccgugcugaacaucgacggcuacaucuacaccuggaccaccgacagacuguggagaaagagcagaagcccccacaacaacggcaccugcuucggcaccgaccugaacagaaacuucaacgccagcuggugcagcaucggcgccagcagaaacugccaggaccagaccuucugcggcaccggccccgugagcgagcccgagaccaaggccguggccagcuucaucgagagcaagaaggacgacauccugugcuuccugaccaugcacagcuacggccagcugauccugacccccuacggcuacaccaagaacaagagcagcaaccaccccgagaugauccaggugggccagaaggccgccaacgcccugaaggccaaguacggcaccaacuacagagugggcagcagcgccgacauccuguacgccagcagcggcagcagcagagacugggccagagacaucggcauccccuucagcuacaccuucgagcugagagacagcggcaccuacggcuucgugcugcccgaggcccagauccagcccaccugcgaggagaccauggaggccgugcugagcgugcuggacgacguguacgccaagcacuggcacagcgacagcgccggcagagugaccagcgccaccaugcugcugggccugcuggugagcugcaugagccugcuguaa

SEQ ID NO: 15590 - RNA, 1365 nt, Artificial Sequence
  CPOX__Homo_sapiens__NP_000088
auggcccugcagcugggcagacugagcagcggccccugcuggcugguggccagaggcggcugcggcggccccagagccuggagccagugcggcggcggcggccugagagccuggagccagagaagcgccgccggcagagugugcagaccccccggccccgccggcaccgagcagagcagaggccugggccacggcagcaccagcagaggcggccccugggugggcaccggccuggccgccgcccuggccggccuggugggccuggccaccgccgccuucggccacgugcagagagccgagaugcugcccaagaccagcggcaccagagccaccagccugggcagacccgaggaggaggaggacgagcuggcccacagaugcagcagcuucauggccccccccgugaccgaccugggcgagcugagaagaagacccggcgacaugaagaccaagauggagcugcugauccuggagacccaggcccaggugugccaggcccuggcccagguggacggcggcgccaacuucagcguggacagaugggagagaaaggagggcggcggcggcaucagcugcgugcugcaggacggcugcguguucgagaaggccggcgugagcaucagcguggugcacggcaaccugagcgaggaggccgccaagcagaugagaagcagaggcaaggugcugaagaccaaggacggcaagcugcccuucugcgccaugggcgugagcagcgugauccaccccaagaacccccacgcccccaccauccacuucaacuacagauacuucgagguggaggaggccgacggcaacaagcaguggugguucggcggcggcugcgaccugacccccaccuaccugaaccaggaggacgccgugcacuuccacagaacccugaaggaggccugcgaccagcacggccccgaccuguaccccaaguucaagaaguggugcgacgacuacuucuucaucgcccacagaggcgagagaagaggcaucggcggcaucuucuucgacgaccuggacagccccagcaaggaggagguguucagauucgugcagagcugcgccagagccguggugcccagcuacaucccccuggugaagaagcacugcgacgacagcuucaccccccaggagaagcuguggcagcagcugagaagaggcagauacguggaguucaaccugcuguacgacagaggcaccaaguucggccuguucacccccggcagcagaaucgagagcauccugaugagccugccccugaccgccagaugggaguacaugcacagccccagcgagaacagcaaggaggccgagauccuggaggugcugagacaccccagagacugggugagauaa

SEQ ID NO: 15591 - RNA, 519 nt, Artificial Sequence
  CPPED1__Homo_sapiens__NP_001092925
augagcgccgccgaggccggcggcguguuccacagagccagaggcagaacccuggccgccuuccccgccgagaaggagagcgaguggaagggccccuucuacuucauccugggcgccgacccccaguucggccugaucaaggccuggagcaccggcgacugcgacaacggcggcgacgagugggagcaggagaucagacugaccgagcaggccgugcaggccaucaacaagcugaaccccaagcccaaguucuucgugcugugcggcgaccugauccacgccaugcccggcgugaaggugguguucagcggccacuaccacagaaacgccggcggcaccuaccagaaccuggacaugguggugagcagcgccaucggcugccagcugggcagagacccccacggccugagaguggugguggugaccgccgagaagaucgugcacagauacuacagccuggacgagcugagcgagaagggcaucgaggacgaccugauggaccugaucaagaagaaguaa

SEQ ID NO: 15592 - RNA, 1419 nt, Artificial Sequence
  CPQ__Homo_sapiens__NP_057218
augaaguuccugaucuucgccuucuucggcggcgugcaccugcugagccugugcagcggcaaggccaucugcaagaacggcaucagcaagagaaccuucgaggagaucaaggaggagaucgccagcugcggcgacguggccaaggccaucaucaaccuggccguguacggcaaggcccagaacagaagcuacgagagacuggcccugcugguggacaccgugggccccagacugagcggcagcaagaaccuggagaaggccauccagaucauguaccagaaccugcagcaggacggccuggagaaggugcaccuggagcccgugagaaucccccacugggagagaggcgaggagagcgccgugaugcuggagcccagaauccacaagaucgccauccugggccugggcagcagcaucggcaccccccccgagggcaucaccgccgaggugcugguggugaccagcuucgacgagcugcagagaagagccagcgaggccagaggcaagaucgugguguacaaccagcccuacaucaacuacagcagaaccgugcaguacagaacccagggcgccguggaggccgccaaggugggcgcccuggccagccugaucagaagcguggccagcuucagcaucuacagcccccacaccggcauccaggaguaccaggacggcgugcccaagauccccaccgccugcaucaccguggaggacgccgagaugaugagcagaauggccagccacggcaucaagaucgugauccagcugaagaugggcgccaagaccuaccccgacaccgacagcuucaacaccguggccgagaucaccggcagcaaguaccccgagcagguggugcuggugagcggccaccuggacagcugggacgugggccagggcgccauggacgacggcggcggcgccuucaucagcugggaggcccugagccugaucaaggaccugggccugagacccaagagaacccugagacuggugcuguggaccgccgaggagcagggcggcgugggcgccuuccaguacuaccagcugcacaaggugaacaucagcaacuacagccuggugauggagagcgacgccggcaccuuccugcccaccggccugcaguucaccggcagcgagaaggccagagccaucauggaggaggugaugagccugcugcagccccugaacaucacccaggugcugagccacggcgagggcaccgacaucaacuucuggauccaggccggcgugcccggcgccagccugcuggacgaccuguacaaguacuucuucuuccaccacagccacggcgacaccaugaccgugauggaccccaagcagaugaacguggccgccgccgugugggccguggugagcuacgugguggccgacauggaggagaugcugcccagaagcuaa

SEQ ID NO: 15593 - RNA, 4521 nt, Artificial Sequence
  CPS1__Homo_sapiens__NP_001116105
augccccagaucaucaagaugaccagaauccugaccgccuucaagguggugagaacccugaagaccggcuucggcuucaccaacgugaccgcccaccagaaguggaaguucagcagacccggcaucagacugcugagcgugaaggcccagaccgcccacaucgugcuggaggacggcaccaagaugaagggcuacagcuucggccaccccagcagcguggccggcgaggugguguucaacaccggccugggcggcuaccccgaggccaucaccgaccccgccuacaagggccagauccugaccauggccaaccccaucaucggcaacggcggcgcccccgacaccaccgcccuggacgagcugggccugagcaaguaccuggagagcaacggcaucaaggugagcggccugcuggugcuggacuacagcaaggacuacaaccacuggcuggccaccaagagccugggccaguggcugcaggaggagaaggugcccgccaucuacggcguggacaccagaaugcugaccaagaucaucagagacaagggcaccaugcugggcaagaucgaguucgagggccagcccguggacuucguggaccccaacaagcagaaccugaucgccgaggugagcaccaaggacgugaagguguacggcaagggcaaccccaccaaggugguggccguggacugcggcaucaagaacaacgugaucagacugcuggugaagagaggcgccgaggugcaccuggugcccuggaaccacgacuucaccaagauggaguacgacggcauccugaucgccggcggccccggcaaccccgcccuggccgagccccugauccagaacgugagaaagauccuggagagcgacagaaaggagccccuguucggcaucagcaccggcaaccugaucaccggccuggccgccggcgccaagaccuacaagaugagcauggccaacagaggccagaaccagcccgugcugaacaucaccaacaagcaggccuucaucaccgcccagaaccacggcuacgcccuggacaacacccugcccgccggcuggaagccccuguucgugaacgugaacgaccagaccaacgagggcaucaugcacgagagcaagcccuucuucgccgugcaguuccaccccgaggugacccccggccccaucgacaccgaguaccuguucgacagcuucuucagccugaucaagaagggcaaggccaccaccaucaccagcgugcugcccaagcccgcccugguggccagcagaguggaggugagcaaggugcugauccugggcagcggcggccugagcaucggccaggccggcgaguucgacuacagcggcagccaggccgugaaggccaugaaggaggagaacgugaagaccgugcugaugaaccccaacaucgccagcgugcagaccaacgaggugggccugaagcaggccgacaccguguacuuccugcccaucaccccccaguucgugaccgaggugaucaaggccgagcagcccgacggccugauccugggcaugggcggccagaccgcccugaacugcggcguggagcuguucaagagaggcgugcugaaggaguacggcgugaaggugcugggcaccagcguggagagcaucauggccaccgaggacagacagcuguucagcgacaagcugaacgagaucaacgagaagaucgcccccagcuucgccguggagagcaucgaggacgcccugaaggccgccgacaccaucggcuaccccgugaugaucagaagcgccuacgcccugggcggccugggcagcggcaucugccccaacagagagacccugauggaccugagcaccaaggccuucgccaugaccaaccagauccugguggagaagagcgugaccggcuggaaggagaucgaguacgagguggugagagacgccgacgacaacugcgugaccgugugcaacauggagaacguggacgccaugggcgugcacaccggcgacagcguggugguggcccccgcccagacccugagcaacgccgaguuccagaugcugagaagaaccagcaucaacguggugagacaccugggcaucgugggcgagugcaacauccaguucgcccugcaccccaccagcauggaguacugcaucaucgaggugaacgccagacugagcagaagcagcgcccuggccagcaaggccaccggcuacccccuggccuucaucgccgccaagaucgcccugggcaucccccugcccgagaucaagaacguggugagcggcaagaccagcgccugcuucgagcccagccuggacuacauggugaccaagauccccagaugggaccuggacagauuccacggcaccagcagcagaaucggcagcagcaugaagagcgugggcgaggugauggccaucggcagaaccuucgaggagagcuuccagaaggcccugagaaugugccaccccagcaucgagggcuucacccccagacugcccaugaacaaggaguggcccagcaaccuggaccugagaaaggagcugagcgagcccagcagcaccagaaucuacgccaucgccaaggccaucgacgacaacaugagccuggacgagaucgagaagcugaccuacaucgacaagugguuccuguacaagaugagagacauccugaacauggagaagacccugaagggccugaacagcgagagcaugaccgaggagacccugaagagagccaaggagaucggcuucagcgacaagcagaucagcaagugccugggccugaccgaggcccagaccagagagcugagacugaagaagaacauccaccccugggugaagcagaucgacacccuggccgccgaguaccccagcgugaccaacuaccuguacgugaccuacaacggccaggagcacgacgugaacuucgacgaccacggcaugauggugcugggcugcggccccuaccacaucggcagcagcguggaguucgacuggugcgccgugagcagcaucagaacccugagacagcugggcaagaagaccgugguggugaacugcaaccccgagaccgugagcaccgacuucgacgagugcgacaagcuguacuucgaggagcugagccuggagagaauccuggacaucuaccaccaggaggccugcggcggcugcaucaucagcgugggcggccagauccccaacaaccuggccgugccccuguacaagaacggcgugaagaucaugggcaccagcccccugcagaucgacagagccgaggacagaagcaucuucagcgccgugcuggacgagcugaagguggcccaggcccccuggaaggccgugaacacccugaacgaggcccuggaguucgccaagagcguggacuaccccugccugcugagacccagcuacgugcugagcggcagcgccaugaacgugguguucagcgaggacgagaugaagaaguuccuggaggaggccaccagagugagccaggagcaccccguggugcugaccaaguucguggagggcgccagagagguggagauggacgccgugggcaaggacggcagagugaucagccacgccaucagcgagcacguggaggacgccggcgugcacagcggcgacgccacccugaugcugcccacccagaccaucagccagggcgccaucgagaaggugaaggacgccaccagaaagaucgccaaggccuucgccaucagcggccccuucaacgugcaguuccuggugaagggcaacgacgugcuggugaucgagugcaaccugagagccagcagaagcuuccccuucgugagcaagacccugggcguggacuucaucgacguggccaccaaggugaugaucggcgagaacguggacgagaagcaccugcccacccuggaccaccccaucauccccgccgacuacguggccaucaaggcccccauguucagcuggcccagacugagagacgccgaccccauccugagaugcgagauggccagcaccggcgagguggccugcuucggcgagggcauccacaccgccuuccugaaggccaugcugagcaccggcuucaagaucccccagaagggcauccugaucggcauccagcagagcuucagacccagauuccugggcguggccgagcagcugcacaacgagggcuucaagcuguucgccaccgaggccaccagcgacuggcugaacgccaacaacgugcccgccacccccguggccuggcccagccaggagggccagaaccccagccugagcagcaucagaaagcugaucagagacggcagcaucgaccuggugaucaaccugcccaacaacaacaccaaguucgugcacgacaacuacgugaucagaagaaccgccguggacagcggcaucccccugcugaccaacuuccaggugaccaagcuguucgccgaggccgugcagaagagcagaaagguggacagcaagagccuguuccacuacagacaguacagcgccggcaaggccgccuaa

SEQ ID NO: 15594 - RNA, 4332 nt, Artificial Sequence
  CPSF1__Homo_sapiens__NP_037423
auguacgccguguacaagcaggcccacccccccaccggccuggaguucagcauguacugcaacuucuucaacaacagcgagagaaaccuggugguggccggcaccagccagcuguacguguacagacugaacagagacgccgaggcccugaccaagaacgacagaagcaccgagggcaaggcccacagagagaagcuggagcuggccgccagcuucagcuucuucggcaacgugaugagcauggccagcgugcagcuggccggcgccaagagagacgcccugcugcugagcuucaaggacgccaagcugagcgugguggaguacgaccccggcacccacgaccugaagacccugagccugcacuacuucgaggagcccgagcugagagacggcuucgugcagaacgugcacacccccagagugagaguggaccccgacggcagaugcgccgccaugcugguguacggcaccagacugguggugcugcccuucagaagagagagccuggccgaggagcacgagggccuggugggcgagggccagagaagcagcuuccugcccagcuacaucaucgacgugagagcccuggacgagaagcugcugaacaucaucgaccugcaguuccugcacggcuacuacgagcccacccugcugauccuguucgagcccaaccagaccuggcccggcagaguggccgugagacaggacaccugcagcaucguggccaucagccugaacaucacccagaaggugcaccccgugaucuggagccugaccagccugcccuucgacugcacccaggcccuggccgugcccaagcccaucggcggcguggugguguucgccgugaacagccugcuguaccugaaccagagcgugccccccuacggcguggcccugaacagccugaccaccggcaccaccgccuucccccugagaacccaggagggcgugagaaucacccuggacugcgcccaggccaccuucaucagcuacgacaagauggugaucagccugaagggcggcgagaucuacgugcugacccugaucaccgacggcaugagaagcgugagagccuuccacuucgacaaggccgccgccagcgugcugaccaccagcauggugaccauggagcccggcuaccuguuccugggcagcagacugggcaacagccugcugcugaaguacaccgagaagcugcaggagccccccgccagcgccgugagagaggccgccgacaaggaggagccccccagcaagaagaagagaguggacgccaccgccggcuggagcgccgccggcaagagcgugccccaggacgagguggacgagaucgagguguacggcagcgaggcccagagcggcacccagcuggccaccuacagcuucgaggugugcgacagcauccugaacaucggccccugcgccaacgccgccgugggcgagcccgccuuccugagcgaggaguuccagaacagccccgagcccgaccuggagaucguggugugcagcggccacggcaagaacggcgcccugagcgugcugcagaagagcaucagaccccagguggugaccaccuucgagcugcccggcugcuacgacauguggaccgugaucgcccccgugagaaaggaggaggaggacaaccccaagggcgagggcaccgagcaggagcccagcaccacccccgaggccgacgacgacggcagaagacacggcuuccugauccugagcagagaggacagcaccaugauccugcagaccggccaggagaucauggagcuggacaccagcggcuucgccacccagggccccaccguguucgccggcaacaucggcgacaacagauacaucgugcaggugagcccccugggcaucagacugcuggagggcgugaaccagcugcacuucauccccguggaccugggcgcccccaucgugcagugcgccguggccgaccccuacguggugaucaugagcgccgagggccacgugaccauguuccugcugaagagcgacagcuacggcggcagacaccacagacuggcccugcacaagcccccccugcaccaccagagcaaggugaucacccugugccuguacagagaccugagcggcauguucaccaccgagagcagacugggcggcgccagagacgagcugggcggcagaagcggccccgaggccgagggccugggcagcgagaccagccccaccguggacgacgaggaggagaugcuguacggcgacagcggcagccuguucagccccagcaaggaggaggccagaagaagcagccagccccccgccgacagagaccccgcccccuucagagccgagcccacccacuggugccugcuggugagagagaacggcaccauggagaucuaccagcugcccgacuggagacugguguuccuggugaagaacuuccccgugggccagagagugcugguggacagcagcuucggccagcccaccacccagggcgaggccagaagagaggaggccaccagacagggcgagcugccccuggugaaggaggugcugcugguggcccugggcagcagacagagcagacccuaccugcuggugcacguggaccaggagcugcugaucuacgaggccuucccccacgacagccagcugggccagggcaaccugaaggugagauucaagaaggugccccacaacaucaacuucagagagaagaagcccaagcccagcaagaagaaggccgagggcggcggcgccgaggagggcgccggcgccagaggcagaguggccagauucagauacuucgaggacaucuacggcuacagcggcguguucaucugcggccccagcccccacuggcugcuggugaccggcagaggcgcccugagacugcaccccauggccaucgacggccccguggacagcuucgcccccuuccacaacgugaacugccccagaggcuuccuguacuucaacagacagggcgagcugagaaucagcgugcugcccgccuaccugagcuacgacgcccccuggcccgugagaaagaucccccugagaugcaccgcccacuacguggccuaccacguggagagcaagguguacgccguggccaccagcaccaacacccccugcgccagaauccccagaaugaccggcgaggagaaggaguucgagaccaucgagagagacgagagauacauccacccccagcaggaggccuucagcauccagcugaucagccccgugagcugggaggccauccccaacgccagaaucgagcugcaggagugggagcacgugaccugcaugaagaccgugagccugagaagcgaggagaccgugagcggccugaagggcuacguggccgccggcaccugccugaugcagggcgaggaggugaccugcagaggcagaauccugaucauggacgugaucgagguggugcccgagcccggccagccccugaccaagaacaaguucaaggugcuguacgagaaggagcagaagggccccgugaccgcccugugccacugcaacggccaccuggugagcgccaucggccagaagaucuuccuguggagccugagagccagcgagcugaccggcauggccuucaucgacacccagcuguacauccaccagaugaucagcgugaagaacuucauccuggccgccgacgugaugaagagcaucagccugcugagauaccaggaggagagcaagacccugagccuggugagcagagacgccaagccccuggagguguacagcguggacuucaugguggacaacgcccagcugggcuuccuggugagcgacagagacagaaaccugaugguguacauguaccugcccgaggccaaggagagcuucggcggcaugagacugcugagaagagccgacuuccacgugggcgcccacgugaacaccuucuggagaacccccugcagaggcgccaccgagggccugagcaagaagagcguggugugggagaacaagcacaucaccugguucgccacccuggacggcggcaucggccugcugcugcccaugcaggagaagaccuacagaagacugcugaugcugcagaacgcccugaccaccaugcugccccaccacgccggccugaaccccagagccuucagaaugcugcacguggacagaagaacccugcagaacgccgugagaaacgugcuggacggcgagcugcugaacagauaccuguaccugagcaccauggagagaagcgagcuggccaagaagaucggcaccacccccgacaucauccuggacgaccugcuggagaccgacagagugaccgcccacuucuaa

SEQ ID NO: 15595 - RNA, 2349 nt, Artificial Sequence
  CPSF2__Homo_sapiens__NP_059133
augaccagcaucaucaagcugaccacccugagcggcgugcaggaggagagcgcccugugcuaccugcugcagguggacgaguucagauuccugcuggacugcggcugggacgagcacuucagcauggacaucaucgacagccugagaaagcacgugcaccagaucgacgccgugcugcugagccaccccgacccccugcaccugggcgcccugcccuacgccgugggcaagcugggccugaacugcgccaucuacgccaccauccccguguacaagaugggccagauguucauguacgaccuguaccagagcagacacaacaccgaggacuucacccuguucacccuggacgacguggacgccgccuucgacaagauccagcagcugaaguucagccagaucgugaaccugaagggcaagggccacggccugagcaucaccccccugcccgccggccacaugaucggcggcaccaucuggaagaucgugaaggacggcgaggaggagaucguguacgccguggacuucaaccacaagagagagauccaccugaacggcugcagccuggagaugcugagcagacccagccugcugaucaccgacagcuucaacgccaccuacgugcagcccagaagaaagcagagagacgagcagcugcugaccaacgugcuggagacccugagaggcgacggcaacgugcugaucgccguggacaccgccggcagagugcuggagcuggcccagcugcuggaccagaucuggagaaccaaggacgccggccugggcguguacagccuggcccugcugaacaacgugagcuacaacgugguggaguucagcaagagccagguggaguggaugagcgacaagcugaugagaugcuucgaggacaagagaaacaaccccuuccaguucagacaccugagccugugccacggccugagcgaccuggccagagugcccagccccaagguggugcuggccagccagcccgaccuggagugcggcuucagcagagaccuguucauccaguggugccaggaccccaagaacagcaucauccugaccuacagaaccacccccggcacccuggccagauuccugaucgacaaccccagcgagaagaucaccgagaucgagcugagaaagagagugaagcuggagggcaaggagcuggaggaguaccuggagaaggagaagcugaagaaggaggccgccaagaagcuggagcagagcaaggaggccgacaucgacagcagcgacgagagcgacaucgaggaggacaucgaccagcccagcgcccacaagaccaagcacgaccugaugaugaagggcgagggcagcagaaagggcagcuucuucaagcaggccaagaagagcuaccccauguuccccgcccccgaggagagaaucaagugggacgaguacggcgagaucaucaagcccgaggacuuccuggugcccgagcugcaggccaccgaggaggagaagagcaagcuggagagcggccugaccaacggcgacgagcccauggaccaggaccugagcgacgugcccaccaagugcaucagcaccaccgagagcaucgagaucaaggccagagugaccuacaucgacuacgagggcagaagcgacggcgacagcaucaagaagaucaucaaccagaugaagcccagacagcugaucaucgugcacggcccccccgaggccagccaggaccuggccgagugcugcagagccuucggcggcaaggacaucaagguguacaugcccaagcugcacgagaccguggacgccaccagcgagacccacaucuaccaggugagacugaaggacagccuggugagcagccugcaguucugcaaggccaaggacgccgagcuggccuggaucgacggcgugcuggacaugagagugagcaagguggacaccggcgugauccuggaggagggcgagcugaaggacgacggcgaggacagcgagaugcagguggaggcccccagcgacagcagcgugaucgcccagcagaaggccaugaagagccuguucggcgacgacgagaaggagaccggcgaggagagcgagaucauccccacccuggagccccugcccccccacgaggugcccggccaccagagcguguucaugaacgagcccagacugagcgacuucaagcaggugcugcugagagagggcauccaggccgaguucgugggcggcgugcuggugugcaacaaccagguggccgugagaagaaccgagaccggcagaaucggccuggagggcugccugugccaggacuucuacagaaucagagaccugcuguacgagcaguacgccaucguguaa

SEQ ID NO: 15596 - RNA, 2055 nt, Artificial Sequence
  CPSF3__Homo_sapiens__NP_057291
augagcgccauccccgccgaggagagcgaccagcugcugaucagaccccugggcgccggccaggaggugggcagaagcugcaucauccuggaguucaagggcagaaagaucaugcuggacugcggcauccaccccggccuggagggcauggacgcccugcccuacaucgaccugaucgaccccgccgagaucgaccugcugcugaucagccacuuccaccuggaccacugcggcgcccugcccugguuccugcagaagaccagcuucaagggcagaaccuucaugacccacgccaccaaggccaucuacagauggcugcugagcgacuacgugaaggugagcaacaucagcgccgacgacaugcuguacaccgagaccgaccuggaggagagcauggacaagaucgagaccaucaacuuccacgaggugaaggagguggccggcaucaaguucuggugcuaccacgccggccacgugcugggcgccgccauguucaugaucgagaucgccggcgugaagcugcuguacaccggcgacuucagcagacaggaggacagacaccugauggccgccgagauccccaacaucaagcccgacauccugaucaucgagagcaccuacggcacccacauccacgagaagagagaggagagagaggccagauucugcaacaccgugcacgacaucgugaacagaggcggcagaggccugauccccguguucgcccugggcagagcccaggagcugcugcugauccuggacgaguacuggcagaaccaccccgagcugcacgacauccccaucuacuacgccagcagccuggccaagaagugcauggccguguaccagaccuacgugaacgccaugaacgacaagaucagaaagcagaucaacaucaacaaccccuucguguucaagcacaucagcaaccugaagagcauggaccacuucgacgacaucggccccagcguggugauggccagccccggcaugaugcagagcggccugagcagagagcuguucgagagcuggugcaccgacaagagaaacggcgugaucaucgccggcuacugcguggagggcacccuggccaagcacaucaugagcgagcccgaggagaucaccaccaugagcggccagaagcugccccugaagaugagcguggacuacaucagcuucagcgcccacaccgacuaccagcagaccagcgaguucaucagagcccugaagcccccccacgugauccuggugcacggcgagcagaacgagauggccagacugaaggccgcccugaucagagaguacgaggacaacgacgaggugcacaucgaggugcacaaccccagaaacaccgaggccgugacccugaacuucagaggcgagaagcuggccaaggugaugggcuuccuggccgacaagaagcccgagcagggccagagagugagcggcauccuggugaagagaaacuucaacuaccacauccugagccccugcgaccugagcaacuacaccgaccuggccaugagcaccgugaagcagacccaggccauccccuacaccggccccuucaaccugcugugcuaccagcugcagaagcugaccggcgacguggaggagcuggagauccaggagaagcccgcccugaagguguucaagaacaucaccgugauccaggagcccggcaugguggugcuggaguggcuggccaaccccagcaacgacauguacgccgacaccgugaccaccgugauccuggaggugcagagcaaccccaagaucagaaagggcgccgugcagaaggugagcaagaagcuggagaugcacguguacagcaagagacuggagaucaugcugcaggacaucuucggcgaggacugcgugagcgugaaggacgacagcauccugagcgugaccguggacggcaagaccgccaaccugaaccuggagaccagaaccguggagugcgaggagggcagcgaggacgacgagagccugagagagaugguggagcuggccgcccagagacuguacgaggcccugacccccgugcacuaa

SEQ ID NO: 15597 - RNA, 1983 nt, Artificial Sequence
  CPSF3L__Homo_sapiens__XP_011539949
augcccgagaucagagugaccccccugggcgccugccccgugcugagcuggaaccuggugcugccccccggcagaggcagcagagcccccagcagcaccgacaccagaaccggcuuccacgugcugccccacggcccccugggcugcggccccgugauccugaugugcggcgccggcuucggccacuucgaguggcuggccggcggcggcgccggccaggacgugggcagaagcugcauccuggugagcaucgccggcaagaacgugaugcuggacugcggcaugcacaugggcuucaacgacgacagaagauuccccgacuucagcuacaucacccagaacggcagacugaccgacuuccuggacugcgugaucaucagccacuuccaccuggaccacugcggcgcccugcccuacuucagcgagauggugggcuacgacggccccaucuacaugacccaccccacccaggccaucugccccauccugcuggaggacuacagaaagaucgccguggacaagaagggcgaggccaacuucuucaccagccagaugaucaaggacugcaugaagaaggugguggccgugcaccugcaccagaccgugcagguggacgacgagcuggagaucaaggccuacuacgccggccacgugcugggcgccgccauguuccagaucaaggugggcagcgagagcgugguguacaccggcgacuacaacaugacccccgacagacaccugggcgccgccuggaucgacaagugcagacccaaccugcugaucaccgagagcaccuacgccaccaccaucagagacagcaagagaugcagagagagagacuuccugaagaaggugcacgagaccguggagagaggcggcaaggugcugauccccguguucgcccugggcagagcccaggagcugugcauccugcuggagaccuucugggagagaaugaaccugaaggugcccaucuacuucagcaccggccugaccgagaaggccaaccacuacuacaagcuguucauccccuggaccaaccagaagaucagaaagaccuucgugcagagaaacauguucgaguucaagcacaucaaggccuucgacagagccuucgccgacaaccccggccccauggugguguucgccacccccggcaugcugcacgccggccagagccugcagaucuucagaaagugggccggcaacgagaagaacauggugaucaugcccggcuacugcgugcagggcaccgugggccacaagauccugagcggccagagaaagcuggagauggagggcagacaggugcuggaggugaagaugcagguggaguacaugagcuucagcgcccacgccgacgccaagggcaucaugcagcuggugggccaggccgagcccgagagcgugcugcuggugcacggcgaggccaagaagauggaguuccugaagcagaagaucgagcaggagcugagagugaacugcuacaugcccgccaacggcgagaccgugacccugcccaccagccccagcauccccgugggcaucagccugggccugcugaagagagagauggcccagggccugcugcccgaggccaagaagcccagacugcugcacggcacccugaucaugaaggacagcaacuucagacuggugagcagcgagcaggcccugaaggagcugggccuggccgagcaccagcugagauucaccugcagagugcaccugcacgacaccagaaaggagcaggagaccgcccugagaguguacagccaccugaagagcgugcugaaggaccacugcgugcagcaccugcccgacggcagcgugaccguggagagcgugcugcugcaggccgccgcccccagcgaggaccccggcaccaaggugcugcuggugagcuggaccuaccaggacgaggagcugggcagcuuccugaccagccugcugaagaagggccugccccaggcccccagcuaa

SEQ ID NO: 15598 - RNA, 735 nt, Artificial Sequence
  CPSF4__Homo_sapiens__NP_001075028
augcaggagaucaucgccagcguggaccacaucaaguucgaccuggagaucgccguggagcagcagcugggcgcccagccccugcccuuccccggcauggacaagagcggcgccgccgugugcgaguucuuccugaaggccgccugcggcaagggcggcaugugccccuucagacacaucagcggcgagaagaccguggugugcaagcacuggcugagaggccugugcaagaagggcgaccagugcgaguuccugcacgaguacgacaugaccaagaugcccgagugcuacuucuacagcaaguucggcgagugcagcaacaaggagugccccuuccugcacaucgaccccgagagcaagaucaaggacugccccugguacgacagaggcuucugcaagcacggcccccugugcagacacagacacaccagaagagugaucugcgugaacuaccuggugggcuucugccccgagggccccagcugcaaguucaugcaccccagauucgagcugcccaugggcaccaccgagcagcccccccugccccagcagacccagccccccgccaagcagagaaccccccaggugaucggcgugaugcagagccagaacagcagcgccggcaacagaggccccagaccccuggagcaggugaccugcuacaagugcggcgagaagggccacuacgccaacagaugcaccaagggccaccuggccuuccugagcggccaguaa

SEQ ID NO: 15599 - RNA, 1767 nt, Artificial Sequence
  CPSF6__Homo_sapiens__NP_001287876
auggccgacggcguggaccacaucgacaucuacgccgacgugggcgaggaguucaaccaggaggccgaguacggcggccacgaccagaucgaccuguacgacgacgugaucagccccagcgccaacaacggcgacgcccccgaggacagagacuacauggacacccugccccccaccgugggcgacgacgugggcaagggcgccgcccccaacgugguguacaccuacaccggcaagagaaucgcccuguacaucggcaaccugaccugguggaccaccgacgaggaccugaccgaggccgugcacagccugggcgugaacgacauccuggagaucaaguucuucgagaacagagccaacggccagagcaagggcuucgcccuggugggcgugggcagcgaggccagcagcaagaagcugauggaccugcugcccaagagagagcugcacggccagaaccccguggugacccccugcaacaagcaguuccugagccaguucgagaugcagagcagaaagaccacccagagcggccagaugagcggcgagggcaaggccggcccccccggcggcagcagcagagccgccuucccccagggcggcagaggcagaggcagauuccccggcgccgugcccggcggcgacagauuccccggccccgccggccccggcggcccccccccccccuuccccggcaaccugaucaagcaccuggugaagggcaccagaccccuguuccuggagaccagaauccccuggcacaugggccacagcaucgaggagauccccaucuucggccugaaggccggccagaccccccccagacccccccugggcccccccggcccccccggcccccccggcccccccccccccggccaggugcugccccccccccuggccggcccccccaacagaggcgacagaccccccccccccgugcuguuccccggccagcccuucggccagcccccccugggcccccugccccccggcccccccccccccgugcccggcuacggccccccccccggccccccccccccccagcagggccccccccccccccccggccccuucccccccagaccccccggcccccugggccccccccugacccuggccccccccccccaccugcccggccccccccccggcgcccccccccccgccccccacgugaaccccgccuucuuccccccccccaccaacagcggcaugcccaccagcgacagcagaggccccccccccaccgaccccuacggcagacccccccccuacgacagaggcgacuacggcccccccggcagagagauggacaccgccagaaccccccugagcgaggccgaguucgaggagaucaugaacagaaacagagccaucagcagcagcgccaucagcagagccgugagcgacgccagcgccggcgacuacggcagcgccaucgagacccuggugaccgccaucagccugaucaagcagagcaaggugagcgccgacgacagaugcaaggugcugaucagcagccugcaggacugccugcacggcaucgagagcaagagcuacggcagcggcagcagaagagagagaagcagagagagagaccacagcagaagcagagagaagagcagaagacacaagagcagaagcagagacagacacgacgacuacuacagagagagaagcagagagagagagagacacagagacagagacagagacagagacagagagagagacagagagagagaguacagacacagauaa

SEQ ID NO: 15600 - RNA, 1416 nt, Artificial Sequence
  CPSF7__Homo_sapiens__NP_001129512
augagcgagggcguggaccugaucgacaucuacgccgacgaggaguucaaccaggaccccgaguucaacaacaccgaccagaucgaccuguacgacgacgugcugaccgccaccagccagcccagcgacgacagaagcagcagcaccgagccccccccccccgugagacaggagcccagccccaagcccaacaacaagacccccgccauccuguacaccuacagcggccugagaaacagaagagccgccguguacgugggcagcuucagcugguggaccaccgaccagcagcugauccaggugaucagaagcaucggcguguacgacgugguggagcugaaguucgccgagaacagagccaacggccagagcaagggcuacgccgagguggugguggccagcgagaacagcgugcacaagcugcuggagcugcugcccggcaaggugcugaacggcgagaagguggacgugagacccgccaccagacagaaccugagccaguucgaggcccaggccagaaagagagagugcgugagagugcccagaggcggcaucccccccagagcccacagcagagacagcagcgacagcgccgacggcagagccacccccagcgagaaccuggugcccagcagcgccagaguggacaagccccccagcgugcugcccuacuucaacagaccccccagcgcccugccccugaugggccugccccccccccccaucccccccccccccccccugagcagcagcuucggcgugcccccccccccccccggcauccacuaccagcaccugaugccccccccccccagacugcccccccaccuggccgugcccccccccggcgccaucccccccgcccugcaccugaaccccgccuucuuccccccccccaacgccaccgugggccccccccccgacaccuacaugaaggccagcgcccccuacaaccaccacggcagcagagacagcggccccccccccagcaccgugagcgaggccgaguucgaggacaucaugaagagaaacagagccaucagcagcagcgccaucagcaaggccgugagcggcgccagcgccggcgacuacagcgacgccaucgagacccugcugaccgccaucgccgugaucaagcagagcagaguggccaacgacgagagaugcagagugcugaucagcagccugaaggacugccugcacggcaucgaggccaagagcuacagcgugggcgccagcggcagcagcagcagaaagagacacagaagcagagagagaagccccagcagaagcagagagagcagcagaagacacagagaccugcugcacaacgaggacagacacgacgacuacuuccaggagagaaacagagagcacgagagacacagagacagagagagagacagacaccacuaa

SEQ ID NO: 15601 - RNA, 2418 nt, Artificial Sequence
  CPT1A__Homo_sapiens__XP_005273819
augcagcaccugagcagcgaggcccugagcaccgagcugagcccccagcugggcaccgccggccuggaccugcccaccgagagauacagccugaagauggccgaggcccaccaggccguggccuuccaguucaccgugacccccgacggcaucgaccugagacugagccacgaggcccugagacagaucuaccugagcggccugcacagcuggaagaagaaguucaucagauucaagaacggcaucaucaccggcguguaccccgccagccccagcagcuggcugaucgugguggugggcgugaugaccaccauguacgccaagaucgaccccagccugggcaucaucgccaagaucaacagaacccuggagaccgccaacugcaugagcagccagaccaagaacguggugagcggcgugcuguucggcaccggccuguggguggcccugaucgugaccaugagauacagccugaaggugcugcugagcuaccacggcuggauguucaccgagcacggcaagaugagcagagccaccaagaucuggaugggcauggugaagaucuucagcggcagaaagcccaugcuguacagcuuccagaccagccugcccagacugcccgugcccgccgugaaggacaccgugaacagauaccugcagagcgugagaccccugaugaaggaggaggacuucaagagaaugaccgcccuggcccaggacuucgccgugggccugggccccagacugcagugguaccugaagcugaagagcuggugggccaccaacuacgugagcgacuggugggaggaguacaucuaccugagaggcagaggcccccugauggugaacagcaacuacuacgccauggaccugcuguacauccugcccacccacauccaggccgccagagccggcaacgccauccacgccauccugcuguacagaagaaagcuggacagagaggagaucaagcccaucagacugcugggcagcaccaucccccugugcagcgcccagugggagagaauguucaacaccagcagaauccccggcgaggagaccgacaccauccagcacaugagagacagcaagcacaucgugguguaccacagaggcagauacuucaagguguggcuguaccacgacggcagacugcugaagcccagagagauggagcagcagaugcagagaauccuggacaacaccagcgagccccagcccggcgaggccagacuggccgcccugaccgccggcgacagagugcccugggccagaugcagacaggccuacuucggcagaggcaagaacaagcagagccuggacgccguggagaaggccgccuucuucgugacccuggacgagaccgaggagggcuacagaagcgaggaccccgacaccagcauggacagcuacgccaagagccugcugcacggcagaugcuacgacagaugguucgacaagagcuucaccuucgugguguucaagaacggcaagaugggccugaacgccgagcacagcugggccgacgcccccaucguggcccaccugugggaguacgugaugagcaucgacagccugcagcugggcuacgccgaggacggccacugcaagggcgacaucaaccccaacauccccuaccccaccagacugcagugggacauccccggcgagugccaggaggugaucgagaccagccugaacaccgccaaccugcuggccaacgacguggacuuccacagcuuccccuucguggccuucggcaagggcaucaucaagaagugcagaaccagccccgacgccuucgugcagcuggcccugcagcuggcccacuacaaggacaugggcaaguucugccugaccuacgaggccagcaugaccagacuguucagagagggcagaaccgagaccgugagaagcugcaccaccgagagcugcgacuucgugagagccaugguggaccccgcccagaccguggagcagagacugaagcuguucaagcuggccagcgagaagcaccagcacauguacagacuggccaugaccggcagcggcaucgacagacaccuguucugccuguacguggugagcaaguaccuggccguggagagccccuuccugaaggaggugcugagcgagcccuggagacugagcaccagccagaccccccagcagcagguggagcuguucgaccuggagaacaaccccgaguacgugagcagcggcggcggcuucggccccguggccgacgacggcuacggcgugagcuacauccuggugggcgagaaccugaucaacuuccacaucagcagcaaguucagcugccccgagaccgacagccacagauucggcagacaccugaaggaggccaugaccgacaucaucacccuguucggccugagcagcaacagcaagaaguaa

SEQ ID NO: 15602 - RNA, 2217 nt, Artificial Sequence
  CPT1B__Homo_sapiens__NP_001138606
auggccgaggcccaccaggccguggccuuccaguucaccgugacccccgacggcguggacuucagacugagcagagaggcccugaagcacguguaccugagcggcaucaacagcuggaagaagagacugaucagaaucaagaacggcauccugagaggcguguaccccggcagccccaccagcuggcugguggugaucauggccaccgugggcagcagcuucugcaacguggacaucagccugggccuggugagcugcauccagagaugccugccccagggcugcggccccuaccagaccccccagaccagagcccugcugagcauggccaucuucagcaccggcgugugggugaccggcaucuucuucuucagacagacccugaagcugcugcugugcuaccacggcuggauguucgagaugcacggcaagaccagcaaccugaccagaaucugggccuaccuggagagcgugagaccccugcuggacgacgaggaguacuacagaauggagcugcuggccaaggaguuccaggacaagaccgcccccagacugcagaaguaccuggugcugaagagcuggugggccagcaacuacgugagcgacuggugggaggaguacaucuaccugagaggcagaagcccccugauggugaacagcaacuacuacgugauggaccuggugcugaucaagaacaccgacgugcaggccgccagacugggcaacaucauccacgccaugaucauguacagaagaaagcuggacagagaggagaucaagcccgugauggcccugggcaucgugcccaugugcagcuaccagauggagagaauguucaacaccaccagaauccccggcaaggacaccgacgugcugcagcaccugagcgacagcagacacguggccguguaccacaagggcagauucuucaagcuguggcuguacgagggcgccagacugcugaagccccaggaccuggagaugcaguuccagagaauccuggacgaccccagccccccccagcccggcgaggagaagcuggccgcccugaccgccggcggcagaguggagugggcccaggccagacaggccuucuucagcagcggcaagaacaaggccgcccuggaggccaucgagagagccgccuucuucguggcccuggacgaggagagcuacagcuacgaccccgaggacgaggccagccugagccuguacggcaaggcccugcugcacggcaacugcuacaacagaugguucgacaagagcuucacccugaucagcuucaagaacggccagcugggccugaacgccgagcacgccugggccgacgcccccaucaucggccaccugugggaguucgugcugggcaccgacagcuuccaccugggcuacaccgagaccggccacugccugggcaagcccaaccccgcccuggccccccccaccagacugcagugggacauccccaagcagugccaggccgugaucgagagcagcuaccagguggccaaggcccuggccgacgacguggagcuguacugcuuccaguuccugcccuucggcaagggccugaucaagaagugcagaaccagccccgacgccuucgugcagaucgcccugcagcuggcccacuucagagacagaggcaaguucugccugaccuacgaggccagcaugaccagaauguucagagagggcagaaccgagaccgugagaagcugcaccagcgagagcaccgccuucgugcaggccaugauggagggcagccacaccaaggccgaccugagagaccuguuccagaaggccgccaagaagcaccagaacauguacagacuggccaugaccggcgccggcaucgacagacaccuguucugccuguaccuggugagcaaguaccugggcgugagcagccccuuccuggccgaggugcugagcgagcccuggagacugagcaccagccagaucccccagagccagaucagaauguucgaccccgagcagcaccccaaccaccugggcgccggcggcggcuucggccccguggccgacgacggcuacggcgugagcuacaugaucgccggcgagaacaccaucuucuuccacaucagcagcaaguucagcagcagcgagaccaacgcccagagauucggcaaccacaucagaaaggcccugcuggacaucgccgaccuguuccaggugcccaaggccuacagcuaa

SEQ ID NO: 15603 - RNA, 2379 nt, Artificial Sequence
  CPT1C__Homo_sapiens__NP_001129524
auggccgaggcccaccaggccgugggcuucagacccagccugaccagcgacggcgccgagguggagcugagcgcccccgugcugcaggagaucuaccugagcggccugagaagcuggaagagacaccugagcagauucuggaacgacuuccugaccggcguguuccccgccagcccccugagcuggcuguuccuguucagcgccauccagcuggccugguuccugcagcuggaccccagccugggccugauggagaagaucaaggagcugcugcccgacuggggcggccagcaccacggccugagaggcgugcuggccgccgcccuguucgccagcugccuguggggcgcccugaucuucacccugcacguggcccugagacugcugcugagcuaccacggcuggcugcuggagccccacggcgccaugagcagccccaccaagaccuggcuggcccuggugagaaucuucagcggcagacaccccaugcuguucagcuaccagagaagccugcccagacagcccgugcccagcgugcaggacaccgugagaaaguaccuggagagcgugagacccauccugagcgacgaggacuucgacuggaccgccgugcuggcccaggaguuccugagacugcaggccagccugcugcagugguaccugagacugaagagcuggugggccagcaacuacgugagcgacuggugggaggaguucguguaccugagaagcagaaacccccugauggugaacagcaacuacuacaugauggccgccagagccggcaacgccgugcacgcccugcugcuguacagacacagacugaacagacaggagaucccccccacccugcugaugggcaugagaccccugugcagcgcccaguacgagaagaucuucaacaccaccagaauccccggcgugcagaaggacuacaucagacaccugcacgacagccagcacguggccguguuccacagaggcagauucuucagaaugggcacccacagcagaaacagccugcugagccccagagcccuggagcagcaguuccagagaauccuggacgaccccagccccgccugcccccacgaggagcaccuggccgcccugaccgccgcccccagaggcaccugggcccaggugagaaccagccugaagacccaggccgccgaggcccuggaggccguggagggcgccgccuucuucgugagccuggacgccgagcccgccggccugaccagagaggaccccgccgccagccuggacgccuacgcccacgcccugcuggccggcagaggccacgacagaugguucgacaagagcuucacccugaucguguucagcaacggcaagcugggccugagcguggagcacagcugggccgacugccccaucagcggccacaugugggaguucacccuggccaccgagugcuuccagcugggcuacagcaccgacggccacugcaagggccaccccgaccccacccugccccagccccagagacugcagugggaccugcccgaccagauccacagcagcaucagccuggcccugagaggcgccaagauccugagcgagaacguggacugccacguggugcccuucagccuguucggcaagagcuucaucagaagaugccaccugagcagcgacagcuucauccagaucgcccugcagcuggcccacuucagagacagaggccaguucugccugaccuacgagagcgccaugaccagacuguuccuggagggcagaaccgagaccgugagaagcugcaccagagaggccugcaacuucgugagagccauggaggacaaggagaagaccgacccccagugccuggcccuguucagaguggccguggacaagcaccaggcccugcugaaggccgccaugagcggccagggcguggacagacaccuguucgcccuguacaucgugagcagauuccugcaccugcagagccccuuccugacccaggugcacagcgagcaguggcagcugagcaccagccagauccccgugcagcagaugcaccuguucgacgugcacaacuaccccgacuacgugagcagcggcggcggcuucggccccgccgacgaccacggcuacggcgugagcuacaucuucaugggcgacggcaugaucaccuuccacaucagcagcaagaagagcagcaccaagaccgacagccacagacugggccagcacaucgaggacgcccugcuggacguggccagccuguuccaggccggccagcacuucaagagaagauucagaggcagcggcaaggagaacagcagacacagaugcggcuuccugagcagacagaccggcgccagcaaggccagcaugaccagcaccgacuucuaa

SEQ ID NO: 15604 - RNA, 1431 nt, Artificial Sequence
  CPVL__Homo_sapiens__XP_011513739
auggugggcgccauguggaaggugaucgugagccuggugcugcugaugcccggccccugcgacggccuguucagaagccuguacagaagcgugagcaugccccccaagggcgacagcggccagccccuguuccugacccccuacaucgaggccggcaagauccagaagggcagagagcugagccuggugggccccuuccccggccugaacaugaagagcuacgccggcuuccugaccgugaacaagaccuacaacagcaaccuguucuucugguucuuccccgcccagauccagcccgaggacgcccccguggugcuguggcugcagggcggccccggcggcagcagcauguucggccuguucguggagcacggccccuacguggugaccagcaacaugacccugagagacagagacuuccccuggaccaccacccugagcaugcuguacaucgacaaccccgugggcaccggcuucagcuucaccgacgacacccacggcuacgccgugaacgaggacgacguggccagagaccuguacagcgcccugauccaguucuuccagaucuuccccgaguacaagaacaacgacuucuacgugaccggcgagagcuacgccggcaaguacgugcccgccaucgcccaccugauccacagccugaaccccgugagagaggugaagaucaaccugaacggcaucgccaucggcgacggcuacagcgaccccgagagcaucaucggcggcuacgccgaguuccuguaccagaucggccugcuggacgagaagcagaagaaguacuuccagaagcagugccacgagugcaucgagcacaucagaaagcagaacugguucgaggccuucgagauccuggacaagcugcuggacggcgaccugaccagcgaccccagcuacuuccagaacgugaccggcugcagcaacuacuacaacuuccugagaugcaccgagcccgaggaccagcuguacuacgugaaguuccugagccugcccgaggugagacaggccauccacgugggcaaccagaccuucaacgacggcaccaucguggagaaguaccugagagaggacaccgugcagagcgugaagcccuggcugaccgagaucaugaacaacuacaaggugcugaucuacaacggccagcuggacaucaucguggccgccgcccugaccgagagaagccugaugggcauggacuggaagggcagccaggaguacaagaaggccgagaagaagguguggaagaucuucaagagcgacagcgagguggccggcuacaucagacaggccggcgacuuccaccaggugaucaucagaggcggcggccacauccugcccuacgaccagccccugagagccuucgacaugaucaacagauucaucuacggcaagggcugggaccccuacgugggcuaa

SEQ ID NO: 15605 - RNA, 906 nt, Artificial Sequence
  CPXCR1__Homo_sapiens__NP_001171700
augagcagccccaccaaggagggcagcgacaccgccggcaacgcccacaagaacagcgagaacgagccccccaacgacugcagcaccgacaucgagagccccagcgccgaccccaacaugaucuaccagguggagaccaaccccaucaacagagagcccggcaccgccaccagccaggaggacguggugccccaggccgccgagaacagcgagcuggagaccgagauccagaaggaccagagagaggaggaccugaaggaggagcugcugcugcugcagacccccauccccagaaagcuggugagccacaagccccugaacgacagaagcagaagccacagcggcaagguggagaugaaggccaacaacuuccccaucaaccacaagaccagauucagacugagcaccagcuggagagugcccuucaucaacagccacgagaucagaagcaugauccugcaccugcugugcgacagauacuucagccaggccgccggcugccagaacaccaugugggugaagagaaaguacaucgccugccuguaccaccccaacagcuucacccaccacgagagagccaucaccuucagaagacccagcagagugcacuacuacagaccccugaccgagagaaugaccagcggcaaguucugcaagagcaccgacaccaagggcaagugcagauucagagccaucgugagaagcgugcuguucgugagccagauccagaucgagagcaucuucaacaucaagggcuucguggacauccugaccuacauccacaccaugaacgugaugaucaccaacaccaacaacggcuggaaguacuucugccccaucugcggcagacuguucaacaccuacagcgagcugagacagcacagcugcagcagcagcggcaacuaa

SEQ ID NO: 15606 - RNA, 1959 nt, Artificial Sequence
  CPZ__Homo_sapiens__NP_001014447
augccccccccccccccccugcugcugcugaccgugcuggugguggccgccgccagacccggcugcgaguucgagagaaaccccgccggcgagugccacagaccccccgccgccgacagcgccaccugcguggaccugcagcugagaaccugcagcgacgccgccuacaaccacaccaccuuccccaaccugcugcagcacagaagcugggaggugguggaggccagcagcgaguacauccugcugagcgugcugcaccagcugcuggagggccagugcaaccccgaccugagacugcugggcugcgccgugcuggcccccagaugcgagggcggcugggugagaagacccugcagacacaucugcgagggccugagagaggugugccagcccgccuucgacgccaucgacauggccuggcccuacuuccuggacugccacagauacuucaccagagaggacgagggcugcuacgacccccuggagaagcugagaggcggccuggaggccgacgaggcccugcccagcggccugccccccaccuucaucagauucagccaccacagcuacgcccagauggugagagugcugagaagaaccgccagcagaugcgcccacguggccagaaccuacagcaucggcagaagcuucgacggcagagagcugcuggugaucgaguucagcagcagacccggccagcacgagcugauggagcccgaggugaagcugaucggcaacauccacggcaacgagguggccggcagagagaugcugaucuaccuggcccaguaccugugcagcgaguaccugcugggcaaccccagaauccagagacugcugaacaccaccagaauccaccugcugcccagcaugaaccccgacggcuacgagguggccgccgccgagggcgccggcuacaacggcuggaccagcggcagacagaacgcccagaaccuggaccugaacagaaacuuccccgaccugaccagcgaguacuacagacuggccgagaccagaggcgccagaagcgaccacauccccaucccccagcacuacugguggggcaagguggcccccgagaccaaggccaucaugaaguggaugcagaccauccccuucgugcugagcgccagccugcacggcggcgaccugguggugagcuaccccuucgacuucagcaagcacccccaggaggagaagauguucagccccacccccgacgagaagauguucaagcugcugagcagagccuacgccgacgugcaccccaugaugauggacagaagcgagaacagaugcggcggcaacuuccugaagagaggcagcaucaucaacggcgccgacugguacagcuucaccggcggcaugagcgacuucaacuaccugcacaccaacugcuucgagaucaccguggagcugggcugcgugaaguucccccccgaggaggcccuguacacccuguggcagcacaacaaggagagccugcugaacuucguggagaccgugcacagaggcaucaagggcguggugaccgacaaguucggcaagcccgugaagaacgccagaaucagcgugaagggcaucagacacgacaucaccaccgcccccgacggcgacuacuggagacugcugccccccggcauccacaucgugaucgcccaggcccccggcuacgccaaggugaucaagaaggugaucauccccgccagaaugaagagagccggcagaguggacuucauccugcagccccugggcaugggccccaagaacuucauccacggccugagaagaaccggcccccacgacccccugggcggcgccagcagccugggcgaggccaccgagcccgacccccugagagccagaagacagcccagcgccgacggcagcaagcccuggugguggagcuacuucaccagccugagcacccacagacccagauggcugcugaaguacuaa

SEQ ID NO: 15607 - RNA, 6120 nt, Artificial Sequence
  CR1__Homo_sapiens__NP_000564
augggcgccagcagccccagaagccccgagcccgugggcccccccgcccccggccugcccuucugcugcggcggcagccugcuggccgugguggugcugcuggcccugcccguggccuggggccagugcaacgcccccgaguggcugcccuucgccagacccaccaaccugaccgacgaguucgaguuccccaucggcaccuaccugaacuacgagugcagacccggcuacagcggcagacccuucagcaucaucugccugaagaacagcguguggaccggcgccaaggacagaugcagaagaaagagcugcagaaacccccccgaccccgugaacggcauggugcacgugaucaagggcauccaguucggcagccagaucaaguacagcugcaccaagggcuacagacugaucggcagcagcagcgccaccugcaucaucagcggcgacaccgugaucugggacaacgagacccccaucugcgacagaauccccugcggccugccccccaccaucaccaacggcgacuucaucagcaccaacagagagaacuuccacuacggcagcguggugaccuacagaugcaaccccggcagcggcggcagaaagguguucgagcuggugggcgagcccagcaucuacugcaccagcaacgacgaccaggugggcaucuggagcggccccgccccccagugcaucauccccaacaagugcaccccccccaacguggagaacggcauccuggugagcgacaacagaagccuguucagccugaacgaggugguggaguucagaugccagcccggcuucgugaugaagggccccagaagagugaagugccaggcccugaacaagugggagcccgagcugcccagcugcagcagagugugccagcccccccccgacgugcugcacgccgagagaacccagagagacaaggacaacuucagccccggccaggagguguucuacagcugcgagcccggcuacgaccugagaggcgccgccagcaugagaugcaccccccagggcgacuggagccccgccgcccccaccugcgaggugaagagcugcgacgacuucaugggccagcugcugaacggcagagugcuguuccccgugaaccugcagcugggcgccaagguggacuucgugugcgacgagggcuuccagcugaagggcagcagcgccagcuacugcgugcuggccggcauggagagccuguggaacagcagcgugcccgugugcgagcagaucuucugccccagcccccccgugauccccaacggcagacacaccggcaagccccuggagguguuccccuucggcaagaccgugaacuacaccugcgacccccaccccgacagaggcaccagcuucgaccugaucggcgagagcaccaucagaugcaccagcgacccccagggcaacggcguguggagcagccccgcccccagaugcggcauccugggccacugccaggcccccgaccacuuccuguucgccaagcugaagacccagaccaacgccagcgacuuccccaucggcaccagccugaaguacgagugcagacccgaguacuacggcagacccuucagcaucaccugccuggacaaccugguguggagcagccccaaggacgugugcaagagaaagagcugcaagaccccccccgaccccgugaacggcauggugcacgugaucaccgacauccaggugggcagcagaaucaacuacagcugcaccaccggccacagacugaucggccacagcagcgccgagugcauccugagcggcaacgccgcccacuggagcaccaagccccccaucugccagagaauccccugcggccugccccccaccaucgccaacggcgacuucaucagcaccaacagagagaacuuccacuacggcagcguggugaccuacagaugcaaccccggcagcggcggcagaaagguguucgagcuggugggcgagcccagcaucuacugcaccagcaacgacgaccaggugggcaucuggagcggccccgccccccagugcaucauccccaacaagugcaccccccccaacguggagaacggcauccuggugagcgacaacagaagccuguucagccugaacgaggugguggaguucagaugccagcccggcuucgugaugaagggccccagaagagugaagugccaggcccugaacaagugggagcccgagcugcccagcugcagcagagugugccagcccccccccgacgugcugcacgccgagagaacccagagagacaaggacaacuucagccccggccaggagguguucuacagcugcgagcccggcuacgaccugagaggcgccgccagcaugagaugcaccccccagggcgacuggagccccgccgcccccaccugcgaggugaagagcugcgacgacuucaugggccagcugcugaacggcagagugcuguuccccgugaaccugcagcugggcgccaagguggacuucgugugcgacgagggcuuccagcugaagggcagcagcgccagcuacugcgugcuggccggcauggagagccuguggaacagcagcgugcccgugugcgagcagaucuucugccccagcccccccgugauccccaacggcagacacaccggcaagccccuggagguguuccccuucggcaaggccgugaacuacaccugcgacccccaccccgacagaggcaccagcuucgaccugaucggcgagagcaccaucagaugcaccagcgacccccagggcaacggcguguggagcagccccgcccccagaugcggcauccugggccacugccaggcccccgaccacuuccuguucgccaagcugaagacccagaccaacgccagcgacuuccccaucggcaccagccugaaguacgagugcagacccgaguacuacggcagacccuucagcaucaccugccuggacaaccugguguggagcagccccaaggacgugugcaagagaaagagcugcaagaccccccccgaccccgugaacggcauggugcacgugaucaccgacauccaggugggcagcagaaucaacuacagcugcaccaccggccacagacugaucggccacagcagcgccgagugcauccugagcggcaacaccgcccacuggagcaccaagccccccaucugccagagaauccccugcggccugccccccaccaucgccaacggcgacuucaucagcaccaacagagagaacuuccacuacggcagcguggugaccuacagaugcaaccugggcagcagaggcagaaagguguucgagcuggugggcgagcccagcaucuacugcaccagcaacgacgaccaggugggcaucuggagcggccccgccccccagugcaucauccccaacaagugcaccccccccaacguggagaacggcauccuggugagcgacaacagaagccuguucagccugaacgaggugguggaguucagaugccagcccggcuucgugaugaagggccccagaagagugaagugccaggcccugaacaagugggagcccgagcugcccagcugcagcagagugugccagcccccccccgagauccugcacggcgagcacacccccagccaccaggacaacuucagccccggccaggagguguucuacagcugcgagcccggcuacgaccugagaggcgccgccagccugcacugcaccccccagggcgacuggagccccgaggcccccagaugcgccgugaagagcugcgacgacuuccugggccagcugccccacggcagagugcuguucccccugaaccugcagcugggcgccaaggugagcuucgugugcgacgagggcuucagacugaagggcagcagcgugagccacugcgugcuggugggcaugagaagccuguggaacaacagcgugcccgugugcgagcacaucuucugccccaacccccccgccauccugaacggcagacacaccggcacccccagcggcgacauccccuacggcaaggagaucagcuacaccugcgacccccaccccgacagaggcaugaccuucaaccugaucggcgagagcaccaucagaugcaccagcgacccccacggcaacggcguguggagcagccccgcccccagaugcgagcugagcgugagagccggccacugcaagacccccgagcaguuccccuucgccagccccaccauccccaucaacgacuucgaguuccccgugggcaccagccugaacuacgagugcagacccggcuacuucggcaagauguucagcaucagcugccuggagaaccugguguggagcagcguggaggacaacugcagaagaaagagcugcggccccccccccgagcccuucaacggcauggugcacaucaacaccgacacccaguucggcagcaccgugaacuacagcugcaacgagggcuucagacugaucggcagccccagcaccaccugccuggugagcggcaacaacgugaccugggacaagaaggcccccaucugcgagaucaucagcugcgagcccccccccaccaucagcaacggcgacuucuacagcaacaacagaaccagcuuccacaacggcaccguggugaccuaccagugccacaccggccccgacggcgagcagcuguucgagcuggugggcgagagaagcaucuacugcaccagcaaggacgaccaggugggcguguggagcagccccccccccagaugcaucagcaccaacaagugcaccgcccccgagguggagaacgccaucagagugcccggcaacagaagcuucuucacccugaccgagaucaucagauucagaugccagcccggcuucgugauggugggcagccacaccgugcagugccagaccaacggcagauggggccccaagcugccccacugcagcagagugugccagcccccccccgagauccugcacggcgagcacacccugagccaccaggacaacuucagccccggccaggagguguucuacagcugcgagcccagcuacgaccugagaggcgccgccagccugcacugcaccccccagggcgacuggagccccgaggcccccagaugcaccgugaagagcugcgacgacuuccugggccagcugccccacggcagagugcugcugccccugaaccugcagcugggcgccaaggugagcuucgugugcgacgagggcuucagacugaagggcagaagcgccagccacugcgugcuggccggcaugaaggcccuguggaacagcagcgugcccgugugcgagcagaucuucugccccaacccccccgccauccugaacggcagacacaccggcacccccuucggcgacauccccuacggcaaggagaucagcuacgccugcgacacccaccccgacagaggcaugaccuucaaccugaucggcgagagcagcaucagaugcaccagcgacccccagggcaacggcguguggagcagccccgcccccagaugcgagcugagcgugcccgccgccugcccccacccccccaagauccagaacggccacuacaucggcggccacgugagccuguaccugcccggcaugaccaucagcuacaucugcgaccccggcuaccugcuggugggcaagggcuucaucuucugcaccgaccagggcaucuggagccagcuggaccacuacugcaaggaggugaacugcagcuucccccuguucaugaacggcaucagcaaggagcuggagaugaagaagguguaccacuacggcgacuacgugacccugaagugcgaggacggcuacacccuggagggcagccccuggagccagugccaggccgacgacagaugggaccccccccuggccaagugcaccagcagaacccacgacgcccugaucgugggcacccugagcggcaccaucuucuucauccugcugaucaucuuccugagcuggaucauccugaagcacagaaagggcaacaacgcccacgagaaccccaaggagguggccauccaccugcacagccagggcggcagcagcgugcaccccagaacccugcagaccaacgaggagaacagcagagugcugcccuaa

SEQ ID NO: 15608 - RNA, 3279 nt, Artificial Sequence
  CR2__Homo_sapiens__NP_001006659
augggcgccgccggccugcugggcguguuccuggcccugguggcccccggcgugcugggcaucagcugcggcagccccccccccauccugaacggcagaaucagcuacuacagcacccccaucgccgugggcaccgugaucagauacagcugcagcggcaccuucagacugaucggcgagaagagccugcugugcaucaccaaggacaagguggacggcaccugggacaagcccgcccccaagugcgaguacuucaacaaguacagcagcugccccgagcccaucgugcccggcggcuacaagaucagaggcagcacccccuacagacacggcgacagcgugaccuucgccugcaagaccaacuucagcaugaacggcaacaagagcguguggugccaggccaacaacauguggggccccaccagacugcccaccugcgugagcguguucccccuggagugccccgcccugcccaugauccacaacggccaccacaccagcgagaacgugggcagcaucgcccccggccugagcgugaccuacagcugcgagagcggcuaccugcuggugggcgagaagaucaucaacugccugagcagcggcaaguggagcgccgugccccccaccugcgaggaggccagaugcaagagccugggcagauuccccaacggcaaggugaaggagccccccauccugagagugggcgugaccgccaacuucuucugcgacgagggcuacagacugcagggcccccccagcagcagaugcgugaucgccggccagggcguggccuggaccaagaugcccgugugcgaggagaucuucugccccagccccccccccauccugaacggcagacacaucggcaacagccuggccaacgugagcuacggcagcaucgugaccuacaccugcgaccccgaccccgaggagggcgugaacuucauccugaucggcgagagcacccugagaugcaccguggacagccagaagaccggcaccuggagcggccccgcccccagaugcgagcugagcaccagcgccgugcagugcccccacccccagauccugagaggcagaauggugagcggccagaaggacagauacaccuacaacgacaccgugaucuucgccugcauguucggcuucacccugaagggcagcaagcagaucagaugcaacgcccagggcaccugggagcccagcgcccccgugugcgagaaggagugccaggccccccccaacauccugaacggccagaaggaggacagacacauggugagauucgaccccggcaccagcaucaaguacagcugcaaccccggcuacgugcuggugggcgaggagagcauccagugcaccagcgagggcguguggaccccccccgugccccagugcaagguggccgccugcgaggccaccggcagacagcugcugaccaagccccagcaccaguucgugagacccgacgugaacagcagcugcggcgagggcuacaagcugagcggcagcguguaccaggagugccagggcaccauccccugguucauggagaucagacugugcaaggagaucaccugcccccccccccccgugaucuacaacggcgcccacaccggcagcagccuggaggacuuccccuacggcaccaccgugaccuacaccugcaaccccggccccgagagaggcguggaguucagccugaucggcgagagcaccaucagaugcaccagcaacgaccaggagagaggcaccuggagcggccccgccccccugugcaagcugagccugcuggccgugcagugcagccacgugcacaucgccaacggcuacaagaucagcggcaaggaggcccccuacuucuacaacgacaccgugaccuucaagugcuacagcggcuucacccugaagggcagcagccagaucagaugcaaggccgacaacaccugggaccccgagauccccgugugcgagaagggcugccagagcccccccggccugcaccacggcagacacaccggcggcaacaccguguucuucgugagcggcaugaccguggacuacaccugcgaccccggcuaccugcuggugggcaacaagagcauccacugcaugcccagcggcaacuggagccccagcgcccccagaugcgaggagaccugccagcacgugagacagagccugcaggagcugcccgccggcagcagaguggagcuggugaacaccagcugccaggacggcuaccagcugaccggccacgccuaccagaugugccaggacgccgagaacggcaucugguucaagaagaucccccugugcaaggugauccacugccaccccccccccgugaucgugaacggcaagcacaccggcaugauggccgagaacuuccuguacggcaacgaggugagcuacgagugcgaccagggcuucuaccugcugggcgagaagaagcugcagugcagaagcgacagcaagggccacggcagcuggagcggccccagcccccagugccugagaagcccccccgugaccagaugccccaaccccgaggugaagcacggcuacaagcugaacaagacccacagcgccuacagccacaacgacaucguguacguggacugcaaccccggcuucaucaugaacggcagcagagugaucagaugccacaccgacaacaccugggugcccggcgugcccaccugcaucaagaaggccuucaucggcugcccccccccccccaagacccccaacggcaaccacaccggcggcaacaucgccagauucagccccggcaugagcauccuguacagcugcgaccagggcuaccugcuggugggcgaggcccugcugcugugcacccacgagggcaccuggagccagcccgccccccacugcaaggaggugaacugcagcagccccgccgacauggacggcauccagaagggccuggagcccagaaagauguaccaguacggcgccguggugacccuggagugcgaggacggcuacaugcuggagggcagcccccagagccagugccagagcgaccaccaguggaaccccccccuggccgugugcagaagcagaagccuggcccccgugcugugcggcaucgccgccggccugauccugcugaccuuccugaucgugaucacccuguacgugaucagcaagcacagagccagaaacuacuacaccgacaccagccagaaggaggccuuccaccuggaggccagagagguguacagcguggaccccuacaaccccgccagcuaa

SEQ ID NO: 15609 - RNA, 414 nt, Artificial Sequence
  CRABP1__Homo_sapiens__NP_004369
augcccaacuucgccggcaccuggaagaugagaagcagcgagaacuucgacgagcugcugaaggcccugggcgugaacgccaugcugagaaagguggccguggccgccgccagcaagccccacguggagaucagacaggacggcgaccaguucuacaucaagaccagcaccaccgugagaaccaccgagaucaacuucaaggugggcgagggcuucgaggaggagaccguggacggcagaaagugcagaagccuggccaccugggagaacgagaacaagauccacugcacccagacccugcuggagggcgacggccccaagaccuacuggaccagagagcuggccaacgacgagcugauccugaccuucggcgccgacgacguggugugcaccagaaucuacgugagagaguaa

SEQ ID NO: 15610 - RNA, 417 nt, Artificial Sequence
  CRABP2__Homo_sapiens__NP_001186652
augcccaacuucagcggcaacuggaagaucaucagaagcgagaacuucgaggagcugcugaaggugcugggcgugaacgugaugcugagaaagaucgccguggccgccgccagcaagcccgccguggagaucaagcaggagggcgacaccuucuacaucaagaccagcaccaccgugagaaccaccgagaucaacuucaaggugggcgaggaguucgaggagcagaccguggacggcagacccugcaagagccuggugaagugggagagcgagaacaagauggugugcgagcagaagcugcugaagggcgagggccccaagaccagcuggaccagagagcugaccaacgacggcgagcugauccugaccaugaccgccgacgacguggugugcaccagaguguacgugagagaguaa

SEQ ID NO: 15611 - RNA, 2196 nt, Artificial Sequence
  CRACR2A__Homo_sapiens__NP_001138430
auggccgcccccgacggcagaguggugagcagaccccagagacugggccagggcagcggccagggccccaagggcagcggcgccugccugcacccccuggacagccuggagcagaaggagacccaggagcagaccagcggccagcuggugaugcugagaaaggcccaggaguucuuccagaccugcgacgccgagggcaagggcuucaucgccagaaaggacaugcagagacugcacaaggagcugccccugagccuggaggagcuggaggacguguucgacgcccuggacgccgacggcaacggcuaccugaccccccaggaguucaccaccggcuucagccacuucuucuucagccagaacaaccccagccaggaggacgccggcgagcagguggcccagagacacgaggagaagguguaccugagcagaggcgacgaggaccugggcgacaugggcgaggacgaggaggcccaguucagaaugcugauggacagacugggcgcccagaaggugcuggaggacgagagcgacgugaagcagcuguggcugcagcugaagaaggaggagccccaccugcugagcaacuucgaggacuuccugaccagaaucaucagccagcugcaggaggcccacgaggagaagaacgagcuggagugcgcccugaagagaaagaucgccgccuacgacgaggagauccagcaccuguacgaggagauggagcagcagaucaagagcgagaaggagcaguuccugcugaaggacaccgagagauuccaggccagaagccaggagcuggagcagaagcugcugugcaaggagcaggagcuggagcagcugacccagaagcagaagagacuggagggccagugcaccgcccugcaccacgacaagcacgagaccaaggccgagaacaccaagcugaagcugaccaaccaggagcuggccagagagcuggagagaaccagcugggagcugcaggacgcccagcagcagcuggagagccugcagcaggaggccugcaagcugcaccaggagaaggagauggagguguacagagugaccgagagccugcagagagagaaggccggccugcugaagcagcuggacuuccugagagagagaaacaagcaccugagagacgagagagacaucugcuuccagaagaacaaggccgccaaggccaacaccgccgccagcagagccagcuggaagaagagaagcggcagcgugaucggcaaguacguggacagcagaggcauccugagaagccagagcgaggaggaggaggagguguucggcauccccagaagaagcagccugggccugagcggcuacccccugaccgaggaggagcccggcaccggcgagcccggccccggcggccccuaccccagaccccugagaagaaucaucagcguggaggaggacccccugccccagcugcuggacggcggcuucgagcagccccugagcaagugcagcgaggaggaggaggugagcgaccagggcgugcagggccagauccccgaggcccccccccugaagcugacccccaccagccccagaggccagcccgugggcaaggaggcccugugcaaggaggagagcagccccagcgcccccgacagacuguucaagaucguguucgugggcaacagcgccgugggcaagaccagcuuccugagaagauucugcgaggacagauucagccccggcauggccgccaccgugggcaucgacuacagagugaagacccugaacguggacaacagccagguggcccugcagcugugggacaccgccggccaggagagauacagaugcaucacccagcaguucuucagaaaggccgacggcgugaucgugauguacgaccugaccgacaagcagagcuuccugagcgugagaagauggcugagcagcguggaggaggccgugggcgacagagugcccgugcugcugcugggcaacaagcuggacaacgagaaggagagagaggugcccagaggccugggcgagcagcuggccaccgagaacaaccugaucuucuacgagugcagcgccuacagcggccacaacaccaaggagagccugcugcaccuggccagauuccugaaggagcaggaggacaccgugagagaggacaccauccaggugggccaccccgccaagaagaagagcugcugcggcuaa

SEQ ID NO: 15612 - RNA, 600 nt, Artificial Sequence
  CRADD__Homo_sapiens__NP_003796
auggaggccagagacaagcaggugcugagaagccugagacuggagcugggcgccgaggugcugguggagggccuggugcugcaguaccuguaccaggagggcauccugaccgagaaccacauccaggagaucaacgcccagaccaccggccugagaaagaccaugcugcugcuggacauccugcccagcagaggccccaaggccuucgacaccuuccuggacagccugcaggaguuccccugggugagagagaagcugaagaaggccagagaggaggccaugaccgaccugcccgccggcgacagacugaccggcauccccagccacauccugaacagcagccccagcgacagacagaucaaccagcuggcccagagacugggccccgagugggagcccauggugcugagccugggccugagccagaccgacaucuacagaugcaaggccaaccacccccacaacgugcagagccaggugguggaggccuucaucagauggagacagagauucggcaagcaggccaccuuccagagccugcacaacggccugagagccguggagguggaccccagccugcugcugcacaugcuggaguaa

SEQ ID NO: 15613 - RNA, 3810 nt, Artificial Sequence
  CRAMP1L__Homo_sapiens__NP_065876
augaccgugaagcugggcgacggcggcagcggcgaggacggccugaagaagcugggcaagagagccgccgacgaggagagccuggagggcgagggcgccggcggcgccgacgccgccgaggagagcagcggcaccaagagagacgagaagacccccagagccggcgccgacggcccccccgccccccccggcgccccccaggcccccagccccccccagggcagcccccaggaccagcaccacuuccugagaagcagcgugagaccccagagcaagagacccagaaaggacccccccagcgccgugggcagcggcaacgccggcggcagcggccccagaggcaagggcgccgagggcggcggcagcagcagcggcaacgugagcggcguggcccccgccgcccccgccggcggcagcagaagcagcagcagaaaccugggcagcagcggcggcgagaaggaggagggcaagaaggugagaagacagugggagagcuggagcaccgaggacaagaacaccuucuucgagggccuguacgagcacggcaaggacuucgaggccauccagaacaacaucgcccugaaguacaagaagaagggcaagcccgccagcauggugaagaacaaggagcaggugagacacuucuacuacagaaccuggcacaagaucaccaaguacaucgacuucgaccacguguucagcagaggccugaagaagagcagccaggagcuguacggccugaucugcuacggcgagcugagaaagaagaucggcggcugcauggacgacaagaacgccaccaagcugaacgagcugauccaggugggcgccaccaccgugagauacaagggcagaaaccugagaaucaaggcccccaugugcagagcccugaagaagcugugcgaccccgacggccugagcgacgaggaggaccagaagcccgugagacugccccugaaggugcccaucgagcugcagcccagaaacaaccacgccugggccagagugcagagccuggcccagaaccccagacugagaaugaucguggagcugcacagaaaggugagcagccugaucgaguuccugaagcagaagugggcccugcacgaggugagagugagaaagacccuggaggagagacagcugcaggacagcugcagcgcccccaugcaggagaaggugacccugcaccuguuccccggcgagaacugcacccugaccccccugcccggcguggccagaguggugcacagcaaggccuucugcaccgugcacuggcaggagggcggcagaugcaagcagagcgccaaggacgcccacgugcugccccccgcccagauccugggcauccagagcggccagggcaccgccagaggccaggugaagugccccagaagcggcgccgagggcaagggcgugggcagacccccccccgccgccgacgcccugcagagcagcggcgagagcagccccgagagcgcccccggcgagggcgccgcccugagccugagcagccccgacgcccccgacagacccccccccagacaccaggacaccggccccugccuggagaagacccccgccgagggcagagacagccccaccagagagcccggcgcccugcccugcgccugcggccagcugcccgaccuggaggacgagcugagccugcuggacccccugcccagauaccugaagagcugccaggaccugaucgugcccgagcagugcagaugcgccgacaccagacccggcagcgagcagcccccccugggcggcgccgccagccccgaggugcuggcccccgugagcaaggaggccgccgaccuggcccccaccggccccagccccagacccggccccggccugcugcuggacgugugcaccaaggaccuggccgacgcccccgccgaggagcugcaggagaagggcagccccgccggccccccccccagccagggccagcccgccgccagaccccccaaggaggugcccgccagcagacuggcccagcagcugagagaggagggcuggaaccugcagaccagcgagagccugacccuggccgagguguaccugaugaugggcaagcccagcaagcugcagcuggaguacgacuggcugggccccggcagacaggaccccagacccggcagccugcccaccgcccugcacaagcagagacugcugagcugccugcugaagcugaucagcaccgaggugaaccccaagcuggcccuggaggccaacaccaucagcaccgccagcgugagacccgcccaggaggagcagagcaugaccccccccggcaagguggugaccgugagcagcagaagccccagaugccccagaaaccaggccagccugagaagcagcaagaccuucccccccagcagcgcccccugcagcagcggccugagaaacccccccagaccccugcuggugcccggccccagcagcaccggcagcaacgacagcgacggcggccuguucgccgugcccaccacccugccccccaacagcagacacggcaagcuguucagccccagcaaggaggccgagcugaccuucagacagcaccugaacagcaucagcaugcagagcgacuucuuccugcccaagcccagaaagcugagaaacagacaccugagaaagccccugguggugcagagaacccugcugcccagacccagcgagaaccagagccacaacgugugcagcuucagcauccugagcaacagcagcgugaccggcagaggcagcuucagacccauccagagcagccugaccaaggccgcccugagcagacccaucgugcccaaggugcugcccccccaggccaccagccaccuggccagcgccaucgaccuggccgccaccagcgccggcauccugagcggcaacccccugcccgcccuggacaccgagggccugagcggcaucagcccccugagcagcgacgaggugaccggcgccaucagcggccaggacagcaccggcacccaccaggacggcgacacccugcccaccgugggcggcagcgaccccuucgugagcauccccagcagacccgagcaggagcccguggccgacagcuuccagggcagcagcgugcugagccugagcgagcugcccaaggccccccugcagaacggccugagcaucccccugagcagcagcgagagcagcagcaccagacugagcccccccgacgugagcgcccugcuggacaucagccugcccggcccccccgaggacgcccugagccagggcgagcccgccacccacaucagcgacagcaucaucgagaucgccaucagcagcggccaguacggcgagggcgugccccugagccccgccaagcugaacggcagcgacagcagcaagagccugcccagccccagcagcagcccccagccccacuggaucgccagccccacccacgacccccagugguaccccagcgacagcaccgacagcagccugagcagccuguucgccagcuucaucagccccgagaagagcagaaagaugcugcccacccccaucggcaccaacagcggcaccagccugcugggccccagccugcuggacggcaacagcagagacagcuucgugagcagaagccuggccgacguggccgaggugguggacagccagcuggugugcaugaugaacgagaacagcaucgacuacaucagcagauucaacgaccuggcccaggagcugagcaucgccgagcccggcagaagagaggcccuguucgacggcggcggcggcggccccgccgugagcgaccugagccaguaa

SEQ ID NO: 15614 - RNA, 1881 nt, Artificial Sequence
  CRAT__Homo_sapiens__NP_000746
augcuggccuucgccgccagaaccguggugaagccccugggcuuccugaagcccuucagccugaugaaggccagcagcagauucaaggcccaccaggacgcccugcccagacugcccgugcccccccugcagcagagccuggaccacuaccugaaggcccugcagcccaucgugagcgaggaggagugggcccacaccaagcagcugguggacgaguuccaggccagcggcggcgugggcgagagacugcagaagggccuggagagaagagccagaaagaccgagaacuggcugagcgagugguggcugaagaccgccuaccugcaguacagacagcccguggugaucuacagcagccccggcgugaugcugcccaagcaggacuucguggaccugcagggccagcugagauucgccgccaagcugaucgagggcgugcuggacuucaaggugaugaucgacaacgagacccugcccguggaguaccugggcggcaagccccugugcaugaaccaguacuaccagauccugagcagcugcagagugcccggccccaagcaggacaccgugagcaacuucagcaagaccaagaagccccccacccacaucaccguggugcacaacuaccaguucuucgagcuggacguguaccacagcgacggcaccccccugaccgccgaccagaucuucgugcagcuggagaagaucuggaacagcagccugcagaccaacaaggagcccgugggcauccugaccagcaaccacagaaacagcugggccaaggccuacaacacccugaucaaggacaaggugaacagagacagcgugagaagcauccagaagagcaucuucaccgugugccuggacgccaccaugcccagagugagcgaggacguguacagaagccacguggccggccagaugcugcacggcggcggcagcagacugaacagcggcaacagaugguucgacaagacccugcaguucaucguggccgaggacggcagcugcggccugguguacgagcacgccgccgccgagggcccccccaucgugacccugcuggacuacgugaucgaguacaccaagaagcccgagcuggugagaagccccauggugccccugcccaugcccaagaagcugagauucaacaucacccccgagaucaagagcgacaucgagaaggccaagcagaaccugagcaucaugauccaggaccuggacaucaccgugaugguguuccaccacuucggcaaggacuuccccaagagcgagaagcugagccccgacgccuucauccagauggcccugcagcuggccuacuacagaaucuacggccaggccugcgccaccuacgagagcgccagccugagaauguuccaccugggcagaaccgacaccaucagaagcgccagcauggacagccugaccuucgugaaggccauggacgacagcagcgugaccgagcaccagaagguggagcugcugagaaaggccgugcaggcccacagaggcuacaccgacagagccaucagaggcgaggccuucgacagacaccugcugggccugaagcugcaggccaucgaggaccuggugagcaugcccgacaucuucauggacaccagcuacgccaucgccaugcacuuccaccugagcaccagccaggugcccgccaagaccgacugcgugauguucuucggccccguggugcccgacggcuacggcgugugcuacaaccccauggaggcccacaucaacuucagccugagcgccuacaacagcugcgccgagaccaacgccgccagacuggcccacuaccuggagaaggcccugcuggacaugagagcccugcugcagagccaccccagagccaagcuguaa

SEQ ID NO: 15615 - RNA, 3885 nt, Artificial Sequence
  CRB1__Homo_sapiens__NP_001180569
auggcccugaagaacaucaacuaccugcugaucuucuaccugagcuucagccugcugaucuacaucaagaacagcuucugcaacaagaacaacaccagaugccugagcaacagcugccagaacaacagcaccugcaaggacuucagcaaggacaacgacugcagcugcagcgacaccgccaacaaccuggacaaggacugcgacaacaugaaggaccccugcuucagcaaccccugccagggcagcgccaccugcgugaacacccccggcgagagaagcuuccugugcaagugcccccccggcuacagcggcaccaucugcgagaccaccaucggcagcugcggcaagaacagcugccagcacggcggcaucugccaccaggaccccaucuaccccgugugcaucugccccgccggcuacgccggcagauucugcgagaucgaccacgacgagugcgccagcagccccugccagaacggcgccgugugccaggacggcaucgacggcuacagcugcuucugcgugcccggcuaccagggcagacacugcgaccuggagguggacgagugcgccagcgaccccugcaagaacgaggccaccugccugaacgagaucggcagauacaccugcaucugcccccacaacuacagcggcuacaccggcgcccagugcgagaucgaccugaacgagugcaacagcaaccccugccagagcaacggcgagugcguggagcugagcagcgagaagcaguacggcagaaucaccggccugcccagcagcuucagcuaccacgaggccagcggcuacgugugcaucugccagcccggcuucaccggcauccacugcgaggaggacgugaacgagugcagcagcaaccccugccagaacggcggcaccugcgagaaccugcccggcaacuacaccugccacugccccuucgacaaccugagcagaaccuucuacggcggcagagacugcagcgacauccugcugggcugcacccaccagcagugccugaacaacggcaccugcaucccccacuuccaggacggccagcacggcuucagcugccugugccccagcggcuacaccggcagccugugcgagaucgccaccacccugagcuucgagggcgacggcuuccugugggugaagagcggcagcgugaccaccaagggcagcgugugcaacaucgcccugagauuccagaccgugcagcccauggcccugcugcuguucagaagcaacagagacguguucgugaagcuggagcugcugagcggcuacauccaccugagcauccaggugaacaaccagagcaaggugcugcuguucaucagccacaacaccagcgacggcgaguggcacuucguggaggugaucuucgccgaggccgugacccugacccugaucgacgacagcugcaaggagaagugcaucgccaaggcccccaccccccuggagagcgaccagagcaucugcgccuuccagaacagcuuccugggcggccugcccgugggcaugaccagcaacggcguggcccugcugaacuucuacaacaugcccagcacccccagcuucgugggcugccugcaggacaucaagaucgacuggaaccacaucacccuggagaacaucagcagcggcagcagccugaacgugaaggccggcugcgugagaaaggacuggugcgagagccagcccugccagagcagaggcagaugcaucaaccuguggcugagcuaccagugcgacugccacagacccuacgagggccccaacugccugagagaguacguggccggcagauucggccaggacgacagcaccggcuacgugaucuucacccuggacgagagcuacggcgacaccaucagccugagcauguucgugagaacccugcagcccagcggccugcugcuggcccuggagaacagcaccuaccaguacaucagaguguggcuggagagaggcagacuggccaugcugacccccaacagccccaagcugguggugaaguucgugcugaacgacggcaacgugcaccugaucagccugaagaucaagcccuacaagaucgagcuguaccagagcagccagaaccugggcuucaucagcgccagcaccuggaagaucgagaagggcgacgugaucuacaucggcggccugcccgacaagcaggagaccgagcugaacggcggcuucuucaagggcugcauccaggacgugagacugaacaaccagaaccuggaguucuuccccaaccccaccaacaacgccagccugaaccccgugcuggugaacgugacccagggcugcgccggcgacaacagcugcaagagcaaccccugccacaacggcggcgugugccacagcagaugggacgacuucagcugcagcugccccgcccugaccagcggcaaggccugcgaggaggugcaguggugcggcuucagccccugcccccacggcgcccagugccagcccgugcugcagggcuucgagugcaucgccaacgccguguucaacggccagagcggccagauccuguucagaagcaacggcaacaucaccagagagcugaccaacaucaccuucggcuucagaaccagagacgccaacgugaucauccugcacgccgagaaggagcccgaguuccugaacaucagcauccaggacagcagacuguucuuccagcugcagagcggcaacagcuucuacaugcugagccugaccagccugcagagcgugaacgacggcaccuggcacgaggugacccugagcaugaccgacccccugagccagaccagcagauggcagauggagguggacaacgagacccccuucgugaccagcaccaucgccaccggcagccugaacuuccugaaggacaacaccgacaucuacgugggcgacagagccaucgacaacaucaagggccugcagggcugccugagcaccaucgagaucggcggcaucuaccugagcuacuucgagaacgugcacggcuucaucaacaagccccaggaggagcaguuccugaagaucagcaccaacagcguggugaccggcugccugcagcugaacgugugcaacagcaaccccugccugcacggcggcaacugcgaggacaucuacagcagcuaccacugcagcugcccccugggcuggagcggcaagcacugcgagcugaacaucgacgagugcuucagcaaccccugcauccacggcaacugcagcgacagaguggccgccuaccacugcaccugcgagcccggcuacaccggcgugaacugcgagguggacaucgacaacugccagagccaccagugcgccaacggcgccaccugcaucagccacaccaacggcuacagcugccugugcuucggcaacuucaccggcaaguucugcagacagagcagacugcccagcaccgugugcggcaacgagaagaccaaccugaccugcuacaacggcggcaacugcaccgaguuccagaccgagcugaagugcaugugcagacccggcuucaccggcgaguggugcgagaaggacaucgacgagugcgccagcgaccccugcgugaacggcggccugugccaggaccugcugaacaaguuccagugccugugcgacguggccuucgccggcgagagaugcgagguggaccuggccgacgaccugaucagcgacaucuucaccaccaucggcagcgugaccguggcccugcugcugauccugcugcuggccaucguggccagcguggugaccagcaacaagagagccacccagggcaccuacagccccagcagacaggagaaggagggcagcagaguggagauguggaaccugaugcccccccccgccauggagagacugaucuaa

SEQ ID NO: 15616 - RNA, 3858 nt, Artificial Sequence
  CRB2__Homo_sapiens__NP_775960
auggcccuggccagacccggcacccccgacccccaggcccuggccagcgugcugcugcugcugcugugggcccccgcccugagccugcuggccggcaccgugcccagcgagccccccagcgccugcgccagcgaccccugcgcccccggcaccgagugccaggccaccgagagcggcggcuacaccugcggccccauggagcccagaggcugcgccacccagcccugccaccacggcgcccugugcgugccccagggccccgaccccaccggcuucagaugcuacugcgugcccggcuuccagggccccagaugcgagcuggacaucgacgagugcgccagcagacccugccaccacggcgccaccugcagaaaccuggccgacagauacgagugccacugcccccugggcuacgccggcgugaccugcgagauggagguggacgagugcgccagcgcccccugccugcacggcggcagcugccuggacggcgugggcagcuucagaugcgugugcgcccccggcuacggcggcaccagaugccagcuggaccuggacgagugccagagccagcccugcgcccacggcggcaccugccacgaccuggugaacggcuucagaugcgacugcgccggcaccggcuacgagggcacccacugcgagagagaggugcuggagugcgccagcgcccccugcgagcacaacgccagcugccuggagggccugggcagcuucagaugccugugcuggcccggcuacagcggcgagcugugcgagguggacgaggacgagugcgccagcagccccugccagcacggcggcagaugccugcagagaagcgaccccgcccuguacggcggcgugcaggccgccuuccccggcgccuucagcuucagacacgccgccggcuuccugugccacugcccccccggcuucgagggcgccgacugcggcguggagguggacgagugcgccagcagacccugccugaacggcggccacugccaggaccugcccaacggcuuccagugccacugccccgacggcuacgccggccccaccugcgaggaggacguggacgagugccugagcgaccccugccugcacggcggcaccugcagcgacaccguggccggcuacaucugcagaugccccgagaccuggggcggcagagacugcagcgugcagcugaccggcugccagggccacaccugcccccuggccgccaccugcauccccaucuucgagagcggcgugcacagcuacgugugccacugcccccccggcacccacggccccuucugcggccagaacaccaccuucagcgugauggccggcagccccauccaggccagcgugcccgccggcggcccccugggccuggcccugagauucagaaccacccugcccgccggcacccuggccaccagaaacgacaccaaggagagccuggagcuggcccugguggccgccacccugcaggccacccuguggagcuacagcaccaccgugcuggugcugagacugcccgaccuggcccugaacgacggccacuggcaccagguggagguggugcugcaccuggccacccuggagcugagacuguggcacgagggcugccccgccagacugugcguggccagcggccccguggcccuggccagcaccgccagcgccaccccccugcccgccggcaucagcagcgcccagcugggcgacgccaccuucgccggcugccugcaggacgugagaguggacggccaccugcugcugcccgaggaccugggcgagaacgugcugcugggcugcgagagaagagagcagugcagaccccugcccugcgugcacggcggcagcugcguggaccuguggacccacuucagaugcgacugcgccagaccccacagaggccccaccugcgccgacgagauccccgccgccaccuucggccugggcggcgcccccagcagcgccagcuuccugcugcaggagcugcccggccccaaccugaccgugagcuuccugcugagaaccagagagagcgccggccugcugcugcaguucgccaacgacagcgccgccggccugaccguguuccugagcgagggcagaaucagagccgaggugcccggcagccccgccguggugcugcccggcagaugggacgacggccugagacaccuggugaugcugagcuucggccccgaccagcugcaggaccugggccagcacgugcacgugggcggcagacugcuggccgccgacagccagcccuggggcggccccuucagaggcugccugcaggaccugagacuggacggcugccaccugcccuucuucccccugccccuggacaacagcagccagcccagcgagcugggcggcagacagagcuggaaccugaccgccggcugcgugagcgaggacaugugcagccccgaccccugcuucaacggcggcaccugccuggugaccuggaacgacuuccacugcaccugccccgccaacuucaccggccccaccugcgcccagcagcuguggugccccggccagcccugccugccccccgccaccugcgaggaggugcccgacggcuucgugugcguggccgaggccaccuucagagagggcccccccgccgccuucagcggccacaacgccagcagcggcagacugcugggcggccugagccuggccuucagaaccagagacagcgaggccuggcugcugagagccgccgccggcgcccuggagggcguguggcuggccgugagaaacggcagccuggccggcggcgugagaggcggccacggccugcccggcgccgugcugcccauccccggccccagaguggccgacggcgccuggcacagagugagacuggccauggagagacccgccgccaccaccagcagauggcugcuguggcuggacggcgccgccacccccguggcccugagaggccuggccagcgaccugggcuuccugcagggccccggcgccgugagaauccugcuggccgagaacuucaccggcugccugggcagaguggcccugggcggccugccccugccccuggccagacccagacccggcgccgcccccggcgccagagagcacuucgccagcuggcccggcacccccgcccccauccugggcugcagaggcgcccccgugugcgcccccagccccugccugcacgacggcgccugcagagaccuguucgacgccuucgccugcgccugcggccccggcugggagggccccagaugcgaggcccacguggaccccugccacagcgcccccugcgccagaggcagaugccacacccaccccgacggcagauucgagugcagaugcccccccggcuucggcggccccagaugcagacugcccgugcccagcaaggagugcagccugaacgugaccugccuggacggcagccccugcgagggcggcagccccgccgccaacugcagcugccuggagggccuggccggccagagaugccaggugcccacccugcccugcgaggccaaccccugccugaacggcggcaccugcagagccgccggcggcgugagcgagugcaucugcaacgccagauucagcggccaguucugcgagguggccaagggccugccccugccccugcccuucccccugcuggagguggccgugcccgccgccugcgccugccugcugcugcugcugcugggccugcugagcggcauccuggccgccagaaagagaagacagagcgagggcaccuacagccccagccagcaggagguggccggcgccagacuggagauggacagcgugcugaaggugccccccgaggagagacugaucuaa

SEQ ID NO: 15617 - RNA, 372 nt, Artificial Sequence
  CRB3__Homo_sapiens__NP_777377
auggccaaccccggccugggccugcugcuggcccugggccugcccuuccugcuggccagauggggcagagccuggggccagauccagaccaccagcgccaacgagaacagcaccgugcugcccagcagcaccagcagcagcagcgacggcaaccugagacccgaggccaucaccgccaucaucgugguguucagccugcuggccgcccugcugcuggccgugggccuggcccugcuggugagaaagcugagagagaagagacagaccgagggcaccuacagacccagcagcgaggagcaguucagccacgccgccgaggccagagccccccaggacagcaaggagaccgugcagggcugccugcccaucuaa

SEQ ID NO: 15618 - RNA, 1326 nt, Artificial Sequence
  CRBN__Homo_sapiens__NP_001166953
auggccggcgagggcgaccagcaggacgccgcccacaacaugggcaaccaccugccccugcugcccgagagcgaggaggaggacgagauggagguggaggaccaggacagcaaggaggccaagaagcccaacaucaucaacuucgacaccagccugcccaccagccacaccuaccugggcgccgacauggaggaguuccacggcagaacccugcacgacgacgacagcugccaggugauccccgugcugccccaggugaugaugauccugauccccggccagacccugccccugcagcuguuccacccccaggaggugagcauggugagaaaccugauccagaaggacagaaccuucgccgugcuggccuacagcaacgugcaggagagagaggcccaguucggcaccaccgccgagaucuacgccuacagagaggagcaggacuucggcaucgagaucgugaaggugaaggccaucggcagacagagauucaaggugcuggagcugagaacccagagcgacggcauccagcaggccaaggugcagauccugcccgagugcgugcugcccagcaccaugagcgccgugcagcuggagagccugaacaagugccagaucuuccccagcaagcccgugagcagagaggaccagugcagcuacaagugguggcagaaguaccagaagagaaaguuccacugcgccaaccugaccagcuggcccagauggcuguacagccuguacgacgccgagacccugauggacagaaucaagaagcagcugagagagugggacgagaaccugaaggacgacagccugcccagcaaccccaucgacuucagcuacagaguggccgccugccugcccaucgacgacgugcugagaauccagcugcugaagaucggcagcgccauccagagacugagaugcgagcuggacaucaugaacaagugcaccagccugugcugcaagcagugccaggagaccgagaucaccaccaagaacgagaucuucagccugagccugugcggccccauggccgccuacgugaacccccacggcuacgugcacgagacccugaccguguacaaggccugcaaccugaaccugaucggcagacccagcaccgagcacagcugguuccccggcuacgccuggaccguggcccagugcaagaucugcgccagccacaucggcuggaaguucaccgccaccaagaaggacaugagcccccagaaguucuggggccugaccagaagcgcccugcugcccaccauccccgacaccgaggacgagaucagccccgacaaggugauccugugccuguaa

SEQ ID NO: 15619 - RNA, 348 nt, Artificial Sequence
  CRCP__Homo_sapiens__NP_001035737
auggaggugaaggacgccaacagcgcccugcugagcaacuacgagacccugaaguacaucagcaagacccccugcagacaccagagccccgagaucgugagagaguuccugaccgcccugaagagccacaagcugaccaaggccgagaagcugcagcugcugaaccacagacccgugaccgccguggagauccagcugaugguggaggagagcgaggagagacugaccgaggagcagaucgaggcccugcugcacaccgugaccagcauccugcccgccgagcccgaggccgagcagaagaagaacaccaacagcaacguggccauggacgaggaggaccccgccuaa

SEQ ID NO: 15620 - RNA, 300 nt, Artificial Sequence
  CRCT1__Homo_sapiens__NP_061933
augagcagccagcagagcgccgugagcgccaagggcuucagcaagggcagcagccagggccccgcccccugccccgcccccgcccccacccccgcccccgccagcagcagcagcugcugcggcagcggcagaggcugcugcggcgacagcggcugcugcggcagcagcagcaccagcugcugcugcuuccccagaagaagaagaagacagagaagcagcggcugcugcugcugcggcggcggcagccagagaagccagagaagcaacaacagaagcagcggcugcugcagcggcugcuaa

SEQ ID NO: 15621 - RNA, 1026 nt, Artificial Sequence
  CREB1__Homo_sapiens__XP_011508947
augaccauggagagcggcgccgagaaccagcagagcggcgacgccgccgugaccgaggccgagaaccagcagaugaccgugcaggcccagccccagaucgccacccuggcccaggugagcaugcccgccgcccacgccaccagcagcgcccccaccgugacccuggugcagcugcccaacggccagaccgugcaggugcacggcgugauccaggccgcccagcccagcgugauccagagcccccaggugcagaccgugcagagcagcugcaaggaccugaagagacuguucagcggcacccagaucagcaccaucgccgagagcgaggacagccaggagagcguggacagcgugaccgacagccagaagagaagagagauccugagcagaagacccagcuacagaaagauccugaacgaccugagcagcgacgcccccggcgugcccagaaucgaggaggagaagagcgaggaggagaccagcgcccccgccaucaccaccgugaccgugcccacccccaucuaccagaccagcagcggccaguacaucgccaucacccagggcggcgccauccagcuggccaacaacggcaccgacggcgugcagggccugcagacccugaccaugaccaacgccgccgccacccagcccggcaccaccauccugcaguacgcccagaccaccgacggccagcagauccuggugcccagcaaccaggugguggugcaggccgccagcggcgacgugcagaccuaccagaucagaaccgcccccaccagcaccaucgcccccggcguggugauggccagcagccccgcccugcccacccagcccgccgaggaggccgccagaaagagagaggugagacugaugaagaacagagaggccgccagagagugcagaagaaagaagaaggaguacgugaagugccuggagaacagaguggccgugcuggagaaccagaacaagacccugaucgaggagcugaaggcccugaaggaccuguacugccacaagagcgacuaa

SEQ ID NO: 15622 - RNA, 1116 nt, Artificial Sequence
  CREB3__Homo_sapiens__NP_006359
auggagcuggagcuggacgccggcgaccaggaccugcuggccuuccugcuggaggagagcggcgaccugggcaccgcccccgacgaggccgugagagccccccuggacugggcccugccccugagcgaggugcccagcgacugggagguggacgaccugcugugcagccugcugagcccccccgccagccugaacauccugagcagcagcaaccccugccuggugcaccacgaccacaccuacagccugcccagagagaccgugagcauggaccuggagagcgagagcugcagaaaggagggcacccagaugaccccccagcacauggaggagcuggccgagcaggagaucgccagacuggugcugaccgacgaggagaagagccugcuggagaaggagggccugauccugcccgagacccugccccugaccaagaccgaggagcagauccugaagagagugagaagaaagaucagaaacaagagaagcgcccaggagagcagaagaaagaagaagguguacgugggcggccuggagagcagagugcugaaguacaccgcccagaacauggagcugcagaacaaggugcagcugcuggaggagcagaaccugagccugcuggaccagcugagaaagcugcaggccauggugaucgagaucagcaacaagaccagcagcagcagcaccugcauccuggugcugcuggugagcuucugccugcugcuggugcccgccauguacagcagcgacaccagaggcagccugcccgccgagcacggcgugcugagcagacagcugagagcccugcccagcgaggaccccuaccagcuggagcugcccgcccugcagagcgaggugcccaaggacagcacccaccaguggcuggacggcagcgacugcgugcugcaggcccccggcaacaccagcugccugcugcacuacaugccccaggcccccagcgccgagcccccccuggaguggcccuuccccgaccuguucagcgagccccugugcagaggccccauccugccccugcaggccaaccugaccagaaagggcggcuggcugcccaccggcagccccagcgugauccugcaggacagauacagcggcuaa

SEQ ID NO: 15623 - RNA, 1560 nt, Artificial Sequence
  CREB3L1__Homo_sapiens__NP_443086
auggacgccgugcuggagcccuuccccgccgacagacuguuccccggcagcagcuuccuggaccugggcgaccugaacgagagcgacuuccugaacaacgcccacuuccccgagcaccuggaccacuucaccgagaacauggaggacuucagcaacgaccuguucagcagcuucuucgacgaccccgugcuggacgagaagagcccccugcuggacauggagcuggacagccccacccccggcauccaggccgagcacagcuacagccugagcggcgacagcgccccccagagcccccuggugcccaucaagauggaggacaccacccaggacgccgagcacggcgccugggcccugggccacaagcugugcagcaucauggugaagcaggagcagagccccgagcugcccguggacccccuggccgcccccagcgccauggccgccgccgccgccauggccaccaccccccugcugggccugagcccccugagcagacugcccaucccccaccaggcccccggcgagaugacccagcugcccgugaucaaggccgagccccuggaggugaaccaguuccugaaggugacccccgaggaccuggugcagaugccccccaccccccccagcagccacggcagcgacagcgacggcagccagagccccagaagccugccccccagcagccccgugagacccauggccagaagcagcaccgccaucagcaccagcccccugcugaccgccccccacaagcugcagggcaccagcggcccccugcugcugaccgaggaggagaagagaacccugaucgccgagggcuaccccauccccaccaagcugccccugaccaaggccgaggagaaggcccugaagagagugagaagaaagaucaagaacaagaucagcgcccaggagagcagaagaaagaagaaggaguacguggagugccuggagaagaagguggagaccuucaccagcgagaacaacgagcuguggaagaagguggagacccuggagaacgccaacagaacccugcugcagcagcugcagaagcugcagacccuggugaccaacaagaucagcagacccuacaagauggccgccacccagaccggcaccugccugaugguggccgcccugugcuucgugcuggugcugggcagccuggugcccugccugcccgaguucagcagcggcagccagaccgugaaggaggacccccuggccgccgacggcguguacaccgccagccagaugcccagcagaagccugcuguucuacgacgacggcgccggccugugggaggacggcagaagcacccugcugcccauggagccccccgacggcugggagaucaaccccggcggccccgccgagcagagacccagagaccaccugcagcacgaccaccuggacagcacccacgagaccaccaaguaccugagcgaggccuggcccaaggacggcggcaacggcaccagccccgacuucagccacagcaaggagugguuccacgacagagaccugggccccaacaccaccaucaagcugagcuaa

SEQ ID NO: 15624 - RNA, 747 nt, Artificial Sequence
  CREB3L2__Homo_sapiens__NP_001240704
auggaggugcuggagagcggcgagcagggcgugcugcagugggacagaaagcugagcgagcugagcgagcccggcgacggcgaggcccugauguaccacacccacuucagcgagcugcuggacgaguucagccagaacgugcugggccagcugcugaacgaccccuuccugagcgagaagagcgugagcauggagguggagcccagccccaccagccccgccccccugauccaggccgagcacagcuacagccugugcgaggagcccagagcccagagccccuucacccacaucaccaccagcgacagcuucaacgacgacgagguggagagcgagaagugguaccugagcaccgacuuccccagcaccagcaucaagaccgagcccgugaccgacgagcccccccccggccuggugcccagcgugacccugaccaucaccgccaucagcaccccccuggagaaggaggagcccccccuggagaugaacaccggcguggacagcagcugccagaccaucauccccaagaucaagcuggagccccacgagguggaccaguuccugaacuucagccccaaggagggccugagcgcccugcccgugagccugugggugauggacauggugagcggcagcaccgagagagaguacggcgagagagccggcaugagccuguaccacagaugcugcagcuggcuguacgagaucgcccuguuccugaagaacaagaacuucgccagcaaguaa

SEQ ID NO: 15625 - RNA, 1383 nt, Artificial Sequence
  CREB3L3__Homo_sapiens__NP_001258924
augaacaccgaccuggccgccggcaagauggccagcgccgccugcagcauggaccccaucgacagcuucgagcugcuggaccugcuguucgacagacaggacggcauccugagacacguggagcugggcgagggcuggggccacgugaaggaccaggugcugcccaaccccgacagcgacgacuuccugagcagcauccugggcagcggcgacagccugcccagcagcccccuguggagccccgagggcagcgacagcggcaucagcgaggaccugcccagcgacccccaggacaccccccccagaagcggccccgccaccagccccgccggcugccaccccgcccagcccggcaagggccccugccugagcuaccaccccggcaacagcugcagcaccaccacccccggccccgugauccaggugcccgaggccagcgugaccaucgaccuggagauguggagccccggcggcagaaucugcgccgagaagcccgccgaccccguggaccugagccccagaugcaaccugaccgugaaggaccugcugcugagcggcagcagcggcgaccugcagcagcaccaccugggcgccagcuaccugcugagacccggcgccggccacugccaggagcuggugcugaccgaggacgagaagaagcugcuggccaaggagggcaucacccugcccacccagcugccccugaccaaguacgaggagagagugcugaagaagaucagaagaaagaucagaaacaagcagagcgcccaggagagcagaaagaagaagaaggaguacaucgacggccuggagaccagaaugagcgccugcaccgcccagaaccaggagcugcagagaaaggugcugcaccuggagaagcagaaccugagccugcuggagcagcugaagaagcugcaggccaucguggugcagagcaccagcaagagcgcccagaccggcaccugcguggccgugcugcugcugagcuucgcccugaucauccugcccagcaucagccccuucggccccaacaagaccgagagccccggcgacuucgcccccgugagaguguucagcagaacccugcacaacgacgccgccagcagaguggccgccgacgccgugcccggcagcgaggcccccggccccagacccgaggccgacaccaccagagaggagagccccggcagccccggcgccgacuggggcuuccaggacaccgccaaccugaccaacagcaccgaggagcuggacaacgccacccuggugcugagaaacgccaccgagggccugggccagguggcccugcuggacuggguggcccccggccccagcaccggcagcggcagagccggccuggaggccgccggcgacgagcuguaa

SEQ ID NO: 15626 - RNA, 1188 nt, Artificial Sequence
  CREB3L4__Homo_sapiens__NP_001242908
auggaccugggcauccccgaccugcuggacgccuggcuggagccccccgaggacaucuucagcaccggcagcgugcuggagcugggccugcacugccccccccccgaggugcccgugaccagacugcaggagcagggccugcagggcuggaagagcggcggcgacagaggcugcggccugcaggagagcgagcccgaggacuuccugaagcuguucaucgaccccaacgagguguacugcagcgaggccagccccggcagcgacagcggcaucagcgaggaccccugccaccccgacagcccccccgcccccagagccaccagcagccccaugcuguacgaggugguguacgaggccggcgcccuggagagaaugcagggcgagaccggccccaacgugggccugaucagcauccagcuggaccaguggagccccgccuucauggugcccgacagcugcauggugagcgagcugcccuucgacgcccacgcccacauccugcccagagccggcaccguggcccccgugcccugcaccacccugcugcccugccagacccuguuccugaccgacgaggagaagagacugcugggccaggagggcgugagccugcccagccaccugccccugaccaaggccgaggagagagugcugaagaaggugagaagaaagaucagaaacaagcagagcgcccaggacagcagaagaagaaagaaggaguacaucgacggccuggagagcagaguggccgccugcagcgcccagaaccaggagcugcagaagaaggugcaggagcuggagagacacaacaucagccugguggcccagcugagacagcugcagacccugaucgcccagaccagcaacaaggccgcccagaccagcaccugcgugcugauccugcuguucagccuggcccugaucauccugcccagcuucagccccuuccagagcagacccgaggccggcagcgaggacuaccagccccacggcgugaccagcagaaacauccugacccacaaggacgugaccgagaaccuggagacccaggugguggagagcagacugagagagccccccggcgccaaggacgccaacggcagcaccagaacccugcuggagaagaugggcggcaagcccagacccagcggcagaaucagaagcgugcugcacgccgacgagauguaa

SEQ ID NO: 15627 - RNA, 1110 nt, Artificial Sequence
  CREB5__Homo_sapiens__NP_001011666
auguucugcaccagcggcggcaacagcgccagcgugaugagcaugagacccgugcccggcagccugagcagccugcugcaccugcacaacagacagagacagcccaugcccgccagcaugcccggcacccugcccaaccccaccaugcccggcagcagcgccgugcugaugcccauggagagacagaugagcgugaacagcagcaucaugggcaugcagggccccaaccugagcaaccccugcgccagcccccaggugcagcccaugcacagcgaggccaagaugagacugaaggccgcccugacccaccaccccgccgccaugagcaacggcaacaugaacaccaugggccacaugauggagaugaugggcagcagacaggaccagaccccccaccaccacaugcacagccacccccaccagcaccagacccugcccccccaccaccccuacccccaccagcaccagcaccccgcccaccacccccacccccagccccaccaccagcagaaccacccccaccaccacagccacagccaccugcacgcccaccccgcccaccaccagaccagcccccaccccccccugcacaccggcaaccaggcccaggugagccccgccacccagcagaugcagcccacccagaccauccagcccccccagcccaccggcggcagaagaagaagagugguggacgaggaccccgacgagagaagaagaaaguuccuggagagaaacagagccgccgccaccagaugcagacagaagagaaaggugugggugaugagccuggagaagaaggccgaggagcugacccagaccaacaugcagcugcagaacgaggugagcaugcugaagaacgagguggcccagcugaagcagcugcugcugacccacaaggacugccccaucaccgccaugcagaaggagagccagggcuaccugagccccgagagcagcccccccgccagccccgugcccgccugcagccagcagcaggugauccagcacaacaccaucaccaccagcagcagcgugagcgagguggugggcagcagcacccugagccagcugaccacccacagaaccgaccugaaccccauccuguaa

SEQ ID NO: 15628 - RNA, 7215 nt, Artificial Sequence
  CREBBP__Homo_sapiens__NP_001073315
auggccgagaaccugcuggacggcccccccaaccccaagagagccaagcugagcagccccggcuucagcgccaacgacagcaccgacuucggcagccuguucgaccuggagaacgaccugcccgacgagcugauccccaacggcggcgagcugggccugcugaacagcggcaaccuggugcccgacgccgccagcaagcacaagcagcugagcgagcugcugagaggcggcagcggcagcagcaucaaccccggcaucggcaacgugagcgccagcagccccgugcagcagggccugggcggccaggcccagggccagcccaacagcgccaacauggccagccugagcgccaugggcaagagcccccugagccagggcgacagcagcgcccccagccugcccaagcaggccgccagcaccagcggccccacccccgccgccagccaggcccugaacccccaggcccagaagcaggugggccuggccaccagcagccccgccaccagccagaccggccccggcaucugcaugaacgccaacuucaaccagacccaccccggccugcugaacagcaacagcggccacagccugaucaaccaggccagccagggccaggcccaggugaugaacggcagccugggcgccgccggcagaggcagaggcgccggcaugcccuaccccacccccgccaugcagggcgccagcagcagcgugcuggccgagacccugacccaggugagcccccagaugaccggccacgccggccugaacaccgcccaggccggcggcauggccaagaugggcaucaccggcaacaccagccccuucggccagcccuucagccaggccggcggccagcccaugggcgccaccggcgugaacccccagcuggccagcaagcagagcauggugaacagccugcccaccuuccccaccgacaucaagaacaccagcgugaccaacgugcccaacaugagccagaugcagaccagcgugggcaucgugcccacccaggccaucgccaccggccccaccgccgaccccgagaagagaaagcugauccagcagcagcuggugcugcugcugcacgcccacaagugccagagaagagagcaggccaacggcgaggugagagccugcagccugccccacugcagaaccaugaagaacgugcugaaccacaugacccacugccaggccggcaaggccugccaggccauccugggcagccccgccagcggcauccagaacaccaucggcagcgugggcaccggccagcagaacgccaccagccugagcaaccccaaccccaucgaccccagcagcaugcagagagccuacgccgcccugggccugcccuacaugaaccagccccagacccagcugcagccccaggugcccggccagcagcccgcccagccccagacccaccagcagaugagaacccugaacccccugggcaacaaccccaugaacauccccgccggcggcaucaccaccgaccagcagccccccaaccugaucagcgagagcgcccugcccaccagccugggcgccaccaacccccugaugaacgacggcagcaacagcggcaacaucggcacccugagcaccauccccaccgccgccccccccagcagcaccggcgugagaaagggcuggcacgagcacgugacccaggaccugagaagccaccuggugcacaagcuggugcaggccaucuuccccacccccgaccccgccgcccugaaggacagaagaauggagaaccugguggccuacgccaagaagguggagggcgacauguacgagagcgccaacagcagagacgaguacuaccaccugcuggccgagaagaucuacaagauccagaaggagcuggaggagaagagaagaagcagacugcacaagcagggcauccugggcaaccagcccgcccugcccgcccccggcgcccagccccccgugaucccccaggcccagcccgugagaccccccaacggcccccugagccugcccgugaacagaaugcaggugagccagggcaugaacagcuucaaccccaugagccugggcaacgugcagcugccccaggcccccaugggccccagagccgccagccccaugaaccacagcgugcagaugaacagcaugggcagcgugcccggcauggccaucagccccagcagaaugccccagccccccaacaugaugggcgcccacaccaacaacaugauggcccaggcccccgcccagagccaguuccugccccagaaccaguuccccagcagcagcggcgccaugagcgugggcaugggccagccccccgcccagaccggcgugagccagggccaggugcccggcgccgcccugcccaacccccugaacaugcugggcccccaggccagccagcugcccugcccccccgugacccagagcccccugcaccccacccccccccccgccagcaccgccgccggcaugcccagccugcagcacaccaccccccccggcaugacccccccccagcccgccgcccccacccagcccagcacccccgugagcagcagcggccagacccccacccccacccccggcagcgugcccagcgccacccagacccagagcacccccaccgugcaggccgccgcccaggcccaggugaccccccagccccagacccccgugcagccccccagcguggccaccccccagagcagccagcagcagcccacccccgugcacgcccagccccccggcaccccccugagccaggccgccgccagcaucgacaacagagugcccacccccagcagcguggccagcgccgagaccaacagccagcagcccggccccgacgugcccgugcuggagaugaagaccgagacccaggccgaggacaccgagcccgaccccggcgagagcaagggcgagcccagaagcgagaugauggaggaggaccugcagggcgccagccaggugaaggaggagaccgacaucgccgagcagaagagcgagcccauggagguggacgagaagaagcccgaggugaagguggaggugaaggaggaggaggagagcagcagcaacggcaccgccagccagagcaccagccccagccagcccagaaagaagaucuucaagcccgaggagcugagacaggcccugaugcccacccuggaggcccuguacagacaggaccccgagagccugcccuucagacagcccguggacccccagcugcugggcauccccgacuacuucgacaucgugaagaaccccauggaccugagcaccaucaagagaaagcuggacaccggccaguaccaggagcccuggcaguacguggacgacguguggcugauguucaacaacgccuggcuguacaacagaaagaccagcagaguguacaaguucugcagcaagcuggccgagguguucgagcaggagaucgaccccgugaugcagagccugggcuacugcugcggcagaaaguacgaguucagcccccagacccugugcugcuacggcaagcagcugugcaccauccccagagacgccgccuacuacagcuaccagaacagauaccacuucugcgagaagugcuucaccgagauccagggcgagaacgugacccugggcgacgaccccagccagccccagaccaccaucagcaaggaccaguucgagaagaagaagaacgacacccuggaccccgagcccuucguggacugcaaggagugcggcagaaagaugcaccagaucugcgugcugcacuacgacaucaucuggcccagcggcuucgugugcgacaacugccugaagaagaccggcagacccagaaaggagaacaaguucagcgccaagagacugcagaccaccagacugggcaaccaccuggaggacagagugaacaaguuccugagaagacagaaccaccccgaggccggcgagguguucgugagagugguggccagcagcgacaagaccguggaggugaagcccggcaugaagagcagauucguggacagcggcgagaugagcgagagcuuccccuacagaaccaaggcccuguucgccuucgaggagaucgacggcguggacgugugcuucuucggcaugcacgugcaggaguacggcagcgacugccccccccccaacaccagaagaguguacaucagcuaccuggacagcauccacuucuucagacccagaugccugagaaccgccguguaccacgagauccugaucggcuaccuggaguacgugaagaagcugggcuacgugaccggccacaucugggccugcccccccagcgagggcgacgacuacaucuuccacugccacccccccgaccagaagauccccaagcccaagagacugcaggagugguacaagaagaugcuggacaaggccuucgccgagagaaucauccacgacuacaaggacaucuucaagcaggccaccgaggacagacugaccagcgccaaggagcugcccuacuucgagggcgacuucuggcccaacgugcuggaggagagcaucaaggagcuggagcaggaggaggaggagagaaagaaggaggagagcaccgccgccagcgagaccaccgagggcagccagggcgacagcaagaacgccaagaagaagaacaacaagaagaccaacaagaacaagagcagcaucagcagagccaacaagaagaagcccagcaugcccaacgugagcaacgaccugagccagaagcuguacgccaccauggagaagcacaaggagguguucuucgugauccaccugcacgccggccccgugaucaacacccugccccccaucguggaccccgacccccugcugagcugcgaccugauggacggcagagacgccuuccugacccuggccagagacaagcacugggaguucagcagccugagaagaagcaaguggagcacccugugcaugcugguggagcugcacacccagggccaggacagauucguguacaccugcaacgagugcaagcaccacguggagaccagauggcacugcaccgugugcgaggacuacgaccugugcaucaacugcuacaacaccaagagccacgcccacaagauggugaaguggggccugggccuggacgacgagggcagcagccagggcgagccccagagcaagagcccccaggagagcagaagacugagcauccagagaugcauccagagccuggugcacgccugccagugcagaaacgccaacugcagccugcccagcugccagaagaugaagagaguggugcagcacaccaagggcugcaagagaaagaccaacggcggcugccccgugugcaagcagcugaucgcccugugcugcuaccacgccaagcacugccaggagaacaagugccccgugcccuucugccugaacaucaagcacaagcugagacagcagcagauccagcacagacugcagcaggcccagcugaugagaagaagaauggccaccaugaacaccagaaacgugccccagcagagccugcccagccccaccagcgccccccccggcacccccacccagcagcccagcaccccccagaccccccagccccccgcccagccccagcccagccccgugagcaugagccccgccggcuuccccagcguggccagaacccagccccccaccaccgugagcaccggcaagcccaccagccaggugcccgccccccccccccccgcccagcccccccccgccgccguggaggccgccagacagaucgagagagaggcccagcagcagcagcaccuguacagagugaacaucaacaacagcaugccccccggcagaaccggcaugggcacccccggcagccagauggcccccgugagccugaacgugcccagacccaaccaggugagcggccccgugaugcccagcaugccccccggccaguggcagcaggccccccugccccagcagcagcccaugcccggccugcccagacccgugaucagcaugcaggcccaggccgccguggccggccccagaaugcccagcgugcagccccccagaagcaucagccccagcgcccugcaggaccugcugagaacccugaagagccccagcagcccccagcagcagcagcaggugcugaacauccugaagagcaacccccagcugauggccgccuucaucaagcagagaaccgccaaguacguggccaaccagcccggcaugcagccccagcccggccugcagagccagcccggcaugcagccccagcccggcaugcaccagcagcccagccugcagaaccugaacgccaugcaggccggcgugcccagacccggcgugcccccccagcagcaggccaugggcggccugaacccccagggccaggcccugaacaucaugaaccccggccacaaccccaacauggccagcaugaacccccaguacagagagaugcugagaagacagcugcugcagcagcagcagcagcagcagcagcagcagcagcagcagcagcagcagcagcagggcagcgccggcauggccggcggcauggccggccacggccaguuccagcagccccagggccccggcggcuacccccccgccaugcagcagcagcagagaaugcagcagcaccugccccugcagggcagcagcaugggccagauggccgcccagaugggccagcugggccagaugggccagcccggccugggcgccgacagcacccccaacauccagcaggcccugcagcagagaauccugcagcagcagcagaugaagcagcagaucggcagccccggccagcccaaccccaugagcccccagcagcacaugcugagcggccagccccaggccagccaccugcccggccagcagaucgccaccagccugagcaaccaggugagaagccccgcccccgugcagagccccagaccccagagccagcccccccacagcagccccagccccagaauccagccccagcccagcccccaccacgugagcccccagaccggcagcccccaccccggccuggccgugaccauggccagcagcaucgaccagggccaccugggcaaccccgagcagagcgccaugcugccccagcugaacacccccagcagaagcgcccugagcagcgagcugagccuggugggcgacaccaccggcgacacccuggagaaguucguggagggccuguaa

SEQ ID NO: 15629 - RNA, 1254 nt, Artificial Sequence
  CREBRF__Homo_sapiens__NP_001161865
augccccagcccagcgugagcggcauggacccccccuucggcgacgccuucagaagccacaccuucagcgagcagacccugaugagcaccgaccugcuggccaacagcagcgaccccgacuucauguacgagcuggacagagagaugaacuaccagcagaaccccagagacaacuuccugagccuggaggacugcaaggacaucgagaaccuggagagcuucaccgacgugcuggacaacgagggcgcccugaccagcaacugggagcagugggacaccuacugcgaggaccugaccaaguacaccaagcugaccagcugcgacaucuggggcaccaaggagguggacuaccugggccuggacgacuucagcagccccuaccaggacgaggaggugaucagcaagacccccacccuggcccagcugaacagcgaggacagccagagcgugagcgacagccuguacuaccccgacagccuguucagcgugaagcagaacccccugcccagcagcuuccccggcaagaagaucaccagcagagccgccgcccccgugugcagcagcaagacccugcaggccgaggugccccugagcgacugcgugcagaaggccagcaagcccaccagcagcacccagaucauggugaagaccaacauguaccacaacgagaaggugaacuuccacguggagugcaaggacuacgugaagaaggccaaggugaagaucaaccccgugcagcagagcagaccccugcugagccagauccacaccgacgccgccaaggagaacaccugcuacugcggcgccguggccaagagacaggagaagaagggcauggagccccugcagggccacgccacccccgcccugcccuucaaggagacccaggagcugcugcugagcccccugccccaggagggccccggcagccuggccgccggcgagagcagcagccugagcgccagcaccagcgugagcgacagcagccagaagaaggaggagcacaacuacagccuguucgugagcgacaaccugggcgagcagcccaccaagugcagccccgaggaggacgaggaggacgaggaggacguggacgacgaggaccacgacgagggcuucggcagcgagcacgagcugagcgagaacgaggaggaggaggaggaggaggaggacuacgaggacgacaaggacgacgacaucagcgacaccuucagcgagcccggcaucaucaugcuggccagccugcccgacuaa

SEQ ID NO: 15630 - RNA, 1065 nt, Artificial Sequence
  CREBZF__Homo_sapiens__NP_001034707
augagacacagccugaccaagcugcuggccgccagcggcagcaacagccccaccagaagcgagagccccgagcccgccgccaccugcagccugcccagcgaccugaccagagccgccgccggcgaggaggagaccgccgccgccggcagccccggcagaaagcagcaguucggcgacgagggcgagcuggaggccggcagaggcagcagaggcggcguggccgugagagcccccagccccgaggagauggaggaggaggccaucgccagccugcccggcgaggagaccgaggacauggacuuccugagcggccuggagcuggccgaccugcuggaccccagacagcccgacuggcaccuggaccccggccugagcagccccggcccccugagcagcagcggcggcggcagcgacagcggcggccuguggagaggcgacgacgacgacgaggccgccgccgccgagaugcagagauucagcgaccugcugcagagacugcugaacggcaucggcggcugcagcagcagcagcgacagcggcagcgccgagaagagaagaagaaagagccccggcggcggcggcggcggcggcagcggcaacgacaacaaccaggccgccaccaagagccccagaaaggccgccgccgccgccgccagacugaacagacugaagaagaaggaguacgugaugggccuggagagcagagugagaggccuggccgccgagaaccaggagcugagagccgagaacagagagcugggcaagagagugcaggcccugcaggaggagagcagauaccugagagccgugcuggccaacgagaccggccuggccagacugcugagcagacugagcggcgugggccugagacugaccaccagccuguucagagacagccccgccggcgaccacgacuacgcccugcccgugggcaagcagaagcaggaccugcuggaggaggacgacagcgccggcggcgugugccugcacguggacaaggacaaggugagcguggaguucugcagcgccugcgccagaaaggccagcagcagccugaagauguaa

SEQ ID NO: 15631 - RNA, 663 nt, Artificial Sequence
  CREG1__Homo_sapiens__NP_003842
auggccggccugagcagaggcagcgccagagcccugcuggccgcccugcuggccagcacccugcuggcccugcuggugagccccgccagaggcagaggcggcagagaccacggcgacugggacgaggccagcagacugcccccccugccccccagagaggacgccgccagaguggccagauucgugacccacgugagcgacuggggcgcccuggccaccaucagcacccuggaggccgugagaggcagacccuucgccgacgugcugagccugagcgacggcccccccggcgccggcagcggcgugcccuacuucuaccugagcccccugcagcugagcgugagcaaccugcaggagaaccccuacgccacccugaccaugacccuggcccagaccaacuucugcaagaagcacggcuucgacccccagagcccccugugcgugcacaucaugcugagcggcaccgugaccaaggugaacgagaccgagauggacaucgccaagcacagccuguucaucagacaccccgagaugaagaccuggcccagcagccacaacugguucuucgccaagcugaacaucaccaacaucugggugcuggacuacuucggcggccccaagaucgugacccccgaggaguacuacaacgugaccgugcaguaa

SEQ ID NO: 15632 - RNA, 1269 nt, Artificial Sequence
  CRELD1__Homo_sapiens__NP_001026887
auggcccccuggccccccaagggccuggugcccgccgugcuguggggccugagccuguuccugaaccugcccggccccaucuggcugcagcccagcccccccccccagagcagcccccccccccagccccaccccugccacaccugcagaggccugguggacagcuucaacaagggccuggagagaaccaucagagacaacuucggcggcggcaacaccgccugggaggaggagaaccugagcaaguacaaggacagcgagaccagacugguggaggugcuggagggcgugugcagcaagagcgacuucgagugccacagacugcuggagcugagcgaggagcugguggagagcuggugguuccacaagcagcaggaggcccccgaccuguuccaguggcugugcagcgacagccugaagcugugcugccccgccggcaccuucggccccagcugccugcccugccccggcggcaccgagagacccugcggcggcuacggccagugcgagggcgagggcaccagaggcggcagcggccacugcgacugccaggccggcuacggcggcgaggccugcggccagugcggccugggcuacuucgaggccgagagaaacgccagccaccuggugugcagcgccugcuucggccccugcgccagaugcagcggccccgaggagagcaacugccugcagugcaagaagggcugggcccugcaccaccugaagugcguggacaucgacgagugcggcaccgagggcgccaacugcggcgccgaccaguucugcgugaacaccgagggcagcuacgagugcagagacugcgccaaggccugccugggcugcaugggcgccggccccggcagaugcaagaagugcagccccggcuaccagcaggugggcagcaagugccuggacguggacgagugcgagaccgaggugugccccggcgagaacaagcagugcgagaacaccgagggcggcuacagaugcaucugcgccgagggcuacaagcagauggagggcaucugcgugaaggagcagauccccggcgccuuccccauccugaccgaccugacccccgagaccaccagaagauggaagcugggcagccacccccacagcaccuacgugaagaugaagaugcagagagacgaggccaccuuccccggccuguacggcaagcagguggccaagcugggcagccagagcagacagagcgacagaggcaccagacugauccacagccagcaggccagcagccagagauaa

SEQ ID NO: 15633 - RNA, 1209 nt, Artificial Sequence
  CRELD2__Homo_sapiens__NP_001128573
augagacugcccagaagagccgcccugggccugcugccccugcugcugcugcugccccccgcccccgaggccgccaagaagcccacccccugccacagaugcagaggccugguggacaaguucaaccagggcaugguggacaccgccaagaagaacuucggcggcggcaacaccgccugggaggagaagacccugagcaaguacgagagcagcgagaucagacugcuggagauccuggagggccugugcgagagcagcgacuucgagugcaaccagaugcuggaggcccaggaggagcaccuggaggccugguggcugcagcugaagagcgaguaccccgaccuguucgagugguucugcgugaagacccugaaggugugcugcagccccggcaccuacggccccgacugccuggccugccagggcggcagccagagacccugcagcggcaacggccacugcagcggcgacggcagcagacagggcgacggcagcugcagaugccacaugggcuaccagggcccccugugcaccgacugcauggacggcuacuucagcagccugagaaacgagacccacagcaucugcaccgugagaaccggccugagcgacagcuacccccccugcugccugagccugggcugcuggagaggcgugggccacgccuggaucagaggcagaaacacccacacccagcccggcuacagcagcagaguguggaucgccgccuucagccccgccugcgacgagagcugcaagaccugcagcggccugaccaacagagacugcggcgagugcgaggugggcugggugcuggacgagggcgccugcguggacguggacgagugcgccgccgagcccccccccugcagcgccgcccaguucugcaagaacgccaacggcagcuacaccugcgaggagugcgacagcagcugcgugggcugcaccggcgagggccccggcaacugcaaggagugcaucagcggcuacgccagagagcacggccagugcgccgacguggacgagugcagccuggccgagaagaccugcgugagaaagaacgagaacugcuacaacacccccggcagcuacgugugcgugugccccgacggcuucgaggagaccgaggacgccugcgugccccccgccgaggccgaggccaccgagggcgagagccccacccagcugcccagcagagaggaccuguaa

SEQ ID NO: 15634 - RNA, 540 nt, Artificial Sequence
  CREM__Homo_sapiens__NP_001254491
auggccgugcccaccagcaucuaccagaccagcaccggccaguacaucgccaucgcccagggcggcaccauccagaucagcaaccccggcagcgacggcgugcagggccugcaggcccugaccaugaccaacagcggcgcccccccccccggcgccaccaucgugcaguacgccgcccagagcgccgacggcacccagcaguucuucgugcccggcagccaggugguggugcaggccgccaccggcgacaugcccaccuaccagaucagagcccccaccgccgcccugccccagggcguggugauggccgccagccccggcagccugcacagcccccagcagcuggccgaggaggccaccagaaagagagagcugagacugaugaagaacagagaggccgccaaggagugcagaagaagaaagaaggaguacgugaagugccuggagagcagaguggccgugcuggaggugcagaacaagaagcugaucgaggagcuggagacccugaaggacaucugcagccccaagaccgacuacuaa

SEQ ID NO: 15635 - RNA, 969 nt, Artificial Sequence
  CRHBP__Homo_sapiens__NP_001873
augagccccaacuucaagcugcagugccacuucauccugaucuuccugaccgcccugagaggcgagagcagauaccuggagcugagagaggccgccgacuacgaccccuuccugcuguucagcgccaaccugaagagagagcuggccggcgagcagcccuacagaagagcccugagaugccuggacaugcugagccugcagggccaguucaccuucaccgccgacagaccccagcugcacugcgccgccuucuucaucagcgagcccgaggaguucaucaccauccacuacgaccaggugagcaucgacugccagggcggcgacuuccugaagguguucgacggcuggauccugaagggcgagaaguuccccagcagccaggaccacccccugcccagcgccgagagauacaucgacuucugcgagagcggccugagcagaagaagcaucagaagcagccagaacguggccaugaucuucuucagagugcacgagcccggcaacggcuucacccugaccaucaagaccgaccccaaccuguuccccugcaacgugaucagccagacccccaacggcaaguucacccugguggugccccaccagcacagaaacugcagcuucagcaucaucuaccccguggugaucaagaucagcgaccugacccugggccacgugaacggccugcagcugaagaagagcagcgccggcugcgagggcaucggcgacuucguggagcugcugggcggcaccggccuggaccccagcaagaugaccccccuggccgaccugugcuaccccuuccacggccccgcccagaugaaggugggcugcgacaacaccguggugagaauggugagcagcggcaagcacgugaacagagugaccuucgaguacagacagcuggagcccuacgagcuggagaaccccaacggcaacagcaucggcgaguucugccugagcggccuguaa

SEQ ID NO: 15636 - RNA, 591 nt, Artificial Sequence
  CRH__Homo_sapiens__NP_000747
augagacugccccugcuggugagcgccggcgugcugcugguggcccugcugcccugcccccccugcagagcccugcugagcagaggccccgugcccggcgccagacaggccccccagcacccccagccccuggacuucuuccagccccccccccagagcgagcagccccagcagccccaggccagacccgugcugcugagaaugggcgaggaguacuuccugagacugggcaaccugaacaagagccccgccgccccccugagccccgccagcagccugcuggccggcggcagcggcagcagacccagccccgagcaggccaccgccaacuucuucagagugcugcugcagcagcugcugcugcccagaagaagccuggacagccccgccgcccuggccgagagaggcgccagaaacgcccugggcggccaccaggaggcccccgagagagagagaagaagcgaggagccccccaucagccuggaccugaccuuccaccugcugagagaggugcuggagauggccagagccgagcagcuggcccagcaggcccacagcaacagaaagcugauggagaucaucggcaaguaa

SEQ ID NO: 15637 - RNA, 1335 nt, Artificial Sequence
  CRHR1__Homo_sapiens__NP_001138618
augggcggccacccccagcugagacuggugaaggcccugcugcugcugggccugaaccccgugagcgccagccugcaggaccagcacugcgagagccugagccuggccagcaacaucagcggccugcagugcaacgccagcguggaccugaucggcaccugcuggcccagaagccccgccggccagcugguggugagacccugccccgccuucuucuacggcgugagauacaacaccaccaacaacggcuacagagagugccuggccaacggcagcugggccgccagagugaacuacagcgagugccaggagauccugaacgaggagaagaagagcaaggugcacuaccacguggccgugaucaucaacuaccugggccacugcaucagccugguggcccugcugguggccuucgugcuguuccugagacugagacccggcugcacccacuggggcgaccaggccgacggcgcccuggaggugggcgcccccuggagcggcgcccccuuccaggugagaagaagcaucagaugccugagaaacaucauccacuggaaccugaucagcgccuucauccugagaaacgccaccugguucguggugcagcugaccaugagccccgaggugcaccagagcaacgugggcuggugcagacuggugaccgccgccuacaacuacuuccacgugaccaacuucuucuggauguucggcgagggcugcuaccugcacaccgccaucgugcugaccuacagcaccgacagacugagaaaguggauguucaucugcaucggcuggggcgugcccuuccccaucaucguggccugggccaucggcaagcuguacuacgacaacgagaagugcugguucggcaagagacccggcguguacaccgacuacaucuaccagggccccaugauccuggugcugcugaucaacuucaucuuccuguucaacaucgugagaauccugaugaccaagcugagagccagcaccaccagcgagaccauccaguacagaaaggccgugaaggccacccuggugcugcugccccugcugggcaucaccuacaugcuguucuucgugaaccccggcgaggacgaggugagcagagugguguucaucuacuucaacagcuuccuggagagcuuccagggcuucuucgugagcguguucuacugcuuccugaacagcgaggugagaagcgccaucagaaagagauggcacagauggcaggacaagcacagcaucagagccagaguggccagagccaugagcauccccaccagccccaccagagugagcuuccacagcaucaagcagagcaccgccguguaa

SEQ ID NO: 15638 - RNA, 1317 nt, Artificial Sequence
  CRHR2__Homo_sapiens__NP_001189404
augagaggccccagcggcccccccggccugcuguacgugccccaccugcugcugugccugcugugccugcugccccccccccugcaguacgccgccggccagagccagaugcccaaggaccagccccugugggcccugcuggagcaguacugccacaccaucaugacccugaccaaccugagcggccccuacagcuacugcaacaccacccuggaccagaucggcaccugcuggcccagaagcgccgccggcgcccugguggagagacccugccccgaguacuucaacggcgugaaguacaacaccaccagaaacgccuacagagagugccuggagaacggcaccugggccagcaagaucaacuacagccagugcgagcccauccuggacgacaagcagagaaaguacgaccugcacuacagaaucgcccugguggugaacuaccugggccacugcgugagcguggccgcccugguggccgccuuccugcuguuccuggcccugagaagcaucagaugccugagaaacgugauccacuggaaccugaucaccaccuucauccugagaaacgugaugugguuccugcugcagcugguggaccacgaggugcacgagagcaacgagguguggugcagaugcaucaccaccaucuucaacuacuucguggugaccaacuucuucuggauguucguggagggcugcuaccugcacaccgccaucgugaugaccuacagcaccgagagacugagaaagugccuguuccuguucaucggcuggugcauccccuuccccaucaucguggccugggccaucggcaagcuguacuacgagaacgagcagugcugguucggcaaggagcccggcgaccugguggacuacaucuaccagggccccaucauccuggugcugcugaucaacuucguguuccuguucaacaucgugagaauccugaugaccaagcugagagccagcaccaccagcgagaccauccaguacagaaaggccgugaaggccacccuggugcugcugccccugcugggcaucaccuacaugcuguucuucgugaaccccggcgaggacgaccugagccagaucauguucaucuacuucaacagcuuccugcagagcuuccagggcuucuucgugagcguguucuacugcuucuucaacggcgaggugagaagcgccgugagaaagagauggcacagauggcaggaccaccacagccugagagugcccauggccagagccaugagcauccccaccagccccaccagaaucagcuuccacagcaucaagcagaccgccgccguguaa

SEQ ID NO: 15639 - RNA, 3111 nt, Artificial Sequence
  CRIM1__Homo_sapiens__NP_057525
auguaccugguggccggcgacagaggccuggccggcugcggccaccugcuggugagccugcugggccugcugcugcugcuggccagaagcggcaccagagcccuggugugccugcccugcgacgagagcaagugcgaggagcccagaaacugccccggcagcaucgugcagggcgugugcggcugcugcuacaccugcgccagccagagaaacgagagcugcggcggcaccuucggcaucuacggcaccugcgacagaggccugagaugcgugaucagacccccccugaacggcgacagccugaccgaguacgaggccggcgugugcgaggacgagaacuggaccgacgaccagcugcugggcuucaagcccugcaacgagaaccugaucgccggcugcaacaucaucaacggcaagugcgagugcaacaccaucagaaccugcagcaaccccuucgaguuccccagccaggacaugugccugagcgcccugaagagaaucgaggaggagaagcccgacugcagcaaggccagaugcgaggugcaguucagccccagaugccccgaggacagcgugcugaucgagggcuacgccccccccggcgagugcugcccccugcccagcagaugcgugugcaaccccgccggcugccugagaaaggugugccagcccggcaaccugaacauccuggugagcaaggccagcggcaagcccggcgagugcugcgaccuguacgagugcaagcccguguucggcguggacugcagaaccguggagugcccccccgugcagcagaccgccugcccccccgacagcuacgagacccaggugagacugaccgccgacggcugcugcacccugcccaccagaugcgagugccugagcggccugugcggcuuccccgugugcgaggugggcagcacccccagaaucgugagcagaggcgacggcacccccggcaagugcugcgacguguucgagugcgugaacgacaccaagcccgccugcguguucaacaacguggaguacuacgacggcgacauguucagaauggacaacugcagauucugcagaugccagggcggcguggccaucugcuucaccgcccagugcggcgagaucaacugcgagagauacuacgugcccgagggcgagugcugccccgugugcgaggaccccguguaccccuucaacaaccccgccggcugcuacgccaacggccugauccuggcccacggcgacagauggagagaggacgacugcaccuucugccagugcgugaacggcgagagacacugcguggccaccgugugcggccagaccugcaccaaccccgugaaggugcccggcgagugcugccccgugugcgaggagcccaccaucaucaccguggacccccccgccugcggcgagcugagcaacugcacccugaccggcaaggacugcaucaacggcuucaagagagaccacaacggcugcagaaccugccagugcaucaacaccgaggagcugugcagcgagagaaagcagggcugcacccugaacugccccuucggcuuccugaccgacgcccagaacugcgagaucugcgagugcagacccagacccaagaagugcagacccaucaucugcgacaaguacugcccccugggccugcugaagaacaagcacggcugcgacaucugcagaugcaagaagugccccgagcugagcugcagcaagaucugcccccugggcuuccagcaggacagccacggcugccugaucugcaagugcagagaggccagcgccagcgccggcccccccauccugagcggcaccugccugaccguggacggccaccaccacaagaacgaggagagcuggcacgacggcugcagagagugcuacugccugaacggcagagagaugugcgcccugaucaccugccccgugcccgccugcggcaaccccaccauccaccccggccagugcugccccagcugcgccgacgacuucguggugcagaagcccgagcugagcacccccagcaucugccacgcccccggcggcgaguacuucguggagggcgagaccuggaacaucgacagcugcacccagugcaccugccacagcggcagagugcugugcgagaccgaggugugccccccccugcugugccagaaccccagcagaacccaggacagcugcugcccccagugcaccgaccagcccuucagacccagccugagcagaaacaacagcgugcccaacuacugcaagaacgacgagggcgacaucuuccuggccgccgagagcuggaagcccgacgugugcaccagcugcaucugcaucgacagcgugaucagcugcuucagcgagagcugccccagcgugagcugcgagagacccgugcugagaaagggccagugcugccccuacugcaucgaggacaccauccccaagaagguggugugccacuucagcggcaaggccuacgccgacgaggagagaugggaccuggacagcugcacccacugcuacugccugcagggccagacccugugcagcaccgugagcugccccccccugcccugcguggagcccaucaacguggagggcagcugcugccccaugugccccgagauguacgugcccgagcccaccaacauccccaucgagaagaccaaccacagaggcgagguggaccuggaggugccccuguggcccacccccagcgagaacgacaucgugcaccugcccagagacaugggccaccugcagguggacuacagagacaacagacugcaccccagcgaggacagcagccuggacagcaucgccagcgugguggugcccaucaucaucugccugagcaucaucaucgccuuccuguucaucaaccagaagaagcaguggaucccccugcugugcugguacagaacccccaccaagcccagcagccugaacaaccagcuggugagcguggacugcaagaagggcaccagagugcagguggacagcagccagagaaugcugagaaucgccgagcccgacgccagauucagcggcuucuacagcaugcagaagcagaaccaccugcaggccgacaacuucuaccagaccguguaa

SEQ ID NO: 15640 - RNA, 849 nt, Artificial Sequence
  CRIP2__Homo_sapiens__NP_001257766
augcccccccaccaccugcugcccuggcuggcccaggugcccagcgccgagggcgagcuggugagacuggugagcagagccggcggcagaggcgccugcuucuggcccgccgugaccauggagauggccguggccgccggcugcgugugcaagggcggcggcugcugccacagagagcccagccaggaccaccacgagagccaggagcacagaggcccccuggugggcagccagaccugccuggugcaccaggccgagggcaccgccgagaaggugagcagccugggcaaggacuggcacaaguucugccugaagugcgagagaugcagcaagacccugacccccggcggccacgccgagcacgacggcaagcccuucugccacaagcccugcuacgccacccuguucggccccaagggcgugaacaucggcggcgccggcagcuacaucuacgagaagccccuggccgagggcccccaggugaccggccccaucgaggugcccgccgccagagccgaggagagaaaggccagcggcccccccaagggccccagcagagccagcagcgugaccaccuucaccggcgagcccaacaccugccccagaugcagcaagaagguguacuucgccgagaaggugaccagccugggcaaggacuggcacagacccugccugagaugcgagagaugcggcaagacccugacccccggcggccacgccgagcacgacggccagcccuacugccacaagcccugcuacggcauccuguucggccccaagggcgugaacaccggcgccgugggcagcuacaucuacgacagagaccccgagggcaaggugcagcccuaa

SEQ ID NO: 15641 - RNA, 615 nt, Artificial Sequence
  CRIP3__Homo_sapiens__NP_996805
augagcuggaccugccccagaugccagcagcccguguucuucgccgagaaggugagcagccugggcaagaacuggcacagauucugccugaagugcgagagaugccacagcauccugagccccggcggccacgccgagcacaacggcagacccuacugccacaagcccugcuacggcgcccuguucggccccagaggcgugaacaucggcggcgugggcagcuaccuguacaacccccccacccccagccccggcugcaccaccccccugagccccagcagcuucagcccccccagacccagaaccggccugccccagggcaagaagagccccccccacaugaagaccuucaccggcgagaccagccugugccccggcugcggcgagcccguguacuucgccgagaaggugaugagccugggcagaaacuggcacagacccugccugagaugccagagaugccacaagacccugaccgccggcagccacgccgagcacgacggcgugcccuacugccacgugcccugcuacggcuaccuguucggccccaagggcgugaacaucggcgacgugggcugcuacaucuacgaccccgugaagaucaaguucaaguaa

SEQ ID NO: 15642 - RNA, 1341 nt, Artificial Sequence
  CRIPAK__Homo_sapiens__NP_787114
augcacgagcccagccugugcgccaacguggagugcccccccgcccacaccugccccugcggcgugcccgccugcagcugcgcccacguggagugcccccccgcccacaccugcagaugcggcgugcccgccugcagccacaugcccauguggagcgccagacugcugaccagagcccacguggagugcccccccgcccacaccagagugcacguggagugcccccccgcccacgugcccauguggagcgcccaccugcugaccugcgccgacguggagugccaccugcugacccacgugcccauguggagcgccagacugcugaccugccccugcggcgugcccgccugcagccacgugcccaugagaagcgccagacugcugaccagagcccacgccgagugcccccccgcccacaccugccccugcggcgugcccgccugcagccacgugcccaugagaagcgccagacugcugaccagagccgacguggagugcccccccgcccacaccugccccugcggcgugcccgccugcagccacgugcccaccuggagcgccagacugaucaccagagcccacguggagugcagccccgcccacaccugcagaugcggcgugcccgccugcagccacgugcccauguggagcgugagacugcugaccagagccgacgccgagugcccccccgcccacaccugcagaugcggcgugcccgccugcagccacgugcccauguggagcgccagacugcugaccugcagaugcggcgugcccgccugcagccacgugcccauguggagcgccagacugcugaccugcagaugcggcgugcccgccugcagccacgugcccauguggagcgccagacugcugaccagagcccacguggagugcccccccgcccacaccugcagaagaggcgugcccgccugcagcagagcccacauggagugcccccccgcccacaccugccacugcggcgugcccgccugcagccacaccugcagaugcggcgugcccgccugcagccacgugcccauguggagcgccagacugcugaccagagcccacguggagugcccccccgcccacaccagagcccacguggagugcccccccgcccacaccugccccugcggcgugcccgccugcagccacaccugccccugcggcgugcccgccugcagccacaaggcccuggccuggugguucugcagauuccccgugcugcccgccgagagcgacgccgugaccgugcacagcacccacggcggcuuccugaucagauucuacgugaaggaccccuucuacaucagccugcaccuggagaucaccuaa

SEQ ID NO: 15643 - RNA, 306 nt, Artificial Sequence
  CRIPT__Homo_sapiens__NP_054890
auggugugcgagaagugcgagaagaagcugggcaccgugaucacccccgacaccuggaaggacggcgccagaaacaccaccgagagcggcggcagaaagcugaacgagaacaaggcccugaccagcaagaaggccagauucgaccccuacggcaagaacaaguucagcaccugcagaaucugcaagagcagcgugcaccagcccggcagccacuacugccagggcugcgccuacaagaagggcaucugcgccaugugcggcaagaaggugcuggacaccaagaacuacaagcagaccagcguguaa

SEQ ID NO: 15644 - RNA, 750 nt, Artificial Sequence
  CRISP1__Homo_sapiens__NP_001122
auggagaucaagcaccugcuguuccugguggccgccgccugccugcugcccaugcugagcaugaagaagaagagcgccagagaccaguucaacaagcuggugaccgaccugcccaacgugcaggaggagaucgugaacauccacaacgcccugagaagaagaguggugccccccgccagcaacaugcugaagaugagcuggagcgaggaggccgcccagaacgccagaaucuucagcaaguacugcgacaugaccgagagcaacccccuggagagaagacugcccaacaccuucugcggcgagaacaugcacaugaccagcuaccccgugagcuggagcagcgugaucggcgugugguacagcgagagcaccagcuucaagcacggcgaguggaccaccaccgacgacgacaucaccaccgaccacuacacccagaucgugugggccaccagcuaccugaucggcugcgccaucgccagcugcagacagcagggcagccccagauaccuguacgugugccacuacugccacgagggcaacgaccccgagaccaagaacgagcccuacaagaccggcgugcccugcgaggccugccccagcaacugcgaggacaagcugugcaccaaccccugcaucuacuacgacgaguacuucgacugcgacauccaggugcacuaccugggcugcaaccacagcaccaccauccuguucugcaaggccaccugccugugcgacaccgagaucaaguaa

SEQ ID NO: 15645 - RNA, 732 nt, Artificial Sequence
  CRISP2__Homo_sapiens__NP_001135879
auggcccugcugcccgugcuguuccuggugaccgugcugcugcccagccugcccgccgagggcaaggaccccgccuucaccgcccugcugaccacccagcugcaggugcagagagagaucgugaacaagcacaacgagcugagaaaggccgugagcccccccgccagcaacaugcugaagauggaguggagcagagaggugaccaccaacgcccagagaugggccaacaagugcacccugcagcacagcgaccccgaggacagaaagaccagcaccagaugcggcgagaaccuguacaugagcagcgaccccaccagcuggagcagcgccauccagagcugguacgacgagauccuggacuucguguacggcgugggccccaagagccccaacgccguggugggccacuacacccagcuggugugguacagcaccuaccaggugggcugcggcaucgccuacugccccaaccaggacagccugaaguacuacuacgugugccaguacugccccgccggcaacaacaugaacagaaagaacacccccuaccagcagggcacccccugcgccggcugccccgacgacugcgacaagggccugugcaccaacagcugccaguaccaggaccugcugagcaacugcgacagccugaagaacaccgccggcugcgagcacgagcugcugaaggagaagugcaaggccaccugccugugcgagaacaagaucuacuaa

SEQ ID NO: 15646 - RNA, 807 nt, Artificial Sequence
  CRISP3__Homo_sapiens__NP_001177915
augaagcagauccugcaccccgcccuggagaccaccgaccccugcagcaccggcuucguguuccccgccaugacccuguuccccgugcugcuguuccugguggccggccugcugcccagcuuccccgccaacgaggacaaggaccccgccuucaccgcccugcugaccacccagacccaggugcagagagagaucgugaacaagcacaacgagcugagaagagccgugagcccccccgccagaaacaugcugaagauggaguggaacaaggaggccgccgccaacgcccagaagugggccaaccagugcaacuacagacacagcaaccccaaggacagaaugaccagccugaagugcggcgagaaccuguacaugagcagcgccagcagcagcuggagccaggccauccagagcugguucgacgaguacaacgacuucgacuucggcgugggccccaagacccccaacgccguggugggccacuacacccagguggugugguacagcagcuaccuggugggcugcggcaacgccuacugccccaaccagaaggugcugaaguacuacuacgugugccaguacugccccgccggcaacugggccaacagacuguacgugcccuacgagcagggcgcccccugcgccagcugccccgacaacugcgacgacggccugugcaccaacggcugcaaguacgaggaccuguacagcaacugcaagagccugaagcugacccugaccugcaagcaccagcuggugagagacagcugcaaggccagcugcaacugcagcaacagcaucuacuaa

SEQ ID NO: 15647 - RNA, 939 nt, Artificial Sequence
  CRISPLD1__Homo_sapiens__NP_001273707
augaacaucuggggccagaucuggcccaaggccguguaccuggugugcaacuacagccccaagggcaacugguggggccacgcccccuacaagcacggcagacccugcagcgccugcccccccagcuucggcggcggcugcagagagaaccugugcuacaaggagggcagcgacagauacuacccccccagagaggaggagaccaacgagaucgagagacagcagagccaggugcacgacacccacgugagaaccagaagcgacgacagcagcagaaacgaggugaucagcgcccagcagaugagccagaucgugagcugcgaggugagacugagagaccagugcaagggcaccaccugcaacagauacgagugccccgccggcugccuggacagcaaggccaaggugaucggcagcgugcacuacgagaugcagagcagcaucugcagagccgccauccacuacggcaucaucgacaacgacggcggcuggguggacaucaccagacagggcagaaagcacuacuucaucaagagcaacagaaacggcauccagaccaucggcaaguaccagagcgccaacagcuucaccgugagcaaggugaccgugcaggccgugaccugcgagaccaccguggagcagcugugccccuuccacaagcccgccagccacugccccagaguguacugccccagaaacugcaugcaggccaacccccacuacgccagagugaucggcaccagaguguacagcgaccugagcagcaucugcagagccgccgugcacgccggcguggugagaaaccacggcggcuacguggacgugaugcccguggacaagagaaagaccuacaucgccagcuuccagaacggcaucuucagcgagagccugcagaacccccccggcggcaaggccuucagaguguucgccgugguguaa

SEQ ID NO: 15648 - RNA, 1494 nt, Artificial Sequence
  CRISPLD2__Homo_sapiens__NP_113664
augagcugcgugcugggcggcgugaucccccugggccugcuguuccuggugugcggcagccagggcuaccugcugcccaacgugacccugcuggaggagcugcugagcaaguaccagcacaacgagagccacagcagagugagaagagccauccccagagaggacaaggaggagauccugaugcugcacaacaagcugagaggccaggugcagccccaggccagcaacauggaguacaugaccugggacgacgagcuggagaagagcgccgccgccugggccagccagugcaucugggagcacggccccaccagccugcuggugagcaucggccagaaccugggcgcccacuggggcagauacagaagccccggcuuccacgugcagagcugguacgacgaggugaaggacuacaccuaccccuaccccagcgagugcaaccccuggugccccgagagaugcagcggccccaugugcacccacuacacccagaucgugugggccaccaccaacaagaucggcugcgccgugaacaccugcagaaagaugaccguguggggcgaggugugggagaacgccguguacuucgugugcaacuacagccccaagggcaacuggaucggcgaggcccccuacaagaacggcagacccugcagcgagugcccccccagcuacggcggcagcugcagaaacaaccugugcuacagagaggagaccuacacccccaagcccgagaccgacgagaugaacgagguggagaccgcccccauccccgaggagaaccacguguggcugcagcccagagugaugagacccaccaagcccaagaagaccagcgccgugaacuacaugacccagguggugagaugcgacaccaagaugaaggacagaugcaagggcagcaccugcaacagauaccagugccccgccggcugccugaaccacaaggccaagaucuucggcacccuguucuacgagagcagcagcagcaucugcagagccgccauccacuacggcauccuggacgacaagggcggccugguggacaucaccagaaacggcaaggugcccuucuucgugaagagcgagagacacggcgugcagagccugagcaaguacaagcccagcagcagcuucauggugagcaaggugaaggugcaggaccuggacugcuacaccaccguggcccagcugugccccuucgagaagcccgccacccacugccccagaauccacugccccgcccacugcaaggacgagcccagcuacugggcccccguguucggcaccaacaucuacgccgacaccagcagcaucugcaagaccgccgugcacgccggcgugaucagcaacgagagcggcggcgacguggacgugaugcccguggacaagaagaagaccuacgugggcagccugagaaacggcgugcagagcgagagccugggcacccccagagacggcaaggccuucagaaucuucgccgugagacaguaa

SEQ ID NO: 15649 - RNA, 615 nt, Artificial Sequence
  CRK__Homo_sapiens__NP_005197
auggccggcaacuucgacagcgaggagagaagcagcugguacuggggcagacugagcagacaggaggccguggcccugcugcagggccagagacacggcguguuccuggugagagacagcagcaccagccccggcgacuacgugcugagcgugagcgagaacagcagagugagccacuacaucaucaacagcagcggccccagaccccccgugccccccagccccgcccagcccccccccggcgugagccccagcagacugagaaucggcgaccaggaguucgacagccugcccgcccugcuggaguucuacaagauccacuaccuggacaccaccacccugaucgagcccgugagcagaagcagacagggcagcggcgugauccugagacaggaggaggccgaguacgugagagcccuguucgacuucaacggcaacgacgaggaggaccugcccuucaagaagggcgacauccugagaaucagagacaagcccgaggagcagugguggaacgccgaggacagcgagggcaagagaggcaugauccccgugcccuacguggagaaguacagacccgccagcgccagcgugagcgcccugaucggcggcagauaa

SEQ ID NO: 15650 - RNA, 912 nt, Artificial Sequence
  CRKL__Homo_sapiens__NP_005198
augagcagcgccagauucgacagcagcgacagaagcgccugguacaugggccccgugagcagacaggaggcccagaccagacugcagggccagagacacggcauguuccuggugagagacagcagcaccugccccggcgacuacgugcugagcgugagcgagaacagcagagugagccacuacaucaucaacagccugcccaacagaagauucaagaucggcgaccaggaguucgaccaccugcccgcccugcuggaguucuacaagauccacuaccuggacaccaccacccugaucgagcccgcccccagauaccccagcccccccaugggcagcgugagcgcccccaaccugcccaccgccgaggacaaccuggaguacgugagaacccuguacgacuuccccggcaacgacgccgaggaccugcccuucaagaagggcgagauccuggugaucaucgagaagcccgaggagcagugguggagcgccagaaacaaggacggcagagugggcaugauccccgugcccuacguggagaagcuggugagaagcagcccccacggcaagcacggcaacagaaacagcaacagcuacggcauccccgagcccgcccacgccuacgcccagccccagaccaccaccccccugcccgccgugagcggcagccccggcgccgccaucaccccccugcccagcacccagaacggccccguguucgccaaggccauccagaagagagugcccugcgccuacgacaagaccgcccuggcccuggaggugggcgacaucgugaaggugaccagaaugaacaucaacggccagugggagggcgaggugaacggcagaaagggccuguuccccuucacccacgugaagaucuucgacccccagaaccccgacgagaacgaguaa

SEQ ID NO: 15651 - RNA, 1269 nt, Artificial Sequence
  CRLF1__Homo_sapiens__NP_004741
augcccgccggcagaagaggccccgccgcccagagcgccagaagaccccccccccugcugccccugcugcugcugcugugcgugcugggcgcccccagagccggcagcggcgcccacaccgccgugaucagcccccaggaccccacccugcugaucggcagcagccugcuggccaccugcagcgugcacggcgacccccccggcgccaccgccgagggccuguacuggacccugaacggcagaagacugccccccgagcugagcagagugcugaacgccagcacccuggcccuggcccuggccaaccugaacggcagcagacagagaagcggcgacaaccuggugugccacgccagagacggcagcauccuggccggcagcugccuguacgugggccugccccccgagaagcccgugaacaucagcugcuggagcaagaacaugaaggaccugaccugcagauggacccccggcgcccacggcgagaccuuccugcacaccaacuacagccugaaguacaagcugagaugguacggccaggacaacaccugcgaggaguaccacaccgugggcccccacagcugccacauccccaaggaccuggcccuguucacccccuacgagaucuggguggaggccaccaacagacugggcagcgccagaagcgacgugcugacccuggacauccuggacguggugaccaccgaccccccccccgacgugcacgugagcagagugggcggccuggaggaccagcugagcgugagaugggugagcccccccgcccugaaggacuuccuguuccaggccaaguaccagaucagauacagaguggaggacagcguggacuggaaggugguggacgacgugagcaaccagaccagcugcagacuggccggccugaagcccggcaccguguacuucgugcaggugagaugcaaccccuucggcaucuacggcagcaagaaggccggcaucuggagcgaguggagccaccccaccgccgccagcacccccagaagcgagagacccggccccggcggcggcgccugcgagcccagaggcggcgagcccagcagcggccccgugagaagagagcugaagcaguuccugggcuggcugaagaagcacgccuacugcagcaaccugagcuucagacuguacgaccaguggagagccuggaugcagaagagccacaagaccagaaaccaggacgagggcauccugcccagcggcagaagaggcaccgccagaggccccgccagauaa

SEQ ID NO: 15652 - RNA, 1116 nt, Artificial Sequence
  CRLF2__Homo_sapiens__NP_071431
augggcagacuggugcugcuguggggcgccgccguguuccugcugggcggcuggauggcccugggccagggcggcgccgccgagggcgugcagauccagaucaucuacuucaaccuggagaccgugcaggugaccuggaacgccagcaaguacagcagaaccaaccugaccuuccacuacagauucaacggcgacgaggccuacgaccagugcaccaacuaccugcugcaggagggccacaccagcggcugccugcuggacgccgagcagagagacgacauccuguacuucagcaucagaaacggcacccaccccguguucaccgccagcagauggaugguguacuaccugaagcccagcagccccaagcacgugagauucagcuggcaccaggacgccgugaccgugaccugcagcgaccugagcuacggcgaccugcuguacgaggugcaguacagaagccccuucgacaccgaguggcagagcaagcaggagaacaccugcaacgugaccaucgagggccuggacgccgagaagugcuacagcuucugggugagagugaaggccauggaggacguguacggccccgacaccuaccccagcgacuggagcgaggugaccugcuggcagagaggcgagaucagagacgccugcgccgagacccccaccccccccaagcccaagcugagcaaguucauccugaucagcagccuggccauccugcugauggugagccugcugcugcugagccuguggaagcuguggagagugaagaaguuccugauccccagcgugcccgaccccaagagcaucuuccccggccuguucgagauccaccagggcaacuuccaggaguggaucaccgacacccagaacguggcccaccugcacaagauggccggcgccgagcaggagagcggccccgaggagccccugguggugcagcuggccaagaccgaggccgagagccccagaaugcuggacccccagaccgaggagaaggaggccagcggcggcagccugcagcugccccaccagccccugcagggcggcgacguggugaccaucggcggcuucaccuucgugaugaacgacagaagcuacguggcccuguaa

SEQ ID NO: 15653 - RNA, 1329 nt, Artificial Sequence
  CRLF3__Homo_sapiens__NP_057070
augagaggcgccauggagcuggagcccgagcugcugcugcaggaggccagagagaacguggaggccgcccagagcuacagaagagagcugggccacagacuggagggccugagagaggccagaagacagaucaaggagagcgccagccagaccagagacgugcugaagcagcacuucaacgaccugaagggcacccugggcaagcugcuggacgagagacuggugacccugcugcaggagguggacaccaucgagcaggagaccaucaagccccuggacgacugccagaagcugaucgagcacggcgugaacaccgccgaggaccuggugagagagggcgagaucgccaugcugggcggcgugggcgaggagaacgagaagcuguggagcuucaccaagaaggccagccacauccagcuggacagccugcccgaggugccccugcugguggacgugcccugccugagcgcccagcuggacgacagcauccugaacaucgugaaggaccacaucuucaagcacggcaccguggccagcagaccccccgugcagaucgaggagcugaucgagaagcccggcggcaucaucgugagauggugcaagguggacgacgacuucaccgcccaggacuacagacugcaguucagaaagugcaccagcaaccacuucgaggacguguacgugggcagcgagaccgaguucaucgugcugcacaucgaccccaacguggacuaccaguucagagugugcgccagaggcgacggcagacaggaguggagccccuggagcgugccccagaucggccacagcacccuggugccccacgaguggaccgccggcuucgagggcuacagccugagcagcagaagaaacaucgcccugagaaacgacagcgagagcagcggcgugcuguacagcagagcccccaccuacuucugcggccagacccugaccuucagaguggagaccgugggccagcccgacagaagagacagcaucggcgugugcgccgagaagcaggacggcuacgacagccugcagagagaccaggccgugugcaucagcaccaacggcgccguguucgugaacggcaaggagaugaccaaccagcugcccgccgugaccagcggcagcaccgugaccuucgacaucgaggccgugacccugggcaccaccagcaacaacgagggcggccacuucaagcugagagugaccaucagcagcaacaacagagaggugguguucgacuggcugcuggaccagagcugcggcagccuguacuucggcugcagcuucuucuaccccggcuggaaggugcugguguucuaa

SEQ ID NO: 15654 - RNA, 609 nt, Artificial Sequence
  CRLS1__Homo_sapiens__NP_001120930
augccccaguacgagaaccccuggaccauccccaacaugcugagcaugaccagaaucggccuggcccccgugcugggcuaccugaucaucgaggaggacuucaacaucgcccugggcguguucgcccuggccggccugaccgaccugcuggacggcuucaucgccagaaacugggccaaccagagaagcgcccugggcagcgcccuggacccccuggccgacaagauccugaucagcauccuguacgugagccugaccuacgccgaccugauccccgugccccugaccuacaugaucaucagcagagacgugaugcugaucgccgccguguucuacgugagauacagaacccugcccacccccagaacccuggccaaguacuucaaccccugcuacgccaccgccagacugaagcccaccuucaucagcaaggugaacaccgccgugcagcugauccugguggccgccagccuggccgcccccguguucaacuacgccgacagcaucuaccugcagauccuguggugcuucaccgccuucaccaccgccgccagcgccuacagcuacuaccacuacggcagaaagaccgugcaggugaucaaggacuaa

SEQ ID NO: 15655 - RNA, 2061 nt, Artificial Sequence
  CRMP1__Homo_sapiens__NP_001014809
auggccgacagaagaagagccuggaacaccgaggacgaccugcccguguaccuggccagacccggcagcgccgcccagacccccagacagaaguacggcggcauguucgccgccguggagggcgccuacgagaacaagaccaucgacuucgacgccuacagcgugggcagaagaggcagcgccagaacccccagaagcgccggcagacccgacgccgugggccugcccggccccggcggcagcgaggacaccgccagcgacgugagcgagcccagcggcagcgccgugagcagccccggcgagagagacgagagaccccccacccugagaaucagaagacccgcccccagagaccugccccugggcagagacaacggccagagcgacagacugcugaucaagggcggcagaaucaucaacgacgaccagagccuguacgccgacguguaccuggaggacggccugaucaagcagaucggcgagaaccugaucgugcccggcggcgugaagaccaucgaggccaacggcagaauggugauccccggcggcaucgacgugaacaccuaccugcagaagcccagccagggcaugaccgccgccgacgacuucuuccagggcaccagagccgcccuggugggcggcaccaccaugaucaucgaccacguggugcccgagcccggcagcagccugcugaccagcuucgagaaguggcacgaggccgccgacaccaagagcugcugcgacuacagccugcacguggacaucaccagcugguacgacggcgugagagaggagcuggaggugcuggugcaggacaagggcgugaacagcuuccagguguacauggccuacaaggacguguaccagaugagcgacagccagcuguacgaggccuucaccuuccugaagggccugggcgccgugauccuggugcacgccgagaacggcgaccugaucgcccaggagcagaagagaauccuggagaugggcaucaccggccccgagggccacgcccugagcagacccgaggagcuggaggccgaggccguguucagagccaucaccaucgccggcagaaucaacugccccguguacaucaccaaggugaugagcaagagcgccgccgacaucaucgcccuggccagaaagaagggcccccugguguucggcgagcccaucgccgccagccugggcaccgacggcacccacuacuggagcaagaacugggccaaggccgccgccuucgugaccagccccccccugagccccgaccccaccacccccgacuaccugaccagccugcuggccugcggcgaccugcaggugaccggcagcggccacugccccuacagcaccgcccagaaggccgugggcaaggacaacuucacccugauccccgagggcgugaacggcaucgaggagagaaugaccguggugugggacaaggccguggccaccggcaagauggacgagaaccaguucguggccgugaccagcaccaacgccgccaagaucuucaaccuguaccccagaaagggcagaaucgccgugggcagcgacgccgacguggugaucugggaccccgacaagcugaagaccaucaccgccaagagccacaagagcgccguggaguacaacaucuucgagggcauggagugccacggcagcccccugguggugaucagccagggcaagaucguguucgaggacggcaacaucaacgugaacaagggcaugggcagauucauccccagaaaggccuuccccgagcaccuguaccagagagugaagaucagaaacaagguguucggccugcagggcgugagcagaggcauguacgacggccccguguacgaggugcccgccacccccaaguacgccacccccgcccccagcgccaagagcagccccagcaagcaccagcccccccccaucagaaaccugcaccagagcaacuucagccugagcggcgcccagaucgacgacaacaaccccagaagaaccggccacagaaucguggccccccccggcggcagaagcaacaucaccagccugggcuaa

SEQ ID NO: 15656 - RNA, 2511 nt, Artificial Sequence
  CRNKL1__Homo_sapiens__NP_001265554
augaccgccaccguggagaaccugaccuuccagaaggacacccugggcaacgccguggacaagaacagaagacacggcagcaccgagccccuggugcuggccuggagcagccaguucagaagacugaccuggggcugcgcccuggacgcccugcacagaagccccugcguggccgccagccagcacggcgugacccaccugaucagaagcagcagaaccccccacagcaccagaugcagaaaggaggacgcccagcccggccaccacggcaacggcgccgccagcgugaccgcccaggccagaggccagagaagcgugcugcaggugccccugcccgugcccagaagcugccuguucagcgagagcuucguggugagcgugagcagccagagcagauuccuggccagcgugcccggcaccggcgugcagagaagcaccgccgccgacauggccgccagcaccgccgccggcaagcagagaauccccaagguggccaaggugaagaacaaggcccccgccgaggugcagaucaccgccgagcagcugcugagagaggccaaggagagagagcuggagcugcugcccccccccccccagcagaagaucaccgacgaggaggagcugaacgacuacaagcugagaaagagaaagaccuucgaggacaacaucagaaagaacagaaccgugaucagcaacuggaucaaguacgcccagugggaggagagccugaaggagauccagagagccagaagcaucuacgagagagcccuggacguggacuacagaaacaucacccuguggcugaaguacgccgagauggagaugaagaacagacaggugaaccacgccagaaacaucugggacagagccaucaccacccugcccagagugaaccaguucugguacaaguacaccuacauggaggagaugcugggcaacguggccggcgccagacagguguucgagagauggauggaguggcagcccgaggagcaggccuggcacagcuacaucaacuucgagcugagauacaaggagguggacagagccagaaccaucuacgagagauucgugcuggugcaccccgacgugaagaacuggaucaaguacgccagauucgaggagaagcacgccuacuucgcccacgccagaaagguguacgagagagccguggaguucuucggcgacgagcacauggacgagcaccuguacguggccuucgccaaguucgaggagaaccagaaggaguucgagagagugagagugaucuacaaguacgcccuggacagaaucagcaagcaggacgcccaggagcuguucaagaacuacaccaucuucgagaagaaguucggcgacagaagaggcaucgaggacaucaucgugagcaagagaagauuccaguacgaggaggaggugaaggccaacccccacaacuacgacgccugguucgacuaccugagacugguggagagcgacgccgaggccgaggccgugagagagguguacgagagagccaucgccaacgugccccccauccaggagaagagacacuggaagagauacaucuaccuguggaucaacuacgcccuguacgaggagcuggaggccaaggaccccgagagaaccagacagguguaccaggccagccuggagcugaucccccacaagaaguucaccuucgccaagauguggauccuguacgcccaguucgagaucagacagaagaaccugagccuggccagaagagcccugggcaccagcaucggcaagugccccaagaacaagcuguucaagguguacaucgagcuggagcugcagcugagagaguucgacagaugcagaaagcuguacgagaaguuccuggaguucggccccgagaacugcaccagcuggaucaaguucgccgagcuggagaccauccugggcgacaucgacagagccagagccaucuacgagcuggccaucagccagcccagacuggacaugcccgaggugcuguggaagagcuacaucgacuucgagaucgagcaggaggagaccgagagaaccagaaaccuguacagaagacugcugcagagaacccagcacgugaagguguggaucagcuucgcccaguucgagcugagcagcggcaaggagggcagccugaccaagugcagacagaucuacgaggaggccaacaagaccaugagaaacugcgaggagaaggaggagagacugaugcugcuggagagcuggagaagcuucgaggaggaguucggcaccgccagcgacaaggagagaguggacaagcugaugcccgagaaggugaagaagagaagaaaggugcagaccgacgacggcagcgacgccggcugggaggaguacuucgacuacaucuuccccgaggacgccgccaaccagcccaaccugaagcugcuggccauggccaagcuguggaagaagcagcagcaggagaaggaggacgccgagcaccaccccgacgaggacguggacgagagcgagagcuaa

SEQ ID NO: 15657 - RNA, 1488 nt, Artificial Sequence
  CRNN__Homo_sapiens__NP_057274
augccccagcugcugcagaacaucaacggcaucaucgaggccuucagaagauacgccagaaccgagggcaacugcaccgcccugaccagaggcgagcugaagagacugcuggagcaggaguucgccgacgugaucgugaagccccacgaccccgccaccguggacgaggugcugagacugcuggacgaggaccacaccggcaccguggaguucaaggaguuccuggugcugguguucaagguggcccaggccugcuucaagacccugagcgagagcgccgagggcgccugcggcagccaggagagcggcagccugcacagcggcgccagccaggagcugggcgagggccagagaagcggcaccgaggugggcagagccggcaagggccagcacuacgagggcagcagccacagacagagccagcagggcagcagaggccagaacagacccggcgugcagacccagggccaggccaccggcagcgccugggugagcagcuacgacagacaggccgagagccagagccaggagagaaucagcccccagauccagcugagcggccagaccgagcagacccagaaggccggcgagggcaagagaaaccagaccaccgagaugagacccgagagacagccccagaccagagagcaggacagagcccaccagaccggcgagaccgugaccggcagcggcacccagacccaggccggcgccacccagaccguggagcaggacagcagccaccagaccggcagaaccagcaagcagacccaggaggccaccaacgaccagaacagaggcaccgagacccacggccagggcagaagccagaccagccaggccgugaccggcggccacgcccagauccaggccggcacccacacccagacccccacccagaccguggagcaggacagcagccaccagaccggcagcaccagcacccagacccaggagagcaccaacggccagaacagaggcaccgagauccacggccagggcagaagccagaccagccaggccgugaccggcggccacacccagauccaggccggcagccacaccgagaccguggagcaggacagaagccagaccgugagccacggcggcgccagagagcagggccagacccagacccagcccggcagcggccagagauggaugcaggugagcaaccccgaggccggcgagaccgugcccggcggccaggcccagaccggcgccagcaccgagagcggcagacaggaguggagcagcacccaccccagaagaugcgugaccgagggccagggcgacagacagcccaccguggugggcgaggaguggguggacgaccacagcagagagaccgugauccugagacuggaccagggcaaccugcacaccagcgugagcagcgcccagggccaggacgccgcccagagcgaggagaagagaggcaucaccgccagagagcuguacagcuaccugagaagcaccaagcccuaa

SEQ ID NO: 15658 - RNA, 5316 nt, Artificial Sequence
  CROCC__Homo_sapiens__XP_011540774
augaccagcugggacccccagaaccccgccggccuguggggcagaacccugggcauggagcccagaacccuggagagcagcgugcugugccaggagaagggccugggcgccagagaccuggcccaggacgcccagaucaccagccugcccgcccugaucagagagaucgugaccagaaaccugagccagcccgagagccccgugcugcugcccgccaccgagauggccagccugcugagccugcaggaggagaaccagcugcugcagcaggagcugagcagaguggaggaccugcuggcccagagcagagccgagagagacgagcuggccaucaaguacaacgccgugagcgagagacuggagcaggcccugagacuggagcccggcgagcuggagacccaggagcccagaggccuggugagacagagcguggagcugagaagacagcugcaggaggagcaggccagcuacagaagaaagcugcaggccuaccaggagggccagcagagacaggcccagcuggugcagagacugcagggcaagauccugcaguacaagaagagaugcagcgagcuggagcagcagcugcuggagagaagcggcgagcuggagcagcagagacugagagacaccgagcacagccaggaccuggagagcgcccugaucagacuggaggaggagcagcagagaagcgccagccuggcccaggugaacgccaugcugagagagcagcuggaccaggccggcagcgccaaccaggcccugagcgaggacaucagaaaggugaccaacgacuggaccagaugcagaaaggagcuggagcacagagaggccgccuggagaagagaggaggagagcuucaacgccuacuucagcaacgagcacagcagacugcugcugcuguggagacagguggugggcuucagaagacuggugagcgaggugaagauguucaccgagagagaccugcugcagcugggcggcgagcuggccagaaccagcagagccgugcaggaggccggccugggccugagcaccggccugagacuggccgagagcagagccgaggccgcccuggagaagcaggcccugcugcaggcccagcuggaggagcagcugagagacaaggugcugagagagaaggaccuggcccagcagcagaugcagagcgaccuggacaaggccgaccugagcgccagagugaccgagcugggccuggccgugaagagacuggagaagcagaaccuggagaaggaccaggugaacaaggaccugaccgagaagcuggaggcccuggagagccugagacugcaggagcaggccgcccuggagaccgaggacggcgagggccugcagcagacccugagagaccuggcccaggccgugcugagcgacagcgagagcggcgugcagcugagcggcagcgagagaaccgccgacgccagcaacggcagccugagaggccugagcggccagagaacccccagcccccccagaagaagcagccccggcagaggcagaagccccagaagaggccccagccccgccugcagcgacagcagcacccuggcccugauccacagcgcccugcacaagagacagcugcaggugcaggacaugagaggcagauacgaggccagccaggaccugcugggcacccugagaaagcagcugagcgacagcgagagcgagagaagagcccuggaggagcagcugcagagacugagagacaagaccgacggcgccaugcaggcccacgaggacgcccagagagaggugcagagacugagaagcgccaacgagcugcugagcagagagaagagcaaccuggcccacagccugcagguggcccagcagcaggccgaggagcugagacaggagagagagaagcugcaggccgcccaggaggagcugagaagacagagagacagacuggaggaggagcaggaggacgccgugcaggacggcgccagagugagaagagagcuggagagaagccacagacagcuggagcagcuggagggcaagagaagcgugcuggccaaggagcugguggaggugagagaggcccugagcagagccacccugcagagagacaugcugcaggccgagaaggccgagguggccgaggcccugaccaaggccgaggccggcagaguggagcuggagcugagcaugaccaagcugagagccgaggaggccagccugcaggacagccugagcaagcugagcgcccugaacgagagccuggcccaggacaagcuggaccugaacagacugguggcccagcuggaggaggagaagagcgcccugcagggcagacagagacaggccgagcaggaggccaccguggccagagaggagcaggagagacuggaggagcugagacuggagcaggagguggccagacagggccuggagggcagccugagaguggccgagcaggcccaggaggcccuggagcagcagcugcccacccugagacacgagagaagccagcugcaggagcagcuggcccagcugagcagacagcugagcggcagagagcaggagcuggagcaggccagaagagaggcccagagacagguggaggcccuggagagagccgccagagagaaggaggcccuggccaaggagcacgccggccuggccgugcagcugguggccgccgagagagagggcagaacccugagcgaggaggccaccagacugagacuggagaaggaggcccuggagggcagccuguucgaggugcagagacagcuggcccagcuggaggccagaagagagcagcuggaggccgagggccaggcccugcugcuggccaaggagacccugaccggcgagcuggccggccugagacagcagaucaucgccacccaggagaaggccagccuggacaaggagcugauggcccagaagcuggugcaggccgagagagaggcccaggccagccugagagagcagagagccgcccacgaggaggaccugcagagacugcagagagagaaggaggccgccuggagagagcuggaggccgagagagcccagcugcagagccagcugcagagagagcaggaggagcugcuggccagacuggaggccgagaaggaggagcugagcgaggagaucgccgcccugcagcaggagagagacgagggccugcugcuggccgagagcgagaagcagcaggcccugagccugaaggagagcgagaagaccgcccugagcgagaagcugaugggcaccagacacagccuggccaccaucagccuggagauggagagacagaagagagacgcccagagcagacaggagcaggacagaagcaccgugaacgcccugaccagcgagcugagagaccugagagcccagagagaggaggccgccgccgcccacgcccaggaggugagaagacugcaggagcaggccagagaccugggcaagcagagagacagcugccugagagaggccgaggagcugagaacccagcugagacugcuggaggacgccagagacggccugagaagagagcugcuggaggcccagagaaagcugagagagagccaggagggcagagaggugcagagacaggaggccggcgagcugagaagaagccugggcgagggcgccaaggagagagaggcccugagaagaagcaacgaggagcugagaagcgccgugaagaaggccgagagcgagagaaucagccugaagcuggccaacgaggacaaggagcagaagcuggcccugcuggaggaggccagaaccgccgugggcaaggaggccggcgagcugagaaccggccugcaggagguggagagaagcagacuggaggccagaagagagcugcaggagcugagaagacagaugaagaugcuggacagcgagaacaccagacugggcagagagcuggccgagcugcagggcagacuggcccugggcgagagagccgagaaggagagcagaagagagacccugggccugagacagagacugcugaagggcgaggccagccuggaggugaugagacaggagcugcagguggcccagagaaagcugcaggagcaggagggcgaguucagaaccagagagagaagacugcugggcagccuggaggaggccagaggcaccgagaagcagcagcuggaccacgccagaggccuggagcugaagcuggaggccgccagagccgaggccgccgagcugggccugagacugagcgccgccgagggcagagcccagggccuggaggccgagcuggccagaguggaggugcagagaagagccgccgaggcccagcugggcggccugagaagcgcccugagaagaggccugggccugggcagagcccccagccccgcccccagacccgugcccggcagccccgccagagacgcccccgccgagggcagcggcgagggccugaacagccccagcacccuggagugcagccccggcagccagccccccagccccggccccgccaccagccccgccagccccgaccuggaccccgaggccgugagaggcgcccugagagaguuccugcaggagcugagaagcgcccagagagagagagacgagcugagaacccagaccagcgcccugaacagacagcuggccgagauggaggccgagagagacagcgccaccagcagagccagacagcugcagaaggccguggccgagagcgaggaggccagaagaagcguggacggcagacugagcggcgugcaggccgagcuggcccugcaggaggagagcgugagaagaagcgagagagagagaagagccacccuggaccagguggccacccuggagagaagccugcaggccaccgagagcgagcugagagccagccaggagaagaucagcaagaugaaggccaacgagaccaagcuggagggcgacaagagaagacugaaggaggugcuggacgccagcgagagcagaaccgugaagcuggagcugcagagaagaagccuggagggcgagcugcagagaagcagacugggccugagcgacagagaggcccaggcccaggcccugcaggacagaguggacagccugcagagacagguggccgacagcgaggugaaggccggcacccugcagcugaccguggagagacugaacggcgcccuggccaagguggaggagagcgagggcgcccugagagacaaggugagaggccugaccgaggcccuggcccagagcagcgccagccugaacagcaccagagacaagaaccugcaccugcagaaggcccugaccgccugcgagcacgacagacaggugcugcaggugagauaa

SEQ ID NO: 15659 - RNA, 1923 nt, Artificial Sequence
  CROT__Homo_sapiens__NP_001137407
auggagaaccagcuggccaagagcaccgaggagagaaccuuccaguaccaggacagccugcccagccugcccgugcccagccuggaggagagccugaagaaguaccuggagagcgugaccagaaccugcuaccagaucagaggccuggaccccgacgccaagagaggcuuccuggaccugaccagagagggcauccaggugaagcccuucgccaaccaggaggaguacaagaagaccgaggagaucgugcagaaguuccagagcggcaucggcgagaagcugcaccagaagcugcuggagagagccaagggcaagagaaacuggcuggaggagugguggcugaacguggccuaccuggacgugagaauccccagccagcugaacgugaacuucgccggccccgccgcccacuucgagcacuacuggccccccaaggagggcacccagcuggagagaggcagcaucacccuguggcacaaccugaacuacuggcagcugcugagaaaggagaaggugcccgugcacaaggugggcaacaccccccuggacaugaaccaguucagaaugcuguucagcaccugcaaggugcccggcaucaccagagacagcaucaugaacuacuucagaaccgagagcgagggcagaagccccaaccacaucguggugcugugcagaggcagagccuucguguucgacgugauccacgagggcugccuggugaccccccccgagcugcugagacagcugaccuacauccacaagaagugccacagcgagcccgacggccccggcaucgccgcccugaccagcgaggagagaaccagaugggccaaggccagagaguaccugaucggccuggaccccgagaaccuggcccugcuggagaagauccagagcagccugcugguguacagcauggaggacagcagcccccacgugacccccgaggacuacagcgagaucaucgccgccauccugaucggcgaccccaccgugagauggggcgacaagagcuacaaccugaucagcuucagcaacggcguguucggcugcaacugcgaccacgcccccuucgacgccaugaucauggugaacaucagcuacuacguggacgagaagaucuuccagaacgagggcagauggaagggcagcgagaaggugagagacaucccccugcccgaggagcugaucuucaucguggacgagaaggugcugaacgacaucaaccaggccaaggcccaguaccugagagaggccagcgaccugcagaucgccgccuacgccuucaccagcuucggcaagaagcugaccaagaacaagaugcugcaccccgacaccuucauccagcuggcccugcagcuggccuacuacagacugcacggccaccccggcugcugcuacgagaccgccaugaccagacacuucuaccacggcagaaccgagaccaugagaagcugcaccguggaggccgugagauggugccagagcaugcaggaccccagcgugaaccugagagagagacagcagaagaugcugcaggccuucgccaagcacaacaagaugaugaaggacugcagcgccggcaagggcuucgacagacaccugcugggccugcugcugaucgccaaggaggagggccugcccgugcccgagcuguucaccgacccccuguucagcaagagcggcggcggcggcaacuucgugcugagcaccagccuggugggcuaccugagagugcagggcgugguggugcccauggugcacaacggcuacggcuucuucuaccacaucagagacgacagauucgugguggccugcagcgccuggaagagcugccccgagaccgacgccgagaagcuggugcagcugaccuucugcgccuuccacgacaugauccagcugaugaacagcacccaccuguaa

SEQ ID NO: 15660 - RNA, 675 nt, Artificial Sequence
  CRP__Homo_sapiens__XP_011507509
auggagaagcugcugugcuuccuggugcugaccagccugagccacgccuucggccagaccgacaugagcagaaaggccuucguguuccccaaggagagcgacaccagcuacgugagccugaaggccccccugaccaagccccugaaggccuucaccgugugccugcacuucuacaccgagcugagcagcaccagaggcuacagcaucuucagcuacgccaccaagagacaggacaacgagauccugaucuucuggagcaaggacaucggcuacagcuucaccgugggcggcagcgagauccuguucgaggugcccgaggugaccguggcccccgugcacaucugcaccagcugggagagcgccagcggcaucguggaguucuggguggacggcaagcccagagugagaaagagccugaagaagggcuacaccgugggcgccgaggccagcaucauccugggccaggagcaggacagcuucggcggcaacuucgagggcagccagagccuggugggcgacaucggcaacgugaacaugugggacuucgugcugagccccgacgagaucaacaccaucuaccugggcggccccuucagccccaacgugcugaacuggagagcccugaaguacgaggugcagggcgagguguucaccaagccccagcuguggcccuaa

SEQ ID NO: 15661 - RNA, 1938 nt, Artificial Sequence
  CRTAC1__Homo_sapiens__NP_001193457
auggcccccagcgccgaccccggcaugagcagaaugcugcccuuccugcugcugcugugguuccugcccaucaccgagggcagccagagagccgagcccauguucaccgccgugaccaacagcgugcugccccccgacuacgacagcaaccccacccagcugaacuacggcguggccgugaccgacguggaccacgacggcgacuucgagaucgugguggccggcuacaacggccccaaccuggugcugaaguacgacagagcccagaagagacuggugaacaucgccguggacgagagaagcagccccuacuacgcccugagagacagacagggcaacgccaucggcgugaccgccugcgacaucgacggcgacggcagagaggagaucuacuuccugaacaccaacaacgccuucagcggcguggccaccuacaccgacaagcuguucaaguucagaaacaacagaugggaggacauccugagcgacgaggugaacguggccagaggcguggccagccuguucgccggcagaagcguggccugcguggacagaaagggcagcggcagauacagcaucuacaucgccaacuacgccuacggcaacgugggccccgacgcccugaucgagauggaccccgaggccagcgaccugagcagaggcauccuggcccugagagacguggccgccgaggccggcgugagcaaguacaccggcggcagaggcgugagcgugggccccauccugagcagcagcgccagcgacaucuucugcgacaacgagaacggccccaacuuccuguuccacaacagaggcgacggcaccuucguggacgccgccgccagcgccggcguggacgacccccaccagcacggcagaggcguggcccuggccgacuucaacagagacggcaagguggacaucguguacggcaacuggaacggcccccacagacuguaccugcagaugagcacccacggcaaggugagauucagagacaucgccagccccaaguucagcaugcccagccccgugagaaccgugaucaccgccgacuucgacaacgaccaggagcuggagaucuucuucaacaacaucgccuacagaagcagcagcgccaacagacuguucagagugaucagaagagagcacggcgacccccugaucgaggagcugaaccccggcgacgcccuggagcccgagggcagaggcaccggcggcguggugaccgacuucgacggcgacggcaugcuggaccugauccugagccacggcgagagcauggcccagccccugagcguguucagaggcaaccagggcuucaacaacaacuggcugagaguggugcccagaaccagauucggcgccuucgccagaggcgccaagguggugcuguacaccaagaagagcggcgcccaccugagaaucaucgacggcggcagcggcuaccugugcgagauggagcccguggcccacuucggccugggcaaggacgaggccagcagcguggaggugaccuggcccgacggcaagauggugagcagaaacguggccagcggcgagaugaacagcgugcuggagauccuguaccccagagacgaggacacccugcaggaccccgccccccuggagugcggccagggcuucagccagcaggagaacggccacugcauggacaccaacgagugcauccaguuccccuucgugugccccagagacaagcccgugugcgugaacaccuacggcagcuacagaugcagaaccaacaagaagugcagcagaggcuacgagcccaacgaggacggcaccgccugcguggcccagguggccuuccugggcggcuacagcagcgccgccagcagaaucagcgagccccugagcagagccagcuaccugagccugggccugggccugugccugcagcuguacgcccuguaa

SEQ ID NO: 15662 - RNA, 585 nt, Artificial Sequence
  CRTAM__Homo_sapiens__NP_001291711
augugggugaagcugcugagcaucguggccgaguucugcuucagccccuuccuggugaccgacgaggagaccgccagcgacgcccuggagagaaacagccugagcagccaggacccccagcagcccaccagcaccgugagcgugaccgaggacagcagcaccagcgagaucgacaaggaggagaaggagcagaccacccaggaccccgaccugaccaccgaggccaacccccaguaccugggccuggccagaaagaagagcggcauccugcugcugacccuggugagcuuccugaucuucauccuguucaucaucgugcagcuguucaucaugaagcugagaaaggcccacgugaucuggaagaaggagaacgaggugagcgagcacacccuggagagcuacagaagcagaagcaacaacgaggagaccagcagcgaggagaagaacggccagagcagccaccccaugagaugcaugaacuacaucaccaagcuguacagcgaggccaagaccaagagaaaggagaacgugcagcacagcaagcuggaggagaagcacauccaggugcccgagagcaucguguaa

SEQ ID NO: 15663 - RNA, 1206 nt, Artificial Sequence
  CRTAP__Homo_sapiens__NP_006362
auggagcccggcagaagaggcgccgccgcccugcuggcccugcugugcguggccugcgcccugagagccggcagagcccaguacgagagauacagcuucagaagcuuccccagagacgagcugaugccccuggagagcgccuacagacacgcccuggacaaguacagcggcgagcacugggccgagagcgugggcuaccuggagaucagccugagacugcacagacugcugagagacagcgaggccuucugccacagaaacugcagcgccgccccccagcccgagcccgccgccggccuggccagcuaccccgagcugagacuguucggcggccugcugagaagagcccacugccugaagagaugcaagcagggccugcccgccuucagacagagccagcccagcagagaggugcuggccgacuuccagagaagagagcccuacaaguuccugcaguucgccuacuucaaggccaacaaccugcccaaggccaucgccgccgcccacaccuuccugcugaagcaccccgacgacgagaugaugaagagaaacauggccuacuacaagagccugcccggcgccgaggacuacaucaaggaccuggagaccaagagcuacgagagccuguucaucagagccgugagagccuacaacggcgagaacuggagaaccagcaucaccgacauggagcuggcccugcccgacuucuucaaggccuucuacgagugccuggccgccugcgagggcagcagagagaucaaggacuucaaggacuucuaccugagcaucgccgaccacuacguggaggugcuggagugcaagauccagugcgaggagaaccugacccccgugaucggcggcuaccccguggagaaguucguggccaccauguaccacuaccugcaguucgccuacuacaagcugaacgaccugaagaacgccgcccccugcgccgugagcuaccugcuguucgaccagaacgacaaggugaugcagcagaaccugguguacuaccaguaccacagagacaccuggggccugagcgacgagcacuuccagcccagacccgaggccgugcaguucuucaacgugaccacccugcagaaggagcuguacgacuucgccaaggagaacaucauggacgacgacgagggcgaggugguggaguacguggacgaccugcuggagcuggaggagaccagcuaa

SEQ ID NO: 15664 - RNA, 1953 nt, Artificial Sequence
  CRTC1__Homo_sapiens__NP_001091952
auggccaccagcaacaaccccagaaaguucagcgagaagaucgcccugcacaaccagaagcaggccgaggagaccgccgccuucgaggaggugaugaaggaccugagccugaccagagccgccagacugcagcugcagaagagccaguaccugcagcugggccccagcagaggccaguacuacggcggcagccugcccaacgugaaccagaucggcagcggcaccauggaccugcccuuccagcccagcggcuuccugggcgaggcccuggccgccgcccccgugagccugacccccuuccagagcagcggccuggacaccagcagaaccaccagacaccacggccugguggacagaguguacagagagagaggcagacugggcagcccccacagaagaccccugagcguggacaagcacggcagacaggccgacagcugccccuacggcaccauguaccugagcccccccgccgacaccagcuggagaagaaccaacagcgacagcgcccugcaccagagcaccaugacccccacccagcccgagagcuucagcagcggcagccaggacgugcaccagaagagagugcugcugcugaccgugcccggcauggaggagaccaccagcgaggccgacaagaaccugagcaagcaggccugggacaccaagaagaccggcagcagacccaagagcugcgaggugcccggcaucaacaucuuccccagcgccgaccaggagaacaccaccgcccugauccccgccacccacaacaccggcggcagccugcccgaccugaccaacauccacuuccccagcccccugcccaccccccuggaccccgaggagcccaccuuccccgcccugagcagcagcagcagcaccggcaaccuggccgccaaccugacccaccugggcaucggcggcgccggccagggcaugagcacccccggcagcagcccccagcacagacccgccggcgugagcccccugagccugagcaccgaggccagaagacagcaggccagccccacccugagcccccugagccccaucacccaggccguggccauggacgcccugagccuggagcagcagcugcccuacgccuucuucacccaggccggcagccagcagccccccccccagccccagcccccccccccccccccccccgccagccagcagccccccccccccccccccccccaggcccccgugagacugccccccggcggcccccugcugcccagcgccagccugaccagaggcccccagccccccccccuggccgugaccgugcccagcagccugccccagagcccccccgagaaccccggccagcccagcaugggcaucgacaucgccagcgcccccgcccugcagcaguacagaaccagcgccggcagccccgccaaccagagccccaccagccccgugagcaaccagggcuucagccccggcagcagcccccagcacaccagcacccugggcagcguguucggcgacgccuacuacgagcagcagauggccgccagacaggccaacgcccugagccaccagcuggagcaguucaacaugauggagaacgccaucagcagcagcagccuguacagccccggcagcacccugaacuacagccaggccgccaugaugggccugaccggcagccacggcagccugcccgacagccagcagcugggcuacgccagccacagcggcauccccaacaucauccugaccgugaccggcgagagcccccccagccugagcaaggagcugaccagcagccuggccggcgugggcgacgugagcuucgacagcgacagccaguucccccuggacgagcugaagaucgacccccugacccuggacggccugcacaugcugaacgaccccgacauggugcuggccgaccccgccaccgaggacaccuucagaauggacagacuguaa

SEQ ID NO: 15665 - RNA, 2082 nt, Artificial Sequence
  CRTC2__Homo_sapiens__NP_859066
auggccaccagcggcgccaacggccccggcagcgccaccgccagcgccagcaaccccagaaaguucagcgagaagaucgcccugcagaagcagagacaggccgaggagaccgccgccuucgaggaggugaugauggacaucggcagcaccagacugcaggcccagaagcugagacuggccuacaccagaagcagccacuacggcggcagccugcccaacgugaaccagaucggcagcggccuggccgaguuccagagcccccugcacagcccccuggacagcagcagaagcaccagacaccacggccugguggagagagugcagagagaccccagaagaauggugagcccccugagaagauacaccagacacaucgacagcagccccuacagccccgccuaccugagccccccccccgagagcagcuggagaagaaccauggccuggggcaacuuccccgccgagaagggccagcuguucagacugcccagcgcccugaacagaaccagcagcgacagcgcccugcacaccagcgugaugaaccccagcccccaggacaccuaccccggccccaccccccccagcauccugcccagcagaagaggcggcauccuggacggcgagauggaccccaaggugcccgccaucgaggagaaccugcuggacgacaagcaccugcugaagcccugggacgccaagaagcugagcagcagcagcagcagacccagaagcugcgaggugcccggcaucaacaucuuccccagccccgaccagcccgccaacgugcccgugcugccccccgccaugaacaccggcggcagccugcccgaccugaccaaccugcacuucccccccccccugcccaccccccuggaccccgaggagaccgccuaccccagccugagcggcggcaacagcaccagcaaccugacccacaccaugacccaccugggcaucagcagaggcaugggccugggccccggcuacgacgcccccggccugcacagcccccugagccaccccagccugcagagcagccugagcaaccccaaccugcaggccagccugagcagcccccagccccagcugcagggcagccacagccaccccagccugcccgccagcagccuggccagacacgugcugcccaccaccagccugggccaccccagccugagcgcccccgcccugagcagcagcagcagcagcagcagcaccagcagccccgugcugggcgcccccagcuaccccgccagcacccccggcgccagcccccaccacagaagagugccccugagcccccugagccugcuggccggccccgccgacgccagaagaagccagcagcagcugcccaagcaguucagccccaccaugagccccacccugagcagcaucacccagggcgugccccuggacaccagcaagcugagcaccgaccagagacugccccccuaccccuacagcagccccagccuggugcugcccacccagccccacacccccaagagccugcagcagcccggccugcccagccagagcugcagcgugcagagcagcggcggccagccccccggcagacagagccacuacggcacccccuacccccccggccccagcggccacggccagcagagcuaccacagacccaugagcgacuucaaccugggcaaccuggagcaguucagcauggagagccccagcgccagccuggugcuggacccccccggcuucagcgagggccccggcuuccugggcggcgagggccccaugggcggcccccaggacccccacaccuucaaccaccagaaccugacccacugcagcagacacggcagcggccccaacaucauccugaccggcgacagcagccccggcuucagcaaggagaucgccgccgcccuggccggcgugcccggcuucgaggugagcgccgccggccuggagcugggccugggccuggaggacgagcugagaauggagccccugggccuggagggccugaacaugcugagcgaccccugcgcccugcugcccgaccccgccguggaggagagcuucagaagcgacagacugcaguaa

SEQ ID NO: 15666 - RNA, 1857 nt, Artificial Sequence
  CRTC3__Homo_sapiens__NP_001036039
auggccgccagccccggcagcggcagcgccaaccccagaaaguucagcgagaagaucgcccugcacacccagagacaggccgaggagaccagagccuucgagcagcugaugaccgaccugacccugagcagagugcaguuccagaagcugcagcagcugagacugacccaguaccacggcggcagccugcccaacgugagccagcugagaagcagcgccagcgaguuccagcccagcuuccaccaggccgacaacgugagaggcaccagacaccacggccugguggagagacccagcagaaacagauuccacccccugcacagaagaagcggcgacaagcccggcagacaguucgacggcagcgccuucggcgccaacuacagcagccagccccuggacgagagcuggcccagacagcagccccccuggaaggacgagaagcaccccggcuucagacugaccagcgcccugaacagaaccaacagcgacagcgcccugcacaccagcgcccugagcaccaagccccaggaccccuacggcggcggcggccagagcgccuggcccgcccccuacaugggcuucugcgacggcgagaacaacggccacggcgagguggccagcuuccccggcccccugaaggaggagaaccugcugaacgugcccaagccccugcccaagcagcugugggagaccaaggagauccagagccugagcggcagacccagaagcugcgacgugggcggcggcaacgccuucccccacaacggccagaaccugggccugagccccuuccugggcacccugaacaccggcggcagccugcccgaccugaccaaccugcacuacagcaccccccugcccgccagccuggacaccaccgaccaccacuucggcagcaugagcgugggcaacagcgugaacaacauccccgccgccaugacccaccugggcaucagaagcagcagcggccugcagagcagcagaagcaaccccagcauccaggccacccugaacaagaccgugcugagcagcagccugaacaaccacccccagaccagcgugcccaacgccagcgcccugcaccccagccugagacuguucagccugagcaaccccagccugagcaccaccaaccugagcggccccagcagaagaagacagccccccgugagcccccugacccugagccccggccccgaggcccaccagggcuucagcagacagcugagcagcaccagcccccuggcccccuaccccaccagccagauggugagcagcgacagaagccagcugagcuuccugcccaccgaggcccaggcccaggugagcccccccccccccuaccccgccccccaggagcugacccagccccugcugcagcagcccagagcccccgaggcccccgcccagcagccccaggccgccagcagccugccccagagcgacuuccagcugcugcccgcccagggcagcagccugaccaacuucuuccccgacgugggcuucgaccagcagagcaugagacccggccccgccuucccccagcaggugccccuggugcagcagggcagcagagagcugcaggacagcuuccaccugagacccagccccuacagcaacugcggcagccugcccaacaccauccugcccgacagcagcaccagccuguucaaggaccugaacagcgcccuggccggccugcccgaggugagccugaacguggacacccccuucccccuggaggaggagcugcagaucgagccccugagccuggacggccugaacaugcugagcgacagcagcaugggccugcuggaccccagcguggaggagaccuucagagccgacagacuguaa

SEQ ID NO: 15667 - RNA, 900 nt, Artificial Sequence
  CRX__Homo_sapiens__NP_000545
augauggccuacaugaaccccggcccccacuacagcgugaacgcccuggcccugagcggccccagcguggaccugaugcaccaggccgugcccuaccccagcgcccccagaaagcagagaagagagagaaccaccuucaccagaagccagcuggaggagcuggaggcccuguucgccaagacccaguaccccgacguguacgccagagaggagguggcccugaagaucaaccugcccgagagcagagugcaggugugguucaagaacagaagagccaagugcagacagcagagacagcagcagaagcagcagcagcagccccccggcggccaggccaaggccagacccgccaagagaaaggccggcaccagccccagacccagcaccgacgugugccccgacccccugggcaucagcgacagcuacagccccccccugcccggccccagcggcagccccaccaccgccguggccaccgugagcaucuggagccccgccagcgagagcccccugcccgaggcccagagagccggccugguggccagcggccccagccugaccagcgcccccuacgccaugaccuacgcccccgccagcgccuucugcagcagccccagcgccuacggcagccccagcagcuacuucagcggccuggaccccuaccugagccccauggugccccagcugggcggccccgcccugagcccccugagcggccccagcgugggccccagccuggcccagagccccaccagccugagcggccagagcuacggcgccuacagccccguggacagccuggaguucaaggaccccaccggcaccuggaaguucaccuacaaccccauggacccccuggacuacaaggaccagagcgccuggaaguuccagauccuguaa

SEQ ID NO: 15668 - RNA, 1761 nt, Artificial Sequence
  CRY1__Homo_sapiens__NP_004066
augggcgugaacgccgugcacugguucagaaagggccugagacugcacgacaaccccgcccugaaggagugcauccagggcgccgacaccaucagaugcguguacauccuggaccccugguucgccggcagcagcaacgugggcaucaacagauggagauuccugcugcagugccuggaggaccuggacgccaaccugagaaagcugaacagcagacuguucgugaucagaggccagcccgccgacguguuccccagacuguucaaggaguggaacaucaccaagcugagcaucgaguacgacagcgagcccuucggcaaggagagagacgccgccaucaagaagcuggccaccgaggccggcguggaggugaucgugagaaucagccacacccuguacgaccuggacaagaucaucgagcugaacggcggccagcccccccugaccuacaagagauuccagacccugaucagcaagauggagccccuggagauccccguggagaccaucaccagcgaggugaucgagaagugcaccaccccccugagcgacgaccacgacgagaaguacggcgugcccagccuggaggagcugggcuucgacaccgacggccugagcagcgccguguggcccggcggcgagaccgaggcccugaccagacuggagagacaccuggagagaaaggccuggguggccaacuucgagagacccagaaugaacgccaacagccugcuggccagccccaccggccugagccccuaccugagauucggcugccugagcugcagacuguucuacuucaagcugaccgaccuguacaagaaggugaagaagaacagcagccccccccugagccuguacggccagcugcuguggagagaguucuucuacaccgccgccaccaacaaccccagauucgacaagauggagggcaaccccaucugcgugcagauccccugggacaagaaccccgaggcccuggccaagugggccgagggcagaaccggcuuccccuggaucgacgccaucaugacccagcugagacaggagggcuggauccaccaccuggccagacacgccguggccugcuuccugaccagaggcgaccuguggaucagcugggaggagggcaugaagguguucgaggagcugcugcuggacgccgacuggagcaucaacgccggcagcuggauguggcugagcugcagcagcuucuuccagcaguucuuccacugcuacugccccgugggcuucggcagaagaaccgaccccaacggcgacuacaucagaagauaccugcccgugcugagaggcuuccccgccaaguacaucuacgaccccuggaacgcccccgagggcauccagaagguggccaagugccugaucggcgugaacuaccccaagcccauggugaaccacgccgaggccagcagacugaacaucgagagaaugaagcagaucuaccagcagcugagcagauacagaggccugggccugcuggccagcgugcccagcaaccccaacggcaacggcggcuucaugggcuacagcgccgagaacauccccggcugcagcagcagcggcagcugcagccagggcagcggcauccugcacuacgcccacggcgacagccagcagacccaccugcugaagcagggcagaagcagcaugggcaccggccugagcggcggcaagagacccagccaggaggaggacacccagagcaucggccccaaggugcagagacagagcaccaacuaa

SEQ ID NO: 15669 - RNA, 1599 nt, Artificial Sequence
  CRY2__Homo_sapiens__NP_001120929
augcccgccccccccggcagaacccacaccugguuccugcugcagagccuggaggaccuggacaccagccugagaaagcugaacagcagacuguucguggugagaggccagcccgccgacguguuccccagacuguucaaggaguggggcgugaccagacugaccuucgaguacgacagcgagcccuucggcaaggagagagacgccgccaucaugaagauggccaaggaggccggcguggagguggugaccgagaacagccacacccuguacgaccuggacagaaucaucgagcugaacggccagaagcccccccugaccuacaagagauuccaggccaucaucagcagaauggagcugcccaagaagcccgugggccuggugaccagccagcagauggagagcugcagagccgagauccaggagaaccacgacgagaccuacggcgugcccagccuggaggagcugggcuuccccaccgagggccugggccccgccguguggcagggcggcgagaccgaggcccuggccagacuggacaagcaccuggagagaaaggccuggguggccaacuacgagagacccagaaugaacgccaacagccugcuggccagccccaccggccugagccccuaccugagauucggcugccugagcugcagacuguucuacuacagacugugggaccuguacaagaaggugaagagaaacagcacccccccccugagccuguucggccagcugcuguggagagaguucuucuacaccgccgccaccaacaaccccagauucgacagaauggagggcaaccccaucugcauccagauccccugggacagaaaccccgaggcccuggccaagugggccgagggcaagaccggcuuccccuggaucgacgccaucaugacccagcugagacaggagggcuggauccaccaccuggccagacacgccguggccugcuuccugaccagaggcgaccugugggugagcugggagagcggcgugagaguguucgacgagcugcugcuggacgccgacuucagcgugaacgccggcagcuggauguggcugagcugcagcgccuucuuccagcaguucuuccacugcuacugccccgugggcuucggcagaagaaccgaccccagcggcgacuacaucagaagauaccugcccaagcugaaggccuuccccagcagauacaucuacgagcccuggaacgcccccgagagcauccagaaggccgccaagugcaucaucggcguggacuaccccagacccaucgugaaccacgccgagaccagcagacugaacaucgagagaaugaagcagaucuaccagcagcugagcagauacagaggccugugccugcuggccagcgugcccagcugcguggaggaccugagccaccccguggccgagcccagcagcagccaggccggcagcaugagcagcgccggccccagaccccugcccagcggccccgccagccccaagagaaagcuggaggccgccgaggagccccccggcgaggagcugagcaagagagccagaguggccgagcugcccacccccgagcugcccagcaaggacgccuaa

SEQ ID NO: 15670 - RNA, 528 nt, Artificial Sequence
  CRYAB__Homo_sapiens__NP_001276737
auggacaucgccauccaccaccccuggaucagaagacccuucuuccccuuccacagccccagcagacuguucgaccaguucuucggcgagcaccugcuggagagcgaccuguuccccaccagcaccagccugagccccuucuaccugagaccccccagcuuccugagagcccccagcugguucgacaccggccugagcgagaugagacuggagaaggacagauucagcgugaaccuggacgugaagcacuucagccccgaggagcugaaggugaaggugcugggcgacgugaucgaggugcacggcaagcacgaggagagacaggacgagcacggcuucaucagcagagaguuccacagaaaguacagaauccccgccgacguggacccccugaccaucaccagcagccugagcagcgacggcgugcugaccgugaacggccccagaaagcaggugagcggccccgagagaaccauccccaucaccagagaggagaagcccgccgugaccgccgcccccaagaaguaa

SEQ ID NO: 15671 - RNA, 648 nt, Artificial Sequence
  CRYBA1__Homo_sapiens__NP_005199
auggagacccaggccgagcagcaggagcuggagacccugcccaccaccaagauggcccagaccaaccccacccccggcagccugggccccuggaagaucaccaucuacgaccaggagaacuuccagggcaagagaauggaguucaccagcagcugccccaacgugagcgagagaagcuucgacaacgugagaagccugaagguggagagcggcgccuggaucggcuacgagcacaccagcuucugcggccagcaguucauccuggagagaggcgaguaccccagaugggacgccuggagcggcagcaacgccuaccacaucgagagacugaugagcuucagacccaucugcagcgccaaccacaaggagagcaagaugaccaucuucgagaaggagaacuucaucggcagacagugggagaucagcgacgacuaccccagccugcaggccaugggcugguucaacaacgaggugggcagcaugaagauccagagcggcgccugggugugcuaccaguaccccggcuacagaggcuaccaguacauccuggagugcgaccaccacggcggcgacuacaagcacuggagagaguggggcagccacgcccagaccagccagauccagagcaucagaagaauccagcaguaa

SEQ ID NO: 15672 - RNA, 594 nt, Artificial Sequence
  CRYBA2__Homo_sapiens__NP_476434
augagcagcgcccccgcccccggccccgcccccgccagccugacccugugggacgaggaggacuuccagggcagaagaugcagacugcugagcgacugcgccaacgugugcgagagaggcggccugcccagagugagaagcgugaagguggagaacggcguguggguggccuucgaguaccccgacuuccagggccagcaguucauccuggagaagggcgacuaccccagauggagcgccuggagcggcagcagcagccacaacagcaaccagcugcugagcuucagacccgugcugugcgccaaccacaacgacagcagagugacccuguucgagggcgacaacuuccagggcugcaaguucgaccugguggacgacuaccccagccugcccagcaugggcugggccagcaaggacgugggcagccugaaggugagcagcggcgccuggguggccuaccaguaccccggcuacagaggcuaccaguacgugcuggagagagacagacacagcggcgaguucugcaccuacggcgagcugggcacccaggcccacaccggccagcugcagagcaucagaagagugcagcacuaa

SEQ ID NO: 15673 - RNA, 591 nt, Artificial Sequence
  CRYBA4__Homo_sapiens__NP_001877
augacccugcagugcaccaagagcgccggccccuggaagaugguggugugggacgaggacggcuuccagggcagaagacacgaguucaccgccgagugccccagcgugcuggagcugggcuucgagaccgugagaagccugaaggugcugagcggcgccugggugggcuucgagcacgccggcuuccagggccagcaguacauccuggagagaggcgaguaccccagcugggacgccuggggcggcaacaccgccuaccccgccgagagacugaccagcuucagacccgccgccugcgccaaccacagagacagcagacugaccaucuucgagcaggagaacuuccugggcaagaagggcgagcugagcgacgacuaccccagccugcaggccaugggcugggagggcaacgaggugggcagcuuccacgugcacagcggcgccugggugugcagccaguuccccggcuacagaggcuuccaguacgugcuggagugcgaccaccacagcggcgacuacaagcacuucagagaguggggcagccacgcccccaccuuccaggugcagagcaucagaagaauccagcaguaa

SEQ ID NO: 15674 - RNA, 759 nt, Artificial Sequence
  CRYBB1__Homo_sapiens__NP_001878
augagccaggccgccaaggccagcgccagcgccaccguggccgugaaccccggccccgacaccaagggcaagggcgccccccccgccggcaccagccccagccccggcaccacccuggcccccaccaccgugcccaucaccagcgccaaggccgccgagcugccccccggcaacuacagacuggugguguucgagcuggagaacuuccagggcagaagagccgaguucagcggcgagugcagcaaccuggccgacagaggcuucgacagagugagaagcaucaucgugagcgccggccccuggguggccuucgagcagagcaacuucagaggcgagauguucauccuggagaagggcgaguaccccagauggaacaccuggagcagcagcuacagaagcgacagacugaugagcuucagacccaucaagauggacgcccaggagcacaagaucagccuguucgagggcgccaacuucaagggcaacaccaucgagauccagggcgacgacgcccccagccuguggguguacggcuucagcgacagagugggcagcgugaaggugagcagcggcaccugggugggcuaccaguaccccggcuacagaggcuaccaguaccugcuggagcccggcgacuucagacacuggaacgaguggggcgccuuccagccccagaugcagagccugagaagacugagagacaagcaguggcaccuggagggcagcuuccccgugcuggccaccgagccccccaaguaa

SEQ ID NO: 15675 - RNA, 618 nt, Artificial Sequence
  CRYBB2__Homo_sapiens__NP_000487
auggccagcgaccaccagacccaggccggcaagccccagagccugaaccccaagaucaucaucuucgagcaggagaacuuccagggccacagccacgagcugaacggccccugccccaaccugaaggagaccggcguggagaaggccggcagcgugcuggugcaggccggccccugggugggcuacgagcaggccaacugcaagggcgagcaguucguguucgagaagggcgaguaccccagaugggacagcuggaccagcagcagaagaaccgacagccugagcagccugagacccaucaagguggacagccaggagcacaagaucauccuguacgagaaccccaacuucaccggcaagaagauggagaucaucgacgacgacgugcccagcuuccacgcccacggcuaccaggagaaggugagcagcgugagagugcagagcggcaccugggugggcuaccaguaccccggcuacagaggccugcaguaccugcuggagaagggcgacuacaaggacagcagcgacuucggcgccccccacccccaggugcagagcgugagaagaaucagagacaugcaguggcaccagagaggcgccuuccaccccagcaacuaa

SEQ ID NO: 15676 - RNA, 636 nt, Artificial Sequence
  CRYBB3__Homo_sapiens__NP_004067
auggccgagcagcacggcgcccccgagcaggccgccgccggcaagagccacggcgaccugggcggcagcuacaaggugauccuguacgagcuggagaacuuccagggcaagagaugcgagcugagcgccgagugccccagccugaccgacagccugcuggagaaggugggcagcauccagguggagagcggccccuggcuggccuucgagagcagagccuucagaggcgagcaguucgugcuggagaagggcgacuaccccagaugggacgccuggagcaacagcagagacagcgacagccugcugagccugagaccccugaacaucgacagcccccaccacaagcugcaccuguucgagaaccccgccuucagcggcagaaagauggagaucguggacgacgacgugcccagccugugggcccacggcuuccaggacagaguggccagcgugagagccaucaacggcaccugggugggcuacgaguuccccggcuacagaggcagacaguacguguucgagagaggcgaguacagacacuggaacgagugggacgccagccagccccagcugcagagcgugagaagaaucagagaccagaaguggcacaagagaggcagauuccccagcagcuaa

SEQ ID NO: 15677 - RNA, 528 nt, Artificial Sequence
  CRYGB__Homo_sapiens__NP_005201
augggcaagaucaccuucuacgaggacagagccuuccagggcagaagcuacgagugcaccaccgacugccccaaccugcagcccuacuucagcagaugcaacagcaucagaguggagagcggcugcuggaugaucuacgagagacccaacuaccagggccaccaguacuuccugagaagaggcgaguaccccgacuaccagcaguggaugggccugagcgacagcaucagaagcugcugccugauccccccccacagcggcgccuacagaaugaagaucuacgacagagacgagcugagaggccagaugagcgagcugaccgacgacugcaucagcgugcaggacagauuccaccugaccgagauccacagccugaacgugcuggagggcagcuggauccuguacgagaugcccaacuacagaggcagacaguaccugcugagacccggcgaguacagaagauuccuggacuggggcgcccccaacgccaaggugggcagccugagaagagugauggaccuguacuaa

SEQ ID NO: 15678 - RNA, 525 nt, Artificial Sequence
  CRYGC__Homo_sapiens__NP_066269
augggcaagaucaccuucuacgaggacagagccuuccagggcagaagcuacgagaccaccaccgacugccccaaccugcagcccuacuucagcagaugcaacagcaucagaguggagagcggcugcuggaugcuguacgagagacccaacuaccagggccagcaguaccugcugagaagaggcgaguaccccgacuaccagcaguggaugggccugagcgacagcaucagaagcugcugccugaucccccagaccgugagccacagacugagacuguacgagagagaggaccacaagggccugaugauggagcugagcgaggacugccccagcauccaggacagauuccaccugagcgagaucagaagccugcacgugcuggagggcugcugggugcuguacgagcugcccaacuacagaggcagacaguaccugcugagaccccaggaguacagaagaugccaggacuggggcgccauggacgccaaggccggcagccugagaagagugguggaccuguacuaa

SEQ ID NO: 15679 - RNA, 525 nt, Artificial Sequence
  CRYGD__Homo_sapiens__NP_008822
augggcaagaucacccuguacgaggacagaggcuuccagggcagacacuacgagugcagcagcgaccaccccaaccugcagcccuaccugagcagaugcaacagcgccagaguggacagcggcugcuggaugcuguacgagcagcccaacuacagcggccugcaguacuuccugagaagaggcgacuacgccgaccaccagcaguggaugggccugagcgacagcgugagaagcugcagacugaucccccacagcggcagccacagaaucagacuguacgagagagaggacuacagaggccagaugaucgaguucaccgaggacugcagcugccugcaggacagauucagauucaacgagauccacagccugaacgugcuggagggcagcugggugcuguacgagcugagcaacuacagaggcagacaguaccugcugaugcccggcgacuacagaagauaccaggacuggggcgccaccaacgccagagugggcagccugagaagagugaucgacuucagcuaa

SEQ ID NO: 15680 - RNA, 537 nt, Artificial Sequence
  CRYGS__Homo_sapiens__NP_060011
augagcaagaccggcaccaagaucaccuucuacgaggacaagaacuuccagggcagaagauacgacugcgacugcgacugcgccgacuuccacaccuaccugagcagaugcaacagcaucaagguggagggcggcaccugggccguguacgagagacccaacuucgccggcuacauguacauccugccccagggcgaguaccccgaguaccagagauggaugggccugaacgacagacugagcagcugcagagccgugcaccugcccagcggcggccaguacaagauccagaucuucgagaagggcgacuucagcggccagauguacgagaccaccgaggacugccccagcaucauggagcaguuccacaugagagagauccacagcugcaaggugcuggagggcguguggaucuucuacgagcugcccaacuacagaggcagacaguaccugcuggacaagaaggaguacagaaagcccaucgacuggggcgccgccagccccgccgugcagagcuucagaagaaucguggaguaa

SEQ ID NO: 15681 - RNA, 960 nt, Artificial Sequence
  CRYL1__Homo_sapiens__NP_057058
auggccagcagcgccgccggcugcguggugaucgugggcagcggcgugaucggcagaagcugggccaugcuguucgccagcggcggcuuccaggugaagcuguacgacaucgagcagcagcagaucagaaacgcccuggagaacaucagaaaggagaugaagcugcuggagcaggccggcagccugaagggcagccugagcguggaggagcagcugagccugaucagcggcugccccaacauccaggaggccguggagggcgccaugcacauccaggagugcgugcccgaggaccuggagcugaagaagaagaucuucgcccagcuggacagcaucaucgacgacagagugauccugagcagcagcaccagcugccugaugcccagcaagcuguucgccggccuggugcacgugaagcagugcaucguggcccaccccgugaacccccccuacuacaucccccugguggagcuggugccccaccccgagaccgcccccaccaccguggacagaacccacgcccugaugaagaagaucggccagugccccaugagagugcagaaggagguggccggcuucgugcugaacagacugcaguacgccaucaucagcgaggccuggagacugguggaggagggcaucgugagccccagcgaccuggaccuggugaugagcgagggccugggcaugagauacgccuucaucggcccccuggagaccaugcaccugaacgccgagggcaugcugagcuacugcgacagauacagcgagggcaucaagcacgugcugcagaccuucggccccauccccgaguucagcagagccaccgccgagaaggugaaccaggacaugugcaugaaggugcccgacgaccccgagcaccuggccgccagaagacaguggagagacgagugccugaugagacuggccaagcugaagagccaggugcagccccaguaa

SEQ ID NO: 15682 - RNA, 945 nt, Artificial Sequence
  CRYM__Homo_sapiens__NP_001879
augagcagagugcccgccuuccugagcgccgccgagguggaggagcaccugagaagcagcagccugcugauccccccccuggagaccgcccuggccaacuucagcagcggccccgagggcggcgugaugcagcccgugagaaccguggugcccgugaccaagcacagaggcuaccugggcgugaugcccgccuacagcgccgccgaggacgcccugaccaccaagcuggugaccuucuacgaggacagaggcaucaccagcguggugcccagccaccaggccaccgugcugcuguucgagcccagcaacggcacccugcuggccgugauggacggcaacgugaucaccgccaagagaaccgccgccgugagcgccaucgccaccaaguuccugaagccccccagcagcgaggugcugugcauccugggcgccggcgugcaggccuacagccacuacgagaucuucaccgagcaguucagcuucaaggaggugagaaucuggaacagaaccaaggagaacgccgagaaguucgccgacaccgugcagggcgaggugagagugugcagcagcgugcaggaggccguggccggcgccgacgugaucaucaccgugacccuggccaccgagcccauccuguucggcgagugggugaagcccggcgcccacaucaacgccgugggcgccagcagacccgacuggagagagcuggacgacgagcugaugaaggaggccgugcuguacguggacagccaggaggccgcccugaaggagagcggcgacgugcugcugagcggcgccgagaucuucgccgagcugggcgaggugaucaagggcgugaagcccgcccacugcgagaagaccaccguguucaagagccugggcauggccguggaggacaccguggccgccaagcugaucuacgacagcuggagcagcggcaaguaa

SEQ ID NO: 15683 - RNA, 1050 nt, Artificial Sequence
  CRYZL1__Homo_sapiens__NP_665857
augaagggccuguacuuccagcagagcagcaccgacgaggagaucaccuucguguuccaggagaaggaggaccugcccgugaccgaggacaacuucgugaagcugcaggugaaggccugcgcccugagccagaucaacaccaagcugcuggccgagaugaagaugaagaaggaccuguuccccgugggcagagagaucgccggcaucgugcuggacgugggcagcaaggugagcuucuuccagcccgacgacgagguggugggcauccugccccuggacagcgaggaccccggccugugcgagguggugagagugcacgagcacuaccuggugcacaagcccgagaaggugaccuggaccgaggccgccggcagcaucagagacggcgugagagccuacaccgcccugcacuaccugagccaccugagccccggcaagagcgugcugaucauggacggcgccagcgccuucggcaccaucgccauccagcuggcccaccacagaggcgccaaggugaucagcaccgccugcagccuggaggacaagcagugccuggagagauucagaccccccaucgccagagugaucgacgugagcaacggcaaggugcacguggccgagagcugccuggaggagaccggcggccugggcguggacaucgugcuggacgccggcgugagacuguacagcaaggacgacgagcccgccgugaagcugcagcugcugccccacaagcacgacaucaucacccugcugggcgugggcggccacugggugaccaccgaggagaaccugcagcuggacccccccgacagccacugccuguuccugaagggcgccacccuggccuuccugaacgacgagguguggaaccugagcaacgugcagcagggcaaguaccugugcauccugaaggacgugauggagaagcugagcaccggcguguucagaccccagcuggacgagcccaucccccuguacgaggccaaggugagcauggaggccgugcagaagaaccagggcagaaagaagcagguggugcaguucuaa

SEQ ID NO: 15684 - RNA, 1482 nt, Artificial Sequence
  CSAD__Homo_sapiens__NP_001231634
auggccgacagcgaggcccugcccagccuggccggcgaccccguggccguggaggcccugcugagagccguguucggcguggugguggacgaggccauccagaagggcaccagcgugagccagaaggugugcgaguggaaggagcccgaggagcugaagcagcugcuggaccuggagcugagaagccagggcgagagccagaagcagauccuggagagaugcagagccgugaucagauacagcgugaagaccggccaccccagauucuucaaccagcuguucagcggccuggacccccacgcccuggccggcagaaucaucaccgagagccugaacaccagccaguacaccuacgagaucgcccccguguucgugcugauggaggaggaggugcugagaaagcugagagcccuggugggcuggagcagcggcgacggcaucuucugccccggcggcagcaucagcaacauguacgccgugaaccuggccagauaccagagauaccccgacugcaagcagagaggccugagaacccugcccccccuggcccuguucaccagcaaggagugccacuacagcauccagaagggcgccgccuuccugggccugggcaccgacagcgugagaguggugaaggccgacgagagaggcaagauggugcccgaggaccuggagagacagaucggcauggccgaggccgagggcgccgugcccuuccuggugagcgccaccagcggcaccaccgugcugggcgccuucgacccccuggaggccaucgccgacgugugccagagacacggccuguggcugcacguggacgccgccuggggcggcagcgugcugcugagccagacccacagacaccugcuggacggcauccagagagccgacagcguggccuggaacccccacaagcugcuggccgccggccugcagugcagcgcccugcugcugcaggacaccagcaaccugcugaagagaugccacggcagccaggccagcuaccuguuccagcaggacaaguucuacgacguggcccuggacaccggcgacaagguggugcagugcggcagaagaguggacugccugaagcuguggcugauguggaaggcccagggcgaccagggccuggagagaagaaucgaccaggccuucgugcuggccagauaccugguggaggagaugaagaagagagagggcuucgagcuggugauggagcccgaguucgugaacgugugcuucugguucgugccccccagccugagaggcaagcaggagagccccgacuaccacgagagacugagcaagguggcccccgugcugaaggagagaauggugaaggagggcagcaugaugaucggcuaccagccccacggcaccagaggcaacuucuucagaguggugguggccaacagcgcccugaccugcgccgacauggacuuccugcugaacgagcuggagagacugggccaggaccuguaa

SEQ ID NO: 15685 - RNA, 333 nt, Artificial Sequence
  CSAG3__Homo_sapiens__NP_001123300
auguggaugggccugauccagcugguggagggcgugaagagaaaggaccagggcuuccuggagaaggaguucuaccacaagaccaacaucaagaugagaugcgaguuccuggccugcuggcccgccuucaccgugcugggcgaggccuggagagaccagguggacuggagcagacugcugagagacgccggccuggugaagaugagcagaaagcccagagccagcagcccccugagcaacaaccacccccccacccccaagagauuccccagacagcccggcagagagaagggccccaucaaggaggugcccggcaccaagggcagccccuaa

SEQ ID NO: 15686 - RNA, 2748 nt, Artificial Sequence
  CSE1L__Homo_sapiens__NP_001243064
auggagcugagcgacgccaaccugcagacccugaccgaguaccugaagaagacccuggaccccgaccccgccaucagaagacccgccgagaaguuccuggagagcguggagggcaaccagaacuacccccugcugcugcugacccugcuggagaagagccaggacaacgugaucaaggugugcgccagcgugaccuucaagaacuacaucaagagaaacuggagaaucguggaggacgagcccaacaagaucugcgaggccgacagaguggccaucaaggccaacaucgugcaccugaugcugagcagccccgagcagauccagaagcagcugagcgacgccaucagcaucaucggcagagaggacuucccccagaaguggcccgaccugcugaccgagauggugaacagauuccagagcggcgacuuccacgugaucaacggcgugcugagaaccgcccacagccuguucaagagauacagacacgaguucaagagcaacgagcuguggaccgagaucaagcuggugcuggacgccuucgcccugccccugaccaaccuguucaaggccaccaucgagcugugcagcacccacgccaacgacgccagcgcccugagaauccuguucagcagccugauccugaucagcaagcuguucuacagccugaacuuccaggaccugcccgaguucuucgaggacaacauggagaccuggaugaacaacuuccacacccugcugacccuggacaacaagcugcugcagaccgaccuggugagcaacgccauccaguuccuggccagcgugugcgagagaccccacuacaagaaccuguucgaggaccagaacacccugaccagcaucugcgagaaggugaucgugcccaacauggaguucagagccgccgacgaggaggccuucgaggacaacagcgaggaguacaucagaagagaccuggagggcagcgacaucgacaccagaagaagagccgccugcgaccuggugagaggccugugcaaguucuucgagggccccgugaccggcaucuucagcggcuacgugaacagcaugcugcaggaguacgccaagaaccccagcgugaacuggaagcacaaggacgccgccaucuaccuggugaccagccuggccagcaaggcccagacccagaagcacggcaucacccaggccaacgagcuggugaaccugaccgaguucuucgugaaccacauccugcccgaccugaagagcgccaacgugaacgaguuccccgugcugaaggccgacggcaucaaguacaucaugaucuucagaaaccaggugcccaaggagcaccugcuggugagcaucccccugcugaucaaccaccugcaggccgagagcaucguggugcacaccuacgccgcccacgcccuggagagacuguucaccaugagaggccccaacaacgccacccuguucaccgccgccgagaucgcccccuucguggagauccugcugaccaaccuguucaaggcccugacccugcccggcagcagcgagaacgaguacaucaugaaggccaucaugagaagcuucagccugcugcaggaggccaucauccccuacauccccacccugaucacccagcugacccagaagcugcuggccgugagcaagaaccccagcaagccccacuucaaccacuacauguucgaggccaucugccugagcaucagaaucaccugcaaggccaaccccgccgccguggugaacuucgaggaggcccuguuccugguguucaccgagauccugcagaacgacgugcaggaguucauccccuacguguuccaggugaugagccugcugcuggagacccacaagaacgacauccccagcagcuacauggcccuguucccccaccugcugcagcccgugcugugggagagaaccggcaacauccccgcccuggugagacugcugcaggccuuccuggagagaggcagcaacaccaucgccagcgccgccgccgacaagauccccggccugcugggcguguuccagaagcugaucgccagcaaggccaacgaccaccagggcuucuaccugcugaacagcaucaucgagcacaugccccccgagagcguggaccaguacagaaagcagaucuucauccugcuguuccagagacugcagaacagcaagaccaccaaguucaucaagagcuuccugguguucaucaaccuguacugcaucaaguacggcgcccuggcccugcaggagaucuucgacggcauccagcccaagauguucggcauggugcuggagaagaucaucauccccgagauccagaaggugagcggcaacguggagaagaagaucugcgccgugggcaucaccaagcugcugaccgagugcccccccaugauggacaccgaguacaccaagcuguggaccccccugcugcagagccugaucggccuguucgagcugcccgaggacgacaccauccccgacgaggagcacuucaucgacaucgaggacacccccggcuaccagaccgccuucagccagcuggccuucgccggcaagaaggagcacgaccccgugggccagauggugaacaaccccaagauccaccuggcccagagccugcacaagcugagcaccgccugccccggcagagugcccagcauggugagcaccagccugaacgccgaggcccugcaguaccugcagggcuaccugcaggccgccagcgugacccugcuguaa

SEQ ID NO: 15687 - RNA, 2919 nt, Artificial Sequence
  CSF1R__Homo_sapiens__NP_005202
augggccccggcgugcugcugcugcugcugguggccaccgccuggcacggccagggcauccccgugaucgagcccagcgugcccgagcugguggugaagcccggcgccaccgugacccugagaugcgugggcaacggcagcguggagugggacggcccccccagcccccacuggacccuguacagcgacggcagcagcagcauccugagcaccaacaacgccaccuuccagaacaccggcaccuacagaugcaccgagcccggcgacccccugggcggcagcgccgccauccaccuguacgugaaggaccccgccagacccuggaacgugcuggcccaggagguggugguguucgaggaccaggacgcccugcugcccugccugcugaccgaccccgugcuggaggccggcgugagccuggugagagugagaggcagaccccugaugagacacaccaacuacagcuucagccccuggcacggcuucaccauccacagagccaaguucauccagagccaggacuaccagugcagcgcccugaugggcggcagaaaggugaugagcaucagcaucagacugaaggugcagaaggugauccccggcccccccgcccugacccuggugcccgccgagcuggugagaaucagaggcgaggccgcccagaucgugugcagcgccagcagcguggacgugaacuucgacguguuccugcagcacaacaacaccaagcuggccaucccccagcagagcgacuuccacaacaacagauaccagaaggugcugacccugaaccuggaccagguggacuuccagcacgccggcaacuacagcugcguggccagcaacgugcagggcaagcacagcaccagcauguucuucagagugguggagagcgccuaccugaaccugagcagcgagcagaaccugauccaggaggugaccgugggcgagggccugaaccugaaggugaugguggaggccuaccccggccugcagggcuucaacuggaccuaccugggccccuucagcgaccaccagcccgagcccaagcuggccaacgccaccaccaaggacaccuacagacacaccuucacccugagccugcccagacugaagcccagcgaggccggcagauacagcuuccuggccagaaaccccggcggcuggagagcccugaccuucgagcugacccugagauacccccccgaggugagcgugaucuggaccuucaucaacggcagcggcacccugcugugcgccgccagcggcuacccccagcccaacgugaccuggcugcagugcagcggccacaccgacagaugcgacgaggcccaggugcugcaggugugggacgaccccuaccccgaggugcugagccaggagcccuuccacaaggugaccgugcagagccugcugaccguggagacccuggagcacaaccagaccuacgagugcagagcccacaacagcgugggcagcggcagcugggccuucauccccaucagcgccggcgcccacacccacccccccgacgaguuccuguucacccccguggugguggccugcaugagcaucauggcccugcugcugcugcugcugcugcugcugcuguacaaguacaagcagaagcccaaguaccaggugagauggaagaucaucgagagcuacgagggcaacagcuacaccuucaucgaccccacccagcugcccuacaacgagaagugggaguuccccagaaacaaccugcaguucggcaagacccugggcgccggcgccuucggcaaggugguggaggccaccgccuucggccugggcaaggaggacgccgugcugaagguggccgugaagaugcugaagagcaccgcccacgccgacgagaaggaggcccugaugagcgagcugaagaucaugagccaccugggccagcacgagaacaucgugaaccugcugggcgccugcacccacggcggccccgugcuggugaucaccgaguacugcugcuacggcgaccugcugaacuuccugagaagaaaggccgaggccaugcugggccccagccugagccccggccaggaccccgagggcggcguggacuacaagaacauccaccuggagaagaaguacgugagaagagacagcggcuucagcagccagggcguggacaccuacguggagaugagacccgugagcaccagcagcaacgacagcuucagcgagcaggaccuggacaaggaggacggcagaccccuggagcugagagaccugcugcacuucagcagccagguggcccagggcauggccuuccuggccagcaagaacugcauccacagagacguggccgccagaaacgugcugcugaccaacggccacguggccaagaucggcgacuucggccuggccagagacaucaugaacgacagcaacuacaucgugaagggcaacgccagacugcccgugaaguggauggcccccgagagcaucuucgacugcguguacaccgugcagagcgacguguggagcuacggcauccugcugugggagaucuucagccugggccugaaccccuaccccggcauccuggugaacagcaaguucuacaagcuggugaaggacggcuaccagauggcccagcccgccuucgcccccaagaacaucuacagcaucaugcaggccugcugggcccuggagcccacccacagacccaccuuccagcagaucugcagcuuccugcaggagcaggcccaggaggacagaagagagagagacuacaccaaccugcccagcagcagcagaagcggcggcagcggcagcagcagcagcgagcuggaggaggagagcagcagcgagcaccugaccugcugcgagcagggcgacaucgcccagccccugcugcagcccaacaacuaccaguucugcuaa

SEQ ID NO: 15688 - RNA, 435 nt, Artificial Sequence
  CSF2__Homo_sapiens__NP_000749
auguggcugcagagccugcugcugcugggcaccguggccugcagcaucagcgcccccgccagaagccccagccccagcacccagcccugggagcacgugaacgccauccaggaggccagaagacugcugaaccugagcagagacaccgccgccgagaugaacgagaccguggaggugaucagcgagauguucgaccugcaggagcccaccugccugcagaccagacuggagcuguacaagcagggccugagaggcagccugaccaagcugaagggcccccugaccaugauggccagccacuacaagcagcacugcccccccacccccgagaccagcugcgccacccagaucaucaccuucgagagcuucaaggagaaccugaaggacuuccugcuggugauccccuucgacugcugggagcccgugcaggaguaa

SEQ ID NO: 15689 - RNA, 1305 nt, Artificial Sequence
  CSF2RA__Homo_sapiens__NP_001155002
augcugcugcuggugaccagccugcugcugugcgagcugccccaccccgccuuccugcugauccccgagaagagcgaccugagaaccguggcccccgccagcagccugaacgugagauucgacagcagaaccaugaaccugagcugggacugccaggagaacaccaccuucagcaagugcuuccugaccgacaagaagaacagagugguggagcccagacugagcaacaacgagugcagcugcaccuucagagagaucugccugcacgagggcgugaccuucgaggugcacgugaacaccagccagagaggcuuccagcagaagcugcuguaccccaacagcggcagagagggcaccgccgcccagaacuucagcugcuucaucuacaacgccgaccugaugaacugcaccugggccagaggccccaccgcccccagagacgugcaguacuuccuguacaucagaaacagcaagagaagaagagagaucagaugccccuacuacauccaggacagcggcacccacgugggcugccaccuggacaaccugagcggccugaccagcagaaacuacuuccuggugaacggcaccagcagagagaucggcauccaguucuucgacagccugcuggacaccaagaagaucgagagauucaacccccccagcaacgugaccgugagaugcaacaccacccacugccuggugagauggaagcagcccagaaccuaccagaagcugagcuaccuggacuuccaguaccagcuggacgugcacagaaagaacacccagcccggcaccgagaaccugcugaucaacgugagcggcgaccuggagaacagauacaacuuccccagcagcgagcccagagccaagcacagcgugaagaucagagccgccgacgugagaauccugaacuggagcagcuggagcgaggccaucgaguucggcagccacagcgugacccaggccggcgugcaguggcacaaccugggcagccugcagccccccagccccagacugaagagauucagcugccugagacugcccggcagcgacgacggcaaccugggcagcguguacaucuacgugcugcugaucgugggcacccuggugugcggcaucgugcugggcuuccuguucaagagauuccugagaauccagagacuguucccccccgugccccagaucaaggacaagcugaacgacaaccacgagguggaggacgagaucaucugggaggaguucacccccgaggagggcaagggcuacagagaggaggugcugaccgugaaggagaucaccuaa

SEQ ID NO: 15690 - RNA, 2694 nt, Artificial Sequence
  CSF2RB__Homo_sapiens__NP_000386
auggugcuggcccagggccugcugagcauggcccugcuggcccugugcugggagagaagccuggccggcgccgaggagaccaucccccugcagacccugagaugcuacaacgacuacaccagccacaucaccugcagaugggccgacacccaggacgcccagagacuggugaacgugacccugaucagaagagugaacgaggaccugcuggagcccgugagcugcgaccugagcgacgacaugcccuggagcgccugcccccaccccagaugcgugcccagaagaugcgugauccccugccagagcuucguggugaccgacguggacuacuucagcuuccagcccgacagaccccugggcaccagacugaccgugacccugacccagcacgugcagccccccgagcccagagaccugcagaucagcaccgaccaggaccacuuccugcugaccuggagcguggcccugggcagcccccagagccacuggcugagccccggcgaccuggaguucgaggugguguacaagagacugcaggacagcugggaggacgccgccauccugcugagcaacaccagccaggccacccugggccccgagcaccugaugcccagcagcaccuacguggccagagugagaaccagacuggcccccggcagcagacugagcggcagacccagcaaguggagccccgaggugugcugggacagccagcccggcgacgaggcccagccccagaaccuggagugcuucuucgacggcgccgccgugcugagcugcagcugggaggugagaaaggagguggccagcagcgugagcuucggccuguucuacaagcccagccccgacgccggcgaggaggagugcagccccgugcugagagagggccugggcagccugcacaccagacaccacugccagauccccgugcccgaccccgccacccacggccaguacaucgugagcgugcagcccagaagagccgagaagcacaucaagagcagcgugaacauccagauggccccccccagccugaacgugaccaaggacggcgacagcuacagccugagaugggagaccaugaagaugagauacgagcacaucgaccacaccuucgagauccaguacagaaaggacaccgccaccuggaaggacagcaagaccgagacccugcagaacgcccacagcauggcccugcccgcccuggagcccagcaccagauacugggccagagugagagugagaaccagcagaaccggcuacaacggcaucuggagcgaguggagcgaggccagaagcugggacaccgagagcgugcugcccaugugggugcuggcccugaucgugaucuuccugaccaucgccgugcugcuggcccugagauucugcggcaucuacggcuacagacugagaagaaagugggaggagaagauccccaaccccagcaagagccaccuguuccagaacggcagcgccgagcuguggccccccggcagcaugagcgccuucaccagcggcagccccccccaccagggccccuggggcagcagauuccccgagcuggagggcguguuccccgugggcuucggcgacagcgaggugagcccccugaccaucgaggaccccaagcacgugugcgacccccccagcggccccgacaccacccccgccgccagcgaccugcccaccgagcagccccccagcccccagcccggcccccccgccgccagccacacccccgagaagcaggccagcagcuucgacuucaacggccccuaccugggccccccccacagcagaagccugcccgacauccugggccagcccgagcccccccaggagggcggcagccagaagagccccccccccggcagccuggaguaccugugccugcccgccggcggccaggugcagcuggugccccuggcccaggccaugggccccggccaggccguggagguggagagaagacccagccagggcgccgccggcagccccagccuggagagcggcggcggccccgccccccccgcccugggccccagagugggcggccaggaccagaaggacagccccguggccauccccaugagcagcggcgacaccgaggaccccggcguggccagcggcuacgugagcagcgccgaccugguguucacccccaacagcggcgccagcagcgugagccuggugcccagccugggccugcccagcgaccagacccccagccugugccccggccuggccagcggcccccccggcgcccccggccccgugaagagcggcuucgagggcuacguggagcugccccccaucgagggcagaagccccagaagccccagaaacaaccccgugccccccgaggccaagagccccgugcugaaccccggcgagagacccgccgacgugagccccaccagcccccagcccgagggccugcuggugcugcagcaggugggcgacuacugcuuccugcccggccugggccccggcccccugagccugagaagcaagcccagcagccccggccccggccccgagaucaagaaccuggaccaggccuuccaggugaagaagccccccggccaggccgugccccaggugcccgugauccagcuguucaaggcccugaagcagcaggacuaccugagccugccccccugggaggugaacaagcccggcgaggugugcuaa

SEQ ID NO: 15691 - RNA, 624 nt, Artificial Sequence
  CSF3__Homo_sapiens__NP_000750
auggccggccccgccacccagagccccaugaagcugauggcccugcagcugcugcuguggcacagcgcccuguggaccgugcaggaggccaccccccugggccccgccagcagccugccccagagcuuccugcugaagugccuggagcaggugagaaagauccagggcgacggcgccgcccugcaggagaagcuggugagcgagugcgccaccuacaagcugugccaccccgaggagcuggugcugcugggccacagccugggcauccccugggccccccugagcagcugccccagccaggcccugcagcuggccggcugccugagccagcugcacagcggccuguuccuguaccagggccugcugcaggcccuggagggcaucagccccgagcugggccccacccuggacacccugcagcuggacguggccgacuucgccaccaccaucuggcagcagauggaggagcugggcauggcccccgcccugcagcccacccagggcgccaugcccgccuucgccagcgccuuccagagaagagccggcggcgugcugguggccagccaccugcagagcuuccuggaggugagcuacagagugcugagacaccuggcccagcccuaa

SEQ ID NO: 15692 - RNA, 1599 nt, Artificial Sequence
  CSGALNACT1__Homo_sapiens__NP_001123990
augaugauggugagaagaggccugcuggccuggaucagcagagugguggugcugcuggugcugcugugcugcgccaucagcgugcuguacaugcuggccugcacccccaagggcgacgaggagcagcuggcccugcccagagccaacagccccaccggcaaggagggcuaccaggccgugcugcaggagugggaggagcagcacagaaacuacgugagcagccugaagagacagaucgcccagcugaaggaggagcugcaggagagaagcgagcagcugagaaacggccaguaccaggccagcgacgccgccggccugggccuggacagaagcccccccgagaagacccaggccgaccugcuggccuuccugcacagccagguggacaaggccgaggugaacgccggcgugaagcuggccaccgaguacgccgccgugcccuucgacagcuucacccugcagaagguguaccagcuggagaccggccugaccagacaccccgaggagaagcccgugagaaaggacaagagagacgagcugguggaggccaucgagagcgcccuggagacccugaacagccccgccgagaacagccccaaccacagacccuacaccgccagcgacuucaucgagggcaucuacagaaccgagagagacaagggcacccuguacgagcugaccuucaagggcgaccacaagcacgaguucaagagacugauccuguucagacccuucggccccaucaugaaggugaagaacgagaagcugaacauggccaacacccugaucaacgugaucgugccccuggccaagagaguggacaaguucagacaguucaugcagaacuucagagagaugugcaucgagcaggacggcagagugcaccugaccgugguguacuucggcaaggaggagaucaacgaggugaagggcauccuggagaacaccagcaaggccgccaacuucagaaacuucaccuucauccagcugaacggcgaguucagcagaggcaagggccuggacgugggcgccagauucuggaagggcagcaacgugcugcuguucuucugcgacguggacaucuacuucaccagcgaguuccugaacaccugcagacugaacacccagcccggcaagaagguguucuaccccgugcuguucagccaguacaaccccggcaucaucuacggccaccacgacgccgugcccccccuggagcagcagcuggugaucaagaaggagaccggcuucuggagagacuucggcuucggcaugaccugccaguacagaagcgacuucaucaacaucggcggcuucgaccuggacaucaagggcuggggcggcgaggacgugcaccuguacagaaaguaccugcacagcaaccugaucguggugagaacccccgugagaggccuguuccaccuguggcacgagaagagaugcauggacgagcugacccccgagcaguacaagaugugcaugcagagcaaggccaugaacgaggccagccacggccagcugggcaugcugguguucagacacgagaucgaggcccaccugagaaagcagaagcagaagaccagcagcaagaagaccuaa

SEQ ID NO: 15693 - RNA, 1629 nt, Artificial Sequence
  CSGALNACT2__Homo_sapiens__NP_061060
augcccagaagaggccugauccugcacaccagaacccacuggcugcugcugggccuggcccugcugugcagccuggugcuguucauguaccugcuggagugcgccccccagaccgacggcaacgccagccugcccggcguggugggcgagaacuacggcaaggaguacuaccaggcccugcugcaggagcaggaggagcacuaccagaccagagccaccagccugaagagacagaucgcccagcugaagcaggagcugcaggagaugagcgagaagaugagaagccugcaggagagaagaaacgugggcgccaacggcaucggcuaccagagcaacaaggagcaggcccccagcgaccugcuggaguuccugcacagccagaucgacaaggccgaggugagcaucggcgccaagcugcccagcgaguacggcgugauccccuucgagagcuucacccugaugaagguguuccagcuggagaugggccugaccagacaccccgaggagaagcccgugagaaaggacaagagagacgagcugguggaggugaucgaggccggccuggaggugaucaacaaccccgacgaggacgacgagcaggaggacgaggagggcccccugggcgagaagcugaucuucaacgagaacgacuucguggagggcuacuacagaaccgagagagacaagggcacccaguacgagcuguucuucaagaaggccgaccugaccgaguacagacacgugacccuguucagacccuucggcccccugaugaaggugaagagcgagaugaucgacaucaccagaagcaucaucaacaucaucgugccccuggccgagagaaccgaggccuucgugcaguucaugcagaacuucagagacgugugcauccaccaggacaagaagauccaccugaccgugguguacuucggcaaggagggccugagcaaggugaagagcauccuggagagcgugaccagcgagagcaacuuccacaacuacacccuggugagccugaacgaggaguucaacagaggcagaggccugaacgugggcgccagagccugggacaagggcgaggugcugauguucuucugcgacguggacaucuacuucagcgccgaguuccugaacagcugcagacugaacgccgagcccggcaagaagguguucuaccccgugguguucagccuguacaaccccgccaucguguacgccaaccaggaggugcccccccccguggagcagcagcuggugcacaagaaggacagcggcuucuggagagacuucggcuucggcaugaccugccaguacagaagcgacuuccugaccaucggcggcuucgacauggaggugaagggcuggggcggcgaggacgugcaccuguacagaaaguaccugcacggcgaccugaucgugaucagaacccccgugcccggccuguuccaccuguggcacgagaagagaugcgccgacgagcugacccccgagcaguacagaaugugcauccagagcaaggccaugaacgaggccagccacagccaccugggcaugcugguguucagagaggagaucgagacccaccugcacaagcaggccuacagaaccaacagcgaggccgugggcuaa

SEQ ID NO: 15694 - RNA, 654 nt, Artificial Sequence
  CSH1__Homo_sapiens__NP_001308
auggcccccggcagcagaaccagccugcugcuggccuucgcccugcugugccugcccuggcugcaggaggccggcgccgugcagaccgugccccugagcagacuguucgaccacgccaugcugcaggcccacagagcccaccagcuggccaucgacaccuaccaggaguucgaggagaccuacauccccaaggaccagaaguacagcuuccugcacgacagccagaccagcuucugcuucagcgacagcauccccacccccagcaacauggaggagacccagcagaagagcaaccuggagcugcugagaaucagccugcugcugaucgagagcuggcuggagcccgugagauuccugagaagcauguucgccaacaaccugguguacgacaccagcgacagcgacgacuaccaccugcugaaggaccuggaggagggcauccagacccugaugggcagacuggaggacggcagcagaagaaccggccagauccugaagcagaccuacagcaaguucgacaccaacagccacaaccacgacgcccugcugaagaacuacggccugcuguacugcuucagaaaggacauggacaagguggagaccuuccugagaauggugcagugcagaagcguggagggcagcugcggcuucuaa

SEQ ID NO: 15695 - RNA, 654 nt, Artificial Sequence
  CSH2__Homo_sapiens__NP_066271
auggccgccggcagcagaaccagccugcugcuggccuucgcccugcugugccugcccuggcugcaggaggccggcgccgugcagaccgugccccugagcagacuguucgaccacgccaugcugcaggcccacagagcccaccagcuggccaucgacaccuaccaggaguucgaggagaccuacauccccaaggaccagaaguacagcuuccugcacgacagccagaccagcuucugcuucagcgacagcauccccacccccagcaacauggaggagacccagcagaagagcaaccuggagcugcugagaaucagccugcugcugaucgagagcuggcuggagcccgugagauuccugagaagcauguucgccaacaaccugguguacgacaccagcgacagcgacgacuaccaccugcugaaggaccuggaggagggcauccagacccugaugggcagacuggaggacggcagcagaagaaccggccagauccugaagcagaccuacagcaaguucgacaccaacagccacaaccacgacgcccugcugaagaacuacggccugcuguacugcuucagaaaggacauggacaagguggagaccuuccugagaauggugcagugcagaagcguggagggcagcugcggcuucuaa

SEQ ID NO: 15696 - RNA, 387 nt, Artificial Sequence
  CSHL1__Homo_sapiens__NP_001309
auggaggagacccagcagaagagcaaccuggagcugcugcacaucagccugcugcugaucgagagcagacuggagcccgugagauuccugagaagcaccuucaccaacaaccugguguacgacaccagcgacagcgacgacuaccaccugcugaaggaccuggaggagggcauccagaugcugaugggcagacuggaggacggcagccaccugaccggccagacccugaagcagaccuacagcaaguucgacaccaacagccacaaccacgacgcccugcugaagaacuacggccugcugcacugcuucagaaaggacauggacaagguggagaccuuccugagaauggugcagugcagaagcguggagggcagcugcggcuucuaa

SEQ ID NO: 15697 - RNA, 1401 nt, Artificial Sequence
  CS__Homo_sapiens__NP_004068
auggcccugcugaccgccgccgccagacugcugggcaccaagaacgccagcugccuggugcuggccgccagacacgccagcgccagcagcaccaaccugaaggacauccuggccgaccugauccccaaggagcaggccagaaucaagaccuucagacagcagcacggcaagaccguggugggccagaucaccguggacaugauguacggcggcaugagaggcaugaagggccugguguacgagaccagcgugcuggaccccgacgagggcaucagauucagaggcuucagcauccccgagugccagaagcugcugcccaaggccaagggcggcgaggagccccugcccgagggccuguucuggcugcuggugaccggccacauccccaccgaggagcaggugagcuggcugagcaaggagugggccaagagagccgcccugcccagccacguggugaccaugcuggacaacuuccccaccaaccugcaccccaugagccagcugagcgccgccgugaccgcccugaacagcgagagcaacuucgccagagccuacgcccagggcaucagcagaaccaaguacugggagcugaucuacgaggacagcauggaccugaucgccaagcugcccugcguggccgccaagaucuacagaaaccuguacagagagggcagcggcaucggcgccaucgacagcaaccuggacuggagccacaacuucaccaacaugcugggcuacaccgaccaccaguucaccgagcugaccagacuguaccugaccauccacagcgaccacgagggcggcaacgugagcgcccacaccagccaccuggugggcagcgcccugagcgaccccuaccugagcuucgccgccgccaugaacggccuggccggcccccugcacggccuggccaaccaggaggugcugguguggcugacccagcugcagaaggaggugggcaaggacgugagcgacgagaagcugagagacuacaucuggaacacccugaacagcggcagaguggugcccggcuacggccacgccgugcugagaaagaccgaccccagauacaccugccagagagaguucgcccugaagcaccugcccaacgaccccauguucaagcugguggcccagcuguacaagaucgugcccaacgugcugcuggagcagggcaaggccaagaaccccuggcccaacguggacgcccacagcggcgugcugcugcaguacuacggcaugaccgagaugaacuacuacaccgugcuguucggcgugagcagagcccugggcgugcuggcccagcugaucuggagcagagcccugggcuucccccuggagagacccaagagcaugagcaccgagggccugaugaaguucguggacagcaagagcggcuaa

SEQ ID NO: 15698 - RNA, 1353 nt, Artificial Sequence
  CSK__Homo_sapiens__XP_005254222
augagcgccauccaggccgccuggcccagcggcaccgagugcaucgccaaguacaacuuccacggcaccgccgagcaggaccugcccuucugcaagggcgacgugcugaccaucguggccgugaccaaggaccccaacugguacaaggccaagaacaaggugggcagagagggcaucauccccgccaacuacgugcagaagagagagggcgugaaggccggcaccaagcugagccugaugcccugguuccacggcaagaucaccagagagcaggccgagagacugcuguacccccccgagaccggccuguuccuggugagagagagcaccaacuaccccggcgacuacacccugugcgugagcugcgacggcaagguggagcacuacagaaucauguaccacgccagcaagcugagcaucgacgaggagguguacuucgagaaccugaugcagcugguggagcacuacaccagcgacgccgacggccugugcaccagacugaucaagcccaaggugauggagggcaccguggccgcccaggacgaguucuacagaagcggcugggcccugaacaugaaggagcugaagcugcugcagaccaucggcaagggcgaguucggcgacgugaugcugggcgacuacagaggcaacaagguggccgugaagugcaucaagaacgacgccaccgcccaggccuuccuggccgaggccagcgugaugacccagcugagacacagcaaccuggugcagcugcugggcgugaucguggaggagaagggcggccuguacaucgugaccgaguacauggccaagggcagccugguggacuaccugagaagcagaggcagaagcgugcugggcggcgacugccugcugaaguucagccuggacgugugcgaggccauggaguaccuggagggcaacaacuucgugcacagagaccuggccgccagaaacgugcuggugagcgaggacaacguggccaaggugagcgacuucggccugaccaaggaggccagcagcacccaggacaccggcaagcugcccgugaaguggaccgcccccgaggcccugagagagaagaaguucagcaccaagagcgacguguggagcuucggcauccugcugugggagaucuacagcuucggcagagugcccuaccccagaaucccccugaaggacguggugcccagaguggagaagggcuacaagauggacgcccccgacggcugcccccccgccguguacgaggugaugaagaacugcuggcaccuggacgccgccaugagacccagcuuccugcagcugagagagcagcuggagcacaucaagacccacgagcugcaccuguaa

SEQ ID NO: 15699 - RNA, 10695 nt, Artificial Sequence
  CSMD1__Homo_sapiens__NP_150094
augaccgccuggagaagauuccagagccugcugcugcugcugggccugcuggugcugugcgccagacugcugaccgccgccaagggccagaacugcggcggccuggugcagggccccaacggcaccaucgagagccccggcuucccccacggcuaccccaacuacgccaacugcaccuggaucaucaucaccggcgagagaaacagaauccagcugagcuuccacaccuucgcccuggaggaggacuucgacauccugagcguguacgacggccagccccagcagggcaaccugaaggugagacugagcggcuuccagcugcccagcagcaucgugagcaccggcagcauccugacccugugguucaccaccgacuucgccgugagcgcccagggcuucaaggcccuguacgaggugcugcccagccacaccugcggcaaccccggcgagauccugaagggcgugcugcacggcaccagauucaacaucggcgacaagaucagauacagcugccugcccggcuacauccuggagggccacgccauccugaccugcaucgugagccccggcaacggcgccagcugggacuuccccgcccccuucugcagagccgagggcgccugcggcggcacccugagaggcaccagcagcagcaucagcagcccccacuuccccagcgaguacgagaacaacgccgacugcaccuggaccauccuggccgagcccggcgacaccaucgcccugguguucaccgacuuccagcuggaggagggcuacgacuuccuggagaucagcggcaccgaggcccccagcaucuggcugaccggcaugaaccugcccagccccgugaucagcagcaagaacuggcugagacugcacuucaccagcgacagcaaccacagaagaaagggcuucaacgcccaguuccaggugaagaaggccaucgagcugaagagcagaggcgugaagaugcugcccagcaaggacggcagccacaagaacagcgugcugagccagggcggcguggcccuggugagcgacaugugccccgaccccggcauccccgagaacggcagaagagccggcagcgacuucagagugggcgccaacgugcaguucagcugcgaggacaacuacgugcugcagggcagcaagagcaucaccugccagagagugaccgagacccuggccgccuggagcgaccacagacccaucugcagagccagaaccugcggcagcaaccugagaggccccagcggcgugaucaccagccccaacuaccccgugcaguacgaggacaacgcccacugcgugugggugaucaccaccaccgaccccgacaaggugaucaagcuggccuucgaggaguucgagcuggagagaggcuacgacacccugaccgugggcgacgccggcaaggugggcgacaccagaagcgugcuguacgugcugaccggcagcagcgugcccgaccugaucgugagcaugagcaaccagauguggcugcaccugcagagcgacgacagcaucggcagccccggcuucaaggccguguaccaggagaucgagaagggcggcugcggcgaccccggcauccccgccuacggcaagagaaccggcagcagcuuccugcacggcgacacccugaccuucgagugccccgccgccuucgagcuggugggcgagagagugaucaccugccagcagaacaaccaguggagcggcaacaagcccagcugcguguucagcugcuucuucaacuucaccgccagcagcggcaucauccugagccccaacuaccccgaggaguacggcaacaacaugaacugcguguggcugaucaucagcgagcccggcagcagaauccaccugaucuucaacgacuucgacguggagccccaguucgacuuccuggccgugaaggacgacggcaucagcgacaucaccgugcugggcaccuucagcggcaacgaggugcccagccagcuggccagcagcggccacaucgugagacuggaguuccagagcgaccacagcaccaccggcagaggcuucaacaucaccuacaccaccuucggccagaacgagugccacgaccccggcauccccaucaacggcagaagauucggcgacagauuccugcugggcagcagcgugagcuuccacugcgacgacggcuucgugaagacccagggcagcgagagcaucaccugcauccugcaggacggcaacgugguguggagcagcaccgugcccagaugcgaggcccccugcggcggccaccugaccgccagcagcggcgugauccugccccccggcuggcccggcuacuacaaggacagccugcacugcgaguggaucaucgaggccaagcccggccacagcaucaagaucaccuucgacagauuccagaccgaggugaacuacgacacccuggaggugagagacggccccgccagcagcagcccccugaucggcgaguaccacggcacccaggccccccaguuccugaucagcaccggcaacuucauguaccugcuguucaccaccgacaacagcagaagcagcaucggcuuccugauccacuacgagagcgugacccuggagagcgacagcugccuggaccccggcauccccgugaacggccacagacacggcggcgacuucggcaucagaagcaccgugaccuucagcugcgaccccggcuacacccugagcgacgacgagccccuggugugcgagagaaaccaccaguggaaccacgcccugcccagcugcgacgcccugugcggcggcuacauccagggcaagagcggcaccgugcugagccccggcuuccccgacuucuaccccaacagccugaacugcaccuggaccaucgaggugagccacggcaagggcgugcagaugaucuuccacaccuuccaccuggagagcagccacgacuaccugcugaucaccgaggacggcagcuucagcgagcccguggccagacugaccggcagcgugcugccccacaccaucaaggccggccuguucggcaacuucaccgcccagcugagauucaucagcgacuucagcaucagcuacgagggcuucaacaucaccuucagcgaguacgaccuggagcccugcgacgaccccggcgugcccgccuucagcagaagaaucggcuuccacuucggcgugggcgacagccugaccuucagcugcuuccugggcuacagacuggagggcgccaccaagcugaccugccugggcggcggcagaagaguguggagcgccccccugcccagaugcguggccgagugcggcgccagcgugaagggcaacgagggcacccugcugagccccaacuuccccagcaacuacgacaacaaccacgagugcaucuacaagaucgagaccgaggccggcaagggcauccaccugagaaccagaagcuuccagcuguucgagggcgacacccugaagguguacgacggcaaggacagcagcagcagaccccugggcaccuucaccaagaacgagcugcugggccugauccugaacagcaccagcaaccaccuguggcuggaguucaacaccaacggcagcgacaccgaccagggcuuccagcugaccuacaccagcuucgaccuggugaagugcgaggaccccggcauccccaacuacggcuacagaaucagagacgagggccacuucaccgacaccguggugcuguacagcugcaaccccggcuacgccaugcacggcagcaacacccugaccugccugagcggcgacagaagagugugggacaagccccugcccagcugcaucgccgagugcggcggccagauccacgccgccaccagcggcagaauccugagccccggcuaccccgcccccuacgacaacaaccugcacugcaccuggaucaucgaggccgaccccggcaagaccaucagccugcacuucaucguguucgacaccgagauggcccacgacauccugaaggugugggacggccccguggacagcgacauccugcugaaggaguggagcggcagcgcccugcccgaggacauccacagcaccuucaacagccugacccugcaguucgacagcgacuucuucaucagcaagagcggcuucagcauccaguucagcaccagcaucgccgccaccugcaacgaccccggcaugccccagaacggcaccagauacggcgacagcagagaggccggcgacaccgugaccuuccagugcgaccccggcuaccagcugcagggccaggccaagaucaccugcgugcagcugaacaacagauucuucuggcagcccgacccccccaccugcaucgccgccugcggcggcaaccugaccggccccgccggcgugauccugagccccaacuacccccagcccuacccccccggcaaggagugcgacuggagagugaaggugaaccccgacuucgugaucgcccugaucuucaagagcuucaacauggagcccagcuacgacuuccugcacaucuacgagggcgaggacagcaacagcccccugaucggcagcuaccagggcagccaggcccccgagagaaucgagagcagcggcaacagccuguuccuggccuucagaagcgacgccagcgugggccugagcggcuucgccaucgaguucaaggagaagcccagagaggccugcuucgaccccggcaacaucaugaacggcaccagagugggcaccgacuucaagcugggcagcaccaucaccuaccagugcgacagcggcuacaagauccuggaccccagcagcaucaccugcgugaucggcgccgacggcaagcccagcugggaccaggugcugcccagcugcaacgcccccugcggcggccaguacaccggcagcgagggcguggugcugagccccaacuacccccacaacuacaccgccggccagaucugccuguacagcaucaccgugcccaaggaguucgugguguucggccaguucgccuacuuccagaccgcccugaacgaccuggccgagcuguucgacggcacccacgcccaggccagacugcugagcagccugagcggcagccacagcggcgagacccugccccuggccaccagcaaccagauccugcugagauucagcgccaagagcggcgccagcgccagaggcuuccacuucguguaccaggccgugcccagaaccagcgacacccagugcagcagcgugcccgagcccagauacggcagaagaaucggcagcgaguucagcgccggcagcaucgugagauucgagugcaaccccggcuaccugcugcagggcagcaccgcccugcacugccagagcgugcccaacgcccuggcccaguggaacgacaccauccccagcugcguggugcccugcagcggcaacuucacccagagaagaggcaccauccugagccccggcuaccccgagcccuacggcaacaaccugaacugcaucuggaagaucaucgugaccgagggcagcggcauccagauccaggugaucagcuucgccaccgagcagaacugggacagccuggagauccacgacggcggcgacgugaccgcccccagacugggcagcuucagcggcaccaccgugcccgcccugcugaacagcaccagcaaccagcuguaccugcacuuccagagcgacaucagcguggccgccgccggcuuccaccuggaguacaagaccgugggccuggccgccugccaggagcccgcccugcccagcaacagcaucaagaucggcgacagauacauggugaacgacgugcugagcuuccagugcgagcccggcuacacccugcagggcagaagccacaucagcugcaugcccggcaccgugagaagauggaacuaccccagcccccugugcaucgccaccugcggcggcacccugagcacccugggcggcgugauccugagccccggcuuccccggcagcuaccccaacaaccuggacugcaccuggagaaucagccugcccaucggcuacggcgcccacauccaguuccugaacuucagcaccgaggccaaccacgacuuccuggagauccagaacggccccuaccacaccagccccaugaucggccaguucagcggcaccgaccugcccgccgcccugcugagcaccacccacgagacccugauccacuucuacagcgaccacagccagaacagacagggcuucaagcuggccuaccaggccuacgagcugcagaacugccccgaccccccccccuuccagaacggcuacaugaucaacagcgacuacagcgugggccagagcgugagcuucgagugcuaccccggcuacauccugaucggccaccccgugcugaccugccagcacggcaucaacagaaacuggaacuaccccuuccccagaugcgacgcccccugcggcuacaacgugaccagccagaacggcaccaucuacagccccggcuuccccgacgaguaccccauccugaaggacugcaucuggcugaucaccgugccccccggccacggcguguacaucaacuucacccugcugcagaccgaggccgugaacgacuacaucgccgugugggacggccccgaccagaacagcccccagcugggcguguucagcggcaacaccgcccuggagaccgccuacagcagcaccaaccaggugcugcugaaguuccacagcgacuucagcaacggcggcuucuucgugcugaacuuccacgccuuccagcugaagaagugccagcccccccccgccgugccccaggccgagaugcugaccgaggacgacgacuucgagaucggcgacuucgugaaguaccagugccaccccggcuacacccuggugggcaccgacauccugaccugcaagcugagcagccagcugcaguucgagggcagccugcccaccugcgaggcccagugccccgccaacgaggugagaaccggcagcagcggcgugauccugagccccggcuaccccggcaacuacuucaacagccagaccugcagcuggagcaucaagguggagcccaacuacaacaucaccaucuucguggacaccuuccagagcgagaagcaguucgacgcccuggagguguucgacggcagcagcggccagagcccccugcugguggugcugagcggcaaccacaccgagcagagcaacuucaccagcagaagcaaccagcuguaccugagauggagcaccgaccacgccaccagcaagaagggcuucaagaucagauacgccgcccccuacugcagccugacccacccccugaagaacggcggcauccugaacagaaccgccggcgccgugggcagcaaggugcacuacuucugcaagcccggcuacagaauggugggccacagcaacgccaccugcagaagaaacccccugggcauguaccagugggacagccugaccccccugugccaggccgugagcugcggcauccccgagagccccggcaacggcagcuucaccggcaacgaguucacccuggacagcaaggugguguacgagugccacgagggcuucaagcuggagagcagccagcaggccaccgccgugugccaggaggacggccuguggagcaacaagggcaagccccccaccugcaagcccguggccugccccagcaucgaggcccagcugagcgagcacgugaucuggagacuggugagcggcagccugaacgaguacggcgcccaggugcugcugagcugcagccccggcuacuaccuggagggcuggagacugcugagaugccaggccaacggcaccuggaacaucggcgacgagagacccagcugcagagugaucagcugcggcagccugagcuucccccccaacggcaacaagaucggcacccugaccguguacggcgccaccgccaucuucaccugcaacaccggcuacacccuggugggcagccacgugagagagugccuggccaacggccuguggagcggcagcgagaccagaugccuggccggccacugcggcagccccgaccccaucgugaacggccacaucagcggcgacggcuucagcuacagagacaccgugguguaccagugcaaccccggcuucagacuggugggcaccagcgugagaaucugccugcaggaccacaaguggagcggccagacccccgugugcgugcccaucaccugcggccaccccggcaaccccgcccacggcuucaccaacggcagcgaguucaaccugaacgacguggugaacuucaccugcaacaccggcuaccugcugcagggcgugagcagagcccagugcagaagcaacggccaguggagcagcccccugcccaccugcagaguggugaacugcagcgaccccggcuucguggagaacgccaucagacacggccagcagaacuuccccgagagcuucgaguacggcaugagcauccuguaccacugcaagaagggcuucuaccugcugggcagcagcgcccugaccugcauggccaacggccugugggacagaagccugcccaagugccuggccaucagcugcggccaccccggcgugcccgccaacgccgugcugaccggcgagcuguucaccuacggcgccguggugcacuacagcugcagaggcagcgagagccugaucggcaacgacaccagagugugccaggaggacagccacuggagcggcgcccugccccacugcaccggcaacaaccccggcuucugcggcgaccccggcacccccgcccacggcagcagacugggcgacgacuucaagaccaagagccugcugagauucagcugcgagaugggccaccagcugagaggcagccccgagagaaccugccugcugaacggcagcuggagcggccugcagcccgugugcgaggccgugagcugcggcaaccccggcacccccaccaacggcaugaucgugagcagcgacggcauccuguucagcagcagcgugaucuacgccugcugggagggcuacaagaccagcggccugaugaccagacacugcaccgccaacggcaccuggaccggcaccgcccccgacugcaccaucaucagcugcggcgaccccggcacccuggccaacggcauccaguucggcaccgacuucaccuucaacaagaccgugagcuaccagugcaaccccggcuacgugauggaggccgugaccagcgccaccaucagaugcaccaaggacggcagauggaaccccagcaagcccgugugcaaggccgugcugugcccccagcccccccccgugcagaacggcaccguggagggcagcgacuucagauggggcagcagcaucagcuacagcugcauggacggcuaccagcugagccacagcgccauccugagcugcgagggcagaggcguguggaagggcgagaucccccagugccugcccguguucugcggcgaccccggcauccccgccgagggcagacugagcggcaagagcuucaccuacaagagcgagguguucuuccagugcaagagccccuucauccuggugggcagcagcagaagagugugccaggccgacggcaccuggagcggcauccagcccaccugcaucgaccccgcccacaacaccugccccgaccccggcaccccccacuucggcauccagaacagcagcagaggcuacgaggugggcagcaccguguucuucagaugcagaaagggcuaccacauccagggcagcaccaccagaaccugccuggccaaccugaccuggagcggcauccagaccgagugcaucccccacgccugcagacagcccgagacccccgcccacgccgacgugagagccaucgaccugcccaccuucggcuacacccugguguacaccugccaccccggcuucuuccuggccggcggcagcgagcacagaaccugcaaggccgacaugaaguggaccggcaagagccccgugugcaagagcaagggcgugagagaggugaacgagaccgugaccaagacccccgugcccagcgacguguucuucgugaacagccuguggaagggcuacuacgaguaccugggcaagagacagcccgccacccugaccguggacugguucaacgccaccagcagcaaggugaacgccaccuucagcgaggccagccccguggagcugaagcugaccggcaucuacaagaaggaggaggcccaccugcugcugaaggccuuccagaucaagggccaggccgacaucuucgugagcaaguucgagaacgacaacuggggccuggacggcuacgugagcagcggccuggagagaggcggcuucaccuuccagggcgacauccacggcaaggacuucggcaaguucaagcuggagagacaggacccccugaaccccgaccaggacagcagcagccacuaccacggcaccagcagcggcagcguggccgccgccauccuggugcccuucuucgcccugauccugagcggcuucgccuucuaccuguacaagcacagaaccagacccaaggugcaguacaacggcuacgccggccacgagaacagcaacggccaggccagcuucgagaaccccauguacgacaccaaccugaagcccaccgaggccaaggccgugagauucgacaccacccugaacaccgugugcaccgugguguaa

SEQ ID NO: 15700 - RNA, 10824 nt, Artificial Sequence
  CSMD2__Homo_sapiens__XP_011538874
augcccagaagcagaggcagagagcugggcagaugcggcugccccgccggcagagccagaggcgagaccggcaucagcgcccuggugcccggcgccggcagcagauggggcagaccccccccccccaccccccccccccugcugcugcugcugggcugcggccugcugagcgugagcgccgccgccggccagaacugcaccuuccagcugcacggccccaacggcaccguggagagccccggcuuccccuacggcuaccccaacuacgccaacugcaccuggaccaucaccgccgaggagcagcacagaauccagcugguguuccagagcuucgcccuggaggaggacuucgacgugcugagcguguucgacggccccccccagcccgagaaccugagaaccagacugaccggcuuccagcugcccgccaccaucgugagcgccgccaccacccugagccugagacugaucagcgacuacgccgugagcgcccagggcuuccacgccaccuacgaggugcugcccagccacaccugcggcaaccccggcagacugcccaacggcauccagcagggcagcaccuucaaccugggcgacaaggugagauacagcugcaaccugggcuucuuccuggagggccacgccgugcugaccugccacgccggcagcgagaacagcgccaccugggacuucccccugcccagcugcagagccgacgacgccugcggcggcacccugagaggccagagcggcaucaucagcagcccccacuuccccagcgaguaccacaacaacgccgacugcaccuggaccauccuggccgagcugggcgacaccaucgcccugguguucaucgacuuccagcuggaggacggcuacgacuuccuggaggugaccggcaccgagggcagcagccugugguucaccggcgccagccugcccgcccccgugaucagcagcaagaacuggcugagacugcacuucaccagcgacggcaaccacagacagagaggcuucagcgcccaguaccaggugaagaagcagaucgagcugaagagcagaggcgugaagcugaugcccagcaaggacaacagccagaagaccagcgugcugacccaggugggcgugagccagggccacaacaugugccccgaccccggcauccccgagagaggcaagagacugggcagcgacuucagacugggcagcagcgugcaguucaccugcaacgagggcuacgaccugcagggcagcaagagaaucaccugcaugaaggugagcgacauguucgccgccuggagcgaccacagacccgugugcagagccagaaugugcgacgcccaccugagaggccccagcggcaucaucaccagccccaacuuccccauccaguacgacaacaacgcccacugcguguggaucaucaccgcccugaaccccagcaaggugaucaagcuggccuucgaggaguucgaccuggagagaggcuacgacacccugaccgugggcgacggcggccaggacggcgaccagaagaccgugcuguacauccugaccggcaccagcgugcccgaccugaucgugagcaccaaccaccagauguggcugcuguuccagaccgacggcagcggcagcagccugggcuucaaggccagcuacgaggagaucgagcagggcagcugcggcgaccccggcauccccgccuacggcagaagagagggcagcagauuccaccacggcgacacccugaaguucgagugccagcccgccuucgagcuggugggccagaaggccaucaccugccagaagaacaaccaguggagcgccaagaagcccggcugcguguucagcugcuucuucaacuucaccagccccagcggcguggugcugagccccaacuaccccgaggacuacggcaaccaccugcacugcguguggcugauccuggccagacccgagagcagaauccaccuggccuucaacgacaucgacguggagccccaguucgacuuccuggugaucaaggacggcgccaccgccgaggcccccgugcugggcaccuucagcggcaaccagcugcccagcagcaucaccagcagcggccacguggccagacuggaguuccagaccgaccacagcaccggcaagagaggcuucaacaucaccuucaccaccuucagacacaacgagugccccgaccccggcgugcccgugaacggcaagagauucggcgacagccugcagcugggcagcagcaucagcuuccugugcgacgagggcuuccugggcacccagggcagcgagaccaucaccugcgugcugaaggagggcagcgugguguggaacagcgccgugcugagaugcgaggcccccugcggcggccaccugaccagccccagcggcaccauccugagccccggcuggcccggcuucuacaaggacgcccugagcugcgccugggugaucgaggcccagcccggcuaccccaucaagaucaccuucgacagauucaagaccgaggugaacuacgacacccuggaggugagagacggcagaaccuacagcgccccccugaucggcguguaccacggcacccaggugccccaguuccugaucagcaccagcaacuaccuguaccugcuguucagcaccgacaagagccacagcgacaucggcuuccagcugagauacgagaccaucacccugcagagcgaccacugccuggaccccggcauccccgugaacggccagagacacggcaacgacuucuacgugggcgcccuggugaccuucagcugcgacagcggcuacacccugagcgacggcgagccccuggagugcgagcccaacuuccaguggagcagagcccugcccagcugcgaggcccugugcggcggcuucauccagggcagcagcggcaccauccugagccccggcuuccccgacuucuaccccaacaaccugaacugcaccuggaucaucgagaccagccacggcaagggcguguucuucaccuuccacaccuuccaccuggagagcggccacgacuaccugcugaucaccgagaacggcagcuucacccagccccugagacagcugaccggcagcagacugcccgcccccaucagcgccggccuguacggcaacuucaccgcccaggugagauucaucagcgacuucagcaugagcuacgagggcuucaacaucaccuucagcgaguacgaccuggagcccugcgaggagcccgaggugcccgccuacagcaucagaaagggccugcaguucggcgugggcgacacccugaccuucagcugcuuccccggcuacagacuggagggcaccgccagaaucaccugccugggcggcagaagaagacuguggagcagcccccugcccagaugcguggccgagugcggcaacagcgugaccggcacccagggcacccugcugagccccaacuuccccgugaacuacaacaacaaccacgagugcaucuacagcauccagacccagcccggcaagggcauccagcugaaggccagagccuucgagcugagcgagggcgacgugcugaagguguacgacggcaacaacaacagcgccagacugcugggcguguucagccacagcgagaugaugggcgugacccugaacagcaccagcagcagccuguggcuggacuucaucaccgacgccgagaacaccagcaagggcuucgagcugcacuucagcagcuucgagcugaucaagugcgaggaccccggcacccccaaguucggcuacaaggugcacgacgagggccacuucgccggcagcagcgugagcuucagcugcgaccccggcuacagccugagaggcagcgaggagcugcugugccugagcggcgagagaagaaccugggacagaccccugcccaccugcguggccgagugcggcggcaccgugagaggcgaggugagcggccaggugcugagccccggcuaccccgcccccuacgagcacaaccugaacugcaucuggaccaucgaggccgaggccggcugcaccaucggccugcacuuccugguguucgacaccgaggaggugcacgacgugcugagaaucugggacggccccguggagagcggcgugcugcugaaggagcugagcggccccgcccugcccaaggaccugcacagcaccuucaacagcguggugcugcaguucagcaccgacuucuucaccagcaagcagggcuucgccauccaguucagcgugagcaccgccaccagcugcaacgaccccggcaucccccagaacggcagcagaagcggcgacagcugggaggccggcgacagcaccguguuccagugcgaccccggcuacgcccugcagggcagcgccgagaucagcugcgugaagaucgagaacagauucuucuggcagcccagcccccccaccugcaucgcccccugcggcggcgaccugaccggccccagcggcgugauccugagccccaacuaccccgagcccuacccccccggcaaggagugcgacuggaaggugaccgugagccccgacuacgugaucgcccugguguucaacaucuucaaccuggagcccggcuacgacuuccugcacaucuacgacggcagagacagccugagcccccugaucggcagcuucuacggcagccagcugcccggcagaaucgagagcagcagcaacagccuguuccuggccuucagaagcgacgccagcgugagcaacgccggcuucgugaucgacuacaccgagaaccccagagagagcugcuucgaccccggcagcaucaagaacggcaccagagugggcagcgaccugaagcugggcagcagcgugaccuacuacugccacggcggcuacgagguggagggcaccagcacccugagcugcauccugggccccgacggcaagcccguguggaacaaccccagacccgugugcaccgcccccugcggcggccaguacgugggcagcgacggcguggugcugagccccaacuacccccagaacuacaccagcggccagaucugccuguacuucgugaccgugcccaaggacuacgugguguucggccaguucgccuucuuccacaccgcccugaacgacgugguggaggugcacgacggccacagccagcacagcagacugcugagcagccugagcggcagccacaccggcgagagccugccccuggccaccagcaaccaggugcugaucaaguucagcgccaagggccuggcccccgccagaggcuuccacuucguguaccaggccgugcccagaaccagcgccacccagugcagcagcgugcccgagcccagauacggcaagagacugggcagcgacuucagcgugggcgccaucgugagauucgagugcaacagcggcuacgcccugcagggcagccccgagaucgagugccugcccgugcccggcgcccuggcccaguggaacgugagcgcccccaccugcguggugcccugcggcggcaaccugaccgagagaagaggcaccauccugagccccggcuuccccgagcccuaccugaacagccugaacugcguguggaagaucguggugcccgagggcgccggcauccagauccagguggugagcuucgugaccgagcagaacugggacagccuggagguguucgacggcgccgacaacaccgugaccaugcugggcagcuucagcggcaccaccgugcccgcccugcugaacagcaccagcaaccagcuguaccugcacuucuacagcgacaucagcgugagcgccgccggcuuccaccuggaguacaagaccgugggccugagcagcugccccgagcccgccgugcccagcaacggcgugaagaccggcgagagauaccuggugaacgacguggugagcuuccagugcgagcccggcuacgcccugcagggccacgcccacaucagcugcaugcccggcaccgugagaagauggaacuacccccccccccugugcaucgcccagugcggcggcaccguggaggagauggagggcgugauccugagccccggcuuccccggcaacuaccccagcaacauggacugcagcuggaagaucgcccugcccgugggcuucggcgcccacauccaguuccugaacuucagcaccgagcccaaccacgacuacaucgagaucagaaacggccccuacgagaccagcagaaugaugggcagauucagcggcagcgagcugcccagcagccugcugagcaccagccacgagaccaccguguacuuccacagcgaccacagccagaacagacccggcuucaagcuggaguaccaggccuacgagcugcaggagugccccgaccccgagcccuucgccaacggcaucgugagaggcgccggcuacaacgugggccagagcgugaccuucgagugccugcccggcuaccagcugaccggccaccccgugcugaccugccagcacggcaccaacagaaacugggaccacccccugcccaagugcgaggugcccugcggcggcaacaucaccagcagcaacggcaccguguacagccccggcuuccccagccccuacagcagcagccaggacugcguguggcugaucaccgugcccaucggccacggcgugagacugaaccugagccugcugcagaccgagcccagcggcgacuucaucaccaucugggacggcccccagcagaccgcccccagacugggcguguucaccagaagcauggccaagaagaccgugcagagcagcagcaaccaggugcugcugaaguuccacagagacgccgccaccggcggcaucuucgccaucgccuucagcgccuacccccugaccaagugccccccccccaccauccugcccaacgccgagguggugaccgagaacgaggaguucaacaucggcgacaucgugagauacagaugccugcccggcuucacccuggugggcaacgagauccugaccugcaagcugggcaccuaccugcaguucgagggccccccccccaucugcgaggugcacugccccaccaacgagcugcugaccgacagcaccggcgugauccugagccagagcuaccccggcagcuacccccaguuccagaccugcagcuggcuggugagaguggagcccgacuacaacaucagccugaccguggaguacuuccugagcgagaagcaguacgacgaguucgagaucuucgacggccccagcggccagagcccccugcugaaggcccugagcggcaacuacagcgccccccugaucgugaccagcagcagcaacagcguguaccugagauggagcagcgaccacgccuacaacagaaagggcuucaagaucagauacagcgcccccuacugcagccugcccagagccccccugcacggcuucauccugggccagaccagcacccagcccggcggcagcauccacuucggcugcaacgccggcuacagacuggugggccacagcauggccaucugcaccagacacccccagggcuaccaccuguggagcgaggccaucccccugugccaggcccugagcugcggccugcccgaggcccccaagaacggcaugguguucggcaaggaguacaccgugggcaccaaggccauguacagcugcagcgagggcuaccaccugcaggccggcgccgaggccaccgccgagugccuggacaccggccuguggagcaacagaaacgugcccccccagugcgugcccgugaccugccccgacgugagcagcaucagcguggagcacggcagauggagacugaucuucgagacccaguaccaguuccaggcccagcugaugcugaucugcgaccccggcuacuacuacaccggccagagagugaucagaugccaggccaacggcaaguggagccugggcgacagcacccccaccugcagaaucaucagcugcggcgagcugcccaucccccccaacggccacagaaucggcacccugagcguguacggcgccaccgccaucuucagcugcaacagcggcuacacccuggugggcagcagagugagagagugcauggccaacggccuguggagcggcagcgaggugagaugccuggccggccacugcggcacccccgagcccaucgugaacggccacaucaacggcgagaacuacagcuacagaggcagcgugguguaccagugcaacgccggcuucagacugaucggcaugagcgugagaaucugccagcaggaccaccacuggagcggcaagacccccuucugcgugcccaucaccugcggccaccccggcaaccccgugaacggccugacccagggcaaccaguucaaccugaacgacguggugaaguucgugugcaaccccggcuacauggccgagggcgccgccagaagccagugccuggccagcggccaguggagcgacaugcugcccaccugcagaaucaucaacugcaccgaccccggccaccaggagaacagcgugagacaggugcacgccagcggcccccacagauucagcuucggcaccaccgugagcuacagaugcaaccacggcuucuaccugcugggcacccccgugcugagcugccagggcgacggcaccugggacagacccagaccccagugccugcuggugagcugcggccaccccggcagccccccccacagccagaugagcggcgacagcuacaccgugggcgccguggugagauacagcugcaucggcaagagaacccuggugggcaacagcaccagaaugugcggccuggacggccacuggaccggcagccugccccacugcagcggcaccagcgugggcgugugcggcgaccccggcauccccgcccacggcaucagacugggcgacagcuucgaccccggcaccgugaugagauucagcugcgaggccggccacgugcugagaggcagcagcgagagaaccugccaggccaacggcagcuggagcggcagccagcccgagugcggcgugaucagcugcggcaaccccggcacccccagcaacgccagagugguguucagcgacggccugguguucagcagcagcaucguguacgagugcagagagggcuacuacgccaccggccugcugagcagacacugcagcgugaacggcaccuggaccggcagcgaccccgagugccuggugaucaacugcggcgaccccggcauccccgccaacggccugagacugggcaacgacuucagauacaacaagaccgugaccuaccagugcgugcccggcuacaugauggagagccacagagugagcgugcugagcugcaccaaggacagaaccuggaacggcaccaagcccgugugcaaggcccugaugugcaagccccccccccugauccccaacggcaagguggugggcagcgacuucauguggggcagcagcgugaccuacgccugccuggagggcuaccagcugagccugcccgccguguucaccugcgagggcaacggcagcuggaccggcgagcugccccagugcuuccccguguucugcggcgaccccggcgugcccagcagaggcagaagagaggacagaggcuucagcuacagaagcagcgugagcuucagcugccaccccccccuggugcuggugggcagccccagaagauucugccagagcgacggcaccuggagcggcacccagcccagcugcaucgaccccacccugaccaccugcgccgaccccggcgugccccaguucggcauccagaacaacagccagggcuaccaggugggcagcaccgugcuguucagaugccagaagggcuaccugcugcagggcagcaccaccagaaccugccugcccaaccugaccuggagcggcaccccccccgacugcgugccccaccacugcagacagcccgagacccccacccacgccaacgugggcgcccuggaccugcccagcaugggcuacacccugaucuacagcugccaggagggcuucagccugaagggcggcagcgagcacagaaccugcaaggccgacggcagcuggaccggcaagccccccaucugccuggccgaggugagacccagcggcagacccaucaacaccgccagagagcccccccugacccaggcccugauccccggcgacguguucgccaagaacagccuguggaagggcgccuacgaguaccagggcaagaagcagcccgccaugcugagagugaccggcuuccagguggccaacagcaaggugaacgccaccaugaucgaccacagcggcguggagcugcaccuggccggcaccuacaagaaggaggacuuccaccugcugcugcagguguaccagaucaccggccccguggagaucuucaugaacaaguucaaggacgaccacugggcccuggacggccacgugagcagcgagagcagcggcgccaccuucaucuaccagggcagcgugaagggccagggcuucggccaguucggcuuccagagacuggaccugagacugcuggagagcgaccccgagagcaucggcagacacuucgccagcaacagcagcagcguggccgccgccauccuggugcccuucaucgcccugaucaucgccggcuucgugcuguaccuguacaagcacagaagaagacccaaggugcccuucaacggcuacgccggccacgagaacaccaacgugagagccaccuucgagaaccccauguacgacagaaacauccagcccaccgacaucauggccagcgaggccgaguucaccgugagcaccgugugcaccgccguguaa

SEQ ID NO: 15701 - RNA, 10617 nt, Artificial Sequence
  CSMD3__Homo_sapiens__NP_443132
augaagggcaucagaaagggcgagagcagagccaaggagagcaagcccugggagcccggcaagagaagaugcgccaagugcggcagacuggacuucauccugaugaagaagaugggcaucaagagcggcuucaccuucuggaaccugguguuccugcugaccgugagcugcgugaagggcuucaucuacaccugcggcggcacccugaagggccugaacggcaccaucgagagccccggcuuccccuacggcuaccccaacggcgccaacugcaccugggugaucaucgccgaggagagaaacagaauccagaucguguuccagagcuucgcccuggaggaggaguacgacuaccugagccuguacgacggccacccccaccccaccaacuucagaaccagacugaccggcuuccaccugcccccccccgugaccagcaccaagagcguguucagccugagacugaccagcgacuucgccgugagcgcccacggcuucaagguguacuacgaggagcugcagagcagcagcugcggcaaccccggcgugccccccaagggcgugcuguacggcaccagauucgacgugggcgacaagaucagauacagcugcgugaccggcuacauccuggacggccacccccagcugaccugcaucgccaacagcgugaacaccgccagcugggacuuccccgugcccaucugcagagccgaggacgccugcggcggcaccaugagaggcagcagcggcaucaucagcagccccagcuuccccaacgaguaccacaacaacgccgacugcaccuggaccaucguggccgagcccggcgacaccaucagccugaucuucaccgacuuccagauggaggagaaguacgacuaccuggagaucgagggcagcgagccccccaccaucuggcugagcggcaugaacauccccccccccaucaucagcaacaagaacuggcugagacugcacuucgugaccgacagcaaccacagauacagaggcuucagcgcccccuaccaggugaagaaggccaucgacuucaagagcagaggcuucaagcuguuccccggcaaggacaacagcaacaaguucagcauccugaacgagggcggcaucaagaccgccagcaaccugugccccgaccccggcgagcccgagaacggcaagagaaucggcagcgacuucagccugggcagcaccgugcaguucagcugcgacgaggacuacgugcugcagggcgccaagagcaucaccugccagagaaucgccgagguguucgccgccuggagcgaccacagacccgugugcaaggugaagaccugcggcagcaaccugcagggccccagcggcaccuucaccagccccaacuuccccuuccaguacgacagcaacgcccagugcgugugggugaucaccgccgugaacaccaacaaggugauccagaucaacuucgaggaguucgaccuggagaucggcuacgacacccugaccaucggcgacggcggcgaggugggcgaccccagaaccgugcugcaggugcugaccggcagcuucgugcccgaccugaucgugagcaugagcagccagauguggcugcaccugcagaccgacgagagcgugggcagcgugggcuucaaggugaacuacaaggagaucgagaaggagagcugcggcgaccccggcaccccccuguacggcaucagagagggcgacggcuucagcaacagagacgugcugagauucgagugccaguucggcuucgagcugaucggcgagaagagcaucgugugccaggagaacaaccaguggagcgccaacauccccaucugcaucuuccccugccugagcaacuucaccgcccccaugggcaccgugcugagccccgacuaccccgagggcuacggcaacaaccugaacugcaucuggaccaucaucagcgaccccggcagcagaauccaccugagcuucaacgacuucgaccuggagagccaguucgacuuccuggccgugaaggacggcgacagccccgagagccccauccugggcaccuucaccggcgccgaggugcccagccaccugaccagcaacagccacauccugagacuggaguuccaggccgaccacagcaugagcggcagaggcuucaacaucaccuacaacaccuucggccacaacgagugccccgaccccggcauccccaucaacgccagaagauucggcgacaacuuccagcugggcagcagcaucagcgugaucugcgaggagggcuucaucaagacccagggcaccgagaccaucaccugcauccugauggacggcaaggugauguggagcggccugauccccaagugcggcgcccccugcggcggccacuucagcgcccccagcggcgugauccugagccccggcuggcccggcuacuacaaggacagccugaacugcgagugggugaucgaggccgagcccggccacagcaucaagaucaccuucgagagauuccagaccgagcugaacuacgacgugcuggaggugcacgacggccccaaccugcugagcccccugcugggcagcuacaacggcacccaggugccccaguuccuguucagcagcagcaacuucaucuaccugcuguucaccaccgacaacagcagaagcaacaacggcuucaagauccacuacgagagcgugaccgugaacaccuacagcugccuggaccccggcauccccgugcacggcagaagauacggccacgacuucagcaucggcagcaccgugagcuucagcugcgacagcggcuacagacugagccacgaggagccccugcugugcgagaagaaccacugguggagccacccccugcccaccugcgacgcccugugcggcggcgacgugagaggccccagcggcaccauccugagccccggcuaccccgaguucuaccccaacagccugaacugcaccuggaccguggacgugacccacggcaagggcgugcaguucaacuuccacaccuuccaccuggaggaccaccacgacuaccugcugaucaccgagaacggcagcuucacccagccccuggccagacugaccggcagcgaccugccccccaccaucaacgccggccuguacggcaacuucagagcccagcugagauucaucagcgacuucagcaucagcuacgagggcuucaacaucaccuucagcgaguacaaccuggagcccugcgaggaccccggcaucccccaguacggcagcagaaucggcuucaacuucggcaucggcgacacccugaccuucagcugcagcagcggcuacagacuggagggcaccagcgagaucaucugccugggcggcggcagaagaguguggagcgccccccugcccagaugcguggccgagugcggcgccagcgccaccaacaacgagggcauccugcugagccccaacuacccccugaacuacgagaacaaccacgagugcaucuacagcauccaggugcaggccggcaagggcaucaacaucagcgccagaaccuuccaccuggcccagggcgacgugcugaagaucuacgacggcaaggacaagaccacccaccugcugggcgccuucaccggcgccagcaugagaggccugacccugagcagcaccagcaaccagcuguggcuggaguucaacagcgacaccgagggcaccgacgagggcuuccagcugguguacaccagcuucgagcugagccacugcgaggaccccggcaucccccaguucggcuacaagaucagcgaccagggccacuucgccggcagcaccaucaucuacggcugcaaccccggcuacacccugcacggcagcagccugcugaagugcaugaccggcgagagaagagccugggacuacccccugcccagcugcaucgccgagugcggcggcagauucaagggcgagagcagcggcagaauccugagccccggcuaccccuuccccuacgacaacaaccugagaugcauguggaugaucgagguggaccccggcaacaucgugagccugcaguuccuggccuucgacaccgaggccagccacgacauccugagagugugggacggcccccccgagaacgacaugcugcugaaggagaucagcggcagccugauccccgagggcauccacagcacccugaacaucgugaccauccaguucgacaccgacuucuacaucagcaagagcggcuucgccauccaguucagcagcagcguggccaccgccugcagagaccccggcgugcccaugaacggcaccagaaacggcgacggcagagagcccggcgacaccgugguguuccagugcgaccccggcuacgagcugcagggcgaggagagaaucaccugcauccagguggagaacagauacuucuggcagcccagcccccccgugugcaucgcccccugcggcggcaaccugaccggcagcagcggcuucauccugagccccaacuucccccaccccuacccccacagcagagacugcgacuggaccaucaccgugaacgccgacuacgugaucagccuggccuucaucagcuucagcaucgagcccaacuacgacuuccuguacaucuacgacggccccgacagcaacagcccccugaucggcagcuuccaggacagcaagcugcccgagagaaucgagagcagcagcaacaccaugcaccuggccuucagaagcgacggcagcgugagcuacaccggcuuccaccuggaguacaaggccaagcugagagagagcugcuucgaccccggcaacaucaugaacggcaccagacugggcauggacuacaagcugggcagcaccgugaccuacuacugcgacgccggcuacgugcugcagggcuacagcacccugaccugcaucaugggcgacgacggcagacccggcuggaacagagcccugcccagcugccacgcccccugcggcagcagaagcaccggcagcgagggcaccgugcugagccccaacuaccccaagaacuacagcgugggccacaacugcguguacagcaucgccgugcccaaggaguucgugguguucggccaguucguguucuuccagaccagccugcacgacgugguggagguguacgacggccccacccagcagagcagccugcugagcagccugagcggcagccacagcggcgagagccugccccugagcagcggcaaccagaucaccaucagauucaccagcgugggccccaucaccgccaagggcuuccacuucguguaccaggccgugcccagaaccagcagcacccagugcagcagcgugcccgagcccagauucggcagaagaaucggcaacgaguucgccgugggcagcagcgugcuguucgacugcaaccccggcuacauccugcacggcagcaucgccaucagaugcgagaccgugcccaacagccuggcccaguggaacgacagccugcccaccugcaucgugcccugcggcggcauccugaccaagagaaagggcaccauccugagccccggcuaccccgagcccuacgacaacaaccugaacugcguguggaagaucaccgugcccgagggcgccggcauccaggugcagguggugagcuucgccaccgagcacaacugggacagccuggacuucuacgacggcggcgacaacaacgcccccagacugggcagcuacagcggcaccaccaucccccaccugcugaacagcaccagcaacaaccuguaccugaacuuccagagcgacaucagcgugagcgccgccggcuuccaccuggaguacaccgccaucggccuggacagcugccccgagccccagacccccagcagcggcaucaagaucggcgacagauacauggugggcgacguggugagcuuccagugcgaccagggcuacagccugcagggccacagccacaucaccugcaugcccggccccgugagaagauggaacuaccccauccccaucugccuggcccagugcggcggcgccaugagcgacuucagcggcgugauccugagccccggcuuccccggcaacuaccccagcagccuggacugcaccuggaccaucaaccugcccaucggcuucggcgugcaccugcaguucgugaacuucagcaccgagaccauccacgacuaccuggaggugagaagcggcagcagcgagaccagcaccgugaucggcagacugagcggcccccagauccccagcagccuguucagcaccacccacgagaccagccuguacuuccacagcgacuacagccagaacaagcagggcuuccacaucguguaccaggccuaccagcugcagagcugccccgaccccagacccuucagaaacggcuucgugaucggcaacgacuucaccgugggccagaccaucagcuucgagugcuuccccggcuacacccugaucggcaacagcgcccugaccugccugcacggcgugagcagaaacuggaaccacccccugcccagaugcgaggcccugugcggcggcaacaucaccgccaugaacggcaccaucuacagccccggcuaccccgacgaguaccccaacuuccaggacugcuucuggcuggugagagugccccccggcaacggcaucuacaucaacuucaccgugcugcagaccgagcccaucuacgacuucaucaccgugugggacggccccgaccagaacagcccccagaucggccaguucagcggcaacaccgcccuggagagcguguacagcaccagcaaccagauccugaucaaguuccacagcgacuucaccaccagcggcuucuucgugcugagcuaccacgccuaccagcugagagugugccagccccccccccccgugcccaacgccgagauccugaccgaggacgacgaguucgagaucggcgacaucaucagauaccagugccugcccggcuucacccuggugggcaacgccauccugaccugcagacugggcgagagacugcagauggacggcgccccccccgugugccaggugcugugccccgccaacgagcugagacuggacagcaccggcgugauccugagccccggcuaccccgacagcuaccccaaccugcagaugugcgccuggagcaucagcguggagaagggcuacaacaucaccauguucguggaguucuuccagaccgagaaggaguucgacgugcugcagguguacgacggccccaacauccagagccccgugcugaucagccugagcggcgacuacagcagcgccuucaacaucaccagcaacggccacgagguguuccugcaguggagcgccgaccacggcaacaacaagaagggcuucagaaucagauacaucgccuucuacugcagcacccccgagagccccccccacggcuacaucaucagccagaccggcggccagcugaacagcguggugagaugggccugcgacagaggcuucagacuggugggcaagagcagcgccgugugcagaaagagcagcuacggcuaccacgccugggacgcccccgugcccgccugccaggccaucagcugcggcauccccaaggcccccaccaacggcggcauccugaccaccgacuaccuggugggcaccagagugaccuacuucugcaacgacggcuacagacugagcagcaaggagcugaccaccgccgugugccagagcgacggcaccuggagcaaccacaacaagacccccagaugcguggugaucagcugcggcgagcugcccaccccccccaacggcaacaagaucggcacccagaccagcuacggcagcaccgccaucuucaccugcgaccugggcuucaugcuggugggcagcgccgugagagagugccugagcagcggccuguggagcgagagcgagaccagaugccuggccggccacugcggcauccccgagcugaucgugaacggccaggugaucggcgagaacuacggcuacagagacaccgugguguaccagugcaaccccggcuucagacugaucggcagcagcgugagaaucugccagcaggaccacaacuggagcggccagcugcccagcugcgugcccgugagcugcggccaccccggcagccccaucuacggcagaaccagcggcaacggcuucaacuucaacgacguggugaccuucagcugcaacaucggcuaccugaugcagggccccaccaaggcccagugccaggccaacagacaguggagccaccccccccccaugugcaagguggugaacugcagcgaccccggcauccccgccaacagcaagagagagagcaagaucgagcacggcaacuucaccuacggcaccgugguguucuacgacugcaaccccggcuacuuccuguucggcagcagcgugcugaucugccagcccaacggccagugggacaagccccugcccgagugcaucaugaucgacugcggccaccccggcgugccccccaacgccgugcugagcggcgagaaguacaccuucggcagcaccgugcacuacagcugcaccggcaagagaagccugcugggccagagcagcagaaccugccagcugaacggccacuggagcggcagccagccccacugcagcggcgacgccaccggcaccugcggcgaccccggcacccccggccacggcagcagacaggagagcaacuucagaaccaagagcaccgugagauacgccugcgacaccggcuacauccugcacggcagcgaggagagaaccugccuggccaacggcagcuggaccggcagacagcccgagugcaaggccgugcagugcggcaaccccggcaccaccgccaacggcaagguguucagaaucgacggcaccaccuucagcagcagcgugaucuacagcugcauggagggcuacauccugagcggccccagcgugagacagugcaccgccaacggcaccuggagcggcacccugcccaacugcaccaucaucagcugcggcgaccccggcauccccgccaacggccugagauacggcgacgacuacguggugggccagaacgugagcuacaugugccagcccggcuacaccauggagcugaacggcagcagaaucagaaccugcaccaucaacggcaccuggagcggcgugaugcccaccugcagagccgugaccugccccacccccccccagaucagcaacggcagacuggagggcaccaacuucgacuggggcuucagcaucagcuacaucugcagccccggcuacgagcugagcuuccccgccgugcugaccugcgugggcaacggcaccuggagcggcgaggugccccagugccugcccaaguucugcggcgaccccggcauccccgcccagggcaagagagagggcaagagcuucaucuaccagagcgaggugagcuucagcugcaacuuccccuucauccuggugggcagcagcaccagaaucugccaggccgacggcaccuggagcggcagcagcccccacugcaucgagcccacccagaccagcugcgagaaccccggcgugcccagacacggcagccagaacaacaccuucggcuuccaggugggcagcguggugcaguuccacugcaagaagggccaccugcugcagggcagcaccaccagaaccugccugcccgaccugaccuggagcggcauccagcccgagugcaucccccacagcugcaagcagcccgagacccccgcccacgccaacguggugggcauggaccugcccagccacggcuacacccugaucuacaccugccagcccggcuucuuccuggccggcggcaccgagcacagagugugcagaagcgacaacaccuggaccggcaaggugcccaucugcgaggccggcagcaagauccuggugaaggaccccagacccgcccugggcacccccagccccaagcugagcgugcccgacgacguguucgcccagaacuacaucuggaagggcagcuacaacuucaagggcagaaagcagcccaugacccugaccgugaccagcuucaacgccagcaccggcagagugaacgccacccugagcaacagcaacauggagcugcugcugagcggcguguacaagagccaggaggccagacugaugcugagaaucuaccugaucaaggugcccgcccacgccagcgugaagaagaugaaggaggagaacugggccauggacggcuucgugagcgccgagcccgacggcgccaccuacguguuccagggcuucauccagggcaaggacuacggccaguucggccugcagagacugggccugaacaugagcgagggcagcaacagcagcaaccagccccacggcaccaacagcagcagcguggccaucgccauccuggugcccuucuucgcccugaucuucgccggcuucggcuucuaccuguacaagcagagaaccgcccccaagacccaguacaccggcugcagcgugcacgagaacaacaacggccaggccgccuucgagaaccccauguacgacaccaacgccaagagcguggagggcaaggccgugagauucgaccccaaccugaacaccgugugcaccaugguguaa

SEQ ID NO: 15702 - RNA, 531 nt, Artificial Sequence
  CSN1S1__Homo_sapiens__NP_001020275
augagacugcugauccugaccugccugguggccguggcccuggccagacccaagcugccccugagauaccccgagagacugcagaaccccagcgagagcagcgagcccaucccccuggagagcagagaggaguacaugaacggcaugaacagaagaaacauccugagagagaagcagaccgacgagaucaaggacaccagaaacgagagcacccagaacugcgugguggccgagcccgagaagauggagagcagcaucagcagcagcagcgaggagcaguucugcagacugaacgaguacaaccagcugcagcugcaggccgcccacgcccaggagcagaucagaagaaugaacgagaacagccacgugcaggugcccuuccagcagcugaaccagcuggccgccuaccccuacgccgugugguacuacccccagaucaugcaguacgugcccuucccccccuucagcgacaucagcaaccccaccgcccacgagaacuacgagaagaacaacgugaugcugcagugguaa

SEQ ID NO: 15703 - RNA, 681 nt, Artificial Sequence
  CSN2__Homo_sapiens__XP_011529920
augaaggugcugauccuggccugccugguggcccuggcccuggccagagagaccaucgagagccugagcagcagcgaggagagcaucaccgaguacaagcagaagguggagaaggugaagcacgaggaccagcagcagggcgaggacgagcaccaggacaagaucuaccccagcuuccagccccagccccugaucuaccccuucguggagcccauccccuacggcuuccugccccagaacauccugccccuggcccagcccgccguggugcugcccgugccccagcccgagaucauggaggugcccaaggccaaggacaccguguacaccaagggcagagugaugcccgugcugaagagccccaccauccccuucuucgacccccagauccccaagcugaccgaccuggagaaccugcaccugccccugccccugcugcagccccugaugcagcaggugccccagcccaucccccagacccuggcccugcccccccagccccuguggagcgugccccagcccaaggugcugcccaucccccagcagguggugcccuacccccagagagccgugcccgugcaggcccugcugcugaaccaggagcugcugcugaaccccacccaccagaucuaccccgugacccagccccuggcccccgugcacaaccccaucagcguguaa

SEQ ID NO: 15704 - RNA, 549 nt, Artificial Sequence
  CSN3__Homo_sapiens__NP_005203
augaagagcuuccugcugguggugaacgcccuggcccugacccugcccuuccuggccguggaggugcagaaccagaagcagcccgccugccacgagaacgacgagagacccuucuaccagaagaccgcccccuacgugcccauguacuacgugcccaacagcuaccccuacuacggcaccaaccuguaccagagaagacccgccaucgccaucaacaaccccuacgugcccagaaccuacuacgccaaccccgccguggugagaccccacgcccagaucccccagagacaguaccugcccaacagccacccccccaccguggugagaagacccaaccugcaccccagcuucaucgccaucccccccaagaagauccaggacaagaucaucauccccaccaucaacaccaucgccaccguggagcccacccccgcccccgccaccgagcccaccguggacagcguggugacccccgaggccuucagcgagagcaucaucaccagcacccccgagaccaccaccguggccgugaccccccccaccgccuaa

SEQ ID NO: 15705 - RNA, 1098 nt, Artificial Sequence
  CSNK1A1__Homo_sapiens__NP_001020276
auggccagcagcagcggcagcaaggccgaguucaucgugggcggcaaguacaagcuggugagaaagaucggcagcggcagcuucggcgacaucuaccuggccaucaacaucaccaacggcgaggagguggccgugaagcuggagagccagaaggccagacacccccagcugcuguacgagagcaagcuguacaagauccugcagggcggcgugggcaucccccacaucagaugguacggccaggagaaggacuacaacgugcuggugauggaccugcugggccccagccuggaggaccuguucaacuucugcagcagaagauucaccaugaagaccgugcugaugcuggccgaccagaugaucagcagaaucgaguacgugcacaccaagaacuucauccacagagacaucaagcccgacaacuuccugaugggcaucggcagacacugcaacaagugccuggagagccccgugggcaagagaaagagaagcaugaccgugagcaccagccaggaccccagcuucagcggccugaaccagcuguuccugaucgacuucggccuggccaagaaguacagagacaacagaaccagacagcacauccccuacagagaggacaagaaccugaccggcaccgccagauacgccagcaucaacgcccaccugggcaucgagcagagcagaagagacgacauggagagccugggcuacgugcugauguacuucaacagaaccagccugcccuggcagggccugaaggccgccaccaagaagcagaaguacgagaagaucagcgagaagaagaugagcacccccguggaggugcugugcaagggcuuccccgccgaguucgccauguaccugaacuacugcagaggccugagauucgaggaggcccccgacuacauguaccugagacagcuguucagaauccuguucagaacccugaaccaccaguacgacuacaccuucgacuggaccaugcugaagcagaaggccgcccagcaggccgccagcagcagcggccagggccagcaggcccagacccccaccggcaagcagaccgacaagaccaagagcaacaugaagggcuucuaa

SEQ ID NO: 15706 - RNA, 1248 nt, Artificial Sequence
  CSNK1D__Homo_sapiens__NP_001884
auggagcugagagugggcaacagauacagacugggcagaaagaucggcagcggcagcuucggcgacaucuaccugggcaccgacaucgccgccggcgaggagguggccaucaagcuggagugcgugaagaccaagcacccccagcugcacaucgagagcaagaucuacaagaugaugcagggcggcgugggcauccccaccaucagauggugcggcgccgagggcgacuacaacgugauggugauggagcugcugggccccagccuggaggaccuguucaacuucugcagcagaaaguucagccugaagaccgugcugcugcuggccgaccagaugaucagcagaaucgaguacauccacagcaagaacuucauccacagagacgugaagcccgacaacuuccugaugggccugggcaagaagggcaaccugguguacaucaucgacuucggccuggccaagaaguacagagacgccagaacccaccagcacauccccuacagagagaacaagaaccugaccggcaccgccagauacgccagcaucaacacccaccugggcaucgagcagagcagaagagacgaccuggagagccugggcuacgugcugauguacuucaaccugggcagccugcccuggcagggccugaaggccgccaccaagagacagaaguacgagagaaucagcgagaagaagaugagcacccccaucgaggugcugugcaagggcuaccccagcgaguucgccaccuaccugaacuucugcagaagccugagauucgacgacaagcccgacuacagcuaccugagacagcuguucagaaaccuguuccacagacagggcuucagcuacgacuacguguucgacuggaacaugcugaaguucggcgccagcagagccgccgacgacgccgagagagagagaagagacagagaggagagacugagacacagcagaaaccccgccaccagaggccugcccagcaccgccagcggcagacugagaggcacccaggagguggccccccccaccccccugacccccaccagccacaccgccaacaccagccccagacccgugagcggcauggagagagagagaaaggugagcaugagacugcacagaggcgcccccgugaacaucagcagcagcgaccugaccggcagacaggacaccagcagaaugagcaccagccagauccccggcagaguggccagcagcggccugcagagcguggugcacagauaa

SEQ ID NO: 15707 - RNA, 1272 nt, Artificial Sequence
  CSNK1G3__Homo_sapiens__NP_001026982
auggagaacaagaagaaggacaaggacaagagcgacgacagaauggccagacccagcggcagaagcggccacaacaccagaggcaccggcagcagcagcagcggcgugcugauggugggccccaacuucagagugggcaagaagaucggcugcggcaacuucggcgagcugagacugggcaagaaccuguacaccaacgaguacguggccaucaagcuggagcccaugaagagcagagccccccagcugcaccuggaguacagauucuacaagcagcugggcagcggcgacggcaucccccagguguacuacuucggccccugcggcaaguacaacgccauggugcuggagcugcugggccccagccuggaggaccuguucgaccugugcgacagaaccuucagccugaagaccgugcugaugaucgccauccagcugaucagcagaauggaguacgugcacagcaagaaccugaucuacagagacgugaagcccgagaacuuccugaucggcagacccggcaacaagacccagcaggugauccacaucaucgacuucggccuggccaaggaguacaucgaccccgagaccaagaagcacauccccuacagagagcacaagagccugaccggcaccgccagauacaugagcaucaacacccaccugggcaaggagcagagcagaagagacgaccuggaggcccugggccacauguucauguacuuccugagaggcagccugcccuggcagggccugaaggccgacacccugaaggagagauaccagaagaucggcgacaccaagagagccacccccaucgaggugcugugcgagaacuuccccgagauggccaccuaccugagauacgugagaagacuggacuucuucgagaagcccgacuacgacuaccugagaaagcuguucaccgaccuguucgacagaaagggcuacauguucgacuacgaguacgacuggaucggcaagcagcugcccacccccgugggcgccgugcagcaggaccccgcccugagcagcaacagagaggcccaccagcacagagacaagaugcagcagagcaagaaccagguggugagcagcaccaacggcgagcugaacaccgacgaccccaccgccggcagaagcaacgcccccaucaccgcccccaccgagguggaggugauggacgagaccaacugccagaaggugcugaacauguggugcugcugcuucuucaagagaagaaagagaaagaccauccagagacacaaguaa

SEQ ID NO: 15708 - RNA, 1176 nt, Artificial Sequence
  CSNK2A1__Homo_sapiens__XP_011527477
augagcggccccgugcccagcagagccagaguguacaccgacgugaacacccacagacccagagaguacugggacuacgagagccacgugguggaguggggcaaccaggacgacuaccagcuggugagaaagcugggcagaggcaaguacagcgagguguucgaggccaucaacaucaccaacaacgagaaggugguggugaagauccugaagcccgugaagaagaagaagaucaagagagagaucaagauccuggagaaccugagaggcggccccaacaucaucacccuggccgacaucgugaaggaccccgugagcagaacccccgcccugguguucgagcacgugaacaacaccgacuucaagcagcuguaccagacccugaccgacuacgacaucagauucuacauguacgagauccugaaggcccuggacuacugccacagcaugggcaucaugcacagagacgugaagccccacaacgugaugaucgaccacgagcacagaaagcugagacugaucgacuggggccuggccgaguucuaccaccccggccaggaguacaacgugagaguggccagcagauacuucaagggccccgagcugcugguggacuaccagauguacgacuacagccuggacauguggagccugggcugcaugcuggccagcaugaucuucagaaaggagcccuucuuccacggccacgacaacuacgaccagcuggugagaaucgccaaggugcugggcaccgaggaccuguacgacuacaucgacaaguacaacaucgagcuggaccccagauucaacgacauccugggcagacacagcagaaagagaugggagagauucgugcacagcgagaaccagcaccuggugagccccgaggcccuggacuuccuggacaagcugcugagauacgaccaccagagcagacugaccgccagagaggccauggagcaccccuacuucuacaccguggugaaggaccaggccagaaugggcagcagcagcaugcccggcggcagcacccccgugagcagcgccaacaugaugagcggcaucagcagcgugcccacccccagcccccugggcccccuggccggcagccccgugaucgccgccgccaacccccugggcaugcccgugcccgccgccgccggcgcccagcaguaa

SEQ ID NO: 15709 - RNA, 1053 nt, Artificial Sequence
  CSNK2A2__Homo_sapiens__NP_001887
augcccggccccgccgccggcagcagagccagaguguacgccgaggugaacagccugagaagcagagaguacugggacuacgaggcccacgugcccagcuggggcaaccaggacgacuaccagcuggugagaaagcugggcagaggcaaguacagcgagguguucgaggccaucaacaucaccaacaacgagagagugguggugaagauccugaagcccgugaagaagaagaagaucaagagagaggugaagauccuggagaaccugagaggcggcaccaacaucaucaagcugaucgacaccgugaaggaccccgugagcaagacccccgcccugguguucgaguacaucaacaacaccgacuucaagcagcuguaccagauccugaccgacuucgacaucagauucuacauguacgagcugcugaaggcccuggacuacugccacagcaagggcaucaugcacagagacgugaagccccacaacgugaugaucgaccaccagcagaagaagcugagacugaucgacuggggccuggccgaguucuaccaccccgcccaggaguacaacgugagaguggccagcagauacuucaagggccccgagcugcugguggacuaccagauguacgacuacagccuggacauguggagccugggcugcaugcuggccagcaugaucuucagaagagagcccuucuuccacggccaggacaacuacgaccagcuggugagaaucgccaaggugcugggcaccgaggagcuguacggcuaccugaagaaguaccacaucgaccuggacccccacuucaacgacauccugggccagcacagcagaaagagaugggagaacuucauccacagcgagaacagacaccuggugagccccgaggcccuggaccugcuggacaagcugcugagauacgaccaccagcagagacugaccgccaaggaggccauggagcaccccuacuucuaccccguggugaaggagcagagccagcccugcgccgacaacgccgugcugagcagcggccugaccgccgccagauaa

SEQ ID NO: 15710 - RNA, 648 nt, Artificial Sequence
  CSNK2B__Homo_sapiens__NP_001311
augagcagcagcgaggaggugagcuggaucagcugguucugcggccugagaggcaacgaguucuucugcgagguggacgaggacuacauccaggacaaguucaaccugaccggccugaacgagcaggugccccacuacagacaggcccuggacaugauccuggaccuggagcccgacgaggagcuggaggacaaccccaaccagagcgaccugaucgagcaggccgccgagaugcuguacggccugauccacgccagauacauccugaccaacagaggcaucgcccagaugcuggagaaguaccagcagggcgacuucggcuacugccccagaguguacugcgagaaccagcccaugcugcccaucggccugagcgacauccccggcgaggccauggugaagcuguacugccccaagugcauggacguguacacccccaagagcagcagacaccaccacaccgacggcgccuacuucggcaccggcuucccccacaugcuguucauggugcaccccgaguacagacccaagagacccgccaaccaguucgugcccagacuguacggcuucaagauccaccccauggccuaccagcugcagcugcaggccgccagcaacuucaagagccccgugaagaccaucagauaa

SEQ ID NO: 15711 - RNA, 6969 nt, Artificial Sequence
  CSPG4__Homo_sapiens__NP_001888
augcagagcggccccagacccccccugcccgcccccggccuggcccuggcccugacccugaccaugcuggccagacuggccagcgccgccagcuucuucggcgagaaccaccuggaggugcccguggccaccgcccugaccgacaucgaccugcagcugcaguucagcaccagccagcccgaggcccugcugcugcuggccgccggccccgccgaccaccugcugcugcagcuguacagcggcagacugcaggugagacuggugcugggccaggaggagcugagacugcagacccccgccgagacccugcugagcgacagcaucccccacaccguggugcugaccgugguggagggcugggccacccugagcguggacggcuuccugaacgccagcagcgccgugcccggcgccccccuggaggugcccuacggccuguucgugggcggcaccggcacccugggccugcccuaccugagaggcaccagcagaccccugagaggcugccugcacgccgccacccugaacggcagaagccugcugagaccccugacccccgacgugcacgagggcugcgccgaggaguucagcgccagcgacgacguggcccugggcuucagcggcccccacagccuggccgccuuccccgccuggggcacccaggacgagggcacccuggaguucacccugaccacccagagcagacaggccccccuggccuuccaggccggcggcagaagaggcgacuucaucuacguggacaucuucgagggccaccugagagccgugguggagaagggccagggcaccgugcugcugcacaacagcgugcccguggccgacggccagccccacgaggugagcgugcacaucaacgcccacagacuggagaucagcguggaccaguaccccacccacaccagcaacagaggcgugcugagcuaccuggagcccagaggcagccugcugcugggcggccuggacgccgaggccagcagacaccugcaggagcacagacugggccugacccccgaggccaccaacgccagccugcugggcugcauggaggaccugagcgugaacggccagagaagaggccugagagaggcccugcugaccagaaacauggccgccggcugcagacuggaggaggaggaguacgaggacgacgccuacggccacuacgaggccuucagcacccuggcccccgaggccuggcccgccauggagcugcccgagcccugcgugcccgagcccggccugccccccguguucgccaacuucacccagcugcugaccaucagcccccuggugguggccgagggcggcaccgccuggcuggaguggagacacgugcagcccacccuggaccugauggaggccgagcugagaaagagccaggugcuguucagcgugaccagaggcgccagacacggcgagcuggagcuggacauccccggcgcccaggccagaaagauguucacccugcuggacguggugaacagaaaggccagauucauccacgacggcagcgaggacaccagcgaccagcuggugcuggaggugagcgugaccgccagagugcccaugcccagcugccugagaagaggccagaccuaccugcugcccauccaggugaaccccgugaacgaccccccccacaucaucuucccccacggcagccugauggugauccuggagcacacccagaagccccugggccccgagguguuccaggccuacgaccccgacagcgccugcgagggccugaccuuccaggugcugggcaccagcagcggccugcccguggagagaagagaccagcccggcgagcccgccaccgaguucagcugcagagagcuggaggccggcagccugguguacgugcacagaggcggccccgcccaggaccugaccuucagagugagcgacggccugcaggccagcccccccgccacccugaaggugguggccaucagacccgccauccagauccacagaagcaccggccugagacuggcccagggcagcgccaugcccauccugcccgccaaccugagcguggagaccaacgccgugggccaggacgugagcgugcuguucagagugaccggcgcccugcaguucggcgagcugcagaagcagggcgccggcggcguggagggcgccgaguggugggccacccaggccuuccaccagagagacguggagcagggcagagugagauaccugagcaccgacccccagcaccacgccuacgacaccguggagaaccuggcccuggaggugcaggugggccaggagauccugagcaaccugagcuuccccgugaccauccagagagccaccguguggaugcugagacuggagccccugcacacccagaacacccagcaggagacccugaccaccgcccaccuggaggccacccuggaggaggccggccccagcccccccaccuuccacuacgagguggugcaggcccccagaaagggcaaccugcagcugcagggcaccagacugagcgacggccagggcuucacccaggacgacauccaggccggcagagugaccuacggcgccaccgccagagccagcgaggccguggaggacaccuucagauucagagugaccgccccccccuacuucagcccccuguacaccuuccccauccacaucggcggcgaccccgacgcccccgugcugaccaacgugcugcugguggugcccgagggcggcgagggcgugcugagcgccgaccaccuguucgugaagagccugaacagcgccagcuaccuguacgaggugauggagagacccagacacggcagacuggccuggagaggcacccaggacaagaccaccauggugaccagcuucaccaacgaggaccugcugagaggcagacugguguaccagcacgacgacagcgagaccaccgaggacgacauccccuucguggccaccagacagggcgagagcagcggcgacauggccugggaggaggugagaggcguguucagaguggccauccagcccgugaacgaccacgcccccgugcagaccaucagcagaaucuuccacguggccagaggcggcagaagacugcugaccaccgacgacguggccuucagcgacgccgacagcggcuucgccgacgcccagcuggugcugaccagaaaggaccugcuguucggcagcaucguggccguggacgagcccaccagacccaucuacagauucacccaggaggaccugagaaagagaagagugcuguucgugcacagcggcgccgacagaggcuggauccagcugcaggugagcgacggccagcaccaggccaccgcccugcuggaggugcaggccagcgagcccuaccugagaguggccaacggcagcagccugguggugccccagggcggccagggcaccaucgacaccgccgugcugcaccuggacaccaaccuggacaucagaagcggcgacgaggugcacuaccacgugaccgccggccccagauggggccagcuggugagagccggccagcccgccaccgccuucagccagcaggaccugcuggacggcgccgugcuguacagccacaacggcagccugagccccagagacaccauggccuucagcguggaggccggccccgugcacaccgacgccacccugcaggugaccaucgcccuggagggcccccuggccccccugaagcuggugagacacaagaagaucuacguguuccagggcgaggccgccgagaucagaagagaccagcuggaggccgcccaggaggccgugccccccgccgacaucguguucagcgugaagagcccccccagcgccggcuaccuggugauggugagcagaggcgcccuggccgacgagccccccagccuggaccccgugcagagcuucagccaggaggccguggacaccggcagagugcuguaccugcacagcagacccgaggccuggagcgacgccuucagccuggacguggccagcggccugggcgccccccuggagggcgugcugguggagcuggaggugcugcccgccgccaucccccuggaggcccagaacuucagcgugcccgagggcggcagccugacccuggcccccccccugcugagagugagcggccccuacuuccccacccugcugggccugagccugcaggugcuggagcccccccagcacggcgcccugcagaaggaggacggcccccaggccagaacccugagcgccuucagcuggagaaugguggaggagcagcugaucagauacgugcacgacggcagcgagacccugaccgacagcuucgugcugauggccaacgccagcgagauggacagacagagccaccccguggccuucaccgugaccgugcugcccgugaacgaccagccccccauccugaccaccaacaccggccugcagaugugggagggcgccaccgcccccauccccgccgaggcccugagaagcaccgacggcgacagcggcagcgaggaccugguguacaccaucgagcagcccagcaacggcagaguggugcugagaggcgcccccggcaccgaggugagaagcuucacccaggcccagcuggacggcggccuggugcuguucagccacagaggcacccuggacggcggcuucagauucagacugagcgacggcgagcacaccagccccggccacuucuucagagugaccgcccagaagcaggugcugcugagccugaagggcagccagacccugaccgugugccccggcagcgugcagccccugagcagccagacccugagagccagcagcagcgccggcaccgacccccagcugcugcuguacagaguggugagaggcccccagcugggcagacuguuccacgcccagcaggacagcaccggcgaggcccuggugaacuucacccaggccgagguguacgccggcaacauccuguacgagcacgagaugccccccgagcccuucugggaggcccacgacacccuggagcugcagcugagcagcccccccgccagagacguggccgccacccuggccguggccgugagcuucgaggccgccugcccccagagacccagccaccuguggaagaacaagggccugugggugcccgagggccagagagccagaaucaccguggccgcccuggacgccagcaaccugcuggccagcgugcccagcccccagagaagcgagcacgacgugcuguuccaggugacccaguuccccagcagaggccagcugcuggugagcgaggagccccugcacgccggccagccccacuuccugcagagccagcuggccgccggccagcugguguacgcccacggcggcggcggcacccagcaggacggcuuccacuucagagcccaccugcagggccccgccggcgccagcguggccggcccccagaccagcgaggccuucgccaucaccgugagagacgugaacgagagacccccccagccccaggccagcgugccccugagacugaccagaggcagcagagcccccaucagcagagcccagcugagcgugguggaccccgacagcgcccccggcgagaucgaguacgaggugcagagagccccccacaacggcuuccugagccuggugggcggcggccugggccccgugaccagauucacccaggccgacguggacagcggcagacuggccuucguggccaacggcagcagcguggccggcaucuuccagcugagcaugagcgacggcgccagccccccccugcccaugagccuggccguggacauccugcccagcgccaucgaggugcagcugagagccccccuggaggugccccaggcccugggcagaagcagccugagccagcagcagcugagaguggugagcgacagagaggagcccgaggccgccuacagacugauccagggcccccaguacggccaccugcuggugggcggcagacccaccagcgccuucagccaguuccagaucgaccagggcgaggugguguucgccuucaccaacuucagcagcagccacgaccacuucagagugcuggcccuggccagaggcgugaacgccagcgccguggugaacgugaccgugagagcccugcugcacgugugggccggcggccccuggccccagggcgccacccugagacuggaccccaccgugcuggacgccggcgagcuggccaacagaaccggcagcgugcccagauucagacugcuggagggccccagacacggcagaguggugagagugcccagagccagaaccgagcccggcggcagccagcugguggagcaguucacccagcaggaccuggaggacggcagacugggccuggaggugggcagacccgagggcagagcccccggccccgccggcgacagccugacccuggagcugugggcccagggcgugccccccgccguggccagccuggacuucgccaccgagcccuacaacgccgccagacccuacagcguggcccugcugagcgugcccgaggccgccagaaccgaggccggcaagcccgagagcagcacccccaccggcgagcccggccccauggccagcagccccgagcccgccguggccaagggcggcuuccugagcuuccuggaggccaacauguucagcgugaucauccccaugugccuggugcugcugcugcuggcccugauccugccccugcuguucuaccugagaaagagaaacaagaccggcaagcacgacgugcaggugcugaccgccaagcccagaaacggccuggccggcgacaccgagaccuucagaaagguggagcccggccaggccaucccccugaccgccgugcccggccagggccccccccccggcggccagcccgaccccgagcugcugcaguucugcagaacccccaaccccgcccugaagaacggccaguacuggguguaa

SEQ ID NO: 15712 - RNA, 1206 nt, Artificial Sequence
  CSPG5__Homo_sapiens__NP_001193871
augccccccgccauccccgaggccaccgaggccagcggcccccccagccccacccccggcgacaagcugagccccgccagcgagcugcccaaggagagcccccuggagguguggcugaaccugggcggcagcacccccgacccccagggccccgagcugaccuaccccuuccagggcacccuggagccccagcccgccagcgacaucaucgacaucgacuacuucgagggccuggacggcgagggcagaggcgccgaccugggcagcuuccccggcagccccggcaccagcgagaaccaccccgacaccgagggcgagacccccagcuggagccugcuggaccuguacgacgacuucacccccuucgacgagagcgacuucuaccccaccaccagcuucuacgacgaccuggacgaggaggaggaggaggaggaggacgacaaggacgccgugggcggcggcgaccuggaggacgagaacgagcugcuggugcccaccggcaagcccggccugggccccggcaccggccagcccaccagcagauggcacgccgugcccccccagcacacccugggcagcgugcccggcagcagcaucgcccugagacccagacccggcgagcccggcagagaccuggccagcagcgagaacggcaccgagugcagaagcggcuucgugagacacaacggcagcugcagaagcgugugcgaccuguuccccagcuacugccacaacggcggccagugcuaccugguggagaacaucggcgccuucugcagaugcaacacccaggacuacaucuggcacaagggcaugagaugcgagagcaucaucaccgacuuccaggugaugugcguggccgugggcagcgccgcccuggugcugcugcugcuguucaugaugaccguguucuucgccaagaagcuguaccugcugaagaccgagaacaccaagcugagaagaaccaacaaguucagaacccccagcgagcugcacaacgacaacuucagccugagcaccaucgccgagggcagccaccccaacgacgaccccagcgccccccacaagauccaggaggugcugaagagcugccugaaggaggaggagagcuucaacauccagaacagcaugagccccaagcuggagggcggcaagggcgaccaggccgaccuggacgugaacugccugcagaacaaccugaccuaa

SEQ ID NO: 15713 - RNA, 2631 nt, Artificial Sequence
  CSPP1__Homo_sapiens__NP_001278268
auggacgagagauucagauacgagagcgacuucgacagaagacugagcagaguguacaccaacgacagaaugcacagaaacaagagaggcaacaugccccccauggagcacgacggcgacgugaucgagcagagcaacaucagaaucagcagcgccgagaacaagagcgcccccgacaacgagaccagcaagagcgccaaccaggacaccugcagccccuucgccggcaugcuguucggcggcgaggacagagagcugauccagagaagaaaggagaaguacagacuggagcugcuggagcagauggccgagcagcagagaaacaagagaagagagaaggaccuggagcugagaguggccgccagcggcgcccaggaccccgagaagagccccgacagacugaagcaguucagcguggcccccagacacuucgaggagaugaucccccccgagagacccagaaucgccuuccagaccccccugcccccccugagcgcccccagcgugccccccauccccagcgugcaccccgugcccagccagaacgaggaccugagaagcggccugagcagcgcccugggcgagauggugagccccagaaucgccccccugcccccccccccccugcugcccccccuggccaccaacuacagaacccccuacgacgacgccuacuacuucuacggcagcagaaacaccuucgaccccagccuggccuacuacggcagcggcaugaugggcgugcagcccgccgccuacgugagcgcccccgugacccaccagcuggcccagcccguggugaacaccgugggccagaacgagcugaagaucaccagcgaccaggugaucaacagcggccugaucuucgaggacaagcccaagcccagcaagcagagccugcagagcuaccaggaggcccugcagcagcagaucagagagagagaggagagaagaaagaaggagagagaggagaaggaggaguacgaggccaagcuggaggccgagaugagaaccuacaaccccuggggcaagggcggcggcggcgccccccugagagacgccaagggcaaccugaucagccacaugcagacccagagcagccccuucgccagaggcaacguguucggcgagccccccaccgagcugcagaucaagcagcaggagcuguacaagaacuuccugagauuccagaucgaggagaagaagcagagagaggaggccgagagagagagacugagaaucgccgaggagaaggaggagagaagacuggccgagcagagagccagaauccagcaggaguacgaggaggagcaggagaagaagagagagaaggaggaggagcagagacugaagaacgaggagcacaucagacuggccgaggagagacagaaggaggccgagagaaagaagaaggaggaggaggagaaguacaaccugcagcugcagcacuacugcgagagagacaaccugaucggcgaggagaccaagcacaugagacagcccagccccaucgugcccgcccugcagaacaagaucgccagcaagcugcagagaccccccagcguggacagcaucaucagaagcuucauccacgagagcagcaugagcagagcccagagcccccccgugcccgccagaaagaaccagcugagagccgaggaggagaagaagaacgugaucauggagcugagcgagaugagaaagcagcugagaagcgaggagagaagacugcaggagagacugcugcacauggacagcgacgacgagauccccaucagaaagaaggagagaaaccccauggacaucuucgacauggccagacacagacugcaggcccccgugagaagacagagccccaagggccuggacgccgccaccuuccagaacgugcacgacuucaacgagcugaaggacagagacagcgagaccagaguggaccugaaguucauguaccuggacccccccagagaccaccacacccuggagauccagcagcaggcccugcugagagagcagcagaagagacugaacagaaucaagaugcaggagggcgccaagguggaccuggacgccauccccagcgccaaggugagagagcagagaaugcccagagacgacaccagcgacuuccugaagaacagccugcuggagagcgacagcgccuucaucggcgccuacggcgagaccuaccccgccaucgaggacgacgugcugcccccccccagccagcugcccagcgccagagagagaagaagaaacaaguggaagggccuggacaucgacagcagcagacccaacguggcccccgacggccugagccugaagagcaucagcagcgugaacguggacgagcugagagugagaaacgaggagagaaugagaagacugaacgaguuccacaacaagcccaucaacaccgacgacgagagcagccugguggaccccgacgacaucaugaagcacaucggcgacgacggcagcaacagcguggccaccgagcccuggcugagacccggcaccagcgagacccugaagagauucauggccgagcagcugaaccaggagcagcagcagauccccggcaagcccggcaccuucaccuggcagggccugagcaccgcccacggcuaa

SEQ ID NO: 15714 - RNA, 1770 nt, Artificial Sequence
  CSRNP1__Homo_sapiens__NP_149016
augaccggccugcugaagagaaaguucgaccagcuggacgaggacaacagcagcgugagcagcagcagcagcagcagcggcugccagagcagaagcugcagccccagcagcagcgugagcagagccugggacagcgaggaggagggccccugggaccagaugccccugcccgacagagacuucugcggccccagaagcuucaccccccugagcauccugaagagagccagaagagagagacccggcagaguggccuucgacggcaucaccguguucuacuuccccagaugccagggcuucaccagcgugcccagcagaggcggcugcacccugggcauggcccugagacacagcgccugcagaagauucagccuggccgaguucgcccaggagcaggccagagccagacacgagaagcugagacagagacugaaggaggagaagcuggagaugcugcaguggaagcugagcgccgccggcgugccccaggccgaggccggccugccccccgugguggacgccaucgacgacgccagcguggaggaggaccuggccguggccguggccggcggcagacuggaggaggugagcuuccugcagcccuaccccgccagaagaagaagagcccugcugagagccagcggcgugagaagaaucgacagagaggagaagagagagcugcaggcccugagacagagcagagaggacugcggcugccacugcgacagaaucugcgaccccgagaccugcagcugcagccuggccggcaucaagugccagauggaccacaccgccuuccccugcggcugcugcagagagggcugcgagaaccccaugggcagaguggaguucaaccaggccagagugcagacccacuucauccacacccugaccagacugcagcuggagcaggaggccgagagcuucagagagcuggaggcccccgcccagggcagcccccccagccccggcgaggaggcccuggugcccaccuucccccuggccaagccccccaugaacaacgagcugggcgacaacagcugcagcagcgacaugaccgacagcagcaccgccagcagcagcgccagcggcaccagcgaggcccccgacugccccacccaccccggccugcccggccccggcuuccagcccggcguggacgacgacagccuggccagaauccugagcuucagcgacagcgacuucggcggcgaggaggaggaggaggaggagggcagcgugggcaaccuggacaaccugagcugcuuccaccccgccgacaucuucggcaccagcgaccccggcggccuggccagcuggacccacagcuacagcggcugcagcuucaccagcggcgugcuggacgagaacgccaaccuggacgccagcugcuuccugaacggcggccuggagggcagcagagagggcagccugcccggcaccagcgugccccccagcauggacgccggcagaagcagcagcguggaccugagccugagcagcugcgacagcuucgagcugcugcaggcccugcccgacuacagccugggcccccacuacaccagccagaaggugagcgacagccuggacaacaucgaggccccccacuucccccugcccggccugagcccccccggcgacgccagcagcugcuuccuggagagccugaugggcuucagcgagcccgccgccgaggcccuggaccccuucaucgacagccaguucgaggacaccgugcccgccagccugauggagcccgugcccguguaa

SEQ ID NO: 15715 - RNA, 1758 nt, Artificial Sequence
  CSRNP3__Homo_sapiens__NP_079245
augagcggcauccugaagagaaaguucgaggagguggacggcagcagccccugcagcagcgugagagagagcgacgacgaggugagcagcagcgagagcgccgacagcggcgacagcgugaaccccagcaccagcagccacuucacccccagcagcauccugaagagagagaagagacugagaaccaagaacgugcacuucagcugcgugaccguguacuacuucaccagaagacagggcuucaccagcgugcccagccagggcggcagcacccugggcaugagcagcagacacaacagcgugagacaguacacccugggcgaguucgccagagagcaggagagacugcacagagagaugcugagagagcaccugagagaggagaagcugaacagccugaagcugaagaugaccaagaacggcaccguggagagcgaggaggccagcacccugacccuggacgacaucagcgacgacgacaucgaccuggacaacaccgagguggacgaguacuucuuccugcagccccugcccaccaagaagagaagagcccugcugagagccagcggcgugaagaagaucgacguggaggagaagcacgagcugagagccaucagacugagcagagaggacugcggcugcgacugcagaguguucugcgaccccgacaccugcaccugcagccuggccggcaucaagugccagguggacagaaugagcuuccccugcggcugcaccaaggagggcugcagcaacaccgccggcagaaucgaguucaaccccaucagagugagaacccacuuccugcacaccaucaugaagcuggagcuggagaagaacagagagcagcagauccccacccugaacggcugccacagcgagaucagcgcccacagcagcagcaugggccccguggcccacagcguggaguacagcaucgccgacagcuucgagaucgagaccgagccccaggccgccgugcugcaccugcagagcgccgaggagcuggacugccagggcgaggaggaggaggaggaggaggacggcagcagcuucugcagcggcgugaccgacagcagcacccagagccuggcccccagcgagagcgacgaggaggaggaggaggaggaggaggaggaggaggaggaggacgacgacgacgacaagggcgacggcuucguggagggccugggcacccacgccgagguggugccccugcccagcgugcugugcuacagcgacggcaccgccgugcacgagagccacgccaagaacgccagcuucuacgccaacagcagcacccuguacuaccagaucgacagccacauccccggcacccccaaccagaucagcgagaacuacagcgagagagacaccgugaagaacggcacccugagccuggugcccuacaccaugacccccgagcaguucguggacuacgccagacaggccgaggaggccuacggcgccagccacuaccccgccgccaaccccagcgugaucgugugcugcagcagcagcgagaacgacagcggcgugcccugcaacagccuguaccccgagcacagaagcaaccacccccagguggaguuccacagcuaccugaagggccccagccaggagggcuucgugagcgcccugaacggcgacagccacaucagcgagcaccccgccgagaacagccugagccuggccgagaagagcauccugcacgaggagugcaucaagagccccgugguggagaccgugcccguguaa

SEQ ID NO: 15716 - RNA, 582 nt, Artificial Sequence
  CSRP1__Homo_sapiens__NP_001180500
augcccaacuggggcggcggcaagaagugcggcgugugccagaagaccguguacuucgccgaggaggugcagugcgagggcaacagcuuccacaagagcugcuuccugugcauggugugcaagaagaaccuggacagcaccaccguggccgugcacggcgaggagaucuacugcaagagcugcuacggcaagaaguacggccccaagggcuacggcuacggccagggcgccggcacccugagcaccgacaagggcgagagccugggcaucaagcacgaggaggcccccggccacagacccaccaccaaccccaacgccagcaaguucgcccagaagaucggcggcagcgagagaugccccagaugcagccaggccguguacgccgccgagaaggugaucggcgccggcaagagcuggcacaaggccugcuucagaugcgccaagugcggcaagggccuggagagcaccacccuggccgacaaggacggcgagaucuacugcaagggcugcuacgccaagaacuucggccccaagggcuucggcuucggccagggcgccggcgcccuggugcacagcgaguaa

SEQ ID NO: 15717 - RNA, 2349 nt, Artificial Sequence
  CSRP2BP__Homo_sapiens__NP_065397
auggacagcagcauccaccugagcagccugaucagcagacacgacgacgaggccaccagaaccagcaccagcgagggccuggaggagggcgagguggagggcgagacccugcugaucguggagagcgaggaccaggccagcguggaccugagccacgaccagagcggcgacagccugaacagcgacgagggcgacgugagcuggauggaggagcagcugagcuacuucugcgacaagugccagaaguggauccccgccagccagcugagagagcagcugagcuaccugaagggcgacaacuucuucagauucaccugcagcgacugcagcgccgacggcaaggagcaguacgagagacugaagcugaccuggcagcagguggugaugcuggccauguacaaccugagccuggagggcagcggcagacagggcuacuucagauggaaggaggacaucugcgccuucaucgagaagcacuggaccuuccugcugggcaacagaaagaagaccagcaccugguggagcaccguggccggcugccugagcgugggcagccccauguacuucagaagcggcgcccaggaguucggcgagcccggcugguggaagcuggugcacaacaagccccccaccaugaagcccgagggcgagaagcugagcgccagcacccugaagaucaaggccgccagcaagcccacccuggaccccaucaucaccguggagggccugagaaagagagccagcagaaaccccguggagagcgccauggagcugaaggagaagagaagcagaacccaggaggccaaggacaucagaagagcccagaaggaggccgccggcuuccuggacagaagcaccagcagcacccccgugaaguucaucagcagaggcagaagacccgacgugauccuggagaagggcgaggugaucgacuucagcagccugagcagcagcgacagaaccccccugaccagccccagccccagccccagccuggacuucagcgcccccggcacccccgccagccacagcgccacccccagccugcugagcgaggccgaccugauccccgacgugaugcccccccaggcccuguuccacgacgacgacgagauggagggcgacggcgugaucgaccccggcauggaguacgugcccccccccgccggcagcguggccagcggccccguggugggcggcagaaagaaggugagaggccccgagcagaucaagcaggagguggagagcgaggaggagaagcccgacagaauggacaucgacagcgaggacaccgacagcaacaccagccugcagaccagagccagagagaagagaaagccccagcuggagaaggacaccaagcccaaggagcccagauacacccccgugagcaucuacgaggagaagcugcugcugaagagacuggaggccugccccggcgccguggccaugacccccgaggccagaagacugaagagaaagcugaucgugagacaggccaagagagacagaggccugccccuguucgaccuggaccagguggugaacgccgcccugcugcugguggacggcaucuacggcgccaaggagggcggcaucagcagacugcccgccggccaggccaccuacagaaccaccugccaggacuucagaauccuggacagauaccagaccagccugcccagcagaaagggcuucagacaccagaccaccaaguuccuguacagacuggugggcagcgaggacauggccguggaccagagcaucgugagccccuacaccagcagaauccugaagcccuacaucagaagagacuacgagaccaagccccccaagcugcagcugcugagccagaucagaagccaccugcacagaagcgacccccacuggacccccgagcccgacgccccccuggacuacugcuacgugagacccaaccacauccccaccaucaacagcaugugccaggaguucuucuggcccggcaucgaccugagcgagugccugcaguaccccgacuucagcgugguggugcuguacaagaaggugaucaucgccuucggcuucauggugcccgacgugaaguacaacgaggccuacaucagcuuccuguucgugcaccccgaguggagaagagccggcaucgccaccuucaugaucuaccaccugauccagaccugcaugggcaaggacgugacccugcacgugagcgccagcaaccccgccaugcugcuguaccagaaguucggcuucaagaccgaggaguacgugcuggacuucuacgacaaguacuacccccuggagagcaccgagugcaagcacgccuucuuccugagacugagaagauaa

SEQ ID NO: 15718 - RNA, 582 nt, Artificial Sequence
  CSRP2__Homo_sapiens__NP_001287894
augcccguguggggcggcggcaacaagugcggcgccugcggcagaaccguguaccacgccgaggaggugcagugcgacggcagaagcuuccacagaugcugcuuccugugcauggugugcagaaagaaccuggacagcaccaccguggccauccacgacgaggagaucuacugcaagagcugcuacggcaagaaguacggccccaagggcuacggcuacggccagggcgccggcacccugaacauggacagaggcgagagacugggcaucaagcccgagagcgugcagccccacagacccaccaccaaccccaacaccagcaaguucgcccagaaguacggcggcgccgagaagugcagcagaugcggcgacagcguguacgccgccgagaagaucaucggcgccggcaagcccuggcacaagaacugcuucagaugcgccaagugcggcaagagccuggagagcaccacccugaccgagaaggagggcgagaucuacugcaagggcugcuacgccaagaacuucggccccaagggcuucggcuacggccagggcgccggcgcccuggugcacgcccaguaa

SEQ ID NO: 15719 - RNA, 585 nt, Artificial Sequence
  CSRP3__Homo_sapiens__NP_003467
augcccaacuggggcggcggcgccaagugcggcgccugcgagaagaccguguaccacgccgaggagauccagugcaacggcagaagcuuccacaagaccugcuuccacugcauggccugcagaaaggcccuggacagcaccaccguggccgcccacgagagcgagaucuacugcaaggugugcuacggcagaagauacggccccaagggcaucggcuacggccagggcgccggcugccugagcaccgacaccggcgagcaccugggccugcaguuccagcagagccccaagcccgccagaagcgugaccaccagcaaccccagcaaguucaccgccaaguucggcgagagcgagaagugccccagaugcggcaagagcguguacgccgccgagaaggugaugggcggcggcaagcccuggcacaagaccugcuucagaugcgccaucugcggcaagagccuggagagcaccaacgugaccgacaaggacggcgagcuguacugcaaggugugcuacgccaagaacuucggccccaccggcaucggcuucggcggccugacccagcagguggagaagaaggaguaa

SEQ ID NO: 15720 - RNA, 426 nt, Artificial Sequence
  CST1__Homo_sapiens__NP_001889
auggcccaguaccugagcacccugcugcugcugcuggccacccuggccguggcccuggccuggagccccaaggaggaggacagaaucauccccggcggcaucuacaacgccgaccugaacgacgagugggugcagagagcccugcacuucgccaucagcgaguacaacaaggccaccaaggacgacuacuacagaagaccccugagagugcugagagccagacagcagaccgugggcggcgugaacuacuucuucgacguggaggugggcagaaccaucugcaccaagagccagcccaaccuggacaccugcgccuuccacgagcagcccgagcugcagaagaagcagcugugcagcuucgagaucuacgaggugcccugggagaacagaagaagccuggugaagagcagaugccaggagagcuaa

SEQ ID NO: 15721 - RNA, 426 nt, Artificial Sequence
  CST2__Homo_sapiens__NP_001313
auggccuggccccugugcacccugcugcugcugcuggccacccaggccguggcccuggccuggagcccccaggaggaggacagaaucaucgagggcggcaucuacgacgccgaccugaacgacgagagagugcagagagcccugcacuucgugaucagcgaguacaacaaggccaccgaggacgaguacuacagaagacugcugagagugcugagagccagagagcagaucgugggcggcgugaacuacuucuucgacaucgaggugggcagaaccaucugcaccaagagccagcccaaccuggacaccugcgccuuccacgagcagcccgagcugcagaagaagcagcugugcagcuuccagaucuacgaggugcccugggaggacagaaugagccuggugaacagcagaugccaggaggccuaa

SEQ ID NO: 15722 - RNA, 441 nt, Artificial Sequence
  CST3__Homo_sapiens__NP_001275543
auggccggcccccugagagccccccugcugcugcuggccauccuggccguggcccuggccgugagccccgccgccggcagcagccccggcaagccccccagacuggugggcggccccauggacgccagcguggaggaggagggcgugagaagagcccuggacuucgccgugggcgaguacaacaaggccagcaacgacauguaccacagcagagcccugcagguggugagagccagaaagcagaucguggccggcgugaacuacuuccuggacguggagcugggcagaaccaccugcaccaagacccagcccaaccuggacaacugccccuuccacgaccagccccaccugaagagaaaggccuucugcagcuuccagaucuacgccgugcccuggcagggcaccaugacccugagcaagagcaccugccaggacgccuaa

SEQ ID NO: 15723 - RNA, 426 nt, Artificial Sequence
  CST4__Homo_sapiens__NP_001890
auggccagaccccugugcacccugcugcugcugauggccacccuggccggcgcccuggccagcagcagcaaggaggagaacagaaucauccccggcggcaucuacgacgccgaccugaacgacgagugggugcagagagcccugcacuucgccaucagcgaguacaacaaggccaccgaggacgaguacuacagaagaccccugcaggugcugagagccagagagcagaccuucggcggcgugaacuacuucuucgacguggaggugggcagaaccaucugcaccaagagccagcccaaccuggacaccugcgccuuccacgagcagcccgagcugcagaagaagcagcugugcagcuucgagaucuacgaggugcccugggaggacagaaugagccuggugaacagcagaugccaggaggccuaa

SEQ ID NO: 15724 - RNA, 429 nt, Artificial Sequence
  CST5__Homo_sapiens__NP_001891
augauguggcccaugcacaccccccugcugcugcugaccgcccugaugguggccguggccggcagcgccagcgcccagagcagaacccuggccggcggcauccacgccaccgaccugaacgacaagagcgugcagugcgcccuggacuucgccaucagcgaguacaacaaggugaucaacaaggacgaguacuacagcagaccccugcaggugauggccgccuaccagcagaucgugggcggcgugaacuacuacuucaacgugaaguucggcagaaccaccugcaccaagagccagcccaaccuggacaacugccccuucaacgaccagcccaagcugaaggaggaggaguucugcagcuuccagaucaacgaggugcccugggaggacaagaucagcauccugaacuacaagugcagaaagguguaa

SEQ ID NO: 15725 - RNA, 450 nt, Artificial Sequence
  CST6__Homo_sapiens__NP_001314
auggccagaagcaaccugccccuggcccugggccuggcccugguggccuucugccugcuggcccugcccagagacgccagagccagaccccaggagagaauggugggcgagcugagagaccugagccccgacgacccccaggugcagaaggccgcccaggccgccguggccagcuacaacaugggcagcaacagcaucuacuacuucagagacacccacaucaucaaggcccagagccagcugguggccggcaucaaguacuuccugaccauggagaugggcagcaccgacugcagaaagaccagagugaccggcgaccacguggaccugaccaccugcccccuggccgccggcgcccagcaggagaagcugagaugcgacuucgaggugcugguggugcccuggcagaacagcagccagcugcugaagcacaacugcgugcagauguaa

SEQ ID NO: 15726 - RNA, 438 nt, Artificial Sequence
  CST7__Homo_sapiens__NP_003641
augagagccgccggcacccugcuggccuucugcugccuggugcugagcaccaccggcggccccagccccgacaccugcagccaggaccugaacagcagagugaagcccggcuuccccaagaccaucaagaccaacgaccccggcgugcugcaggccgccagauacagcguggagaaguucaacaacugcaccaacgacauguuccuguucaaggagagcagaaucaccagagcccuggugcagaucgugaagggccugaaguacaugcuggagguggagaucggcagaaccaccugcaagaagaaccagcaccugagacuggacgacugcgacuuccagaccaaccacacccugaagcagacccugagcugcuacagcgagguguggguggugcccuggcugcagcacuucgaggugcccgugcugagaugccacuaa

SEQ ID NO: 15727 - RNA, 429 nt, Artificial Sequence
  CST8__Homo_sapiens__NP_005483
augcccagaugcagauggcugagccugauccugcugaccaucccccuggcccugguggccagaaaggaccccaagaagaacgagaccggcgugcugagaaagcugaagcccgugaacgccagcaacgccaacgugaagcagugccugugguucgccaugcaggaguacaacaaggagagcgaggacaaguacguguuccugguggugaagacccugcaggcccagcugcaggugaccaaccugcuggaguaccugaucgacguggagaucgccagaagcgacugcagaaagccccugagcaccaacgagaucugcgccauccaggagaacagcaagcugaagagaaagcugagcugcagcuuccuggugggcgcccugcccuggaacggcgaguucaccgugauggagaagaagugcgaggacgccuaa

SEQ ID NO: 15728 - RNA, 480 nt, Artificial Sequence
  CST9__Homo_sapiens__NP_001008693
augagcagcccccagagaagaaaggccaugcccugggcccugagccugcugcugaugggcuuccagcugcuggugaccuacgccuggugcagcgaggaggagaugggcggcaacaacaagaucgugcaggaccccauguuccuggccaccguggaguucgcccugaacaccuucaacgugcagagcaaggaggagcacgccuacagacugcugagagugcugagcagcuggagagaggacagcauggacagaaaguggagaggcaagaugguguucagcaugaaccugcagcugagacagaccgugugcagaaaguucgaggacgacaucgacaacugccccuuccaggagagccuggagcugaacaacgugagacagggcaucagcuucccccaggugcacagcugcggcugcugcaugggcugcggcgugggcaccggcgccgccgacaaggccauccccagagacaagggcaaguaa

SEQ ID NO: 15729 - RNA, 444 nt, Artificial Sequence
  CST9L__Homo_sapiens__NP_542177
augcugggccugcccuggaagggcggccugagcugggcccugcugcugcugcugcugggcagccagauccugcugaucuacgccuggcacuuccacgagcagagagacugcgacgagcacaacgugauggccagauaccugcccgccaccguggaguucgccgugcacaccuucaaccagcagagcaaggacuacuacgccuacagacugggccacauccugaacagcuggaaggagcagguggagagcaagaccguguucagcauggagcugcugcugggcagaaccagaugcggcaaguucgaggacgacaucgacaacugccacuuccaggagagcaccgagcugaacaacaccuucaccugcuucuucaccaucagcaccagacccuggaugacccaguucagccugcugaacaagaccugccuggagggcuuccacuaa

SEQ ID NO: 15730 - RNA, 297 nt, Artificial Sequence
  CSTA__Homo_sapiens__NP_005204
augauccccggcggccugagcgaggccaagcccgccacccccgagauccaggagaucguggacaaggugaagccccagcuggaggagaagaccaacgagaccuacggcaagcuggaggccgugcaguacaagacccaggugguggccggcaccaacuacuacaucaaggugagagccggcgacaacaaguacaugcaccugaagguguucaagagccugcccggccagaacgaggaccuggugcugaccggcuaccagguggacaagaacaaggacgacgagcugaccggcuucuaa

SEQ ID NO: 15731 - RNA, 297 nt, Artificial Sequence
  CSTB__Homo_sapiens__NP_000091
augaugugcggcgcccccagcgccacccagcccgccaccgccgagacccagcacaucgccgaccaggugagaagccagcuggaggagaaggagaacaagaaguuccccguguucaaggccgugagcuucaagagccaggugguggccggcaccaacuacuucaucaaggugcacgugggcgacgaggacuucgugcaccugagaguguuccagagccugccccacgagaacaagccccugacccugagcaacuaccagaccaacaaggccaagcacgacgagcugaccuacuucuaa

SEQ ID NO: 15732 - RNA, 1296 nt, Artificial Sequence
  CSTF1__Homo_sapiens__NP_001315
auguacagaaccaaggugggccugaaggacagacagcagcuguacaagcugaucaucagccagcugcuguacgacggcuacaucagcaucgccaacggccugaucaacgagaucaagccccagagcgugugcgcccccagcgagcagcugcugcaccugaucaagcugggcauggagaacgacgacaccgccgugcaguacgccaucggcagaagcgacaccguggcccccggcaccggcaucgaccuggaguucgacgccgacgugcagaccaugagccccgaggccagcgaguacgagaccugcuacgugaccagccacaagggccccugcagaguggccaccuacagcagagacggccagcugaucgccaccggcagcgccgacgccagcaucaagauccuggacaccgagagaaugcuggccaagagcgccaugcccaucgaggugaugaugaacgagaccgcccagcagaacauggagaaccaccccgugaucagaacccuguacgaccacguggacgaggugaccugccuggccuuccaccccaccgagcagauccuggccagcggcagcagagacuacacccugaagcuguucgacuacagcaagcccagcgccaagagagccuucaaguacauccaggaggccgagaugcugagaagcaucagcuuccaccccagcggcgacuucauccuggugggcacccagcaccccacccugagacuguacgacaucaacaccuuccagugcuucgugagcugcaacccccaggaccagcacaccgacgccaucugcagcgugaacuacaacagcagcgccaacauguacgugaccggcagcaaggacggcugcaucaagcugugggacggcgugagcaacagaugcaucaccaccuucgagaaggcccacgacggcgccgaggugugcagcgccaucuucagcaagaacagcaaguacauccugagcagcggcaaggacagcguggccaagcugugggagaucagcaccggcagaacccuggugagauacaccggcgccggccugagcggcagacaggugcacagaacccaggccguguucaaccacaccgaggacuacgugcugcugcccgacgagagaaccaucagccugugcugcugggacagcagaaccgccgagagaagaaaccugcugagccugggccacaacaacaucgugagaugcaucgugcacagccccaccaaccccggcuucaugaccugcagcgacgacuucagagccagauucugguacagaagaagcaccaccgacuaa

SEQ ID NO: 15733 - RNA, 1734 nt, Artificial Sequence
  CSTF2__Homo_sapiens__NP_001316
auggccggccugaccgugagagaccccgccguggacagaagccugagaagcguguucgugggcaacauccccuacgaggccaccgaggagcagcugaaggacaucuucagcgaggugggccccguggugagcuucagacugguguacgacagagagaccggcaagcccaagggcuacggcuucugcgaguaccaggaccaggagaccgcccugagcgccaugagaaaccugaacggcagagaguucagcggcagagcccugagaguggacaacgccgccagcgagaagaacaaggaggagcugaagagccugggcaccggcgcccccgugaucgagagccccuacggcgagaccaucagccccgaggacgcccccgagagcaucagcaaggccguggccagccugccccccgagcagauguucgagcugaugaagcagaugaagcugugcgugcagaacagcccccaggaggccagaaacaugcugcugcagaacccccagcuggccuacgcccugcugcaggcccagguggugaugagaaucguggaccccgagaucgcccugaagauccugcacagacagaccaacauccccacccugaucgccggcaacccccagcccgugcacggcgccggccccggcagcggcagcaacgugagcaugaaccagcagaacccccaggccccccaggcccagagccugggcggcaugcacgugaacggcgcccccccccugaugcaggccagcaugcagggcggcgugcccgcccccggccagaugcccgccgccgugaccggccccggccccggcagccuggcccccggcggcggcaugcaggcccaggugggcaugcccggcagcggccccgugagcauggagagaggccaggugcccaugcaggaccccagagccgccaugcagagaggcagccugcccgccaacgugcccacccccagaggccugcugggcgacgcccccaacgaccccagaggcggcacccugcugagcgugaccggcgagguggagcccagaggcuaccugggccccccccaccagggcccccccaugcaccacgugcccggccacgagagcagaggcccccccccccacgagcugagaggcggcccccugcccgagcccagaccccugauggccgagcccagaggccccaugcuggaccagagaggccccccccuggacggcagaggcggcagagaccccagaggcaucgacgccagaggcauggaggccagagccauggaggccagaggccuggacgccagaggccuggaggccagagccauggaggccagagccauggaggccagagccauggaggccagagccauggaggccagagccauggaggugagaggcauggaggccagaggcauggacaccagaggccccgugcccggccccagaggccccauccccagcggcaugcagggccccagccccaucaacaugggcgccguggugccccagggcagcagacaggugcccgugaugcagggcaccggcaugcagggcgccagcauccagggcggcagccagcccggcggcuucagccccggccagaaccaggugaccccccaggaccacgagaaggccgcccugaucaugcaggugcugcagcugaccgccgaccagaucgccaugcugccccccgagcagagacagagcauccugauccugaaggagcagauccagaagagcaccggcgcccccuaa

SEQ ID NO: 15734 - RNA, 1851 nt, Artificial Sequence
  CSTF2T__Homo_sapiens__NP_056050
augagcagccuggccgugagagaccccgccauggacagaagccugagaagcguguucgugggcaacauccccuacgaggccaccgaggagcagcugaaggacaucuucagcgaggugggcagcguggugagcuucagacugguguacgacagagagaccggcaagcccaagggcuacggcuucugcgaguaccaggaccaggagaccgcccugagcgccaugagaaaccugaacggcagagaguucagcggcagagcccugagaguggacaacgccgccagcgagaagaacaaggaggagcugaagagccugggccccgccgcccccaucaucgacagccccuacggcgaccccaucgaccccgaggacgcccccgagagcaucaccagagccguggccagccugccccccgagcagauguucgagcugaugaagcagaugaagcugugcgugcagaacagccaccaggaggccagaaacaugcugcugcagaacccccagcuggccuacgcccugcugcaggcccagguggugaugagaaucauggaccccgagaucgcccugaagauccugcacagaaagauccacgugaccccccugauccccggcaagagccagagcgugagcgugagcggccccggccccggccccggccccggccugugccccggccccaacgugcugcugaaccagcagaacccccccgccccccagccccagcaccuggccagaagacccgugaaggacauccccccccugaugcagacccccauccagggcggcauccccgcccccggccccauccccgccgccgugcccggcgccggccccggcagccugacccccggcggcgccaugcagccccagcugggcaugcccggcgugggccccgugccccuggagagaggccaggugcagaugagcgaccccagagcccccauccccagaggccccgugacccccggcggccugccccccagaggccugcugggcgacgcccccaacgaccccagaggcggcacccugcugagcgugaccggcgagguggagcccagaggcuaccugggccccccccaccagggcccccccaugcaccacgccagcggccacgacaccagaggccccagcagccacgagaugagaggcggcccccugggcgaccccagacugcugaucggcgagcccagaggccccaugaucgaccagagaggccugcccauggacggcagaggcggcagagacagcagagccauggagaccagagccauggagaccgaggugcuggagaccagagugauggagagaagaggcauggagaccugcgccauggagaccagaggcauggaggccagaggcauggacgccagaggccuggagaugagaggccccgugcccagcagcagaggccccaugaccggcggcauccagggccccggccccaucaacaucggcgccggcggccccccccagggccccagacaggugcccggcaucagcggcgugggcaaccccggcgccggcaugcagggcaccggcauccagggcaccggcaugcagggcgccggcauccagggcggcggcaugcagggcgccggcauccagggcgugagcauccagggcggcggcauccagggcggcggcauccagggcgccagcaagcagggcggcagccagcccagcagcuucagccccggccagagccaggugaccccccaggaccaggagaaggccgcccugaucaugcaggugcugcagcugaccgccgaccagaucgccaugcugccccccgagcagagacagagcauccugauccugaaggagcagauccagaagagcaccggcgccagcuaa

SEQ ID NO: 15735 - RNA, 438 nt, Artificial Sequence
  CSTL1__Homo_sapiens__NP_612140
augggcaucggcugcuggagaaacccccugcugcugcugaucgcccuggugcugagcgccaagcugggccacuuccagagaugggagggcuuccagcagaagcugaugagcaagaagaacaugaacagcacccugaacuucuucauccagagcuacaacaacgccagcaacgacaccuaccuguacagagugcagagacugaucagaagccagaugcagcugaccaccggcguggaguacaucgugaccgugaagaucggcuggaccaagugcaagagaaacgacaccagcaacagcagcugcccccugcagagcaagaagcugagaaagagccugaucugcgagagccugaucuacaccaugcccuggaucaacuacuuccagcuguggaacaacagcugccuggaggccgagcacgugggcagaaaccugagauaa

SEQ ID NO: 15736 - RNA, 570 nt, Artificial Sequence
  CT45A1__Homo_sapiens__NP_001017417
augaccgacaagaccgagaagguggccguggaccccgagaccguguucaagagacccagagagugcgacagccccagcuaccagaagagacagagaauggcccugcuggccagaaagcagggcgccggcgacagccugaucgccggcagcgccaugagcaaggccaagaagcugaugaccggccacgccaucccccccagccagcuggacagccagaucgacgacuucaccggcuucagcaaggacagaaugaugcagaagcccggcagcaacgcccccgugggcggcaacgugaccagcagcuucagcggcgacgaccuggagugcagagagaccgccagcagccccaagagccagagagagaucaacgccgacaucaagagaaagcuggugaaggagcugagaugcgugggccagaaguacgagaagaucuucgagaugcuggagggcgugcagggccccaccgccgugagaaagagauucuucgagagcaucaucaaggaggccgccagaugcaugagaagagacuucgugaagcaccugaagaagaagcugaagagaaugaucuaa

SEQ ID NO: 15737 - RNA, 795 nt, Artificial Sequence
  CT55__Homo_sapiens__NP_001026875
augcugagacugcugagacuggcccuggccuucuacggcagaaccgccgaccccgccgagagacagggcccccagcagcagggccugccccagggcgacacccagcugaccaccgugcagggcguggugaccagcuucugcggcgacuacggcaugaucgacgagagcaucuacuucagcagcgacguggugaccggcaacgugccccugaaggugggccagaaggugaacguggugguggaggaggacaagccccacuacggccugagagccaucaagguggacguggugcccagacaccuguacggcgccggccccagcgacagcggcaccagagugcugaucggcugcgugaccagcaucaacgaggacaacaucuacaucagcaacagcaucuacuucagcaucgccaucgugagcgaggacuucgugcccuacaagggcgaccugcuggagguggaguacagcaccgagcccggcaucagcaacaucaaggccaccagcgugaagcccaucagaugcauccacaccgaggaggugugcaucaccagcgugcacggcagaaacggcgugaucgacuacaccaucuucuucacccuggacagcgugaagcugcccgacggcuacgugccccagguggacgacaucgugaacguggugaugguggagagcauccaguucugcuucaucuggagagccaucagcaucacccccgugcacaagagcagcagcggcuuccaggacgacggcggccugggcagacccaagagagagagaagaagccagagcaucuaa

SEQ ID NO: 15738 - RNA, 342 nt, Artificial Sequence
  CT83__Homo_sapiens__NP_001017978
augaacuucuaccugcugcuggccagcagcauccugugcgcccugaucguguucuggaaguacagaagauuccagagaaacaccggcgagaugagcagcaacagcaccgcccuggcccuggugagacccagcagcagcggccugaucaacagcaacaccgacaacaaccuggccguguacgaccugagcagagacauccugaacaacuucccccacagcaucgccagacagaagagaauccuggugaaccugagcaugguggagaacaagcugguggagcuggagcacacccugcugagcaagggcuucagaggcgccagcccccacagaaagagcaccuaa

SEQ ID NO: 15739 - RNA, 543 nt, Artificial Sequence
  CTAG1A__Homo_sapiens__NP_640343
augcaggccgagggcagaggcaccggcggcagcaccggcgacgccgacggccccggcggccccggcauccccgacggccccggcggcaacgccggcggccccggcgaggccggcgccaccggcggcagaggccccagaggcgccggcgccgccagagccagcggccccggcggcggcgcccccagaggcccccacggcggcgccgccagcggccugaacggcugcugcagaugcggcgccagaggccccgagagcagacugcuggaguucuaccuggccaugcccuucgccacccccauggaggccgagcuggccagaagaagccuggcccaggacgcccccccccugcccgugcccggcgugcugcugaaggaguucaccgugagcggcaacauccugaccaucagacugaccgccgccgaccacagacagcugcagcugagcaucagcagcugccugcagcagcugagccugcugauguggaucacccagugcuuccugcccguguuccuggcccagccccccagcggccagagaagauaa

SEQ ID NO: 15740 - RNA, 633 nt, Artificial Sequence
  CTAG2__Homo_sapiens__NP_066274
augcaggccgagggcagaggcaccggcggcagcaccggcgacgccgacggccccggcggccccggcauccccgacggccccggcggcaacgccggcggccccggcgaggccggcgccaccggcggcagaggccccagaggcgccggcgccgccagagccagcggccccagaggcggcgcccccagaggcccccacggcggcgccgccagcgcccaggacggcagaugccccugcggcgccagaagacccgacagcagacugcuggagcugcacaucaccaugcccuucagcagccccauggaggccgagcuggugagaagaauccugagcagagacgccgccccccugcccagacccggcgccgugcugaaggacuucaccgugagcggcaaccugcuguucaugagcgugagagaccaggacagagagggcgccggcagaaugagaguggugggcuggggccugggcagcgccagccccgagggccagaaggccagagaccugagaacccccaagcacaaggugagcgagcagagacccggcacccccggcccccccccccccgagggcgcccagggcgacggcugcagaggcguggccuucaacgugauguucagcgccccccacaucuaa

SEQ ID NO: 15741 - RNA, 2238 nt, Artificial Sequence
  CTAGE1__Homo_sapiens__NP_758441
augagacccgacagccaccccuacggcuuccccugggagcuggugaucagagccgccguggccggcuucuucgccgugcuguuccuguggagaagcuucagaagcgugaccagcagacuguacgugagaagagagaagaaguucgccguggcccugagcggccugaucgaggagaagugcaagcugcuggagaaguucagccuggugcagaaggaguacgagggcuacgagguggagagcagccugaagaacgccagcuucgagaaggaggccaccgaggcccagagccuggaggccaccugcgagaagcugaacagauucaacagcgagcuggugcacgagauccugugccuggagaaggagcugaaggaggagaagagcaagcacagcgagcagaacgagcugauggccgacaucagcaagagaauccagagccuggaggacgagagcaagagccugaagagccagguggccgaggccaagaugaccuucaagagauuccaggccaacgaggagagacuggagaucgagauccaggacgccuggaaggagaacagcgagcugcaggagagccagaagcagcugcugcaggaggccgagguguggaaggagcaggugagcgagcugaucaagcagaagagaaccuucgaggacagcaaggugcacgccgagcaggugcugaacgacaaggagaaccacaucaagacccugaccgagagacugcugaagaugaaggacggcguggccaugcuggaggaggacgugaccgacgacgacaaccuggagcuggagaugaacagcgagagcgaggacggcgccuaccuggacaacccccccaagggcgcccugaagaagcugauccacgccgccaagcugaacgccagccugaagacccuggagggcgagagaaaccagaucuacauccagcugagcgagguggacaagaccaaggaggagcugaccgagcacaucaagaaccugcagaccgagcaggccagccugcagagcgagaacacccacuucgagagcgagaaccagaagcugcagcagaagcugaaggugaugaccgagcuguaccaggagaacgagaugaagcuguacagaaagcugaucguggaggagaagugcagacuggagaaggaggagaagcugagcaagguggacgagaugaucagccacgccaccgaggagcuggagaccuacagaaagagagccaaggaccugaaggaguucgagaagaccauccacuucuaccagaagaagaucauccugcacgagaagaaggcccacgacaacuggagcgccgccuggaccgccgagagaaaccugaacgaccugagaaaggagaacgcccacaacagacagaagcugaccgagaucgaguucaagaucaagcugcuggagaaggaccccuacggccuggacgugcccaacaccgccuucggcagacagcacagccccuacggccccagcccccugggcuggcccagcagcgagaccagagccagccuguacccccccacccugcuggagggcccccugagacugagcccccugcugcccagaggcggcggcagaggcagcagaggccccggcaacccccccgaccaccagaucaccaaggagagaggcgagagcagcugcgacagacugaccgacccccacagagcccccagcgacgccggcccccuggccccccccugggagcaggacuacagaaugauguuccccccccccggccagagcuaccccgacagcgcccugcccccccagagacaggacagauucuacagcaacugcgccagacugagcggccccgccgagcugagaagcuucaacaugcccagccuggacaagauggacggcagcaugcccagcgagauggagagcagcagaaacgacaccaaggacaaccugggcaaccugaaggugcccgacagcagccugcccgccgagaacgaggccaccggccccggcuucgugccccccccccuggcccccaucagaggccugcuguuccccguggacaccagaggccccuucaucagaagaggcccccccuuccccccccccccccccggcaccguguucggcgccagccccgacuacuucagccccagagacgugcccggcccccccagagcccccuucgccaugagaaacguguaccugcccagaggcuuccugcccuacagaccccccagacccgccuucuucccccccgcccccaccuucuaa

SEQ ID NO: 15742 - RNA, 2430 nt, Artificial Sequence
  CTAGE5__Homo_sapiens__NP_001234918
auggaggagcccggcgugaccccccagcccuaccugggccugcugcuggaggagcugagaagagugguggccgcccugcccgagggcaugagacccgacagcaaccuguacggcuuccccugggagcuggugaucugcgccgccguggugggcuucuucgccgugcuguucuuccuguggagaagcuucagaagcgugagaagcagacuguacgugggcagagagaagaagcuggcccugaugcugagcggccugaucgaggagaagagcaagcugcuggagaaguucagccuggugcagaaggaguacgagggcuacgagguggagagcagccugaaggacgccagcuucgagaaggaggccaccgaggcccagagccuggagguggagaaccagauggccaccugcgagaagcugaacagaagcaacagcgagcuggaggacgagauccugugccuggagaaggagcugaaggaggagaagagcaagcacagcgagcaggacgagcugauggccgacaucagcaagagaauccagagccuggaggacgagagcaagagccugaagagccagguggccgaggccaagaugaccuucaagaucuuccagaugaacgaggagagacugaagaucgccaucaaggacgcccugaacgagaacagccagcugcaggagagccagaagcagcugcugcaggaggccgagguguggaaggagcaggugagcgagcugaacaagcagaaggugaccuucgaggacagcaaggugcacgccgagcaggugcugaacgacaaggagagccacaucaagacccugaccgagagacugcugaagaugaaggacugggccgccaugcugggcgaggacaucaccgacgacgacaaccuggagcuggagaugaacagcgagagcgagaacggcgccuaccuggacaacccccccaagggcgcccugaagaagcugauccacgccgccaagcugaacgccagccugaagacccuggagggcgagagaaaccagaucuacauccagcugagcgagguggacaagaccaaggaggagcugaccgagcacaucaagaaccugcagaccgagcaggccagccugcagagcgagaacacccacuucgagaacgagaaccagaagcugcagcagaagcugaaggugaugaccgagcuguaccaggagaacgagaugaagcugcacagaaagcugaccguggaggagaacuacagacuggagaaggaggagaagcugagcaagguggacgagaagaucagccacgccaccgaggagcuggagaccuacagaaagagagccaaggaccuggaggaggagcuggagagaaccauccacagcuaccagggccagaucaucagccacgagaagaaggcccacgacaacuggcuggccgccagaaacgccgagagaaaccugaacgaccugagaaaggagaacgcccacaacagacagaagcugaccgagaccgagcugaaguucgagcugcuggagaaggaccccuacgcccuggacgugcccaacaccgccuucggcagagagcacagccccuacggccccagcccccugggcuggcccagcagcgagaccagagccuuccugagcccccccacccugcuggagggcccccugagacugagcccccugcugcccggcggcggcggcagaggcagcagaggccccggcaacccccuggaccaccagaucaccaacgagagaggcgagagcagcugcgacagacugaccgacccccacagagcccccagcgacaccggcagccugagcccccccugggaccaggacagaagaaugauguuccccccccccggccagagcuaccccgacagcgcccugcccccccagagacaggacagauucugcagcaacagcggcagacugagcggccccgccgagcugagaagcuucaacaugcccagccuggacaagauggacggcagcaugcccagcgagauggagagcagcagaaacgacaccaaggacgaccugggcaaccugaacgugcccgacagcagccugcccgccgagaacgaggccaccggccccggcuucgugccccccccccuggcccccaucagaggcccccuguuccccguggacgccagaggccccuuccugagaagaggcccccccuuccccccccccccccccggcgccauguucggcgccagcagagacuacuucccccccggcgacuuccccggccccccccccgcccccuucgccaugagaaacguguacccccccagaggcuucccccccuaccugccccccagacccggcuucuuccccccccccccccacagcgagggcagaagcgaguuccccagcggccugaucccccccagcaacgagcccgccaccgagcaccccgagccccagcaggagaccuaa

SEQ ID NO: 15743 - RNA, 1290 nt, Artificial Sequence
  CTBP1__Homo_sapiens__NP_001012632
augagcggcgugagaccccccaucaugaacggcccccugcaccccagaccccugguggcccugcuggacggcagagacugcaccguggagaugcccauccugaaggacguggccaccguggccuucugcgacgcccagagcacccaggagauccacgagaaggugcugaacgaggccgugggcgcccugauguaccacaccaucacccugaccagagaggaccuggagaaguucaaggcccugagaaucaucgugagaaucggcagcggcuucgacaacaucgacaucaagagcgccggcgaccugggcaucgccgugugcaacgugcccgccgccagcguggaggagaccgccgacagcacccugugccacauccugaaccuguacagaagagccaccuggcugcaccaggcccugagagagggcaccagagugcagagcguggagcagaucagagagguggccagcggcgccgccagaaucagaggcgagacccugggcaucaucggccugggcagagugggccaggccguggcccugagagccaaggccuucggcuucaacgugcuguucuacgaccccuaccugagcgacggcguggagagagcccugggccugcagagagugagcacccugcaggaccugcuguuccacagcgacugcgugacccugcacugcggccugaacgagcacaaccaccaccugaucaacgacuucaccgugaagcagaugagacagggcgccuuccuggugaacaccgccagaggcggccugguggacgagaaggcccuggcccaggcccugaaggagggcagaaucagaggcgccgcccuggacgugcacgagagcgagcccuucagcuucagccagggcccccugaaggacgcccccaaccugaucugcaccccccacgccgccugguacagcgagcaggccagcaucgagaugagagaggaggccgccagagagaucagaagagccaucaccggcagaauccccgacagccugaagaacugcgugaacaaggaccaccugaccgccgccacccacugggccagcauggaccccgccguggugcaccccgagcugaacggcgccgccuacagauacccccccggcguggugggcguggcccccaccggcauccccgccgccguggagggcaucgugcccagcgccaugagccugagccacggccugccccccguggcccaccccccccacgcccccagccccggccagaccgugaagcccgaggccgacagagaccacgccagcgaccagcuguaa

SEQ ID NO: 15744 - RNA, 1338 nt, Artificial Sequence
  CTBP2__Homo_sapiens__NP_001277143
auggcccugguggacaagcacaaggugaagagacagagacuggacagaaucugcgagggcaucagaccccagaucaugaacggcccccugcaccccagaccccugguggcccugcuggacggcagagacugcaccguggagaugcccauccugaaggaccuggccaccguggccuucugcgacgcccagagcacccaggagauccacgagaaggugcugaacgaggccgugggcgccaugauguaccacaccaucacccugaccagagaggaccuggagaaguucaaggcccugagagugaucgugagaaucggcagcggcuacgacaacguggacaucaaggccgccggcgagcugggcaucgccgugugcaacauccccagcgccgccguggaggagaccgccgacagcaccaucugccacauccugaaccuguacagaagaaacaccuggcuguaccaggcccugagagagggcaccagagugcagagcguggagcagaucagagagguggccagcggcgccgccagaaucagaggcgagacccugggccugaucggcuucggcagaaccggccaggccguggccgugagagccaaggccuucggcuucagcgugaucuucuacgaccccuaccugcaggacggcaucgagagaagccugggcgugcagagaguguacacccugcaggaccugcuguaccagagcgacugcgugagccugcacugcaaccugaacgagcacaaccaccaccugaucaacgacuucaccaucaagcagaugagacagggcgccuuccuggugaacgccgccagaggcggccugguggacgagaaggcccuggcccaggcccugaaggagggcagaaucagaggcgccgcccuggacgugcacgagagcgagcccuucagcuucgcccagggcccccugaaggacgcccccaaccugaucugcaccccccacaccgccugguacagcgagcaggccagccuggagaugagagaggccgccgccaccgagaucagaagagccaucaccggcagaauccccgagagccugagaaacugcgugaacaaggaguucuucgugaccagcgcccccuggagcgugaucgaccagcaggccauccaccccgagcugaacggcgccaccuacagauacccccccggcaucgugggcguggcccccggcggccugcccgccgccauggagggcaucauccccggcggcauccccgugacccacaaccugcccaccguggcccaccccagccaggcccccagccccaaccagcccaccaagcacggcgacaacagagagcaccccaacgagcaguaa

SEQ ID NO: 15745 - RNA, 3654 nt, Artificial Sequence
  CTC1__Homo_sapiens__NP_079375
auggccgccggcagagcccaggugcccagcagcgagcaggccuggcuggaggacgcccagguguucauccagaagacccugugccccgccgugaaggagcccaacgugcagcugaccccccuggugaucgacugcgugaagaccguguggcugagccagggcagaaaccagggcagcacccugccccugagcuacagcuucgugagcgugcaggaccugaagacccaccagagacugcccugcugcagccaccugagcuggagcagcagcgccuaccaggccugggcccaggaggccggccccaacggcaacccccugcccagagagcagcugcugcugcugggcacccugaccgaccugagcgccgaccuggagcaggagugcagaaacggcagccuguacgugagagacaacaccggcgugcugagcugcgagcugaucgaccuggaccugagcuggcugggccaccuguuccuguuccccagauggagcuaccugccccccgccagauggaacagcagcggcgagggccaccuggagcugugggacgcccccgugcccguguucccccugaccaucagccccggccccgugacccccauccccgugcuguaccccgagagcgccagcugccugcugagacugagaaacaagcugagaggcgugcagagaaaccuggccggcagccuggugagacugagcgcccuggugaagagcaagcagaaggccuacuucauccugagccugggcagaagccaccccgccgugacccacgugagcaucaucgugcaggugcccgcccagcugguguggcacagagcccugagacccggcaccgccuacgugcugaccgagcugagagugagcaagaucagaggccagagacagcacguguggaugaccagccagagcagcagacugcugcugcugaagcccgagugcgugcaggagcuggagcuggagcuggagggcccccugcuggaggccgaccccaagccccugcccaugcccagcaacagcgaggacaagaaggaccccgagagccuggugagauacagcagacugcugagcuacagcggcgccgugaccggcgugcugaacgagcccgccggccuguacgagcuggacggccagcugggccugugccuggccuaccagcaguucagaggccugagaagagugaugagacccggcgugugccugcagcugcaggacgugcaccugcugcagagcgugggcggcggcaccagaagacccgugcuggcccccugccugagaggcgccgugcugcugcagagcuucagcagacagaagcccggcgcccacagcagcagacaggccuacggcgccagccuguacgagcagcuggugugggagagacagcugggccugccccuguaccugugggccaccaaggcccuggaggagcuggccugcaagcugugcccccacgugcugagacaccaccaguuccugcagcacagcagccccggcagccccagccugggccugcagcugcuggcccccacccuggaccugcuggccccccccggcagccccgugagaaacgcccacaacgagauccuggaggagccccaccacugcccccugcagaaguacaccagacugcagacccccagcagcuuccccacccuggccacccugaaggaggagggccagagaaaggccugggccagcuucgaccccaaggcccugcugccccugcccgaggccagcuaccugcccagcugccagcugaacagaagacuggccuggagcuggcugugccugcugcccagcgccuucugccccgcccaggugcugcugggcgugcugguggccagcagccacaagggcugccugcagcugagagaccagagcggcagccugcccugccugcugcuggccaagcacagccagccccugagcgaccccagacugaucggcugccuggugagagccgagagauuccagcugaucguggagagagacgugagaagcagcuuccccagcuggaaggagcugagcaugcccggcuucauccagaagcagcaggccagaguguacgugcaguucuuccuggccgacgcccugauccugcccgugcccagacccugccugcacagcgccacccccagcaccccccagaccgaccccaccggccccgagggcccccaccugggccagagcagacuguuccugcugugccacaaggaggcccugaugaagagaaacuucugcgugccccccggcgccagccccgaggugcccaagcccgcccugagcuucuacgugcugggcagcuggcugggcggcacccagagaaaggagggcaccggcuggggccugcccgagccccagggcaacgacgacaacgaccagaaggugcaccugaucuucuucggcagcagcgugagaugguucgaguuccugcaccccggccagguguacagacugaucgcccccggccccgccacccccaugcuguucgagaaggacggcagcagcugcaucagcagaagaccccuggagcuggccggcugcgccagcugccugaccgugcaggacaacuggacccuggagcuggagagcagccaggacauccaggacgugcuggacgccaacaagagccugcccgagagcagccugaccgaccugcugagcgacaacuucaccgacagccuggugagcuucagcgccgagauccugagcagaacccugugcgagccccugguggccagccuguggaugaagcugggcaacaccggcgccaugagaagaugcgugaagcugaccguggcccuggagaccgccgagugcgaguuccccccccaccuggacguguacaucgaggacccccaccugccccccagccugggccugcugcccggcgccagagugcacuucagccagcuggagaagagagugagcagaagccacaacguguacugcugcuucagaagcagcaccuacgugcaggugcugagcuucccccccgagaccaccaucagcaucccccugccccacaucuaccuggccgagcugcugcagggcggccagagccccuuccaggccaccgccagcugccacaucgugagcguguucagccugcagcuguucugggugugcgccuacugcaccagcaucugcagacagggcaagugcaccagacugggcagcaccugccccacccagaccgccaucagccaggccaucaucagacugcugguggaggacggcaccgccgaggccguggugaccugcagaaaccaccacguggccgccgcccugggccugugccccagagagugggccagccugcuggacuucgugcaggugcccggcagaguggugcugcaguucgccggccccggcgcccagcuggagagcagcgccagaguggacgagcccaugaccauguuccuguggacccugugcaccagccccagcgugcugagacccaucgugcugagcuucgagcuggagagaaagcccagcaagaucgugccccuggagccccccagacugcagagauuccagugcggcgagcugcccuuccugacccacgugaaccccagacugagacugagcugccugagcaucagagagagcgaguacagcagcagccugggcauccuggccagcagcugcuaa

SEQ ID NO: 15746 - RNA, 1200 nt, Artificial Sequence
  CTCF__Homo_sapiens__NP_001177951
auggccuucgugaccagcggcgagcuggugagacacagaagauacaagcacacccacgagaagcccuucaagugcagcaugugcgacuacgccagcguggaggugagcaagcugaagagacacaucagaagccacaccggcgagagacccuuccagugcagccugugcagcuacgccagcagagacaccuacaagcugaagagacacaugagaacccacagcggcgagaagcccuacgagugcuacaucugccacgccagauucacccagagcggcaccaugaagaugcacauccugcagaagcacaccgagaacguggccaaguuccacugcccccacugcgacaccgugaucgccagaaagagcgaccugggcgugcaccugagaaagcagcacagcuacaucgagcagggcaagaagugcagauacugcgacgccguguuccacgagagauacgcccugauccagcaccagaagagccacaagaacgagaagagauucaagugcgaccagugcgacuacgccugcagacaggagagacacaugaucaugcacaagagaacccacaccggcgagaagcccuacgccugcagccacugcgacaagaccuucagacagaagcagcugcuggacaugcacuucaagagauaccacgaccccaacuucgugcccgccgccuucgugugcagcaagugcggcaagaccuucaccagaagaaacaccauggccagacacgccgacaacugcgccggccccgacggcguggagggcgagaacggcggcgagaccaagaagagcaagagaggcagaaagagaaagaugagaagcaagaaggaggacagcagcgacagcgagaacgccgagcccgaccuggacgacaacgaggacgaggaggagcccgccguggagaucgagcccgagcccgagccccagcccgugacccccgcccccccccccgccaagaagagaagaggcagaccccccggcagaaccaaccagcccaagcagaaccagcccaccgccaucauccagguggaggaccagaacaccggcgccaucgagaacaucaucguggaggugaagaaggagcccgacgccgagcccgccgagggcgaggaggaggaggcccagcccgccgccaccgacgcccccaacggcgaccugacccccgagaugauccugagcaugauggacagauaa

SEQ ID NO: 15747 - RNA, 1992 nt, Artificial Sequence
  CTCFL__Homo_sapiens__NP_001255970
auggccgccaccgagaucagcgugcugagcgagcaguucaccaagaucaaggagcuggagcugaugcccgagaagggccugaaggaggaggagaaggacggcgugugcagagagaaggaccacagaagccccagcgagcuggaggccgagagaaccagcggcgccuuccaggacagcgugcuggaggaggagguggagcuggugcuggcccccagcgaggagagcgagaaguacauccugacccugcagaccgugcacuucaccagcgaggccguggagcugcaggacaugagccugcugagcauccagcagcaggagggcgugcaggugguggugcagcagcccggccccggccugcuguggcuggaggagggccccagacagagccugcagcagugcguggccaucagcauccagcaggagcuguacagcccccaggagauggaggugcugcaguuccacgcccuggaggagaacgugaugguggccagcgaggacagcaagcuggccgugagccuggccgagaccaccggccugaucaagcuggaggaggagcaggagaagaaccagcugcuggccgagagaaccaaggagcagcuguucuucguggagaccaugagcggcgacgagagaagcgacgagaucgugcugaccgugagcaacagcaacguggaggagcaggaggaccagcccaccgccggccaggccgacgccgagaaggccaagagcaccaagaaccagagaaagaccaagggcgccaagggcaccuuccacugcgacgugugcauguucaccagcagcagaaugagcagcuucaacagacacaugaagacccacaccagcgagaagccccaccugugccaccugugccugaagaccuucagaaccgugacccugcugagaaaccacgugaacacccacaccggcaccagacccuacaagugcaacgacugcaacauggccuucgugaccagcggcgagcuggugagacacagaagauacaagcacacccacgagaagcccuucaagugcagcaugugcaaguacgccagcguggaggccagcaagcugaagagacacgugagaagccacaccggcgagagacccuuccagugcugccagugcagcuacgccagcagagacaccuacaagcugaagagacacaugagaacccacagcggcgagaagcccuacgagugccacaucugccacaccagauucacccagagcggcaccaugaagauccacauccugcagaagcacggcgagaacgugcccaaguaccagugcccccacugcgccaccaucaucgccagaaagagcgaccugagagugcacaugagaaaccugcacgccuacagcgccgccgagcugaagugcagauacugcagcgccguguuccacgagagauacgcccugauccagcaccagaagacccacaagaacgagaagagauucaagugcaagcacugcagcuacgccugcaagcaggagagacacaugaccgcccacaucagaacccacaccggcgagaagcccuucaccugccugagcugcaacaagugcuucagacagaagcagcugcugaacgcccacuucagaaaguaccacgacgccaacuucauccccaccguguacaagugcagcaagugcggcaagggcuucagcagauggaucaaccugcacagacacagcgagaagugcggcagcggcgaggccaagagcgccgccagcggcaagggcagaagaaccagaaagagaaagcagaccauccugaaggaggccaccaagggccagaaggaggccgccaagggcuggaaggaggccgccaacggcgacgaggccgccgccgaggaggccagcaccaccaagggcgagcaguuccccggcgagauguuccccguggccugcagagagaccaccgccagagugaaggaggagguggacgagggcgugaccugcgagaugcugcugaacaccauggacaaguaa

SEQ ID NO: 15748 - RNA, 2886 nt, Artificial Sequence
  CTDP1__Homo_sapiens__NP_004706
auggaggugcccgccgccggcagagugcccgccgagggcgcccccaccgccgccguggccgaggugagaugccccggccccgccccccugagacugcuggaguggagaguggccgccggcgccgccgugagaaucggcagcgugcuggccguguucgaggccgccgccagcgcccagagcagcggcgccagccagagcagaguggccagcggcggcugcgugagacccgccagacccgagagaagacugagaagcgagagagccggcguggugagagagcugugcgcccagcccggccaggugguggcccccggcgccgugcuggugagacuggagggcugcagccaccccguggugaugaagggccugugcgccgagugcggccaggaccugacccagcugcagagcaagaacggcaagcagcaggugccccugagcaccgccaccgugagcauggugcacagcgugcccgagcugauggugagcagcgagcaggccgagcagcugggcagagaggaccagcagagacugcacagaaacagaaagcuggugcugaugguggaccuggaccagacccugauccacaccaccgagcagcacugccagcagaugagcaacaagggcaucuuccacuuccagcugggcagaggcgagcccaugcugcacaccagacugagaccccacugcaaggacuuccuggagaagaucgccaagcuguacgagcugcacguguucaccuucggcagcagacuguacgcccacaccaucgccggcuuccuggaccccgagaagaagcuguucagccacagaauccugagcagagacgagugcaucgaccccuucagcaagaccggcaaccugagaaaccuguuccccugcggcgacagcauggugugcaucaucgacgacagagaggacguguggaaguucgcccccaaccugaucaccgugaagaaguacguguacuuccagggcaccggcgacaugaacgccccccccggcagcagagagagccagaccagaaagaaggugaaccacagcagaggcaccgaggugagcgagcccagcccccccgugagagaccccgagggcgugacccaggcccccggcguggagcccagcaacggccuggagaagcccgccagagagcugaacggcagcgaggccgccacccccagagacagccccagacccggcaagcccgacgagagagacaucuggccccccgcccaggcccccaccagcagccaggagcuggccggcgcccccgagccccagggcagcugcgcccagggcggcagaguggcccccggccagagacccgcccagggcgccaccggcaccgaccuggacuucgaccugagcagcgacagcgagagcagcagcgagagcgagggcaccaagagcagcagcagcgccagcgacggcgagagcgagggcaagagaggcagacagaagcccaaggccgcccccgagggcgccggcgcccuggcccagggcagcagccuggagcccggcagacccgccgcccccagccugcccggcgaggccgagcccggcgcccacgcccccgacaaggagcccgagcugggcggccaggaggagggcgagagagacggccugugcggccugggcaacggcugcgccgacagaaaggaggccgagaccgagagccagaacagcgagcugagcggcgugaccgccggcgagagccuggaccagagcauggaggaggaggaggaggaggacaccgacgaggacgaccaccugaucuaccuggaggagauccuggugagagugcacaccgacuacuacgccaaguacgacagauaccugaacaaggagaucgaggaggcccccgacaucagaaagaucgugcccgagcugaagagcaaggugcuggccgacguggccaucaucuucagcggccugcaccccaccaacuuccccaucgagaagaccagagagcacuaccacgccaccgcccugggcgccaagauccugaccagacuggugcugagccccgacgcccccgacagagccacccaccugaucgccgccagagccggcaccgagaaggugcugcaggcccaggagugcggccaccugcacguggugaaccccgacuggcuguggagcugccuggagagaugggacaagguggaggagcagcuguucccccugagagacgaccacaccaaggcccagagagagaacagccccgccgccuuccccgacagagagggcgugccccccaccgcccuguuccaccccaugcccgugcugcccaaggcccagcccggccccgaggugagaaucuacgacagcaacaccggcaagcugaucagaaccggcgccagaggcccccccgcccccagcagcagccugcccaucagacaggagcccagcagcuucagagccgugccccccccccagccccagauguucggcgaggagcugcccgacgcccaggacggcgagcagcccggccccagcagaagaaagagacagcccagcaugagcgagaccaugccccuguacacccugugcaaggaggaccuggagagcauggacaaggagguggacgacauccugggcgagggcagcgacgacagcgacagcgagaagagaagacccgaggagcaggaggaggagccccagcccagaaagcccggcaccagaagagagagaacccugggcgcccccgccagcagcgagagaagcgccgccggcggcagaggccccagaggccacaagagaaagcugaacgaggaggacgccgccagcgagagcagcagagagagcagcaacgaggacgagggcagcagcagcgaggccgacgagauggccaaggcccuggaggccgagcugaacgaccugauguaa

SEQ ID NO: 15749 - RNA, 783 nt, Artificial Sequence
  CTDSP1__Homo_sapiens__NP_001193807
augguggccgcccccugggccacccaggagcaggaggagggcagaggcauccagcccggcgacagaggcgaccagaagagcgccgccagccagaagcccagaagcagaggcauccugcacagccuguucugcugcgugugcagagacgacggcgaggcccugcccgcccacagcggcgccccccugcugguggaggagaacggcgccauccccaagacccccgugcaguaccugcugcccgaggccaaggcccaggacagcgacaagaucugcguggugaucgaccuggacgagacccuggugcacagcagcuucaagcccgugaacaacgccgacuucaucauccccguggagaucgacggcguggugcaccagguguacgugcugaagagaccccacguggacgaguuccugcagagaaugggcgagcuguucgagugcgugcuguucaccgccagccuggccaaguacgccgaccccguggccgaccugcuggacaaguggggcgccuucagagccagacuguucagagagagcugcguguuccacagaggcaacuacgugaaggaccugagcagacugggcagagaccugagaagagugcugauccuggacaacagccccgccagcuacguguuccaccccgacaacgccgugcccguggccagcugguucgacaacaugagcgacaccgagcugcacgaccugcugcccuucuucgagcagcugagcagaguggacgacguguacagcgugcugagacagcccagacccggcagcuaa

SEQ ID NO: 15750 - RNA, 816 nt, Artificial Sequence
  CTDSP2__Homo_sapiens__NP_005721
auggagcacggcagcaucaucacccaggccagaagagaggacgcccuggugcugaccaagcagggccuggugagcaagagcagccccaagaagcccagaggcagaaacaucuucaaggcccuguucugcugcuucagagcccagcacgugggccagagcagcagcagcaccgagcuggccgccuacaaggaggaggccaacaccaucgccaagagcgaccugcugcagugccugcaguaccaguucuaccagauccccggcaccugccugcugcccgaggugaccgaggaggaccagggcagaaucugcguggugaucgaccuggacgagacccuggugcacagcagcuucaagcccaucaacaacgccgacuucaucgugcccaucgagaucgagggcaccacccaccagguguacgugcugaagagacccuacguggacgaguuccugagaagaaugggcgagcuguucgagugcgugcuguucaccgccagccuggccaaguacgccgaccccgugaccgaccugcuggacagaugcggcguguucagagccagacuguucagagagagcugcguguuccaccagggcugcuacgugaaggaccugagcagacugggcagagaccugagaaagacccugauccuggacaacagccccgccagcuacaucuuccaccccgagaacgccgugcccgugcagagcugguucgacgacauggccgacaccgagcugcugaaccugauccccaucuucgaggagcugagcggcgccgaggacguguacaccagccugggccagcugagagcccccuaa

SEQ ID NO: 15751 - RNA, 831 nt, Artificial Sequence
  CTDSPL__Homo_sapiens__NP_001008393
auggacggccccgccaucaucacccaggugaccaaccccaaggaggacgagggcagacugcccggcgccggcgagaaggccagccagugcaacgugagccugaagaagcagagaagcagaagcauccugagcagcuucuucugcugcuucagagacuacaacguggaggcccccccccccagcagccccagcgugcugcccccccugguggaggagaacggcggccugcagaagggcgaccagagacaggugauccccauccccagcccccccgccaaguaccugcugcccgaggugaccgugcuggacuacggcaagaagugcguggugaucgaccuggacgagacccuggugcacagcagcuucaagcccaucagcaacgccgacuucaucgugcccguggagaucgacggcaccauccaccagguguacgugcugaagagaccccacguggacgaguuccugcagagaaugggccagcuguucgagugcgugcuguucaccgccagccuggccaaguacgccgaccccguggccgaccugcuggacagauggggcguguucagagccagacuguucagagagagcugcguguuccacagaggcaacuacgugaaggaccugagcagacugggcagagagcugagcaaggugaucaucguggacaacagccccgccagcuacaucuuccaccccgagaacgccgugcccgugcagagcugguucgacgacaugaccgacaccgagcugcuggaccugauccccuucuucgagggccugagcagagaggacgacguguacagcaugcugcacagacugugcaacagauaa

SEQ ID NO: 15752 - RNA, 603 nt, Artificial Sequence
  CTF1__Homo_sapiens__NP_001136016
augagcagaagagagggcagccuggacccccagaccgacagcagcgugagccugcugccccaccuggaggccaagaucagacagacccacagccuggcccaccugcugaccaaguacgccgagcagcugcugcaggaguacgugcagcugcagggcgaccccuucggccugcccagcuucagcccccccagacugcccguggccggccugagcgcccccgcccccagccacgccggccugcccgugcacgagagacugagacuggacgccgccgcccuggccgcccugcccccccugcuggacgccgugugcagaagacaggccgagcugaaccccagagcccccagacugcugagaagacuggaggacgccgccagacaggccagagcccugggcgccgccguggaggcccugcuggccgcccugggcgccgccaacagaggccccagagccgagccccccgccgccaccgccagcgccgccagcgccaccggcguguuccccgccaaggugcugggccugagagugugcggccuguacagagaguggcugagcagaaccgagggcgaccugggccagcugcugcccggcggcagcgccuaa

SEQ ID NO: 15753 - RNA, 1050 nt, Artificial Sequence
  CTGF__Homo_sapiens__NP_001892
augaccgccgccagcaugggccccgugagaguggccuucguggugcugcuggcccugugcagcagacccgccgugggccagaacugcagcggccccugcagaugccccgacgagcccgcccccagaugccccgccggcgugagccuggugcuggacggcugcggcugcugcagagugugcgccaagcagcugggcgagcugugcaccgagagagaccccugcgacccccacaagggccuguucugcgacuucggcagccccgccaacagaaagaucggcgugugcaccgccaaggacggcgcccccugcaucuucggcggcaccguguacagaagcggcgagagcuuccagagcagcugcaaguaccagugcaccugccuggacggcgccgugggcugcaugccccugugcagcauggacgugagacugcccagccccgacugccccuuccccagaagagugaagcugcccggcaagugcugcgaggagugggugugcgacgagcccaaggaccagaccguggugggccccgcccuggccgccuacagacuggaggacaccuucggccccgaccccaccaugaucagagccaacugccuggugcagaccaccgaguggagcgccugcagcaagaccugcggcaugggcaucagcaccagagugaccaacgacaacgccagcugcagacuggagaagcagagcagacugugcauggugagacccugcgaggccgaccuggaggagaacaucaagaagggcaagaagugcaucagaacccccaagaucagcaagcccaucaaguucgagcugagcggcugcaccagcaugaagaccuacagagccaaguucugcggcgugugcaccgacggcagaugcugcaccccccacagaaccaccacccugcccguggaguucaagugccccgacggcgaggugaugaagaagaacaugauguucaucaagaccugcgccugccacuacaacugccccggcgacaacgacaucuucgagagccuguacuacagaaagauguacggcgacauggccuaa

SEQ ID NO: 15754 - RNA, 690 nt, Artificial Sequence
  CTHRC1__Homo_sapiens__NP_001243028
auguggccccccggcagaagcaucaccgugaagcugagagagaagaccgugagcagaaagcuggagaugaacggccccagcgccuuccagggccugaucugcggcaaguacaacggcaugugccugcagggccccgccggcgugcccggcagagacggcagccccggcgccaacggcauccccggcacccccggcauccccggcagagacggcuucaagggcgagaagggcgagugccugagagagagcuucgaggagagcuggacccccaacuacaagcagugcagcuggagcagccugaacuacggcaucgaccugggcaagaucgccgagugcaccuucaccaagaugagaagcaacagcgcccugagagugcuguucagcggcagccugagacugaagugcagaaacgccugcugccagagaugguacuucaccuucaacggcgccgagugcagcggcccccugcccaucgaggccaucaucuaccuggaccagggcagccccgagaugaacagcaccaucaacauccacagaaccagcagcguggagggccugugcgagggcaucggcgccggccugguggacguggccaucugggugggcaccugcagcgacuaccccaagggcgacgccagcaccggcuggaacagcgugagcagaaucaucaucgaggagcugcccaaguaa

SEQ ID NO: 15755 - RNA, 1803 nt, Artificial Sequence
  CTIF__Homo_sapiens__NP_001135869
auggagaacagcagcgccgccagcgccagcagcgaggccggcagcagcagaagccaggagaucgaggagcuggagagauucaucgacagcuacgugcuggaguaccaggugcagggccugcuggccgacaagaccgagggcgacggcgagagcgagagaacccagagccacaucagccaguggaccgccgacugcagcgagccccuggacagcagcugcagcuucagcagaggcagagcccccccccagcagaacggcagcaaggacaacagccuggacaugcugggcaccgacaucugggccgccaacaccuucgacagcuucagcggcgccaccugggaccugcagcccgagaagcuggacuucacccaguuccacagaaaggugagacacacccccaagcagccccugccccacaucgacagagagggcugcggcaagggcaagcuggaggacggcgacggcaucaaccugaacgacaucgagaaggugcugcccgccuggcagggcuaccaccccaugccccacgagguggagaucgcccacaccaagaagcuguucagaagaagaagaaacgacagaagaagacagcagagaccccccggcggcaacaagccccagcagcacggcgaccaccagcccggcagcgccaagcacaacagagaccaccagaagagcuaccagggcggcagcgccccccaccccagcggcagacccacccaccacggcuacagccagaacagaagauggcaccacggcaacaugaagcacccccccggcgacaagggcgaggccggcgcccacagaaacgccaaggagaccaugaccaucgagaaccccaagcuggaggacaccgccggcgacaccggccacagcagccuggaggcccccagaagccccgacacccuggcccccguggccagcgagagacugcccccccagcagagcggcggccccgagguggagaccaagagaaaggacagcauccugcccgagagaaucggcgagagacccaagaucacccugcugcagagcagcaaggacagacugagaagaagacugaaggagaaggugcccgacgagguggccguggagaccaccaccccccagcagaacaagauggacaagcugaucgagauccugaacagcaugagaaacaacagcagcgacguggacaccaagcugaccaccuucauggaggaggcccagaacagcaccaacagcgaggagaugcugggcgagaucgugagaaccaucuaccagaaggccgugagcgacagaagcuucgccuucaccgccgccaagcugugcgacaagauggcccuguucaugguggagggcaccaaguucagaagccugcugcugaacaugcugcagaaggacuucaccgugagagaggagcugcagcagcaggacguggagagauggcugggcuucaucaccuuccugugcgagguguucggcaccaugagaagcagcaccggcgagcccuucagagugcuggugugccccaucuacaccugccugagagagcugcugcagagccaggacgugaaggaggacgccgugcugugcugcagcauggagcugcagagcaccggcagacugcuggaggagcagcugcccgagaugaugaccgagcugcuggccagcgccagagacaagaugcugugccccagcgagagcaugcugaccagaagccugcugcuggaggugaucgagcugcacgccaacagcuggaacccccugaccccccccaucacccaguacuacaacagaaccauccagaagcugaccgccuaa

SEQ ID NO: 15756 - RNA, 525 nt, Artificial Sequence
  CTLA4__Homo_sapiens__NP_001032720
auggccugccugggcuuccagagacacaaggcccagcugaaccuggccaccagaaccuggcccugcacccugcuguucuuccugcuguucauccccguguucugcaaggccaugcacguggcccagcccgccguggugcuggccagcagcagaggcaucgccagcuucgugugcgaguacgccagccccggcaaggccaccgaggugagagugaccgugcugagacaggccgacagccaggugaccgaggugugcgccgccaccuacaugaugggcaacgagcugaccuuccuggacgacagcaucugcaccggcaccagcagcggcaaccaggugaaccugaccauccagggccugagagccauggacaccggccuguacaucugcaagguggagcugauguaccccccccccuacuaccugggcaucggcaacggcacccagaucuacgugaucgccaaggagaagaagcccagcuacaacagaggccugugcgagaacgcccccaacagagccagaauguaa

SEQ ID NO: 15757 - RNA, 2526 nt, Artificial Sequence
  CTNNA1__Homo_sapiens__NP_001277236
augaccgccgugcacgccggcaacaucaacuucaagugggaccccaagagccuggagaucagaacccuggccguggagagacugcuggagccccuggugacccaggugaccacccuggugaacaccaacagcaagggccccagcaacaagaagagaggcagaagcaagaaggcccacgugcuggccgccagcguggagcaggccaccgagaacuuccuggagaagggcgacaagaucgccaaggagagccaguuccugaaggaggagcugguggccgccguggaggacgugagaaagcagggcgaccugaugaaggccgccgccggcgaguucgccgacgaccccugcagcagcgugaagagaggcaacauggugagagccgccagagcccugcugagcgccgugaccagacugcugauccuggccgacauggccgacguguacaagcugcuggugcagcugaaggugguggaggacggcauccugaagcugagaaacgccggcaacgagcaggaccugggcauccaguacaaggcccugaagcccgagguggacaagcugaacaucauggccgccaagagacagcaggagcugaaggacgugggccacagagaccagauggccgccgccagaggcauccugcagaagaacgugcccauccuguacaccgccagccaggccugccugcagcaccccgacguggccgccuacaaggccaacagagaccugaucuacaagcagcugcagcaggccgugaccggcaucagcaacgccgcccaggccaccgccagcgacgacgccagccagcaccagggcggcggcggcggcgagcuggccuacgcccugaacaacuucgacaagcagaucaucguggacccccugagcuucagcgaggagagauucagacccagccuggaggagagacuggagagcaucaucagcggcgccgcccugauggccgacagcagcugcaccagagacgacagaagagagagaaucguggccgagugcaacgccgugagacaggcccugcaggaccugcugagcgaguacaugggcaacgccggcagaaaggagagaagcgacgcccugaacagcgccaucgacaagaugaccaagaagaccagagaccugagaagacagcugagaaaggccgugauggaccacgugagcgacagcuuccuggagaccaacgugccccugcuggugcugaucgaggccgccaagaacggcaacgagaaggaggugaaggaguacgcccagguguucagagagcacgccaacaagcugaucgagguggccaaccuggccugcagcaucagcaacaacgaggagggcgugaagcuggugagaaugagcgccagccagcuggaggcccugugcccccaggugaucaacgccgcccuggcccuggccgccaagccccagagcaagcuggcccaggagaacauggaccuguucaaggagcagugggagaagcaggugagagugcugaccgacgccguggacgacaucaccagcaucgacgacuuccuggccgugagcgagaaccacauccuggaggacgugaacaagugcgugaucgcccugcaggagaaggacguggacggccuggacagaaccgccggcgccaucagaggcagagccgccagagugauccacguggugaccagcgagauggacaacuacgagcccggcguguacaccgagaaggugcuggaggccaccaagcugcugagcaacaccgugaugcccagauucaccgagcagguggaggccgccguggaggcccugagcagcgaccccgcccagcccauggacgagaacgaguucaucgacgccagcagacugguguacgacggcaucagagacaucagaaaggccgugcugaugaucagaacccccgaggagcuggacgacagcgacuucgagaccgaggacuucgacgugagaagcagaaccagcgugcagaccgaggacgaccagcugaucgccggccagagcgccagagccaucauggcccagcugccccaggagcagaaggccaagaucgccgagcagguggccagcuuccaggaggagaagagcaagcuggacgccgaggugagcaagugggacgacagcggcaacgacaucaucgugcuggccaagcagaugugcaugaucaugauggagaugaccgacuucaccagaggcaagggcccccugaagaacaccagcgacgugaucagcgccgccaagaagaucgccgaggccggcagcagaauggacaagcugggcagaaccaucgccgaccacugccccgacagcgccugcaagcaggaccugcuggccuaccugcagagaaucgcccuguacugccaccagcugaacaucugcagcaaggugaaggccgaggugcagaaccugggcggcgagcugguggugagcggcaacugcgacaccugcggcgcccugcagggccugaagggcuggccccccccccugugcuggccccugaccggcuggaccgcccccugccccuaa

SEQ ID NO: 15758 - RNA, 2583 nt, Artificial Sequence
  CTNNA2__Homo_sapiens__NP_001158355
augaccagcgccaccagccccaucauccugaagugggaccccaagagccuggagaucagaacccugaccguggagagacugcuggagccccuggugacccaggugaccacccuggugaacaccagcaacaagggccccagcggcaagaagaagggcagaagcaagaaggcccacgugcuggccgccagcguggagcaggccacccagaacuuccuggagaagggcgagcagaucgccaaggagagccaggaccugaaggaggagcugguggccgccguggaggacgugagaaagcagggcgagaccaugagaaucgccagcagcgaguucgccgacgaccccugcagcagcgugaagagaggcaccauggugagagccgccagagcccugcugagcgccgugaccagacugcugauccuggccgacauggccgacgugaugagacugcugagccaccugaagaucguggaggaggcccuggaggccgugaagaacgccaccaacgagcaggaccuggccaacagauucaaggaguucggcaaggagauggugaagcugaacuacguggccgccagaagacagcaggagcugaaggacccccacugcagagacgagauggccgccgccagaggcgcccugaagaagaacgccaccaugcuguacaccgccagccaggccuuccugagacaccccgacguggccgccaccagagccaacagagacuacguguucaagcaggugcaggaggccaucgccggcaucagcaacgccgcccaggccaccagccccaccgacgaggccaagggccacaccggcaucggcgagcuggccgccgcccugaacgaguucgacaacaagaucauccuggaccccaugaccuucagcgaggccagauucagacccagccuggaggagagacuggagagcaucaucagcggcgccgcccugauggccgacagcagcugcaccagagacgacagaagagagagaaucguggccgagugcaacgccgugagacaggcccugcaggaccugcugagcgaguacaugaacaacaccggcagaaaggagaagggcgacccccugaacaucgccaucgacaagaugaccaagaagaccagagaccugagaagacagcugagaaaggccgugauggaccacaucagcgacagcuuccuggagaccaacgugccccugcuggugcugaucgaggccgccaagagcggcaacgagaaggaggugaaggaguacgcccagguguucagagagcacgccaacaagcugguggagguggccaaccuggccugcagcaucagcaacaacgaggagggcgugaagcuggugagaauggccgccacccagaucgacagccugugcccccaggugaucaacgccgcccugacccuggccgccagaccccagagcaagguggcccaggacaacauggacguguucaaggaccagugggagaagcaggugagagugcugaccgaggccguggacgacaucaccagcguggacgacuuccugagcgugagcgagaaccacauccuggaggacgugaacaagugcgugaucgcccugcaggagggcgacguggacacccuggacagaaccgccggcgccaucagaggcagagccgccagagugauccacaucaucaacgccgagauggagaacuacgaggccggcguguacaccgagaaggugcuggaggccaccaagcugcugagcgagaccgugaugcccagauucgccgagcagguggagguggccaucgaggcccugagcgccaacgugccccagcccuucgaggagaacgaguucaucgacgccagcagacugguguacgacggcgugagagacaucagaaaggccgugcugaugaucagaacccccgaggagcuggaggacgacagcgacuucgagcaggaggacuacgacgugagaagcagaaccagcgugcagaccgaggacgaccagcugaucgccggccagagcgccagagccaucauggcccagcugccccaggaggagaaggccaagaucgccgagcagguggagaucuuccaccaggagaagagcaagcuggacgccgagguggccaagugggacgacagcggcaacgacaucaucgugcuggccaagcagaugugcaugaucaugauggagaugaccgacuucaccagaggcaagggcccccugaagaacaccagcgacgugaucaacgccgccaagaagaucgccgaggccggcagcagaauggacaagcuggccagagccguggccgaccagcuggacagcgccaccagccugauccaggccgccaagaaccugaugaacgccguggugcugaccgugaaggccagcuacguggccagcaccaaguaccagaagguguacggcaccgccgccgugaacagccccguggugagcuggaagaugaaggcccccgagaagaagccccuggugaagagagagaagcccgaggaguuccagaccagagugagaagaggcagccagaagaagcacaucagccccgugcaggcccugagcgaguucaaggccauggacagcuucuaa

SEQ ID NO: 15759 - RNA, 1167 nt, Artificial Sequence
  CTNNA3__Homo_sapiens__NP_001278062
augaagagcacccagagaagagagaagcagggcagcaugagcgccgagacccccaucacccugaacaucgacccccaggaccugcaggugcagaccuucaccguggagaagcugcuggagccccugaucauccaggugaccacccuggugaacugcccccagaaccccagcagcagaaagaagggcagaagcaagagagccagcgugcugcuggccagcguggaggaggccaccuggaaccugcuggacaagggcgagaagaucgcccaggaggccaccgugcugaaggacgagcugaccgccagccuggaggaggugagaaaggagagcgaggcccugaaggugagcgccgagagauucaccgacgaccccugcuuccugcccaagagagaggccguggugcaggccgccagagcccugcuggccgccgugaccagacugcugauccuggccgacaugaucgacgugaugugccugcugcagcacgugagcgccuuccagagaaccuucgagagccugaagaacguggccaacaagagcgaccugcagaagaccuaccagaagcugggcaaggagcuggagaaccuggacuaccuggccuucaagagacagcaggaccugaagagccccaaccagagagacgagaucgccggcgccagagccagccugaaggagaacagcccccugcugcacagcaucugcagcgccugccuggagcacagcgacguggccagccugaaggccagcaaggacaccgugugcgaggagauccagaacgcccugaacgugaucagcaacgccagccagggcauccagaacaugaccaccccccccgagccccaggccgccacccugggcagcgcccuggacgagcuggagaaccugaucgugcugaacccccugaccgugaccgaggaggagaucagacccagccuggagaagagacuggaggccaucaucagcggcgccgcccugcuggccgacagcagcugcaccagagaccugcacagagagagaaucaucgccgagugcaacgccaucagacaggcccugcaggaccugcugagcgaguacaugaacaaccugugcaaccagaagagcgaccugggccugaccggcgugaagaucaagcugcuggaggagugcaucaucuucuggagccuguaa

SEQ ID NO: 15760 - RNA, 2157 nt, Artificial Sequence
  CTNNAL1__Homo_sapiens__NP_001273903
auggccgccagccccggccccgccggcgugggcggcgccggcgccguguacggcagcggcagcagcggcuucgcccuggacagcggccuggagaucaagaccagaagcguggagcagacccugcugccccuggugagccagaucaccacccugaucaaccacaaggacaacaccaagaagagcgacaagacccugcaggccauccagagagugggccaggccgugaaccuggccgugggcagauucgugaaggugggcgaggccaucgccaacgagaacugggaccugaaggaggagaucaacaucgccugcaucgaggccaagcaggccggcgagaccaucgccgcccugaccgacaucaccaaccugaaccaccuggagagcgacggccagaucaccaucuucaccgacaagaccggcgugaucaaggccgccagacugcugcugagcagcgugaccaaggugcugcugcuggccgacagaguggugaucaagcagaucaucaccagcagaaacaaggugcuggccaccauggagagacuggagaaggugaacagcuuccaggaguucgugcagaucuucagccaguucggcaacgagaugguggaguucgcccaccugagcggcgacagacagaacgaccugaaggacgagaagaagaaggccaagauggccgccgccagagccgugcuggagaagugcaccaugaugcugcugaccgccagcaagaccugccugagacaccccaacugcgagagcgcccacaagaacaaggagggcguguucgacagaaugaagguggcccuggacaaggugaucgagaucgugaccgacugcaagcccaacggcgagaccgacaucagcagcaucagcaucuucaccggcaucaaggaguucaagaugaacaucgaggcccugagagagaaccuguacuuccagagcaaggagaaccugagcgugacccuggaggugauccuggagagaauggaggacuucaccgacagcgccuacaccagccacgagcacagagagagaauccuggagcugagcacccaggccagaauggagcugcagcagcugaucagcguguggauccaggcccagagcaagaagaccaagagcaucgccgaggagcuggagcugagcauccugaagaucagccacagccugaacgagcugaagaaggagcugcacagcaccgccacccagcuggccgccgaccugcugaaguaccacgccgaccacguggugcugaaggcccugaagcugaccggcguggagggcaaccuggaggcccuggccgaguacgccugcaagcugagcgagcagaaggagcagcugguggagaccugcagacugcugagacacaucagcggcaccgagccccuggagaucaccugcauccacgccgaggagaccuuccaggugaccggccagcagaucaucagcgccgccgagacccugacccugcaccccagcagcaagaucgccaaggagaaccuggacguguucugcgaggccugggagagccagaucagcgacaugagcacccugcugagagagaucaacgacguguucgagggcagaagaggcgagaaguacggcuaccugagccugcccaagcccaugaagaacaacgccaaccugaagagccugaagcccgacaagcccgacagcgaggagcaggccaagaucgccaagcugggccugaagcugggccugcugaccagcgacgccgacugcgagaucgagaagugggaggaccaggagaacgagaucgugcaguacggcagaaacaugagcagcauggccuacagccuguaccuguucaccagaggcgagggcccccugaagaccagccaggaccugauccaccagcuggagguguucgccgccgagggccugaagcugaccagcagcgugcaggccuucagcaagcagcugaaggacgacgacaagcugaugcugcugcuggagaucaacaagcugaucccccugugccaccagcugcagaccgugaccaagaccagccugcagaacaagguguuccugaagguggacaagugcaucaccaagaccagaagcaugauggcccugcuggugcagcugcugagccugugcuacaagcugcugaagaagagcgagaccagauacuaa

SEQ ID NO: 15761 - RNA, 2346 nt, Artificial Sequence
  CTNNB1__Homo_sapiens__NP_001091679
auggccacccaggccgaccugauggagcuggacauggccauggagcccgacagaaaggccgccgugagccacuggcagcagcagagcuaccuggacagcggcauccacagcggcgccaccaccaccgcccccagccugagcggcaagggcaaccccgaggaggaggacguggacaccagccaggugcuguacgagugggagcagggcuucagccagagcuucacccaggagcagguggccgacaucgacggccaguacgccaugaccagagcccagagagugagagccgccauguuccccgagacccuggacgagggcaugcagauccccagcacccaguucgacgccgcccaccccaccaacgugcagagacuggccgagcccagccagaugcugaagcacgccguggugaaccugaucaacuaccaggacgacgccgagcuggccaccagagccauccccgagcugaccaagcugcugaacgacgaggaccaggugguggugaacaaggccgccgugauggugcaccagcugagcaagaaggaggccagcagacacgccaucaugagaagcccccagauggugagcgccaucgugagaaccaugcagaacaccaacgacguggagaccgccagaugcaccgccggcacccugcacaaccugagccaccacagagagggccugcuggccaucuucaagagcggcggcauccccgcccuggugaagaugcugggcagccccguggacagcgugcuguucuacgccaucaccacccugcacaaccugcugcugcaccaggagggcgccaagauggccgugagacuggccggcggccugcagaagaugguggcccugcugaacaagaccaacgugaaguuccuggccaucaccaccgacugccugcagauccuggccuacggcaaccaggagagcaagcugaucauccuggccagcggcggcccccaggcccuggugaacaucaugagaaccuacaccuacgagaagcugcuguggaccaccagcagagugcugaaggugcugagcgugugcagcagcaacaagcccgccaucguggaggccggcggcaugcaggcccugggccugcaccugaccgaccccagccagagacuggugcagaacugccuguggacccugagaaaccugagcgacgccgccaccaagcaggagggcauggagggccugcugggcacccuggugcagcugcugggcagcgacgacaucaacguggugaccugcgccgccggcauccugagcaaccugaccugcaacaacuacaagaacaagaugauggugugccaggugggcggcaucgaggcccuggugagaaccgugcugagagccggcgacagagaggacaucaccgagcccgccaucugcgcccugagacaccugaccagcagacaccaggaggccgagauggcccagaacgccgugagacugcacuacggccugcccgugguggugaagcugcugcacccccccagccacuggccccugaucaaggccaccgugggccugaucagaaaccuggcccugugccccgccaaccacgccccccugagagagcagggcgccauccccagacuggugcagcugcuggugagagcccaccaggacacccagagaagaaccagcaugggcggcacccagcagcaguucguggagggcgugagaauggaggagaucguggagggcugcaccggcgcccugcacauccuggccagagacgugcacaacagaaucgugaucagaggccugaacaccaucccccuguucgugcagcugcuguacagccccaucgagaacauccagagaguggccgccggcgugcugugcgagcuggcccaggacaaggaggccgccgaggccaucgaggccgagggcgccaccgccccccugaccgagcugcugcacagcagaaacgagggcguggccaccuacgccgccgccgugcuguucagaaugagcgaggacaagccccaggacuacaagaagagacugagcguggagcugaccagcagccuguucagaaccgagcccauggccuggaacgagaccgccgaccugggccuggacaucggcgcccagggcgagccccugggcuacagacaggacgaccccagcuacagaagcuuccacagcggcggcuacggccaggacgcccugggcauggaccccaugauggagcacgagaugggcggccaccaccccggcgccgacuaccccguggacggccugcccgaccugggccacgcccaggaccugauggacggccugccccccggcgacagcaaccagcuggccugguucgacaccgaccuguaa

SEQ ID NO: 15762 - RNA, 1611 nt, Artificial Sequence
  CTNNBL1__Homo_sapiens__NP_001268424
augagaagaaagcagaccggcaccagagagagaggcagauacagagaggaggagaugaccgugguggaggaggccgacgacgacaagaagagacugcugcagaucaucgacagagacggcgaggaggaggaggaggaggaggagccccuggacgagagcagcgugaagaagaugauccugaccuucgagaagagaagcuacaagaaccaggagcugagaaucaaguuccccgacaaccccgagaaguucauggagagcgagcuggaccugaacgacaucauccaggagaugcacgugguggccaccaugcccgaccuguaccaccugcugguggagcugaacgccgugcagagccugcugggccugcugggccacgacaacaccgacgugagcaucgccgugguggaccugcugcaggagcugaccgacaucgacacccugcacgagagcgaggagggcgccgaggugcugaucgacgcccugguggacggccaggugguggcccugcuggugcagaaccuggagagacuggacgagagcgugaaggaggaggccgacggcgugcacaacacccuggccaucguggagaacauggccgaguucagacccgagaugugcaccgagggcgcccagcagggccugcugcaguggcugcugaagagacugaaggccaagaugcccuucgacgccaacaagcuguacugcagcgaggugcuggccauccugcugcaggacaacgacgagaacagagagcugcugggcgagcuggacggcaucgacgugcugcugcagcagcugagcguguucaagagacacaaccccagcaccgccgaggagcaggagaugauggagaaccuguucgacagccugugcagcugccugaugcugagcagcaacagagagagauuccugaagggcgagggccugcagcugaugaaccugaugcugagagagaagaagaucagcagaagcagcgcccugaaggugcuggaccacgccaugaucggccccgagggcaccgacaacugccacaaguucguggacauccugggccugagaaccaucuucccccuguucaugaagagccccagaaagaucaagaaggugggcaccaccgagaaggagcacgaggagcacgugugcagcauccuggccagccugcugagaaaccugagaggccagcagagaaccagacugcugaacaaguucaccgagaacgacagcgagaagguggacagacugauggagcugcacuucaaguaccugggcgccaugcagguggccgacaagaagaucgagggcgagaagcacgacauggugagaagaggcgagaucaucgacaacgacaccgaggaggaguucuaccugagaagacuggacgccggccuguucgugcugcagcacaucugcuacaucauggccgagaucugcaacgccaacgugccccagaucagacagagagugcaccagauccugaacaugagaggcagcagcaucaagaucgugagacacaucaucaaggaguacgccgagaacaucggcgacggcagaagccccgaguucagagagaacgagcagaagagaauccugggccugcuggagaacuucuaa

SEQ ID NO: 15763 - RNA, 2907 nt, Artificial Sequence
  CTNND1__Homo_sapiens__NP_001078927
auggacgacagcgagguggagagcaccgccagcauccuggccagcgugaaggagcaggaggcccaguucgagaagcugaccagagcccuggaggaggagagaagacacgugagcgcccagcuggagagagugagagugagcccccaggacgccaacccccugauggccaacggcacccugaccagaagacaccagaacggcagauucgugggcgacgccgaccuggagagacagaaguucagcgaccugaagcugaacggcccccaggaccacagccaccugcuguacagcaccauccccagaaugcaggagcccggccagaucguggagaccuacaccgaggaggaccccgagggcgccaugagcguggugagcguggagaccagcgacgacggcaccaccagaagaaccgagaccaccgugaagaagguggugaagaccgugaccaccagaaccgugcagcccguggccaugggccccgacggccugcccguggacgccagcagcgugagcaacaacuacauccagacccugggcagagacuucagaaagaacggcaacggcggccccggccccuacgugggccaggccggcaccgccacccugcccagaaacuuccacuacccccccgacggcuacagcagacacuacgaggacggcuaccccggcggcagcgacaacuacggcagccugagcagagugaccagaaucgaggagagauacagacccagcauggagggcuacagagcccccagcagacaggacguguacggcccccagccccaggugagagugggcggcagcagcguggaccugcacagauuccaccccgagcccuacggccuggaggacgaccagagaagcaugggcuacgacgaccuggacuacggcaugaugagcgacuacggcaccgccagaagaaccggcacccccagcgaccccagaagaagacugagaagcuacgaggacaugaucggcgaggaggugcccagcgaccaguacuacugggccccccuggcccagcacgagagaggcagccuggccagccuggacagccugagaaagggcggcccccccccccccaacuggagacagcccgagcugcccgaggugaucgccaugcugggcuucagacuggacgccgugaagagcaacgccgccgccuaccugcagcaccugugcuacagaaacgacaaggugaagaccgacgugagaaagcugaagggcauccccgugcuggugggccugcuggaccaccccaagaaggaggugcaccugggcgccugcggcgcccugaagaacaucagcuucggcagagaccaggacaacaagaucgccaucaagaacugcgacggcgugcccgcccuggugagacugcugagaaaggccagagacauggaccugaccgaggugaucaccggcacccuguggaaccugagcagccacgacagcaucaagauggagaucguggaccacgcccugcacgcccugaccgacgaggugaucaucccccacagcggcugggagagagagcccaacgaggacugcaagcccagacacaucgagugggagagcgugcugaccaacaccgccggcugccugagaaacgugagcagcgagagaagcgaggccagaagaaagcugagagagugcgacggccugguggacgcccugaucuucaucgugcaggccgagaucggccagaaggacagcgacagcaagcugguggagaacugcgugugccugcugagaaaccugagcuaccaggugcacagagagaucccccaggccgagagauaccaggaggccgcccccaacguggccaacaacaccggcccccacgccgccagcugcuucggcgccaagaagggcaaggacgagugguucagcagaggcaagaagcccaucgaggaccccgccaacgacaccguggacuuccccaagagaaccagccccgccagaggcuacgagcugcuguuccagcccgagguggugagaaucuacaucagccugcugaaggagagcaagacccccgccauccuggaggccagcgccggcgccauccagaaccugugcgccggcagauggaccuacggcagauacaucagaagcgcccugagacaggagaaggcccugagcgccaucgccgaccugcugaccaacgagcacgagagaguggugaaggccgccagcggcgcccugagaaaccuggccguggacgccagaaacaaggagcugaucggcaagcacgccauccccaaccuggugaagaaccugcccggcggccagcagaacagcagcuggaacuucagcgaggacaccgugaucagcauccugaacaccaucaacgaggugaucgccgagaaccuggaggccgccaagaagcugagagagacccagggcaucgagaagcuggugcugaucaacaagagcggcaacagaagcgagaaggaggugagagccgccgcccuggugcugcagaccaucuggggcuacaaggagcugagaaagccccuggagaaggagggcuggaagaagagcgacuuccaggugaaccugaacaacgccagcagaagccagagcagccacagcuacgacgacagcacccugccccugaucgacagaaaccagaagagcgacaagaagcccgacagagaggagauccagaugagcaacaugggcagcaacaccaagagccuggacaacaacuacagcacccccaacgagagaggcgaccacaacagaacccuggacagaagcggcgaccugggcgacauggagccccugaagggcaccaccccccugaugcaggacgagggccaggagagccuggaggaggagcuggacgugcuggugcuggacgacgagggcggccaggugagcuaccccagcaugcagaagaucuaa

SEQ ID NO: 15764 - RNA, 3405 nt, Artificial Sequence
  CTNND2__Homo_sapiens__NP_001275644
augagcagcaugagcagcgccgaggagcaguuccaguggcagagccaggacggccagaaggacaucgaggacgagcugaccaccggccuggagcugguggacagcugcaucagaagccugcaggagagcggcauccuggacccccaggacuacagcaccggcgagagacccagccugcugagccagagcgcccugcagcugaacagcaagcccgagggcagcuuccaguaccccgccagcuaccacagcaaccagacccuggcccugggcgagaccacccccagccagcugcccgccagaggcacccaggccagagccaccggccagagcuucagccagggcaccaccagcagagccggccaccuggccggccccgagcccgcccccccccccccccccccccccagagagcccuucgcccccagccugggcagcgccuuccaccugcccgacgccccccccgccgccgccgccgccgcccuguacuacagcagcagcacccugcccgccccccccagaggcggcagcccccuggccgccccccagggcggcagccccaccaagcugcagagaggcggcagcgcccccgagggcgccaccuacgccgcccccagaggcagcagccccaagcagagccccagcagacuggccaagagcuacagcaccagcagccccaucaacaucguggugagcagcgccggccugagccccaucagagugaccagcccccccaccgugcagagcaccaucagcagcagccccauccaccagcugagcagcaccaucggcaccuacgccacccugagccccaccaagagacuggugcacgccagcgagcaguacagcaagcacagccaggagcuguacgccaccgccacccugcagagacccggcagccuggccgccggcagcagagccagcuacagcagccagcacggccaccugggccccgagcugagagcccugcagagccccgagcaccacaucgaccccaucuacgaggacagaguguaccagaagccccccaugagaagccugagccagagccagggcgacccccugccccccgcccacaccggcaccuacagaaccagcaccgcccccagcagccccggcguggacagcgugccccugcagagaaccggcagccagcacggcccccagaacgccgccgccgccaccuuccagagagccagcuacgccgccggccccgccagcaacuacgccgaccccuacagacagcugcaguacugccccagcguggagagccccuacagcaagagcggccccgcccugccccccgagggcacccuggccagaagccccagcaucgacagcauccagaaggaccccagagaguucggcuggagagaccccgagcugcccgaggugauccagaugcugcagcaccaguuccccagcgugcagagcaacgccgccgccuaccugcagcaccugugcuucggcgacaacaagaucaaggccgagaucagaagacagggcggcauccagcugcugguggaccugcuggaccacagaaugaccgaggugcacagaagcgccugcggcgcccugagaaaccugguguacggcaaggccaacgacgacaacaagaucgcccugaagaacugcggcggcauccccgcccuggugagacugcugagaaagaccaccgaccuggagaucagagagcuggugaccggcgugcuguggaaccugagcagcugcgacgcccugaagaugcccaucauccaggacgcccuggccgugcugaccaacgccgugaucaucccccacagcggcugggagaacagcccccugcaggacgacagaaagauccagcugcacagcagccaggugcugagaaacgccaccggcugccugagaaacgugagcagcgccggcgaggaggccagaagaagaaugagagagugcgacggccugaccgacgcccugcuguacgugauccagagcgcccugggcagcagcgagaucgacagcaagaccguggagaacugcgugugcauccugagaaaccugagcuacagacuggccgccgagaccagccagggccagcacaugggcaccgacgagcuggacggccugcugugcggcgaggccaacggcaaggacgccgagagcagcggcugcuggggcaagaagaagaagaagaagaagagccaggaccagugggacggcgugggcccccugcccgacugcgccgagccccccaagggcauccagaugcuguggcaccccagcaucgugaagcccuaccugacccugcugagcgagugcagcaaccccgacacccuggagggcgccgccggcgcccugcagaaccuggccgccggcagcuggaaguggagcguguacaucagagccgccgugagaaaggagaagggccugcccauccugguggagcugcugagaaucgacaacgacagaguggugugcgccguggccaccgcccugagaaacauggcccuggacgugagaaacaaggagcugaucggcaaguacgccaugagagaccuggugcacagacugcccggcggcaacaacagcaacaacaccgccagcaaggccaugagcgacgacaccgugaccgccgugugcugcacccugcacgaggugaucaccaagaacauggagaacgccaaggcccugagagacgccggcggcaucgagaagcuggugggcaucagcaagagcaagggcgacaagcacagccccaagguggugaaggccgccagccaggugcugaacagcauguggcaguacagagaccugagaagccuguacaagaaggacggcuggagccaguaccacuucguggccagcagcagcaccaucgagagagacagacagagacccuacagcagcagcagaacccccagcaucagccccgugagagugagccccaacaacagaagcgccagcgcccccgccagccccagagagaugaucagccugaaggagagaaagaccgacuacgagugcaccggcagcaacgccaccuaccacggcgccaagggcgagcacaccagcagaaaggacgccaugaccgcccagaacaccggcaucagcacccuguacagaaacagcuacggcgcccccgccgaggacaucaagcacaaccaggugagcgcccagcccgugccccaggagcccagcagaaaggacuacgagaccuaccagcccuuccagaacagcaccagaaacuacgacgagagcuucuucgaggaccaggugcaccacagaccccccgccagcgaguacaccaugcaccugggccugaagagcaccggcaacuacguggacuucuacagcgccgccagacccuacagcgagcugaacuacgagaccagccacuaccccgccagccccgacagcuggguguaa

SEQ ID NO: 15765 - RNA, 1203 nt, Artificial Sequence
  CTNS__Homo_sapiens__NP_001026851
augaucagaaacuggcugaccaucuucauccuguucccccugaagcugguggagaagugcgagagcagcgugagccugaccgugccccccguggugaagcuggagaacggcagcagcaccaacgugagccugacccugagacccccccugaacgccacccuggugaucaccuucgagaucaccuucagaagcaagaacaucaccauccuggagcugcccgacgaggugguggugccccccggcgugaccaacagcagcuuccaggugaccagccagaacgugggccagcugaccguguaccugcacggcaaccacagcaaccagaccggccccagaaucagauuccuggugaucagaagcagcgccaucagcaucaucaaccaggugaucggcuggaucuacuucguggccuggagcaucagcuucuacccccaggugaucaugaacuggagaagaaagagcgugaucggccugagcuucgacuucguggcccugaaccugaccggcuucguggccuacagcguguucaacaucggccugcugugggugcccuacaucaaggagcaguuccugcugaaguaccccaacggcgugaaccccgugaacagcaacgacguguucuucagccugcacgccguggugcugacccugaucaucaucgugcagugcugccuguacgagagaggcggccagagagugagcuggcccgccaucggcuuccuggugcuggccuggcuguucgccuucgugaccaugaucguggccgccgugggcgugaccaccuggcugcaguuccuguucugcuucagcuacaucaagcuggccgugacccuggugaaguacuucccccaggccuacaugaacuucuacuacaagagcaccgagggcuggagcaucggcaacgugcugcuggacuucaccggcggcagcuucagccugcugcagauguuccugcagagcuacaacaacgaccaguggacccugaucuucggcgaccccaccaaguucggccugggcguguucagcaucguguucgacgugguguucuucauccagcacuucugccuguacagaaagagacccggccugcaggccgccagaaccggcagcggcagcagacugagacaggacugggcccccagccugcagcccaaggcccugccccagaccaccagcgugagcgccagcagccugaagggcuaa

SEQ ID NO: 15766 - RNA, 1308 nt, Artificial Sequence
  CTPS1__Homo_sapiens__NP_001288166
augcccuucaucgaggccuucagacaguuccaguucaaggugaagagagagaacuucugcaacauccacgugagccuggugccccagcccagcagcaccggcgagcagaagaccaagcccacccagaacagcgugagagagcugagaggccugggccugagccccgaccugguggugugcagaugcagcaacccccuggacaccagcgugaaggagaagaucagcauguucugccacguggagcccgagcaggugaucugcgugcacgacgugagcagcaucuacagagugccccugcugcuggaggagcagggcgugguggacuacuuccugagaagacuggaccugcccaucgagagacagcccagaaagaugcugaugaaguggaaggagauggccgacagauacgacagacugcuggagaccugcagcaucgcccuggugggcaaguacaccaaguucagcgacagcuacgccagcgugaucaaggcccuggagcacagcgcccuggccaucaaccacaagcuggagaucaaguacaucgacagcgccgaccuggagcccaucaccagccaggaggagcccgugagauaccacgaggccuggcagaagcugugcagcgcccacggcgugcuggugcccggcggcuucggcgugagaggcaccgagggcaagauccaggccaucgccugggccagaaaccagaagaagcccuuccugggcgugugccugggcaugcagcuggccgugguggaguucagcagaaacgugcugggcuggcaggacgccaacagcaccgaguucgaccccaccaccagccaccccguggugguggacaugcccgagcacaaccccggccagaugggcggcaccaugagacugggcaagagaagaacccuguuccagaccaagaacagcgugaugagaaagcuguacggcgacgccgacuaccuggaggagagacacagacacagauucgaggugaaccccguguggaagaagugccuggaggagcagggccugaaguucgugggccaggacguggagggcgagagaauggagaucguggagcuggaggaccaccccuucuucgugggcgugcaguaccaccccgaguuccugagcagacccaucaagcccagcccccccuacuucggccugcugcuggccagcgugggcagacugagccacuaccugcagaagggcugcagacugagccccagagacaccuacagcgacagaagcggcagcagcagccccgacagcgagaucaccgagcugaaguuccccagcaucaaccacgacuaa

SEQ ID NO: 15767 - RNA, 3522 nt, Artificial Sequence
  CTR9__Homo_sapiens__NP_055448
augagcagaggcagcaucgagaucccccugagagacaccgacgaggugaucgagcuggacuucgaccagcugcccgagggcgacgaggugaucagcauccugaagcaggagcacacccagcugcacaucuggaucgcccuggcccuggaguacuacaagcagggcaagaccgaggaguucgugaagcugcuggaggccgccagaaucgacggcaaccuggacuacagagaccacgagaaggaccagaugaccugccuggacacccuggccgccuacuacgugcagcaggccagaaaggagaagaacaaggacaacaagaaggaccugaucacccaggccacccugcuguacaccauggccgacaagaucaucauguacgaccagaaccaccugcugggcagagccugcuucugccugcuggagggcgacaagauggaccaggccgacgcccaguuccacuucgugcugaaccagagccccaacaacauccccgcccugcugggcaaggccugcaucagcuucaacaagaaggacuacagaggcgcccuggccuacuacaagaaggcccugagaaccaaccccggcugccccgccgaggugagacugggcaugggccacugcuucgugaagcugaacaagcuggagaaggccagacuggccuucagcagagcccuggagcugaacagcaagugcgugggcgcccuggugggccuggccgugcuggagcugaacaacaaggaggccgacagcaucaagaacggcgugcagcugcugagcagagccuacaccaucgaccccagcaaccccauggugcugaaccaccuggccaaccacuucuucuucaagaaggacuacagcaaggugcagcaccuggcccugcacgccuuccacaacaccgagguggaggccaugcaggccgagagcugcuaccagcuggccagaagcuuccacgugcaggaggacuacgaccaggccuuccaguacuacuaccaggccacccaguucgccagcagcagcuucgugcugcccuucuucggccugggccagauguacaucuacagaggcgacaaggagaacgccagccagugcuucgagaaggugcugaaggccuaccccaacaacuacgagaccaugaagauccugggcagccuguacgccgccagcgaggaccaggagaagagagacaucgccaagggccaccugaagaaggugaccgagcaguaccccgacgacguggaggccuggaucgagcuggcccagauccuggagcagaccgacauccagggcgcccugagcgccuacggcaccgccaccagaauccugcaggagaaggugcaggccgacgugccccccgagauccugaacaacgugggcgcccugcacuucagacugggcaaccugggcgaggccaagaaguacuuccuggccagccuggacagagccaaggccgaggccgagcacgacgagcacuacuacaacgccaucagcgugaccaccagcuacaaccuggccagacuguacgaggccaugugcgaguuccacgaggccgagaagcuguacaagaacauccugagagagcaccccaacuacguggacugcuaccugagacugggcgccauggccagagacaagggcaacuucuacgaggccagcgacugguucaaggaggcccugcagaucaaccaggaccaccccgacgccuggagccugaucggcaaccugcaccuggccaagcaggaguggggccccggccagaagaaguucgagagaauccugaagcagcccagcacccagagcgacaccuacagcaugcuggcccugggcaacguguggcugcagacccugcaccagcccaccagagacagagagaaggagaagagacaccaggacagagcccuggccaucuacaagcaggugcugagaaacgacgccaagaaccuguacgccgccaacggcaucggcgccgugcuggcccacaagggcuacuucagagaggccagagacguguucgcccaggugagagaggccaccgccgacaucagcgacguguggcugaaccuggcccacaucuacguggagcagaagcaguacaucagcgccgugcagauguacgagaacugccugagaaaguucuacaagcaccagaacaccgagguggugcuguaccuggccagagcccuguucaagugcggcaagcugcaggagugcaagcagacccugcugaaggccagacacguggcccccagcgacaccgugcugauguucaacguggcccuggugcugcagagacuggccaccagcgugcugaaggacgagaagagcaaccugaaggaggugcugaacgccgugaaggagcuggagcuggcccacagauacuucagcuaccugagcaaggugggcgacaagaugagauucgaccuggcccuggccgccaccgaggccagacagugcagcgaccugcugagccaggcccaguaccacguggccagagccagaaagcaggacgaggaggagagagagcugagagccaagcaggagcaggagaaggagcugcugagacagaagcugcugaaggagcaggaggagaagagacugagagagaaggaggagcagaagaagcugcuggagcagagagcccaguacguggagaagaccaagaacauccugauguucaccggcgagaccgaggccaccaaggagaagaagagaggcggcggcggcggcagaagaagcaagaagggcggcgaguucgacgaguucgugaacgacgacaccgacgacgaccugcccaucagcaagaagaagaagagaagaaagggcagcggcagcgagcaggagggcgaggacgaggagggcggcgagagaaagaagaagaagagaagaagacaccccaagggcgaggagggcagcgacgacgacgagaccgagaacggccccaagcccaagaagagaagaccccccaaggccgagaagaagaaggcccccaagcccgagagacugccccccagcaugaagggcaagaucaagagcaaggccaucaucagcagcagcgacgacagcagcgacgaggacaagcugaagaucgccgacgagggccaccccagaaacagcaacagcaacagcgacagcgacgaggacgagcagagaaagaagugcgccagcagcgagagcgacagcgacgagaaccagaacaagagcggcagcgaggccggcagccccagaagacccagaagacagagaagcgaccaggacagcgacagcgaccagcccagcagaaagagaagacccagcggcagcgagcagagcgacaacgagagcgugcagagcggcagaagccacagcggcgugagcgagaacgacagcagacccgccagccccagcgccgagagcgaccacgagagcgagagaggcagcgacaacgagggcagcggccagggcagcggcaacgagagcgagcccgagggcagcaacaacgaggccagcgacagaggcagcgagcacggcagcgacgacagcgacuaa

SEQ ID NO: 15768 - RNA, 792 nt, Artificial Sequence
  CTRB1__Homo_sapiens__NP_001897
auggccagccuguggcugcugagcugcuucagccuggugggcgccgccuucggcugcggcgugcccgccauccaccccgugcugagcggccugagcagaaucgugaacggcgaggacgccgugcccggcagcuggcccuggcaggugagccugcaggacaagaccggcuuccacuucugcggcggcagccugaucagcgaggacuggguggugaccgccgcccacugcggcgugagaaccagcgacguggugguggccggcgaguucgaccagggcagcgacgaggagaacauccaggugcugaagaucgccaagguguucaagaaccccaaguucagcauccugaccgugaacaacgacaucacccugcugaagcuggccacccccgccagauucagccagaccgugagcgccgugugccugcccagcgccgacgacgacuuccccgccggcacccugugcgccaccaccggcuggggcaagaccaaguacaacgccaacaagacccccgacaagcugcagcaggccgcccugccccugcugagcaacgccgagugcaagaagagcuggggcagaagaaucaccgacgugaugaucugcgccggcgccagcggcgugagcagcugcaugggcgacagcggcggcccccuggugugccagaaggacggcgccuggacccuggugggcaucgugagcuggggcagcgacaccugcagcaccagcagccccggcguguacgccagagugaccaagcugauccccugggugcagaagauccuggccgccaacuaa

SEQ ID NO: 15769 - RNA, 792 nt, Artificial Sequence
  CTRB2__Homo_sapiens__NP_001020371
auggccuuccuguggcugcugagcugcugggcccugcugggcaccaccuucggcugcggcgugcccgccauccaccccgugcugagcggccugagcagaaucgugaacggcgaggacgccgugcccggcagcuggcccuggcaggugagccugcaggacaagaccggcuuccacuucugcggcggcagccugaucagcgaggacuggguggugaccgccgcccacugcggcgugagaaccagcgacguggugguggccggcgaguucgaccagggcagcgacgaggagaacauccaggugcugaagaucgccaagguguucaagaaccccaaguucagcauccugaccgugaacaacgacaucacccugcugaagcuggccacccccgccagauucagccagaccgugagcgccgugugccugcccagcgccgacgacgacuuccccgccggcacccugugcgccaccaccggcuggggcaagaccaaguacaacgccaacaagacccccgacaagcugcagcaggccgcccugccccugcugagcaacgccgagugcaagaagagcuggggcagaagaaucaccgacgugaugaucugcgccggcgccagcggcgugagcagcugcaugggcgacagcggcggcccccuggugugccagaaggacggcgccuggacccuggugggcaucgugagcuggggcagcagaaccugcagcaccaccacccccgccguguacgccagaguggccaagcugauccccugggugcagaagauccuggccgccaacuaa

SEQ ID NO: 15770 - RNA, 843 nt, Artificial Sequence
  CTRC__Homo_sapiens__XP_011538852
augcugggcaucaccgugcuggccgcccugcuggccugcgccagcagcugcggcgugcccagcuucccccccaaccugagcgccagaguggugggcggcgaggacgccagaccccacagcuggcccuggcagaucagccugcaguaccugaagaacgacaccuggagacacaccugcggcggcacccugaucgccagcaacuucgugcugaccgccgcccacugcaucagcaacaccagaaccuacagaguggccgugggcaagaacaaccuggagguggaggacgaggagggcagccuguucgugggcguggacaccauccacgugcacaagagauggaacgcccugcugcugagaaacgacaucgcccugaucaagcuggccgagcacguggagcugagcgacaccauccagguggccugccugcccgagaaggacagccugcugcccaaggacuaccccugcuacgugaccggcuggggcagacuguggagaggccugagauggcccaccgagcugcccgugggcgagagauuccugggcggcguguggcacagacagcuguggcugcccgccggccugcagcacccccaggaggccggcagccugcaccccggcgugagacugcacagacuggaccagagagagaacgccgccgugaucugcugcugggagagaagacagagagugcccgccaccgccaucaacuuccugcugcugggcccccccggcagccugaucugcgccgccagcguggccagccugcugagcggcgccgcccccuuccacaccauggagcccaagagagaccccacccagcccgugagccccacccugcacuaa

SEQ ID NO: 15771 - RNA, 795 nt, Artificial Sequence
  CTRL__Homo_sapiens__NP_001898
augcugcugcugagccugacccugagccuggugcugcugggcagcagcuggggcugcggcauccccgccaucaagcccgcccugagcuucagccagagaaucgugaacggcgagaacgccgugcugggcagcuggcccuggcaggugagccugcaggacagcagcggcuuccacuucugcggcggcagccugaucagccagagcuggguggugaccgccgcccacugcaacgugagccccggcagacacuucguggugcugggcgaguacgacagaagcagcaacgccgagccccugcaggugcugagcgugagcagagccaucacccaccccagcuggaacagcaccaccaugaacaacgacgugacccugcugaagcuggccagccccgcccaguacaccaccagaaucagccccgugugccuggccagcagcaacgaggcccugaccgagggccugaccugcgugaccaccggcuggggcagacugagcggcgugggcaacgugacccccgcccaccugcagcagguggcccugccccuggugaccgugaaccagugcagacaguacuggggcagcagcaucaccgacagcaugaucugcgccggcggcgccggcgccagcagcugccagggcgacagcggcggcccccuggugugccagaagggcaacaccugggugcugaucggcaucgugagcuggggcaccaagaacugcaacgugagagcccccgccguguacaccagagugagcaaguucagcaccuggaucaaccaggugaucgccuacaacuaa

SEQ ID NO: 15772 - RNA, 1497 nt, Artificial Sequence
  CTSA__Homo_sapiens__NP_000299
augaccagcagccccagagccccccccggcgagcagggcagaggcggcgccgagaugaucagagccgccccccccccccuguuccugcugcugcugcugcugcugcugcuggugagcugggccagcagaggcgaggccgcccccgaccaggacgagauccagagacugcccggccuggccaagcagcccagcuucagacaguacagcggcuaccugaagggcagcggcagcaagcaccugcacuacugguucguggagagccagaaggaccccgagaacagccccguggugcuguggcugaacggcggccccggcugcagcagccuggacggccugcugaccgagcacggccccuuccuggugcagcccgacggcgugacccuggaguacaaccccuacagcuggaaccugaucgccaacgugcuguaccuggagagccccgccggcgugggcuucagcuacagcgacgacaaguucuacgccaccaacgacaccgagguggcccagagcaacuucgaggcccugcaggacuucuucagacuguuccccgaguacaagaacaacaagcuguuccugaccggcgagagcuacgccggcaucuacauccccacccuggccgugcuggugaugcaggaccccagcaugaaccugcagggccuggccgugggcaacggccugagcagcuacgagcagaacgacaacagccugguguacuucgccuacuaccacggccugcugggcaacagacuguggagcagccugcagacccacugcugcagccagaacaagugcaacuucuacgacaacaaggaccuggagugcgugaccaaccugcaggagguggccagaaucgugggcaacagcggccugaacaucuacaaccuguacgcccccugcgccggcggcgugcccagccacuucagauacgagaaggacaccgugguggugcaggaccugggcaacaucuucaccagacugccccugaagagaauguggcaccaggcccugcugagaagcggcgacaaggugagaauggacccccccugcaccaacaccaccgccgccagcaccuaccugaacaaccccuacgugagaaaggcccugaacauccccgagcagcugccccagugggacaugugcaacuuccuggugaaccugcaguacagaagacuguacagaagcaugaacagccaguaccugaagcugcugagcagccagaaguaccagauccugcuguacaacggcgacguggacauggccugcaacuucaugggcgacgagugguucguggacagccugaaccagaagauggaggugcagagaagacccuggcuggugaaguacggcgacagcggcgagcagaucgccggcuucgugaaggaguucagccacaucgccuuccugaccaucaagggcgccggccacauggugcccaccgacaagccccuggccgccuucaccauguucagcagauuccugaacaagcagcccuacuaa

SEQ ID NO: 15773 - RNA, 1020 nt, Artificial Sequence
  CTSB__Homo_sapiens__NP_680093
auguggcagcugugggccagccugugcugccugcuggugcuggccaacgccagaagcagacccagcuuccacccccugagcgacgagcuggugaacuacgugaacaagagaaacaccaccuggcaggccggccacaacuucuacaacguggacaugagcuaccugaagagacugugcggcaccuuccugggcggccccaagcccccccagagagugauguucaccgaggaccugaagcugcccgccagcuucgacgccagagagcaguggccccagugccccaccaucaaggagaucagagaccagggcagcugcggcagcugcugggccuucggcgccguggaggccaucagcgacagaaucugcauccacaccaacgcccacgugagcguggaggugagcgccgaggaccugcugaccugcugcggcagcaugugcggcgacggcugcaacggcggcuaccccgccgaggccuggaacuucuggaccagaaagggccuggugagcggcggccuguacgagagccacgugggcugcagacccuacagcaucccccccugcgagcaccacgugaacggcagcagaccccccugcaccggcgagggcgacacccccaagugcagcaagaucugcgagcccggcuacagccccaccuacaagcaggacaagcacuacggcuacaacagcuacagcgugagcaacagcgagaaggacaucauggccgagaucuacaagaacggccccguggagggcgccuucagcguguacagcgacuuccugcuguacaagagcggcguguaccagcacgugaccggcgagaugaugggcggccacgccaucagaauccugggcuggggcguggagaacggcacccccuacuggcugguggccaacagcuggaacaccgacuggggcgacaacggcuucuucaagauccugagaggccaggaccacugcggcaucgagagcgaggugguggccggcauccccagaaccgaccaguacugggagaagaucuaa

SEQ ID NO: 15774 - RNA, 426 nt, Artificial Sequence
  CTSC__Homo_sapiens__NP_001107645
augggcgccggccccagccugcugcuggccgcccugcugcugcugcugagcggcgacggcgccgugagaugcgacacccccgccaacugcaccuaccuggaccugcugggcaccuggguguuccaggugggcagcagcggcagccagagagacgugaacugcagcgugaugggcccccaggagaagaagguggugguguaccugcagaagcuggacaccgccuacgacgaccugggcaacagcggccacuucaccaucaucuacaaccagggcuucgagaucgugcugaacgacuacaagugguucgccuucuucaaggacgugaccgacuucaucagccaccuguucaugcagcugggcaccgugggcaucuacgaccugccccaccugagaaacaagcuggccaugaacagaagauggggcuaa

SEQ ID NO: 15775 - RNA, 1239 nt, Artificial Sequence
  CTSD__Homo_sapiens__NP_001900
augcagcccagcagccugcugccccuggcccugugccugcuggccgcccccgccagcgcccuggugagaaucccccugcacaaguucaccagcaucagaagaaccaugagcgaggugggcggcagcguggaggaccugaucgccaagggccccgugagcaaguacagccaggccgugcccgccgugaccgagggccccauccccgaggugcugaagaacuacauggacgcccaguacuacggcgagaucggcaucggcacccccccccagugcuucaccgugguguucgacaccggcagcagcaaccugugggugcccagcauccacugcaagcugcuggacaucgccugcuggauccaccacaaguacaacagcgacaagagcagcaccuacgugaagaacggcaccagcuucgacauccacuacggcagcggcagccugagcggcuaccugagccaggacaccgugagcgugcccugccagagcgccagcagcgccagcgcccugggcggcgugaagguggagagacagguguucggcgaggccaccaagcagcccggcaucaccuucaucgccgccaaguucgacggcauccugggcauggccuaccccagaaucagcgugaacaacgugcugcccguguucgacaaccugaugcagcagaagcugguggaccagaacaucuucagcuucuaccugagcagagaccccgacgcccagcccggcggcgagcugaugcugggcggcaccgacagcaaguacuacaagggcagccugagcuaccugaacgugaccagaaaggccuacuggcaggugcaccuggaccagguggagguggccagcggccugacccugugcaaggagggcugcgaggccaucguggacaccggcaccagccugauggugggccccguggacgaggugagagagcugcagaaggccaucggcgccgugccccugauccagggcgaguacaugauccccugcgagaaggugagcacccugcccgccaucacccugaagcugggcggcaagggcuacaagcugagccccgaggacuacacccugaaggugagccaggccggcaagacccugugccugagcggcuucaugggcauggacauccccccccccagcggcccccuguggauccugggcgacguguucaucggcagauacuacaccguguucgacagagacaacaacagagugggcuucgccgaggccgccagacuguaa

SEQ ID NO: 15776 - RNA, 1191 nt, Artificial Sequence
  CTSE__Homo_sapiens__NP_001901
augaagacccugcugcugcugcugcuggugcugcuggagcugggcgaggcccagggcagccugcacagagugccccugagaagacaccccagccugaagaagaagcugagagccagaagccagcugagcgaguucuggaagagccacaaccuggacaugauccaguucaccgagagcugcagcauggaccagagcgccaaggagccccugaucaacuaccuggacauggaguacuucggcaccaucagcaucggcagccccccccagaacuucaccgugaucuucgacaccggcagcagcaaccugugggugcccagcguguacugcaccagccccgccugcaagacccacagcagauuccagcccagccagagcagcaccuacagccagcccggccagagcuucagcauccaguacggcaccggcagccugagcggcaucaucggcgccgaccaggugagcguggagggccugaccguggugggccagcaguucggcgagagcgugaccgagcccggccagaccuucguggacgccgaguucgacggcauccugggccugggcuaccccagccuggccgugggcggcgugacccccguguucgacaacaugauggcccagaaccugguggaccugcccauguucagcguguacaugagcagcaaccccgagggcggcgccggcagcgagcugaucuucggcggcuacgaccacagccacuucagcggcagccugaacugggugcccgugaccaagcaggccuacuggcagaucgcccuggacaacauccaggugggcggcaccgugauguucugcagcgagggcugccaggccaucguggacaccggcaccagccugaucaccggccccagcgacaagaucaagcagcugcagaacgccaucggcgccgcccccguggacggcgaguacgccguggagugcgccaaccugaacgugaugcccgacgugaccuucaccaucaacggcgugcccuacacccugagccccaccgccuacacccugcuggacuucguggacggcaugcaguucugcagcagcggcuuccagggccuggacauccacccccccgccggcccccuguggauccugggcgacguguucaucagacaguucuacagcguguucgacagaggcaacaacagagugggccuggcccccgccgugcccuaa

SEQ ID NO: 15777 - RNA, 1455 nt, Artificial Sequence
  CTSF__Homo_sapiens__NP_003784
auggcccccuggcugcagcugcugagccugcugggccugcugcccggcgccguggccgcccccgcccagcccagagccgccagcuuccaggccuggggcccccccagccccgagcugcuggcccccaccagauucgcccuggagauguucaacagaggcagagccgccggcaccagagccgugcugggccuggugagaggcagagugagaagagccggccagggcagccuguacagccuggaggccacccuggaggagccccccugcaacgaccccauggugugcagacugcccgugagcaagaagacccugcugugcagcuuccaggugcuggacgagcugggcagacacgugcugcugagaaaggacugcggccccguggacaccaaggugcccggcgccggcgagcccaagagcgccuucacccagggcagcgccaugaucagcagccugagccagaaccaccccgacaacagaaacgagaccuucagcagcgugaucagccugcugaacgaggacccccugagccaggaccugcccgugaagauggccagcaucuucaagaacuucgugaucaccuacaacagaaccuacgagagcaaggaggaggccagauggagacugagcguguucgugaacaacauggugagagcccagaagauccaggcccuggacagaggcaccgcccaguacggcgugaccaaguucagcgaccugaccgaggaggaguucagaaccaucuaccugaacacccugcugagaaaggagcccggcaacaagaugaagcaggccaagagcgugggcgaccuggccccccccgagugggacuggagaagcaagggcgccgugaccaaggugaaggaccagggcaugugcggcagcugcugggccuucagcgugaccggcaacguggagggccagugguuccugaaccagggcacccugcugagccugagcgagcaggagcugcuggacugcgacaagauggacaaggccugcaugggcggccugcccagcaacgccuacagcgccaucaagaaccugggcggccuggagaccgaggacgacuacagcuaccagggccacaugcagagcugcaacuucagcgccgagaaggccaagguguacaucaacgacagcguggagcugagccagaacgagcagaagcuggccgccuggcuggccaagagaggccccaucagcguggccaucaacgccuucggcaugcaguucuacagacacggcaucagcagaccccugagaccccugugcagccccuggcugaucgaccacgccgugcugcuggugggcuacggcaacagaagcgacgugcccuucugggccaucaagaacagcuggggcaccgacuggggcgagaagggcuacuacuaccugcacagaggcagcggcgccugcggcgugaacaccauggccagcagcgccgugguggacuaa

SEQ ID NO: 15778 - RNA, 768 nt, Artificial Sequence
  CTSG__Homo_sapiens__NP_001902
augcagccccugcugcugcugcuggccuuccugcugcccaccggcgccgaggccggcgagaucaucggcggcagagagagcagaccccacagcagacccuacauggccuaccugcagauccagagccccgccggccagagcagaugcggcggcuuccuggugagagaggacuucgugcugaccgccgcccacugcuggggcagcaacaucaacgugacccugggcgcccacaacauccagagaagagagaacacccagcagcacaucaccgccagaagagccaucagacacccccaguacaaccagagaaccauccagaacgacaucaugcugcugcagcugagcagaagagugagaagaaacagaaacgugaaccccguggcccugcccagagcccaggagggccugagacccggcacccugugcaccguggccggcuggggcagagugagcaugagaagaggcaccgacacccugagagaggugcagcugagagugcagagagacagacagugccugagaaucuucggcagcuacgaccccagaagacagaucugcgugggcgacagaagagagagaaaggccgccuucaagggcgacagcggcggcccccugcugugcaacaacguggcccacggcaucgugagcuacggcaagagcagcggcgugccccccgagguguucaccagagugagcagcuuccugcccuggaucagaaccaccaugagaagcuucaagcugcuggaccagauggagaccccccuguaa

SEQ ID NO: 15779 - RNA, 1008 nt, Artificial Sequence
  CTSH__Homo_sapiens__NP_004381
augugggccacccugccccugcugugcgccggcgccuggcugcugggcgugcccgugugcggcgccgccgagcugugcgugaacagccuggagaaguuccacuucaagagcuggaugagcaagcacagaaagaccuacagcaccgaggaguaccaccacagacugcagaccuucgccagcaacuggagaaagaucaacgcccacaacaacggcaaccacaccuucaagauggcccugaaccaguucagcgacaugagcuucgccgagaucaagcacaaguaccuguggagcgagccccagaacugcagcgccaccaagagcaacuaccugagaggcaccggccccuacccccccagcguggacuggagaaagaagggcaacuucgugagccccgugaagaaccagggcgccugcggcagcugcuggaccuucagcaccaccggcgcccuggagagcgccaucgccaucgccaccggcaagaugcugagccuggccgagcagcagcugguggacugcgcccaggacuucaacaaccacggcugccagggcggccugcccagccaggccuucgaguacauccuguacaacaagggcaucaugggcgaggacaccuaccccuaccagggcaaggacggcuacugcaaguuccagcccggcaaggccaucggcuucgugaaggacguggccaacaucaccaucuacgacgaggaggccaugguggaggccguggcccuguacaaccccgugagcuucgccuucgaggugacccaggacuucaugauguacagaaccggcaucuacagcagcaccagcugccacaagacccccgacaaggugaaccacgccgugcuggccgugggcuacggcgagaagaacggcauccccuacuggaucgugaagaacagcuggggcccccaguggggcaugaacggcuacuuccugaucgagagaggcaagaacaugugcggccuggccgccugcgccagcuaccccaucccccugguguaa

SEQ ID NO: 15780 - RNA, 1002 nt, Artificial Sequence
  CTSL__Homo_sapiens__XP_005251773
augaaccccacccugauccuggccgccuucugccugggcaucgccagcgccacccugaccuucgaccacagccuggaggcccaguggaccaaguggaaggccaugcacaacagacuguacggcaugaacgaggagggcuggagaagagccgugugggagaagaacaugaagaugaucgagcugcacaaccaggaguacagagagggcaagcacagcuucaccauggccaugaacgccuucggcgacaugaccagcgaggaguucagacaggugaugaacggcuuccagaacagaaagcccagaaagggcaagguguuccaggagccccuguucuacgaggcccccagaagcguggacuggagagagaagggcuacgugacccccgugaagaaccagggccagugcggcagcugcugggccuucagcgccaccggcgcccuggagggccagauguucagaaagaccggcagacugaucagccugagcgagcagaaccugguggacugcagcggcccccagggcaacgagggcugcaacggcggccugauggacuacgccuuccaguacgugcaggacaacggcggccuggacagcgaggagagcuaccccuacgaggccaccgaggagagcugcaaguacaaccccaaguacagcguggccaacgacaccggcuucguggacauccccaagcaggagaaggcccugaugaaggccguggccaccgugggccccaucagcguggccaucgacgccggccacgagagcuuccuguucuacaaggagggcaucuacuucgagcccgacugcagcagcgaggacauggaccacggcgugcugguggugggcuacggcuucgagagcaccgagagcgacaacaacaaguacuggcuggugaagaacagcuggggcgaggaguggggcaugggcggcuacgugaagauggccaaggacagaagaaaccacugcggcaucgccagcgccgccagcuaccccaccguguaa

SEQ ID NO: 15781 - RNA, 966 nt, Artificial Sequence
  CTSO__Homo_sapiens__NP_001325
auggacgugagagcccugcccuggcugcccuggcugcuguggcugcugugcagaggcggcggcgacgccgacagcagagcccccuucacccccaccuggcccagaagcagagagagagaggccgccgccuucagagagagccugaacagacacagauaccugaacagccuguuccccagcgagaacagcaccgccuucuacggcaucaaccaguucagcuaccuguuccccgaggaguucaaggccaucuaccugagaagcaagcccagcaaguuccccagauacagcgccgaggugcacaugagcauccccaacgugagccugccccugagauucgacuggagagacaagcagguggugacccaggugagaaaccagcagaugugcggcggcugcugggccuucagcguggugggcgccguggagagcgccuacgccaucaagggcaagccccuggaggaccugagcgugcagcaggugaucgacugcagcuacaacaacuacggcugcaacggcggcagcacccugaacgcccugaacuggcugaacaagaugcaggugaagcuggugaaggacagcgaguaccccuucaaggcccagaacggccugugccacuacuucagcggcagccacagcggcuucagcaucaagggcuacagcgccuacgacuucagcgaccaggaggacgagauggccaaggcccugcugaccuucggcccccugguggugaucguggacgccgugagcuggcaggacuaccugggcggcaucauccagcaccacugcagcagcggcgaggccaaccacgccgugcugaucaccggcuucgacaagaccggcagcacccccuacuggaucgugagaaacagcuggggcagcagcuggggcguggacggcuacgcccacgugaagaugggcagcaacgugugcggcaucgccgacagcgugagcagcaucuucguguaa

SEQ ID NO: 15782 - RNA, 1005 nt, Artificial Sequence
  CTSV__Homo_sapiens__NP_001188504
augaaccugagccuggugcuggccgccuucugccugggcaucgccagcgccgugcccaaguucgaccagaaccuggacaccaagugguaccaguggaaggccacccacagaagacuguacggcgccaacgaggagggcuggagaagagccgugugggagaagaacaugaagaugaucgagcugcacaacggcgaguacagccagggcaagcacggcuucaccauggccaugaacgccuucggcgacaugaccaacgaggaguucagacagaugaugggcugcuucagaaaccagaaguucagaaagggcaagguguucagagagccccuguuccuggaccugcccaagagcguggacuggagaaagaagggcuacgugacccccgugaagaaccagaagcagugcggcagcugcugggccuucagcgccaccggcgcccuggagggccagauguucagaaagaccggcaagcuggugagccugagcgagcagaaccugguggacugcagcagaccccagggcaaccagggcugcaacggcggcuucauggccagagccuuccaguacgugaaggagaacggcggccuggacagcgaggagagcuaccccuacguggccguggacgagaucugcaaguacagacccgagaacagcguggccaacgacaccggcuucaccgugguggcccccggcaaggagaaggcccugaugaaggccguggccaccgugggccccaucagcguggccauggacgccggccacagcagcuuccaguucuacaagagcggcaucuacuucgagcccgacugcagcagcaagaaccuggaccacggcgugcugguggugggcuacggcuucgagggcgccaacagcaacaacagcaaguacuggcuggugaagaacagcuggggccccgaguggggcagcaacggcuacgugaagaucgccaaggacaagaacaaccacugcggcaucgccaccgccgccagcuaccccaacguguaa

SEQ ID NO: 15783 - RNA, 1131 nt, Artificial Sequence
  CTSW__Homo_sapiens__NP_001326
auggcccugaccgcccaccccagcugccugcuggcccugcugguggccggccuggcccagggcaucagaggcccccugagagcccaggaccugggcccccagccccuggagcugaaggaggccuucaagcuguuccagauccaguucaacagaagcuaccugagccccgaggagcacgcccacagacuggacaucuucgcccacaaccuggcccaggcccagagacugcaggaggaggaccugggcaccgccgaguucggcgugacccccuucagcgaccugaccgaggaggaguucggccagcuguacggcuacagaagagccgccggcggcgugcccagcaugggcagagagaucagaagcgaggagcccgaggagagcgugcccuucagcugcgacuggagaaagguggccggcgccaucagccccaucaaggaccagaagaacugcaacugcugcugggccauggccgccgccggcaacaucgagacccuguggagaaucagcuucugggacuucguggacgugagcgugcaggagcugcuggacugcggcagaugcggcgacggcugccacggcggcuucgugugggacgccuucaucaccgugcugaacaacagcggccuggccagcgagaaggacuaccccuuccagggcaaggugagagcccacagaugccaccccaagaaguaccagaagguggccuggauccaggacuucaucaugcugcagaacaacgagcacagaaucgcccaguaccuggccaccuacggccccaucaccgugaccaucaacaugaagccccugcagcuguacagaaagggcgugaucaaggccacccccaccaccugcgacccccagcugguggaccacagcgugcugcuggugggcuucggcagcgugaagagcgaggagggcaucugggccgagaccgugagcagccagagccagccccagcccccccaccccacccccuacuggauccugaagaacagcuggggcgcccaguggggcgagaagggcuacuucagacugcacagaggcagcaacaccugcggcaucaccaaguucccccugaccgccagagugcagaagcccgacaugaagcccagagugagcugcccccccuaa

SEQ ID NO: 15784 - RNA, 912 nt, Artificial Sequence
  CTSZ__Homo_sapiens__NP_001327
auggccagaagaggccccggcuggagaccccugcugcugcuggugcugcuggccggcgccgcccagggcggccuguacuucagaagaggccagaccugcuacagaccccugagaggcgacggccuggccccccugggcagaagcaccuaccccagaccccacgaguaccugagccccgccgaccugcccaagagcugggacuggagaaacguggacggcgugaacuacgccagcaucaccagaaaccagcacaucccccaguacugcggcagcugcugggcccacgccagcaccagcgccauggccgacagaaucaacaucaagagaaagggcgccuggcccagcacccugcugagcgugcagaacgugaucgacugcggcaacgccggcagcugcgagggcggcaacgaccugagcgugugggacuacgcccaccagcacggcauccccgacgagaccugcaacaacuaccaggccaaggaccaggagugcgacaaguucaaccagugcggcaccugcaacgaguucaaggagugccacgccaucagaaacuacacccuguggagagugggcgacuacggcagccugagcggcagagagaagaugauggccgagaucuacgccaacggccccaucagcugcggcaucauggccaccgagagacuggccaacuacaccggcggcaucuacgccgaguaccaggacaccaccuacaucaaccacguggugagcguggccggcuggggcaucagcgacggcaccgaguacuggaucgugagaaacagcuggggcgagcccuggggcgagagaggcuggcugagaaucgugaccagcaccuacaaggacggcaagggcgccagauacaaccuggccaucgaggagcacugcaccuucggcgaccccaucguguaa

SEQ ID NO: 15785 - RNA, 4992 nt, Artificial Sequence
  CTTNBP2__Homo_sapiens__NP_219499
auggccaccgacggcgccagcugcgagcccgaccugagcagagcccccgaggacgccgccggcgccgccgccgaggccgccaagaaggaguucgacguggacacccugagcaagagcgagcugagaaugcugcugagcgugauggagggcgagcuggaggccagagaccuggugaucgaggcccugagagccagaagaaaggagguguucauccaggagagauacggcagauucaaccugaacgaccccuuccuggcccugcagagagacuacgaggccggcgccggcgacaaggagaagaagcccgugugcaccaacccccugagcauccuggaggccgugauggcccacugcaagaagaugcaggagagaaugagcgcccagcuggccgccgccgagagcagacagaagaagcuggagauggagaagcugcagcugcaggcccuggagcaggagcacaagaagcuggccgccagacuggaggaggagagaggcaagaacaagcagguggugcugaugcuggugaaggagugcaagcagcugagcggcaaggugaucgaggaggcccagaagcuggaggacgugauggccaagcuggaggaggagaagaagaagaccaacgagcuggaggaggagcugagcgccgagaagagaagaagcaccgagauggaggcccagauggagaagcagcugagcgaguucgacaccgagagagagcagcugagagccaagcugaacagagaggaggcccacaccaccgaccugaaggaggagaucgacaagaugagaaagaugaucgagcagcugaagagaggcagcgacagcaagcccagccugagccugcccagaaagaccaaggacagaagacuggugagcaucagcgugggcaccgagggcaccgugaccagaagcguggccugccagaccgaccuggugaccgagaacgccgaccacaugaagaagcugccccugaccaugcccgugaagcccagcaccggcagcccccuggugagcgccaacgccaagggcagcgugugcaccagcgccaccauggccagacccggcaucgacagacaggccagcuacggcgaccugaucggcgccagcgugcccgccuuccccccccccagcgccaacaagaucgaggagaacggccccagcaccggcagcacccccgaccccaccagcagcacccccccccugcccagcaacgccgccccccccaccgcccagacccccggcaucgccccccagaacagccaggccccccccaugcacagccugcacagccccugcgccaacaccagccugcaccccggccugaaccccagaauccaggccgccagauucagauuccagggcaacgccaacgaccccgaccagaacggcaacaccacccagagcccccccagcagagacgugagccccaccagcagagacaaccugguggccaagcagcuggccagaaacaccgugacccaggcccugagcagauucaccagcccccaggccggcgcccccagcagacccggcgugccccccaccggcgacgugggcacccacccccccgugggcagaaccagccugaagacccacggcguggccagaguggacagaggcaaccccccccccaucccccccaagaagcccggccugagccagacccccagccccccccacccccagcugaaggugaucaucgacagcagcagagccagcaacaccggcgccaagguggacaacaagaccguggccagcacccccagcagccugccccagggcaacagagugaucaacgaggagaaccugcccaagagcagcagcccccagcugccccccaagcccagcaucgaccugaccguggcccccgccggcugcgccgugagcgcccuggccaccagccaggugggcgccuggcccgccgccacccccggccugaaccagcccgccugcagcgacagcagccuggugauccccaccaccaucgccuucugcagcagcaucaaccccgugagcgccagcagcugcagacccggcgccagcgacagccugcuggugaccgccagcggcuggagccccagccugaccccccugcugaugagcggcggccccgccccccuggccggcagacccacccugcugcagcaggccgccgcccagggcaacgugacccugcugagcaugcugcugaacgaggagggccuggacaucaacuacagcugcgaggacggccacagcgcccuguacagcgccgccaagaacggccacaccgacugcgugagacugcugcugagcgccgaggcccaggugaacgccgccgacaagaacggcuucaccccccugugcgccgccgccgcccagggccacuucgagugcguggagcugcugaucagcuacgacgccaacaucaaccacgccgccgacggcggccagaccccccuguaccuggccugcaagaacggcaacaaggagugcaucaagcugcugcuggaggccggcaccaacagaagcgugaagaccaccgacggcuggacccccgugcacgccgccguggacaccggcaacguggacagccugaagcugcugauguaccacagaauccccgcccacggcaacagcuucaacgaggaggagagcgagagcagcguguucgaccuggacggcggcgaggagagccccgagggcaucagcaagcccguggugcccgccgaccugaucaaccacgccaacagagagggcuggaccgccgcccacaucgccgccagcaagggcuucaagaacugccuggagauccugugcagacacggcggccuggagcccgagagaagagacaagugcaacagaaccgugcacgacguggccaccgacgacugcaagcaccugcuggagaaccugaacgcccugaagaucccccugagaaucagcgugggcgagaucgagcccagcaacuacggcagcgacgaccuggagugcgagaacaccaucugcgcccugaacaucagaaagcagaccagcugggacgacuucagcaaggccgugagccaggcccugaccaaccacuuccaggccaucagcagcgacggcugguggagccuggaggacgugaccugcaacaacaccaccgacagcaacaucggccugagcgccagaagcaucagaagcaucacccugggcaacgugcccuggagcgugggccagagcuucgcccagagccccugggacuucaugagaaagaacaaggccgagcacaucaccgugcugcugagcggcccccaggagggcugccugagcagcgugaccuacgccagcaugaucccccugcagaugaugcagaacuaccugagacugguggagcaguaccacaacgugaucuuccacggccccgagggcagccugcaggacuacaucgugcaccagcuggcccugugccugaagcacagacagauggccgccggcuucagcugcgagaucgugagagccgagguggacgccggcuucagcaaggagcagcugcuggaccuguucaucagcagcgccugccugauccccgugaagcagagccccagcaagaagaagaucaucaucauccuggagaaccuggagaagagcagccugagcgagcugcugagagacuuccuggccccccuggagaacagaagcaccgagagccccugcaccuuccagaagggcaacggccugagcgagugcuacuacuuccacgagaacugcuuccugaugggcaccaucgccaaggccugccugcagggcagcgaccugcuggugcagcagcacuucagaugggugcagcugagaugggacggcgagcccaugcagggccugcugcagagauuccugagaagaaagguggugaacaaguucaagggccaggcccccagccccugcgaccccgugugcaagaucguggacugggcccugagcguguggagacagcugaacagcugccuggccagacugggcacccccgaggcccugcugggccccaaguacuuccugagcugccccguggugcccggccacgcccaggugaccgugaaguggaugagcaagcuguggaacggcgugaucgcccccagagugcaggaggccauccugagcagagccagcgugaagagacagcccggcuucggccagaccaccgccaagagacaccccagccagggccagcaggccguggugaaggccgcccugagcauccugcugaacaaggccgugcugcacggcugcccccugcccagagccgagcuggaccagcacaccgccgacuucaagggcggcagcuucccccugagcaucgugagcagcuacaacaccugcaacaagaagaagggcgagagcggcgccuggagaaaggugaacaccagccccagaagaaagagcggcagauucagccugcccaccuggaacaagcccgaccugagcaccgagggcaugaagaacaagaccaucagccagcugaacugcaacagaaacgccagccugagcaagcagaagagccuggagaacgaccugagccugacccugaaccuggaccagagacugagccugggcagcgacgacgaggccgaccuggugaaggagcugcagagcaugugcagcagcaagagcgagagcgacaucagcaagaucgccgacagcagagacgaccugagaauguucgacagcagcggcaacaaccccgugcugagcgccaccaucaacaaccugagaaugcccgugagccagaaggaggugagcccccugagcagccaccagaccaccgagugcagcaacagcaagagcaagaccgagcugggcgugagcagagugaagagcuuccugcccgugcccagaagcaaggugacccagugcagccagaacaccaagagaagcagcagcagcagcaacaccagacagaucgagaucaacaacaacagcaaggaggugaacuggaaccugcacaagaacgagcaccuggagaagcccaacaaguaa

SEQ ID NO: 15786 - RNA, 1905 nt, Artificial Sequence
  CTTN__Homo_sapiens__NP_001171669
auguggaaggccagcgccggccacgccgugagcaucgcccaggacgacgccggcgccgacgacugggagaccgaccccgacuucgugaacgacgugagcgagaaggagcagagauggggcgccaagaccgugcagggcagcggccaccaggagcacaucaacauccacaagcugagagagaacguguuccaggagcaccagacccugaaggagaaggagcuggagaccggccccaaggccagccacggcuacggcggcaaguucggcguggagcaggacagaauggacaagagcgccgugggccacgaguaccagagcaagcugagcaagcacugcagccagguggacagcgugagaggcuucggcggcaaguucggcgugcagauggacagaguggaccagagcgccgugggcuucgaguaccagggcaagaccgagaagcacgccagccagaaggacuacagcagcggcuucggcggcaaguacggcgugcaggccgacagaguggacaagagcgccgugggcuucgacuaccagggcaagaccgagaagcacgagagccagagagacuacagcaagggcuucggcggcaaguacggcaucgacaaggacaagguggacaagagcgccgugggcuucgaguaccagggcaagaccgagaagcacgagagccagaaggacuacgugaagggcuucggcggcaaguucggcgugcagaccgacagacaggacaagugcgcccugggcugggaccaccaggagaagcugcagcugcacgagagccagaaggacuacagcaagggcuucggcggcaaguacggcgugcagaaggacagaauggacaagaacgccagcaccuucgaggacgugacccaggugagcagcgccuaccagaagaccgugcccguggaggccgugaccagcaagaccagcaacaucagagccaacuucgagaaccuggccaaggagaaggagcaggaggacagaagaaaggccgaggccgagagagcccagagaauggccaaggagagacaggagcaggaggaggccagaagaaagcuggaggagcaggccagagccaagacccagaccccccccgugagccccgccccccagcccaccgaggagagacugcccagcagccccguguacgaggacgccgccagcuucaaggccgagcugagcuacagaggccccgugagcggcaccgagcccgagcccguguacagcauggaggccgccgacuacagagaggccagcagccagcagggccuggccuacgccaccgaggccguguacgagagcgccgaggcccccggccacuaccccgccgaggacagcaccuacgacgaguacgagaacgaccugggcaucaccgccguggcccuguacgacuaccaggccgccggcgacgacgagaucagcuucgaccccgacgacaucaucaccaacaucgagaugaucgacgacggcugguggagaggcgugugcaagggcagauucagagagcuggccuucagcugcgugagaguggcccuggugcccaucaagugcagcagagaccugcccggccaggccagaggccugagaagcgcccuguggagagugggcagaaaggacugccccagaagaggcgccagcagcagagugagccugcugggcagaagaggccugggccugauggaggugaaccccgagcugagccaccccgagcacagaagcugccacgugagaugggagaucugccugugccacaccgugaccgccagaagaaucagaaagcugaucagcuuccugagaagcagagaggccggccccgugcccagcugcagccaggugggcggcgugagcuuccagaaggugaccuggaagugccugggcaccugggugcccgagugccccuaa

SEQ ID NO: 15787 - RNA, 1047 nt, Artificial Sequence
  CTU1__Homo_sapiens__NP_660275
augcccgccccccccugcgccagcugccacgccgccagagccgcccugagaagaccccugagcggccaggcccugugcggcgccugcuucugcgccgccuucgaggccgaggugcugcacaccgugcuggccggcagacugcugccccccggcgccgugguggccgugggcgccagcggcggcaaggacagcaccgugcuggcccacgugcugagagcccuggcccccagacugggcaucagccugcagcugguggccguggacgagggcaucggcggcuacagagacgccgcccuggccgccgugagaagacaggccgccagaugggagcugccccugaccgugguggccuacgaggaccuguucggcggcuggaccauggacgccguggccagaagcaccgccggcagcggcagaagcagaagcugcugcaccuucugcggcgugcugagaagaagagcccuggaggagggcgccagaagagugggcgccacccacaucgugaccggccacaacgccgacgacauggccgagaccgugcugaugaacuuccugagaggcgacgccggcagacuggccagaggcggcggccugggcagccccggcgagggcggcgcccugcccagaugcagaccccugcaguucgccagccagaaggagguggugcuguacgcccacuucagaagacuggacuacuucagcgaggagugcguguacgcccccgaggccuucagaggccacgccagagaccugcugaagagacuggaggccgccagacccagcgccgugcuggaccuggugcacagcgccgagagacuggcccuggcccccgccgccagaccccccagacccggcgccugcagcagaugcggcgcccuggccagcagagcccugugccaggccugcgcccugcuggacggccugaacagaggcagacccagacuggccaucggcaagggcagaagaggccuggacgaggaggccacccccggcacccccggcgaccccgccagaccccccgccagcaaggccgugcccaccuucuaa

SEQ ID NO: 15788 - RNA, 246 nt, Artificial Sequence
  CTXN3__Homo_sapiens__NP_001041717
auggacggcggccagcccauccccagcagccuggugccccugggcaacgagagcgccgacagcagcaugagccuggagcagaagaugaccuucguguucgugauccugcuguucaucuuccugggcauccugaucgugagaugcuucagaauccugcuggaccccuacagaagcaugcccaccagcaccugggccgacggccuggagggccuggagaagggccaguucgaccacgcccuggccuaa

SEQ ID NO: 15789 - RNA, 10872 nt, Artificial Sequence
  CUBN__Homo_sapiens__NP_001072
augaugaacaugagccugcccuuccuguggagccugcugacccugcugaucuucgccgaggugaacggcgaggccggcgagcuggagcugcagagacagaagagaagcaucaaccugcagcagcccagaauggccaccgagagaggcaaccugguguuccugaccggcagcgcccagaacaucgaguucagaaccggcagccugggcaagaucaagcugaacgacgaggaccugagcgagugccugcaccagauccagaagaacaaggaggacaucaucgagcugaagggcagcgccaucggccugccccagaacaucagcagccagaucuaccagcugaacagcaagcugguggaccuggagagaaaguuccagggccugcagcagaccguggacaagaaggugugcagcagcaaccccugccagaacggcggcaccugccugaaccugcacgacagcuucuucugcaucugccccccccaguggaagggcccccugugcagcgccgacgugaacgagugcgagaucuacagcggcaccccccugagcugccagaacggcggcaccugcgugaacaccaugggcagcuacagcugccacugcccccccgagaccuacggcccccagugcgccagcaaguacgacgacugcgagggcggcagcguggccagaugcgugcacggcaucugcgaggaccugaugagagagcaggccggcgagcccaaguacagcugcgugugcgacgccggcuggauguucagccccaacagccccgccugcacccuggacagagacgagugcagcuuccagcccggccccugcagcacccuggugcagugcuucaacacccagggcagcuucuacugcggcgccugccccaccggcuggcagggcaacggcuacaucugcgaggacaucaacgagugcgagaucaacaacggcggcugcagcguggccccccccguggagugcgugaacacccccggcagcagccacugccaggccugcccccccggcuaccagggcgacggcagagugugcacccugaccgacaucugcagcgugagcaacggcggcugccaccccgacgccagcugcagcagcacccugggcagccugccccugugcaccugccugcccggcuacaccggcaacggcuacggccccaacggcugcgugcagcugagcaacaucugccugagccaccccugccugaacggccagugcaucgacaccgugagcggcuacuucugcaagugcgacagcggcuggaccggcgugaacugcaccgagaacaucaacgagugccugagcaaccccugccugaacggcggcaccugcguggacggcguggacagcuucagcugcgagugcaccagacuguggaccggcgcccugugccaggugccccagcaggugugcggcgagagccugagcggcaucaacggcagcuucagcuacagaagccccgacgugggcuacgugcacgacgugaacugcuucugggugaucaagaccgagaugggcaaggugcugagaaucaccuucaccuucuucagacuggagagcauggacaacugcccccacgaguuccugcagguguacgacggcgacagcagcagcgccuuccagcugggcagauucugcggcagcagccugccccacgagcugcugagcagcgacaacgcccuguacuuccaccuguacagcgagcaccugagaaacggcagaggcuucaccgugagaugggagacccagcagcccgagugcggcggcauccugaccggccccuacggcagcaucaagagccccggcuaccccggcaacuacccccccggcagagacugcguguggaucguggugaccagccccgaccugcuggugaccuucaccuucggcacccugagccuggagcaccacgacgacugcaacaaggacuaccuggagaucagagacggcccccuguaccaggacccccugcugggcaaguucugcaccaccuucagcgugcccccccugcagaccaccggccccuucgccagaauccacuuccacagcgacagccagaucagcgaccagggcuuccacaucaccuaccugaccagccccagcgaccugagaugcggcggcaacuacaccgaccccgagggcgagcuguuccugcccgagcugagcggccccuucacccacaccagacagugcguguacaugaugaagcagccccagggcgagcagauccagaucaacuucacccacguggagcugcagugccagagcgacagcagccagaacuacaucgaggugagagacggcgagacccugcugggcaaggugugcggcaacggcaccaucagccacaucaagagcaucaccaacagcguguggaucagauucaagaucgacgccagcguggagaaggccagcuucagagccguguaccagguggccugcggcgacgagcugaccggcgagggcgugaucagaagccccuucuuccccaacguguaccccggcgagagaaccugcagauggaccauccaccagccccagagccaggugauccugcugaacuucaccguguucgagaucggcagcagcgcccacugcgagaccgacuacguggagaucggcagcagcagcauccugggcagccccgagaacaagaaguacugcggcaccgacauccccagcuucaucaccagcguguacaacuuccuguacgugaccuucgugaagagcagcagcaccgagaaccacggcuucauggccaaguucagcgccgaggaccuggccugcggcgagauccugaccgagagcaccggcaccauccagagccccggccaccccaacguguacccccacggcaucaacugcaccuggcacauccuggugcagcccaaccaccugauccaccugauguucgagaccuuccaccuggaguuccacuacaacugcaccaacgacuaccuggagguguacgacaccgacagcgagaccagccugggcagauacugcggcaagagcaucccccccagccugaccagcagcggcaacagccugaugcugguguucgugaccgacagcgaccuggccuacgagggcuuccugaucaacuacgaggccaucagcgccgccaccgccugccugcaggacuacaccgacgaccugggcaccuucaccagccccaacuuccccaacaacuaccccaacaacugggagugcaucuacagaaucaccgugagaaccggccagcugaucgccgugcacuucaccaacuucagccuggaggaggccaucggcaacuacuacaccgacuuccuggagaucagagacggcggcuacgagaagagcccccugcugggcaucuucuacggcagcaaccugccccccaccaucaucagccacagcaacaagcuguggcugaaguucaagagcgaccagaucgacaccagaagcggcuucagcgccuacugggacggcagcagcaccggcugcggcggcaaccugaccaccagcagcggcaccuucaucagccccaacuaccccaugcccuacuaccacagcagcgagugcuacugguggcugaagagcagccacggcagcgccuucgagcuggaguucaaggacuuccaccuggagcaccaccccaacugcacccuggacuaccuggccguguacgacggccccagcagcaacagccaccugcugacccagcugugcggcgacgagaagcccccccugaucagaagcagcggcgacagcauguucaucaagcugagaaccgacgagggccagcagggcagaggcuucaaggccgaguacagacagaccugcgagaacguggugaucgugaaccagaccuacggcauccuggagagcaucggcuaccccaaccccuacagcgagaaccagcacugcaacuggaccaucagagccaccaccggcaacaccgugaacuacaccuuccuggccuucgaccuggagcaccacaucaacugcagcaccgacuaccuggagcuguacgacggccccagacagaugggcagauacugcggcguggaccugcccccccccggcagcaccaccagcagcaagcugcaggugcugcugcugaccgacggcgugggcagaagagagaagggcuuccagaugcagugguucguguacggcugcggcggcgagcugagcggcgccaccggcagcuucagcagccccggcuuccccaacagauacccccccaacaaggagugcaucugguacaucagaaccgaccccggcagcagcauccagcugaccauccacgacuucgacguggaguaccacagcagaugcaacuucgacgugcuggagaucuacggcggccccgacuuccacagccccagaaucgcccagcugugcacccagagaagccccgagaaccccaugcaggugagcagcaccggcaacgagcuggccaucagauucaagaccgaccugagcaucaacggcagaggcuucaacgccagcuggcaggccgugaccggcggcugcggcggcaucuuccaggcccccagcggcgagauccacagccccaacuaccccagccccuacagaagcaacaccgacugcagcugggugaucagaguggacagaaaccacagagugcugcugaacuucaccgacuucgaccuggagccccaggacagcugcaucauggccuacgacggccugagcagcaccaugagcagacuggccagaaccugcggcagagagcagcuggccaaccccaucgugagcagcggcaacagccuguuccugagauuccagagcggccccagcagacagaacagaggcuucagagcccaguucagacaggccugcggcggccacauccugaccagcagcuucgacaccgugagcagccccagauuccccgccaacuaccccaacaaccagaacugcagcuggaucauccaggcccagcccccccugaaccacaucacccugagcuucacccacuucgagcuggagagaagcaccaccugcgccagagacuucguggagauccuggacggcggccacgaggacgccccccugagaggcagauacugcggcaccgacaugccccaccccaucaccagcuucagcagcgcccugacccugagauucgugagcgacagcagcaucagcgccggcggcuuccacaccaccgugaccgccagcgugagcgccugcggcggcaccuucuacauggccgagggcaucuucaacagccccggcuaccccgacaucuacccccccaacguggagugcguguggaacaucgugagcagccccggcaacagacugcagcugagcuucaucagcuuccagcuggaggacagccaggacugcagcagagacuucguggagaucagagagggcaacgccaccggccaccuggugggcagauacugcggcaacagcuucccccugaacuacagcagcaucgugggccacacccugugggugagauucaucagcgacggcagcggcagcggcaccggcuuccaggccaccuucaugaagaucuucggcaacgacaacaucgugggcacccacggcaagguggccagccccuucuggcccgagaacuacccccacaacagcaacuaccaguggaccgugaacgugaacgccagccacguggugcacggcagaauccuggagauggacaucgaggagauccagaacugcuacuacgacaagcugagaaucuacgacggccccagcauccacgccagacugaucggcgccuacugcggcacccagaccgagagcuucagcagcaccggcaacagccugaccuuccacuucuacagcgacagcagcaucagcggcaagggcuuccugcuggagugguucgccguggacgcccccgacggcgugcugcccaccaucgcccccggcgccugcggcggcuuccugagaaccggcgacgcccccguguuccuguucagccccggcuggcccgacagcuacagcaacagaguggacugcaccuggcugauccaggcccccgacagcaccguggagcugaacauccugagccuggacaucgagagccacagaaccugcgccuacgacagccuggugaucagagacggcgacaacaaccuggcccagcagcuggccgugcugugcggcagagagauccccggccccaucagaagcaccggcgaguacauguucaucagauucaccagcgacagcagcgugaccagagccggcuucaacgccagcuuccacaagagcugcggcggcuaccugcacgccgacagaggcaucaucaccagccccaaguaccccgagaccuaccccagcaaccugaacugcagcuggcacgugcuggugcagagcggccugaccaucgccgugcacuucgagcagcccuuccagauccccaacggcgacagcagcugcaaccagggcgacuaccuggugcugagaaacggccccgacaucugcagccccccccugggcccccccggcggcaacggccacuucugcggcagccacgccagcagcacccuguucaccagcgacaaccagauguucgugcaguucaucagcgaccacagcaacgagggccagggcuucaagaucaaguacgaggccaagagccuggccugcggcggcaacguguacauccacgacgccgacagcgccggcuacgugaccagccccaaccacccccacaacuaccccccccacgccgacugcaucuggauccuggccgccccccccgagaccagaauccagcugcaguucgaggacagauucgacaucgaggugacccccaacugcaccagcaacuaccuggagcugagagacggcguggacagcgacgcccccauccugagcaaguucugcggcaccagccugcccagcagccaguggagcagcggcgaggugauguaccugagauucagaagcgacaacagccccacccacgugggcuucaaggccaaguacagcaucgcccagugcggcggcagagugcccggccagagcggcgugguggagagcaucggccaccccacccugcccuacagagacaaccuguucugcgaguggcaccugcagggccugagcggccacuaccugaccaucagcuucgaggacuucaaccugcagaacagcagcggcugcgagaaggacuucguggagaucugggacaaccacaccagcggcaacauccugggcagauacugcggcaacaccauccccgacagcaucgacaccagcagcaacaccgccguggugagauucgugaccgacggcagcgugaccgccagcggcuucagacugagauucgagagcagcauggaggagugcggcggcgaccugcagggcagcaucggcaccuucaccagccccaacuaccccaaccccaacccccacggcagaaucugcgaguggagaaucaccgcccccgagggcagaagaaucacccugauguucaacaaccugagacuggccacccaccccagcugcaacaacgagcacgugaucguguucaacggcaucagaagcaacagcccccagcuggagaagcugugcagcagcgugaacgugagcaacgagaucaagagcagcggcaacaccaugaaggugaucuucuucaccgacggcagcagacccuacggcggcuucaccgccagcuacaccagcagcgaggacgccgugugcggcggcagccugcccaacacccccgagggcaacuucaccagccccggcuacgacggcgugagaaacuacagcagaaaccugaacugcgaguggacccugagcaaccccaaccagggcaacagcagcaucagcauccacuucgaggacuucuaccuggagagccaccaggacugccaguucgacgugcuggaguucagagugggcgacgccgacggcccccugauguggagacugugcggccccagcaagcccacccugccccuggugauccccuacagccagguguggauccacuucgugaccaacgagagaguggagcacaucggcuuccacgccaaguacagcuucaccgacugcggcggcauccagaucggcgacagcggcgugaucaccagccccaacuaccccaacgccuacgacagccugacccacugcagcagccugcuggaggccccccagggccacaccaucacccugaccuucagcgacuucgacaucgagccccacaccaccugcgccugggacagcgugaccgugagaaacggcggcagccccgagagccccaucaucggccaguacugcggcaacagcaaccccagaaccauccagagcggcagcaaccagcugguggugaccuucaacagcgaccacagccugcagggcggcggcuucuacgccaccuggaacacccagacccugggcugcggcggcaucuuccacagcgacaacggcaccaucagaagcccccacuggccccagaacuuccccgagaacagcagaugcagcuggaccgccaucacccacaagagcaagcaccuggagaucagcuucgacaacaacuuccugauccccagcggcgacggccagugccagaacagcuucgugaaggugugggccggcaccgaggagguggacaaggcccugcuggccaccggcugcggcaacguggcccccggccccgugaucacccccagcaacaccuucaccgccguguuccagagccaggaggcccccgcccagggcuucagcgccagcuucgugagcagaugcggcagcaacuucaccggccccagcggcuacaucaucagccccaacuaccccaagcaguacgacaacaacaugaacugcaccuacgugaucgaggccaacccccugagcguggugcugcugaccuucgugagcuuccaccuggaggccagaagcgccgugaccggcagcugcgugaacgacggcgugcacaucaucagaggcuacagcgugaugagcacccccuucgccaccgugugcggcgacgagaugcccgccccccugaccaucgccggccccgugcugcugaacuucuacagcaacgagcagaucaccgacuucggcuucaaguucagcuacagaaucaucagcugcggcggcguguucaacuucagcagcggcaucaucaccagccccgccuacagcuacgccgacuaccccaacgacaugcacugccuguacaccaucaccgugagcgacgacaaggugaucgagcugaaguucagcgacuucgacguggugcccagcaccagcugcagccacgacuaccuggccaucuacgacggcgccaacaccagcgacccccugcugggcaaguucugcggcagcaagagaccccccaacgugaagagcagcaacaacagcaugcugcugguguucaagaccgacagcuuccagaccgccaagggcuggaagaugagcuucagacagacccugggcccccagcagggcugcggcggcuaccugaccggcagcaacaacaccuucgccagccccgacagcgacagcaacggcauguacgacaagaaccugaacugcguguggaucaucaucgcccccgugaacaaggugauccaccugaccuucaacaccuucgcccuggaggccgccagcaccagacagagaugccuguacgacuacgugaagcuguacgacggcgacagcgagaacgccaaccuggccggcaccuucugcggcagcaccgugcccgcccccuucaucagcagcggcaacuuccugaccgugcaguucaucagcgaccugacccuggagagagagggcuucaacgccaccuacaccaucauggacaugcccugcggcggcaccuacaacgccaccuggaccccccagaacaucagcagccccaacagcagcgaccccgacgugcccuucagcaucugcaccugggugaucgacagccccccccaccagcaggugaagaucaccgugugggcccugcagcugaccagccaggacugcacccagaacuaccugcagcugcaggacagcccccagggccacggcaacagcagauuccaguucugcggcagaaacgccagcgccgugcccguguucuacagcagcaugagcaccgccauggugaucuucaagagcggcguggugaacagaaacagcagaaugagcuucaccuaccagaucgccgacugcaacagagacuaccacaaggccuucggcaaccugagaagccccggcuggcccgacaacuacgacaacgacaaggacugcaccgugacccugaccgccccccagaaccacaccaucagccuguucuuccacagccugggcaucgagaacagcguggagugcagaaacgacuuccuggaggugagaaacggcagcaacagcaacagcccccugcugggcaaguacugcggcacccugcugcccaaccccguguucagccagaacaacgagcuguaccugagauucaagagcgacagcgugaccagcgacagaggcuacgagaucaucuggaccagcagccccagcggcugcggcggcacccuguacggcgacagaggcagcuucaccagccccggcuaccccggcaccuaccccaacaacaccuacugcgagugggugcugguggcccccgccggcagacuggugaccaucaacuucuacuucaucagcaucgacgaccccggcgacugcgugcagaacuaccugacccuguacgacggccccaacgccagcagccccagcagcggccccuacugcggcggcgacaccagcaucgcccccuucguggccagcagcaaccagguguucaucaaguuccacgccgacuacgccagaagacccagcgccuucagacugaccugggacagcuaa

SEQ ID NO: 15790 - RNA, 1161 nt, Artificial Sequence
  CUEDC1__Homo_sapiens__NP_001278954
augaccagccuguucagaagaagcagcagcggcagcggcggcggcggcaccgccggcgccagaggcggcggcggcggcaccgccgccccccaggagcugaacaacagcagacccgccagacaggugagaagacuggaguucaaccaggccauggacgacuucaagaccauguuccccaacauggacuacgacaucaucgagugcgugcugagagccaacagcggcgccguggacgccaccaucgaccagcugcugcagaugaaccuggagggcggcggcagcagcggcggcguguacgaggacagcagcgacagcgaggacagcaucccccccgagauccuggagagaacccuggagcccgacagcagcgacgaggagcccccccccguguacagcccccccgccuaccacaugcacguguucgacagacccuacccccuggccccccccacccccccccccagaaucgacgcccugggcagcggcgcccccaccagccagagaagauacagaaacuggaaccccccccugcugggcaaccugcccgacgacuuccugagaauccugccccagcagcuggacagcauccagggcaacgccggcggccccaagcccggcagcggcgagggcugcccccccgccauggccggccccggccccggcgaccaggagagcagauggaagcaguaccuggaggacgagagaaucgcccuguuccugcagaacgaggaguucaugaaggagcugcagagaaacagagacuuccugcuggcccuggagagagacagacugaaguacgagagccagaagagcaagagcagcagcguggccgugggcaacgacuucggcuucagcagccccgugcccggcaccggcgacgccaaccccgccgugagcgaggacgcccuguucagagacaagcugaagcacaugggcaagagcaccagaagaaagcuguucgagcuggccagagccuucagcgagaagaccaagaugagaaagagcaagagaaagcaccugcugaagcaccagagccugggcgccgccgccagcaccgccaaccugcuggacgacguggagggccacgccugcgacgaggacuucagaggcagaagacaggaggcccccaagguggaggagggccugagagagggccaguaa

SEQ ID NO: 15791 - RNA, 864 nt, Artificial Sequence
  CUEDC2__Homo_sapiens__NP_076945
auggagcuggagagaaucgugagcgccgcccugcuggccuucgugcagacccaccugcccgaggccgaccugagcggccuggacgaggugaucuucagcuacgugcugggcgugcuggaggaccugggccccagcggccccagcgaggagaacuucgacauggaggccuucaccgagaugauggaggccuacgugcccggcuucgcccacauccccagaggcaccaucggcgacaugaugcagaagcugagcggccagcugagcgacgccagaaacaaggagaaccugcagccccagagcagcggcgugcagggccaggugcccaucagccccgagccccugcagagacccgagaugcugaaggaggagaccagaagcagcgccgccgccgccgccgacacccaggacgaggccaccggcgccgaggaggagcugcugcccggcguggacgugcugcuggagguguuccccaccugcagcguggagcaggcccagugggugcuggccaaggccagaggcgaccuggaggaggccgugcagaugcugguggagggcaaggaggagggccccgccgccugggagggccccaaccaggaccugcccagaagacugagaggcccccagaaggacgagcugaagagcuucauccugcagaaguacaugaugguggacagcgccgaggaccagaagauccacagacccauggcccccaaggaggcccccaagaagcugaucagauacaucgacaaccagguggugagcaccaagggcgagagauucaaggacgugagaaaccccgaggccgaggagaugaaggccaccuacaucaaccugaagcccgccagaaaguacagauuccacuaa

SEQ ID NO: 15792 - RNA, 2331 nt, Artificial Sequence
  CUL1__Homo_sapiens__XP_011514934
augagcagcaccagaagccagaacccccacggccugaagcagaucggccuggaccagaucugggacgaccugagagccggcauccagcagguguacaccagacagagcauggccaagagcagauacauggagcuguacacccacguguacaacuacugcaccagcgugcaccagagcaaccaggccagaggcgccggcgugccccccagcaagagcaagaagggccagacccccggcggcgcccaguucgugggccuggagcuguacaagagacugaaggaguuccugaagaacuaccugaccaaccugcugaaggacggcgaggaccugauggacgagagcgugcugaaguucuacacccagcagugggaggacuacagauucagcagcaaggugcugaacggcaucugcgccuaccugaacagacacugggugagaagagagugcgacgagggcagaaagggcaucuacgagaucuacagccuggcccuggugaccuggagagacugccuguucagaccccugaacaagcaggugaccaacgccgugcugaagcugaucgagaaggagagaaacggcgagaccaucaacaccagacugaucagcggcguggugcagagcuacguggagcugggccugaacgaggacgacgccuucgccaagggccccacccugaccguguacaaggagagcuucgagagccaguuccuggccgacaccgagagauucuacaccagagagagcaccgaguuccugcagcagaaccccgugaccgaguacaugaagaaggccgaggccagacugcuggaggagcagagaagagugcagguguaccugcacgagagcacccaggacgagcuggccagaaagugcgagcaggugcugaucgagaagcaccuggagaucuuccacaccgaguuccagaaccugcuggacgccgacaagaacgaggaccugggcagaauguacaaccuggugagcagaauccaggacggccugggcgagcugaagaagcugcuggagacccacauccacaaccagggccuggccgccaucgagaagugcggcgaggccgcccugaacgaccccaagauguacgugcagaccgugcuggacgugcacaagaaguacaacgcccuggugaugagcgccuucaacaacgacgccggcuucguggccgcccuggacaaggccugcggcagauucaucaacaacaacgccgugaccaagauggcccagagcagcagcaagagccccgagcugcuggccagauacugcgacagccugcugaagaagagcagcaagaaccccgaggaggccgagcuggaggacacccugaaccaggugauggugguguucaaguacaucgaggacaaggacguguuccagaaguucuacgccaagaugcuggccaagagacuggugcaccagaacagcgccagcgacgacgccgaggccagcaugaucagcaagcugaagcaggccugcggcuucgaguacaccagcaagcugcagagaauguuccaggacaucggcgugagcaaggaccugaacgagcaguucaagaagcaccugaccaacagcgagccccuggaccuggacuucagcauccaggugcugagcagcggcagcuggcccuuccagcagagcugcaccuucgcccugcccagcgagcuggagagaagcuaccagagauucaccgccuucuacgccagcagacacagcggcagaaagcugaccuggcuguaccagcugagcaagggcgagcuggugaccaacugcuucaagaacagauacacccugcaggccagcaccuuccagauggccauccugcugcaguacaacaccgaggacgccuacaccgugcagcagcugaccgacagcacccagaucaagauggacauccuggcccaggugcugcagauccugcugaagagcaagcugcuggugcuggaggacgagaacgccaacguggacgagguggagcugaagcccgacacccugaucaagcuguaccugggcuacaagaacaagaagcugagagugaacaucaacgugcccaugaagaccgagcagaagcaggagcaggagaccacccacaagaacaucgaggaggacagaaagcugcugauccaggccgccaucgugagaaucaugaagaugagaaaggugcugaagcaccagcagcugcugggcgaggugcugacccagcugagcagcagauucaagcccagagugcccgugaucaagaagugcaucgacauccugaucgagaaggaguaccuggagagaguggacggcgagaaggacaccuacagcuaccuggccuaa

SEQ ID NO: 15793 - RNA, 2295 nt, Artificial Sequence
  CUL2__Homo_sapiens__NP_001185707
auguacagagugaccuggagcaccuucuggcugagauuccagcacuacaccugcaccaugagccugaagcccagagugguggacuucgacgagaccuggaacaagcugcugaccaccaucaaggccguggugaugcuggaguacguggagagagccaccuggaacgacagauucagcgacaucuacgcccugugcguggccuaccccgagccccugggcgagagacuguacaccgagaccaagaucuuccuggagaaccacgugagacaccugcacaagagagugcuggagagcgaggagcaggugcuggugauguaccacagauacugggaggaguacagcaagggcgccgacuacauggacugccuguacagauaccugaacacccaguucaucaagaagaacaagcugaccgaggccgaccugcaguacggcuacggcggcguggacaugaacgagccccugauggagaucggcgagcuggcccuggacauguggagaaagcugaugguggagccccugcaggccauccugaucagaaugcugcugagagagaucaagaacgacagaggcggcgaggaccccaaccagaaggugauccacggcgugaucaacagcuucgugcacguggagcaguacaagaagaaguucccccugaaguucuaccaggagaucuucgagagccccuuccugaccgagaccggcgaguacuacaagcaggaggccagcaaccugcugcaggagagcaacugcagccaguacauggagaaggugcugggcagacugaaggacgaggagaucagaugcagaaaguaccugcaccccagcagcuacaccaaggugauccacgagugccagcagagaaugguggccgaccaccugcaguuccugcacgccgagugccacaacaucaucagacaggagaagaagaacgacauggccaacauguacgugcugcugagagccgugagcaccggccugccccacaugauccaggagcugcagaaccacauccacgacgagggccugagagccaccagcaaccugacccaggagaacaugcccacccuguucguggagagcgugcuggaggugcacggcaaguucgugcagcugaucaacaccgugcugaacggcgaccagcacuucaugagcgcccuggacaaggcccugaccagcguggugaacuacagagagcccaagagcgugugcaaggcccccgagcugcuggccaaguacugcgacaaccugcugaagaagagcgccaagggcaugaccgagaacgagguggaggacagacugaccagcuucaucaccguguucaaguacaucgacgacaaggacguguuccagaaguucuacgccagaaugcuggccaagagacugauccacggccugagcaugagcauggacagcgaggaggccaugaucaacaagcugaagcaggccugcggcuacgaguucaccagcaagcugcacagaauguacaccgacaugagcgugagcgccgaccugaacaacaaguucaacaacuucaucaagaaccaggacaccgugaucgaccugggcaucagcuuccagaucuacgugcugcaggccggcgccuggccccugacccaggcccccagcagcaccuucgccaucccccaggagcuggagaagagcgugcagauguucgagcuguucuacagccagcacuucagcggcagaaagcugaccuggcugcacuaccugugcaccggcgaggugaagaugaacuaccugggcaagcccuacguggccauggugaccaccuaccagauggccgugcugcuggccuucaacaacagcgagaccgugagcuacaaggagcugcaggacagcacccagaugaacgagaaggagcugaccaagaccaucaagagccugcuggacgugaagaugaucaaccacgacagcgagaaggaggacaucgacgccgagagcagcuucagccugaacaugaacuucagcagcaagagaaccaaguucaagaucaccaccagcaugcagaaggacaccccccaggagauggagcagaccagaagcgccguggacgaggacagaaagauguaccugcaggccgccaucgugagaaucaugaaggccagaaaggugcugagacacaacgcccugauccaggaggugaucagccagagcagagccagauucaaccccagcaucagcaugaucaagaagugcaucgaggugcugaucgacaagcaguacaucgagagaagccaggccagcgccgacgaguacagcuacguggccuaa

SEQ ID NO: 15794 - RNA, 2109 nt, Artificial Sequence
  CUL3__Homo_sapiens__NP_001244126
augagcaaccugagcaagggcaccggcagcagaaaggacaccaagaugagaaucagagccuuccccgugagagaggacgugcugaacagccugaacaacaacuuccugcagacccugaaccaggccuggaacgaccaccagaccgccauggugaugaucagagacauccugauguacauggacagaguguacgugcagcagaacaacguggagaacguguacaaccugggccugaucaucuucagagaccagguggugagauacggcugcaucagagaccaccugagacagacccugcuggacaugaucgccagagagagaaagggcgaggugguggacagaggcgccaucagaaacgccugccagaugcugaugauccugggccuggagggcagaagcguguacgaggaggacuucgaggcccccuuccuggagaugagcgccgaguucuuccagauggagagccagaaguuccuggccgagaacagcgccagcguguacaucaagaagguggaggccagaaucaacgaggagaucgagagagugaugcacugccuggacaagagcaccgaggagcccaucgugaaggugguggagagagagcugaucagcaagcacaugaagaccaucguggagauggagaacagcggccuggugcacaugcugaagaacggcaagaccgaggaccugggcugcauguacaagcuguucagcagagugcccaacggccugaagaccaugugcgagugcaugagcagcuaccugagagagcagggcaaggcccuggugagcgaggagggcgagggcaagaaccccguggacuacauccagggccugcuggaccugaagagcagauucgacagauuccugcuggagagcuucaacaacgacagacuguucaagcagaccaucgccggcgacuucgaguacuuccugaaccugaacagcagaagccccgaguaccugagccuguucaucgacgacaagcugaagaagggcgugaagggccugaccgagcaggagguggagaccauccuggacaaggccauggugcuguucagauucaugcaggagaaggacguguucgagagauacuacaagcagcaccuggccagaagacugcugaccaacaagagcgugagcgacgacagcgagaagaacaugaucagcaagcugaagaccgagugcggcugccaguucaccagcaagcuggagggcauguucagagacaugagcaucagcaacaccaccauggacgaguucagacagcaccugcaggccaccggcgugagccugggcggcguggaccugaccgugagagugcugaccaccggcuacuggcccacccagagcgccacccccaagugcaacaucccccccgcccccagacacgccuucgagaucuucagaagauucuaccuggccaagcacagcggcagacagcugacccugcagcaccacaugggcagcgccgaccugaacgccaccuucuacggccccgugaagaaggaggacggcagcgaggugggcgugggcggcgcccaggugaccggcagcaacaccagaaagcacauccugcaggugagcaccuuccagaugaccauccugaugcuguucaacaacagagagaaguacaccuucgaggagauccagcaggagaccgacauccccgagagagagcuggugagagcccugcagagccuggccugcggcaagcccacccagagagugcugaccaaggagcccaagagcaaggagaucgagaacggccacaucuucaccgugaacgaccaguucaccagcaagcugcacagagugaagauccagaccguggccgccaagcagggcgagagcgaccccgagagaaaggagaccagacagaagguggacgacgacagaaagcacgagaucgaggccgccaucgugagaaucaugaagagcagaaagaagaugcagcacaacgugcugguggccgaggugacccagcagcugaaggccagauuccugcccagccccguggugaucaagaagagaaucgagggccugaucgagagagaguaccuggccagaacccccgaggacagaaagguguacaccuacguggccuaa

SEQ ID NO: 15795 - RNA, 2280 nt, Artificial Sequence
  CUL4A__Homo_sapiens__NP_001008895
auggccgacgaggcccccagaaagggcagcuucagcgcccuggugggcagaaccaacggccugaccaagcccgccgcccuggccgccgcccccgccaagcccggcggcgccggcggcagcaagaagcuggugaucaagaacuucagagacagacccagacugcccgacaacuacacccaggacaccuggagaaagcugcacgaggccgugagagccgugcagagcagcaccagcaucagauacaaccuggaggagcuguaccaggccguggagaaccugugcagccacaaggugagccccaugcuguacaagcagcugagacaggccugcgaggaccacgugcaggcccagauccugcccuucagagaggacagccuggacagcgugcuguuccugaagaagaucaacaccugcuggcaggaccacugcagacagaugaucaugaucagaagcaucuuccuguuccuggacagaaccuacgugcugcagaacagcacccugcccagcaucugggacaugggccuggagcuguucagaacccacaucaucagcgacaagauggugcagagcaagaccaucgacggcauccugcugcugaucgagagagagagaagcggcgaggccguggacagaagccugcugagaagccugcugggcaugcugagcgaccugcagguguacaaggacagcuucgagcugaaguuccuggaggagaccaacugccuguacgccgccgagggccagagacugaugcaggagagagaggugcccgaguaccugaaccacgugagcaagagacuggaggaggagggcgacagagugaucaccuaccuggaccacagcacccagaagccccugaucgccugcguggagaagcagcugcugggcgagcaccugaccgccauccugcagaagggccuggaccaccugcuggacgagaacagagugcccgaccuggcccagauguaccagcuguucagcagagugagaggcggccagcaggcccugcugcagcacuggagcgaguacaucaagaccuucggcaccgccaucgugaucaaccccgagaaggacaaggacauggugcaggaccugcuggacuucaaggacaagguggaccacgugaucgaggugugcuuccagaagaacgagagauucgugaaccugaugaaggagagcuucgagaccuucaucaacaagagacccaacaagcccgccgagcugaucgccaagcacguggacagcaagcugagagccggcaacaaggaggccaccgacgaggagcuggagagaacccuggacaagaucaugauccuguucagauucauccacggcaaggacguguucgaggccuucuacaagaaggaccuggccaagagacugcuggugggcaagagcgccagcguggacgccgagaagagcaugcugagcaagcugaagcacgagugcggcgccgccuucaccagcaagcuggagggcauguucaaggacauggagcugagcaaggacaucauggugcacuucaagcagcacaugcagaaccagagcgacagcggccccaucgaccugaccgugaacauccugaccaugggcuacuggcccaccuacacccccauggaggugcaccugacccccgagaugaucaagcugcaggagguguucaaggccuucuaccugggcaagcacagcggcagaaagcugcaguggcagaccacccugggccacgccgugcugaaggccgaguucaaggagggcaagaaggaguuccaggugagccuguuccagacccuggugcugcugauguucaacgagggcgacggcuucagcuucgaggagaucaagauggccaccggcaucgaggacagcgagcugagaagaacccugcagagccuggccugcggcaaggccagagugcugaucaagagccccaagggcaaggagguggaggacggcgacaaguucaucuucaacggcgaguucaagcacaagcuguucagaaucaagaucaaccagauccagaugaaggagaccguggaggagcaggugagcaccaccgagagaguguuccaggacagacaguaccagaucgacgccgccaucgugagaaucaugaagaugagaaagacccugggccacaaccugcuggugagcgagcuguacaaccagcugaaguuccccgugaagcccggcgaccugaagaagagaaucgagagccugaucgacagagacuacauggagagagacaaggacaaccccaaccaguaccacuacguggccuaa

SEQ ID NO: 15796 - RNA, 2688 nt, Artificial Sequence
  CUL4B__Homo_sapiens__NP_001073341
auguuccccaccggcuucagcagccccagccccagcgccgccgccgccgcccaggaggugagaagcgccaccgacggcaacaccagcaccaccccccccaccagcgccaagaagagaaagcugaacagcagcagcagcagcagcagcaacagcagcaacgagagagaggacuucgacagcaccagcagcagcagcagcacccccccccugcagcccagagacagcgccagccccagcaccagcagcuucugccugggcgugagcguggccgccagcagccacgugcccauccagaagaagcugagauucgaggacacccuggaguucgugggcuucgacgccaagauggccgaggagagcagcagcagcagcagcagcagcagccccaccgccgccaccagccagcagcagcagcugaagaacaagagcauccugaucagcagcguggccagcgugcaccacgccaacggccuggccaagagcagcaccaccgugagcagcuucgccaacagcaagcccggcagcgccaagaagcuggugaucaagaacuucaaggacaagcccaagcugcccgagaacuacaccgacgagaccuggcagaagcugaaggaggccguggaggccauccagaacagcaccagcaucaaguacaaccuggaggagcuguaccaggccguggagaaccugugcagcuacaagaucagcgccaaccuguacaagcagcugagacagaucugcgaggaccacaucaaggcccagauccaccaguucagagaggacagccuggacagcgugcuguuccugaagaagaucgacagaugcuggcagaaccacugcagacagaugaucaugaucagaagcaucuuccuguuccuggacagaaccuacgugcugcagaacagcaugcugcccagcaucugggacaugggccuggagcuguucagagcccacaucaucagcgaccagaaggugcagaacaagaccaucgacggcauccugcugcugaucgagagagagagaaacggcgaggccaucgacagaagccugcugagaagccugcugagcaugcugagcgaccugcagaucuaccaggacagcuucgagcagagauuccuggaggagaccaacagacuguacgccgccgagggccagaagcugaugcaggagagagaggugcccgaguaccugcaccacgugaacaagagacuggaggaggaggccgacagacugaucaccuaccuggaccagaccacccagaagagccugaucgccaccguggagaagcagcugcugggcgagcaccugaccgccauccugcagaagggccugaacaaccugcuggacgagaacagaauccaggaccugagccugcuguaccagcuguucagcagagugagaggcggcgugcaggugcugcugcagcaguggaucgaguacaucaaggccuucggcagcaccaucgugaucaaccccgagaaggacaagaccauggugcaggagcugcuggacuucaaggacaagguggaccacaucaucgacaucugcuuccugaagaacgagaaguucaucaacgccaugaaggaggccuucgagaccuucaucaacaagagacccaacaagcccgccgagcugaucgccaaguacguggacagcaagcugagagccggcaacaaggaggccaccgacgaggagcuggagaagaugcuggacaagaucaugaucaucuucagauucaucuacggcaaggacguguucgaggccuucuacaagaaggaccuggccaagagacugcuggugggcaagagcgccagcguggacgccgagaagagcaugcugagcaagcugaagcacgagugcggcgccgccuucaccagcaagcuggagggcauguucaaggacauggagcugagcaaggacaucaugauccaguucaagcaguacaugcagaaccagaacgugcccggcaacaucgagcugaccgugaacauccugaccaugggcuacuggcccaccuacgugcccauggaggugcaccugccccccgagauggugaagcugcaggagaucuucaagaccuucuaccugggcaagcacagcggcagaaagcugcaguggcagagcacccugggccacugcgugcugaaggccgaguucaaggagggcaagaaggagcugcaggugagccuguuccagacccuggugcugcugauguucaacgagggcgaggaguucagccuggaggagaucaagcaggccaccggcaucgaggacggcgagcugagaagaacccugcagagccuggccugcggcaaggccagagugcuggccaagaaccccaagggcaaggacaucgaggacggcgacaaguucaucugcaacgacgacuucaagcacaagcuguucagaaucaagaucaaccagauccagaugaaggagaccguggaggagcaggccagcaccaccgagagaguguuccaggacagacaguaccagaucgacgccgccaucgugagaaucaugaagaugagaaagacccugagccacaaccugcuggugagcgagguguacaaccagcugaaguuccccgugaagcccgccgaccugaagaagagaaucgagagccugaucgacagagacuacauggagagagacaaggagaaccccaaccaguacaacuacaucgccuaa

SEQ ID NO: 15797 - RNA, 2343 nt, Artificial Sequence
  CUL5__Homo_sapiens__NP_003469
auggccaccagcaaccugcugaagaacaagggcagccugcaguucgaggacaagugggacuucaugagacccaucgugcugaagcugcugagacaggagagcgugaccaagcagcagugguucgaccuguucagcgacgugcacgccgugugccugugggacgacaagggccccgccaagauccaccaggcccugaaggaggacauccuggaguucaucaagcaggcccaggccagagugcugagccaccaggacgacaccgcccugcugaaggccuacaucguggaguggagaaaguucuucacccagugcgacauccugcccaagcccuucugccagcuggagaucacccugaugggcaagcagggcagcaacaagaagagcaacguggaggacagcaucgugagaaagcugaugcuggacaccuggaacgagagcaucuucagcaacaucaagaacagacugcaggacagcgccaugaagcuggugcacgccgagagacugggcgaggccuucgacagccagcuggugaucggcgugagagagagcuacgugaaccugugcagcaaccccgaggacaagcugcagaucuacagagacaacuucgagaaggccuaccuggacagcaccgagagauucuacagaacccaggcccccagcuaccugcagcagaacggcgugcagaacuacaugaaguacgccgacgccaagcugaaggaggaggagaagagagcccugagauaccuggagaccagaagagagugcaacagcguggaggcccugauggagugcugcgugaacgcccuggugaccagcuucaaggagaccauccuggccgagugccagggcaugaucaagagaaacgagaccgagaagcugcaccugauguucagccugauggacaaggugcccaacggcaucgagcccaugcugaaggaccuggaggagcacaucaucagcgccggccuggccgacaugguggccgccgccgagaccaucaccaccgacagcgagaaguacguggagcagcugcugacccuguucaacagauucagcaagcuggugaaggaggccuuccaggacgaccccagauuccugaccgccagagacaaggccuacaaggccguggugaacgacgccaccaucuucaagcuggagcugccccugaagcagaagggcgugggccugaagacccagcccgagagcaagugccccgagcugcuggccaacuacugcgacaugcugcugagaaagaccccccugagcaagaagcugaccagcgaggagaucgaggccaagcugaaggaggugcugcuggugcugaaguacgugcagaacaaggacguguucaugagauaccacaaggcccaccugaccagaagacugauccuggacaucagcgccgacagcgagaucgaggagaacaugguggaguggcugagagaggugggcaugcccgccgacuacgugaacaagcuggccagaauguuccaggacaucaaggugagcgaggaccugaaccaggccuucaaggagaugcacaagaacaacaagcuggcccugcccgccgacagcgugaacaucaagauccugaacgccggcgccuggagcagaagcagcgagaagguguucgugagccugcccaccgagcuggaggaccugauccccgagguggaggaguucuacaagaagaaccacagcggcagaaagcugcacuggcaccaccugaugagcaacggcaucaucaccuucaagaacgaggugggccaguacgaccuggaggugaccaccuuccagcuggccgugcuguucgccuggaaccagagacccagagagaagaucagcuucgagaaccugaagcuggccaccgagcugcccgacgccgagcugagaagaacccuguggagccugguggccuuccccaagcugaagagacaggugcugcuguacgagccccaggugaacagccccaaggacuucaccgagggcacccuguucagcgugaaccaggaguucagccugaucaagaacgccaaggugcagaagagaggcaagaucaaccugaucggcagacugcagcugaccaccgagagaaugagagaggaggagaacgagggcaucgugcagcugagaauccugagaacccaggaggccaucauccagaucaugaagaugagaaagaagaucagcaacgcccagcugcagaccgagcugguggagauccugaagaacauguuccugccccagaagaagaugaucaaggagcagaucgaguggcugaucgagcacaaguacaucagaagagacgagagcgacaucaacaccuucaucuacauggccuaa

SEQ ID NO: 15798 - RNA, 5349 nt, Artificial Sequence
  CUL7__Homo_sapiens__NP_001161842
augagcagaggcuucuggcuggccgagccccuggccggcaccggcccccaccccgcccccguggccgccgacagcagaggcugcagcagcgugcccagaagacacgcccccagcagacugagcgugagcacccccagcagaggccccggcgccagaauggugggcgagcugagauacagagaguucagagugccccugggccccggccugcacgccuaccccgacgagcugaucagacagagagugggccacgacggccaccccgaguaccagaucagauggcugauccugagaagaggcgacgagggcgacggcggcagcggccagguggacugcaaggccgagcacauccugcuguggaugagcaaggacgagaucuacgccaacugccacaagaugcugggcgaggacggccaggugaucggccccagccaggagagcgccggcgaggugggcgcccuggacaagagcgugcuggaggagauggagaccgacgugaagagccugauccagagagcccugagacagcuggaggagugcgugggcaccaucccccccgccccccugcugcacaccgugcacgugcugagcgccuacgccagcaucgagccccugaccggcguguucaaggaccccagagugcuggaccugcugaugcacaugcugagcagccccgacuaccagaucagauggagcgccggcagaaugauccaggcccugagcagccacgacgccggcgagggccagugcggcgaggagggcaaggccggcgagggccugggcagacugagagacagccaggacaccguggccggcgccagcgaccugaucagaaccagaacccagauccugcugagccugagccagcaggaggccaucgagaagcaccuggacuucgacagcagaugcgcccugcuggcccuguucgcccaggccacccugagcgagcaccccaugagcuucgagggcauccagcugccccaggugcccggcagagugcuguucagccuggugaagagauaccugcacgugaccagccugcuggaccagcugaacgacagcgccgccgagcccggcgcccagaacaccagcgcccccgaggagcugagcggcgagagaggccagcuggagcuggaguucagcauggccaugggcacccugaucagcgagcuggugcaggccaugagaugggaccaggccagcgacagacccagaagcagcgccagaagccccggcagcaucuuccagccccagcuggccgacgugagccccggccugcccgccgcccaggcccagcccagcuucagaagaagcagaagauucagacccagaagcgaguucgccagcggcaacaccuacgcccuguacgugagagacacccugcagcccggcaugagagugagaaugcuggacgacuacgaggagaucagcgccggcgacgagggcgaguucagacagagcaacaacggcgugccccccgugcagguguucugggagagcaccggcagaaccuacugggugcacuggcacaugcuggagauccugggcuucgaggaggacaucgaggacaugguggaggccgacgaguaccagggcgccguggccagcagagugcugggcagagcccugcccgccuggagauggagacccaugaccgagcuguacgccgugcccuacgugcugcccgaggacgaggacaccgaggagugcgagcaccugacccuggccgaguggugggagcugcuguucuucaucaagaagcuggacggccccgaccaccaggaggugcugcagauccugcaggagaaccuggacggcgagauccuggacgacgagauccuggccgagcuggccgugcccaucgagcuggcccaggaccugcugcugacccugccccagagacugaacgacagcgcccugagagaccugaucaacugccacguguacaagaaguacggccccgaggcccuggccggcaaccaggccuaccccagccugcuggaggcccaggaggacgugcugcugcuggacgcccaggcccaggccaaggacagcgaggacgccgccaagguggaggccaaggagccccccagccagagccccaacaccccccugcagagacugguggagggcuacggccccgccggcaagauccugcuggaccuggagcaggcccugagcagcgagggcacccaggagaacaaggugaagccccugcugcugcagcugcagagacagccccagcccuuccuggcccugaugcagagccuggacacccccgagaccaacagaacccugcaccugaccgugcugagaauccugaagcagcugguggacuuccccgaggcccugcugcugcccuggcacgaggccguggacgccugcauggccugccugagaagccccaacaccgacagagaggugcugcaggagcugaucuucuuccugcacagacugaccagcgugagcagagacuacgccguggugcugaaccagcugggcgccagagacgccaucagcaaggcccuggagaagcaccugggcaagcuggagcuggcccaggagcugagagacaugguguucaagugcgagaagcacgcccaccuguacagaaagcugaucaccaacauccugggcggcugcauccagauggugcugggccagaucgaggaccacagaagaacccaccagcccaucaacauccccuucuucgacguguuccugagauaccugugccagggcagcagcguggaggugaaggaggacaagugcugggagaagguggaggugagcagcaacccccacagagccagcaagcugaccgaccacaaccccaagaccuacugggagagcaacggcagcgccggcagccacuacaucacccugcacaugagaagaggcauccugaucagacagcugacccugcugguggccagcgaggacagcagcuacaugcccgccagagugguggugugcggcggcgacagcaccagcagccugcacaccgagcugaacagcgugaacgugaugcccagcgccagcagagugauccugcuggagaaccugaccagauucuggcccaucauccagaucagaaucaagagaugccagcagggcggcaucgacaccagaaucagaggccuggagauccugggccccaagcccaccuucuggcccguguucagagagcagcugugcagacacaccagacuguucuacauggugagagcccaggccuggagccaggacauggccgaggacagaagaagccugcugcaccugagcagcagacugaacggcgcccugagacaggagcagaacuucgccgacagauuccugcccgacgacgaggccgcccaggcccugggcaagaccugcugggaggcccuggugagccccguggugcagaacaucaccagccccgacgaggacggcaucagcccccugggcuggcugcuggaccaguaccuggagugccaggaggccguguucaacccccagagcagaggccccgccuucuucagcagagugagaagacugacccaccugcuggugcacguggagcccugcgaggcccccccccccgugguggccacccccagacccaagggcagaaacagaagccacgacuggagcagccuggccaccagaggccugcccagcagcaucaugagaaaccugaccagaugcuggagagccgugguggagaagcaggugaacaacuuccugaccagcagcuggagagacgacgacuucgugcccagauacugcgagcacuucaacauccugcagaacagcagcagcgagcuguucggccccagagccgccuuccugcuggcccugcagaacggcugcgccggcgcccugcugaagcugcccuuccugaaggccgcccacgugagcgagcaguucgccagacacaucgaccagcagauccagggcagcagaaucggcggcgcccaggagauggagagacuggcccagcugcagcagugccugcaggccgugcugaucuucagcggccuggagaucgccaccaccuucgagcacuacuaccagcacuacauggccgacagacugcugggcguggugagcagcuggcuggagggcgccgugcuggagcagaucggccccugcuuccccaacagacugccccagcagaugcugcagagccugagcaccagcaaggagcugcagagacaguuccacguguaccagcugcagcagcuggaccaggagcugcugaagcuggaggacaccgagaagaagauccaggugggccugggcgccagcggcaaggagcacaagagcgagaaggaggaggaggccggcgccgccgccgugguggacguggccgagggcgaggaggaggaggaggagaacgaggaccuguacuacgagggcgccaugcccgaggugagcgugcuggugcugagcagacacagcuggcccguggccagcaucugccacacccugaaccccagaaccugccugcccagcuaccugagaggcacccugaacagauacagcaacuucuacaacaagagccagagccaccccgcccuggagagaggcagccagagaagacugcaguggaccuggcugggcugggccgagcugcaguucggcaaccagacccugcacgugagcaccgugcagauguggcugcugcuguaccugaacgaccugaaggccgugagcguggagagccugcuggccuucagcggccugagcgccgacaugcugaaccaggccaucggcccccugaccagcagcagaggcccccuggaccugcacgagcagaaggacauccccggcggcgugcugaagaucagagacggcagcaaggagcccagaagcagaugggacaucgugagacugauccccccccagaccuaccugcaggccgagggcgaggacggccagaaccuggagaagagaagaaaccugcugaacugccugaucgugagaauccugaaggcccacggcgacgagggccugcacaucgaccagcuggugugccuggugcuggaggccuggcagaagggccccugcccccccagaggccuggugagcagccugggcaagggcagcgccugcagcagcaccgacgugcugagcugcauccugcaccugcugggcaagggcacccugagaagacacgacgacagaccccaggugcugagcuacgccgugcccgugaccgugauggagccccacaccgagagccugaaccccggcagcagcggccccaaccccccccugaccuuccacacccugcagaucagaagcagaggcgugcccuacgccagcugcaccgccacccagagcuucagcaccuucagauaa

SEQ ID NO: 15799 - RNA, 7554 nt, Artificial Sequence
  CUL9__Homo_sapiens__NP_055904
auggugggcgagagacacgccggcgaccugauggugccccugggccccagacugcaggccuaccccgaggagcugaucagacagagacccggccacgacggccaccccgaguaccugaucagauggagcgugcugaagugcggcgaggugggcaaggugggcguggaggagggcaaggccgagcacauccugauguggcugagcgcccccgagguguacgccaacugccccggccugcugggcgagagagcccugagcaagggccugcagcacgagcccgccggcgugagcggcagcuuccccagagaccccggcggccuggacgagguggccaugggcgagauggaggccgacgugcaggcccuggugagaagagccgccagacagcuggccgagagcggcacccccagccugaccgccgccgugcugcacaccauccacgugcugagcgccuacgccagcaucggcccccugaccggcguguucagagagaccggcgcccuggaccugcugaugcacaugcugugcaaccccgagccccagaucagaagaagcgccggcaagaugcugcaggcccuggccgcccacgacgccggcagcagagcccacgugcugcugagccugagccagcaggacggcaucgagcagcacauggacuucgacagcagauacacccugcuggagcuguucgccgagaccaccagcagcgaggagcacugcauggccuucgagggcauccaccugccccagauccccggcaagcugcuguucagccuggugaagagauaccugugcgugaccagccugcuggaccagcugaacagcagccccgagcugggcgccggcgaccagagcagccccugcgccaccagagagaagagcagaggccagagagagcuggaguucagcauggccgugggcaaccugaucagcgagcuggugagaagcaugggcugggccagaaaccugagcgagcagggcaugagcccccccagacccaccagaagcaucuuccagcccuacaucagcggccccagccugcugcugcccaccaucgugaccacccccagaagacagggcuggguguucagacagagaagcgaguucagcagcagaagcggcuacggcgaguacgugcagcagacccugcagcccggcaugagagugagaaugcuggacgacuacgaggagaucagcgccggcgacgagggcgaguucagacagagcaacaacggcaucccccccgugcagguguucuggcagagcaccggcagaaccuacugggugcacuggcacaugcuggagauccugggccccgaggaggccaccgaggacaaggccagcgccgccguggagaagggcgccggcgccaccgugcugggcaccgccuuccccagcugggacuggaaccccauggacggccuguacccccugcccuaccugcagcccgagccccagaagaacgagagagugggcuaccugacccaggccgaguggugggagcugcuguucuucaucaagaagcuggaccugugcgagcagcagcccaucuuccagaaccuguggaagaaccuggacgagacccugggcgagaaggcccugggcgagaucagcgugagcguggagauggccgagagccugcugcaggugcugagcagcagauucgagggcagcacccugaacgaccugcugaacagccagaucuacaccaaguacggccugcugagcaacgagcccagcagcagcagcaccagcagaaaccacagcugcacccccgaccccgaggaggagagcaagagcgaggccagcuucagcgaggaggagaccgagagccugaaggccaaggccgaggcccccaagaccgaggccgagcccaccaagaccagaaccgagacccccauggcccagagcgacagccagcuguucaaccagcugcuggugaccgagggcaugacccugcccaccgagaugaaggaggccgccagcgagauggccagagcccugagaggccccggccccagaagcagccuggaccagcacguggccgccgugguggccaccgugcagaucagcagccuggacaccaaccugcagcugagcggccugagcgcccugagccaggccguggaggaggugaccgagagagaccacccccuggugagacccgacagaagccugagagagaagcuggugaagaugcugguggagcugcugaccaaccaggugggcgagaagauggugguggugcaggcccugagacugcuguaccugcugaugaccaagcacgaguggagaccccuguucgccagagagggcggcaucuacgccgugcuggugugcaugcaggaguacaagaccagcgugcuggugcagcaggccggccuggccgcccugaagaugcuggccguggccagcagcagcgagauccccaccuucgugaccggcagagacagcauccacagccuguucgacgcccagaugaccagagagaucuucgccagcaucgacagcgccaccagacccggcagcgagagccugcugcugaccgugcccgccgccgugauccugaugcugaacaccgagggcugcagcagcgccgccagaaacggccugcugcugcugaaccugcugcugugcaaccaccacacccugggcgaccagaucaucacccaggagcugagagacacccuguucagacacagcggcaucgcccccagaaccgagcccaugcccaccaccagaaccauccugaugaugcugcugaacagauacagcgagccccccggcagccccgagagagccgcccuggagacccccaucauccagggccaggacggcagccccgagcugcugaucagaagccuggugggcggccccagcgccgagcugcugcuggaccuggagagagugcugugcagagagggcagccccggcggcgccgugagaccccugcugaagagacugcagcaggagacccagcccuuccugcugcugcugagaacccuggacgcccccggccccaacaagacccugcugcugagcgugcugagagugaucaccagacugcuggacuuccccgaggccauggugcugcccuggcacgaggugcuggagcccugccugaacugccugagcggccccagcagcgacagcgagaucgugcaggagcugaccugcuuccugcacagacuggccagcaugcacaaggacuacgccguggugcugugcugccugggcgccaaggagauccugagcaaggugcuggacaagcacagcgcccagcugcugcugggcugcgagcugagagaccuggugaccgagugcgagaaguacgcccagcuguacagcaaccugaccagcagcauccuggccggcugcauccagauggugcugggccagaucgaggaccacagaagaacccaccagcccaucaacauccccuucuucgacguguuccugagacaccugugccagggcagcagcguggaggugaaggaggacaagugcugggagaagguggaggugagcagcaacccccacagagccagcaagcugaccgaccacaaccccaagaccuacugggagagcaacggcagcaccggcagccacuacaucacccugcacaugcacagaggcgugcuggugagacagcugacccugcugguggccagcgaggacagcagcuacaugcccgccagaguggugguguucggcggcgacagcaccagcugcaucggcaccgagcugaacaccgugaacgugaugcccagcgccagcagagugauccugcuggagaaccugaacagauucuggcccaucauccagaucagaaucaagagaugccagcagggcggcaucgacaccagagugagaggcguggaggugcugggccccaagcccaccuucuggccccuguucagagagcagcugugcagaagaaccugccuguucuacaccaucagagcccaggccuggagcagagacaucgccgaggaccacagaagacugcugcagcugugccccagacugaacagagugcugagacacgagcagaacuucgccgacagauuccugcccgacgacgaggccgcccaggcccugggcaagaccugcugggaggcccuggugagcccccuggugcagaacaucaccagccccgacgccgagggcgugagcgcccugggcuggcugcuggaccaguaccuggagcagagagagaccagcagaaacccccugagcagagccgccagcuucgccagcagagugagaagacugugccaccugcuggugcacguggagcccccccccggccccagccccgagcccagcaccagacccuucagcaagaacagcaagggcagagacagaagccccgcccccagccccgugcugcccagcagcagccugagaaacaucacccagugcuggcugagcguggugcaggagcaggugagcagauuccuggccgccgccuggagagcccccgacuucgugcccagauacugcaagcuguacgagcaccugcagagagccggcagcgagcuguucggccccagagccgccuucaugcuggcccugagaagcggcuucagcggcgcccugcugcagcagagcuuccugaccgccgcccacaugagcgagcaguucgccagauacaucgaccagcagauccagggcggccugaucggcggcgcccccggcguggagaugcugggccagcugcagagacaccuggagcccaucauggugcugagcggccuggagcuggccaccaccuucgagcacuucuaccagcacuacauggccgacagacugcugagcuucggcagcagcuggcuggagggcgccgugcuggagcagaucggccugugcuuccccaacagacugccccagcugaugcugcagagccugagcaccagcgaggagcugcagagacaguuccaccuguuccagcugcagagacuggacaagcuguuccuggagcaggaggacgaggaggagaagagacuggaggaggaggaggaggaggaggaggaggaggaggccgagaaggagcuguucaucgaggaccccagccccgccaucagcauccuggugcugagccccagaugcuggcccgugagcccccugugcuaccuguaccaccccagaaagugccugcccaccgaguucugcgacgcccuggacagauucagcagcuucuacagccagagccagaaccaccccgugcuggacaugggcccccacagaagacugcaguggaccuggcugggcagagccgagcugcaguucggcaagcagauccugcacgugagcaccgugcagauguggcugcugcugaaguucaaccagaccgaggaggugagcguggagacccugcugaaggacagcgaccugagccccgagcugcugcugcaggcccuggugccccugaccagcggcaacggcccccugacccugcacgagggccaggacuucccccacggcggcgugcugagacugcacgagcccggcccccagagaagcggcgaggcccuguggcugauccccccccaggccuaccugaacguggagaaggacgagggcagaacccuggagcagaagagaaaccugcugagcugccugcuggugagaauccugaaggcccacggcgagaagggccugcacaucgaccagcuggugugccuggugcuggaggccuggcagaagggccccaacccccccggcacccugggccacaccguggccggcggcguggccugcaccagcaccgacgugcugagcugcauccugcaccugcugggccagggcuacgugaagagaagagacgacagaccccagauccugauguacgccgcccccgagcccaugggccccugcagaggccaggccgacgugcccuucugcggcagccagagcgagaccagcaagcccagccccgaggccguggccacccuggccagccugcagcugcccgccggcagaaccaugagcccccaggagguggagggccugaugaagcagaccgugagacaggugcaggagacccugaaccuggagcccgacguggcccagcaccugcuggcccacagccacuggggcgccgagcagcugcugcagagcuacagcgaggaccccgagccccugcugcuggccgccggccugugcgugcaccaggcccaggccgugcccgugagacccgaccacugccccgugugcgugagcccccugggcugcgacgacgaccugcccagccugugcugcaugcacuacugcugcaagagcugcuggaacgaguaccugaccaccagaaucgagcagaaccuggugcugaacugcaccugccccaucgccgacugccccgcccagcccaccggcgccuucaucagagccaucgugagcagccccgaggugaucagcaaguacgagaaggcccugcugagaggcuacguggagagcugcagcaaccugaccuggugcaccaacccccagggcugcgacagaauccugugcagacagggccugggcugcggcaccaccugcagcaagugcggcugggccagcugcuucaacugcagcuuccccgaggcccacuaccccgccagcugcggccacaugagccaguggguggacgacggcggcuacuacgacggcaugagcguggaggcccagagcaagcaccuggccaagcugaucagcaagagaugccccagcugccaggcccccaucgagaagaacgagggcugccugcacaugaccugcgccaagugcaaccacggcuucugcuggagaugccugaagagcuggaagcccaaccacaaggacuacuacaacugcagcgccauggugagcaaggccgccagacaggagaagagauuccaggacuacaacgagagaugcaccuuccaccaccaggccagagaguucgccgugaaccugagaaacagagugagcgccauccacgaggugcccccccccagaagcuucaccuuccugaacgacgccugccagggccuggagcaggccagaaaggugcuggccuacgccugcguguacagcuucuacagccaggacgccgaguacauggacgugguggagcagcagaccgagaaccuggagcugcacaccaacgcccugcagauccugcuggaggagacccugcugagaugcagagaccuggccagcagccugagacugcugagagccgacugccugagcaccggcauggagcugcugagaagaauccaggagagacugcuggccauccugcagcacagcgcccaggacuucagagugggccugcagagccccagcguggaggccugggaggccaagggccccaacaugcccggcagccagccccaggccagcagcggccccgaggccgaggaggaggaggaggacgacgaggacgacgugcccgaguggcagcaggacgaguucgacgaggagcuggacaacgacagcuucagcuacgacgagagcgagaaccuggaccaggagaccuucuucuucggcgacgaggaggaggacgaggacgaggccuacgacuaa

SEQ ID NO: 15800 - RNA, 597 nt, Artificial Sequence
  CUTA__Homo_sapiens__NP_001014433
augaucggcagcggccuggccggcagcggcggcgccggcggccccagcagcaccgugaccuggugcgcccuguucagcaaccacguggccgccacccaggccagccugcugcugagcuucguguggaugcccgcccugcugcccguggccagcagacugcugcugcugcccagagugcugcugaccauggccagcggcagcccccccacccagcccagccccgccagcgacagcggcagcggcuacgugcccggcagcgugagcgccgccuucgugaccugccccaacgagaagguggccaaggagaucgccagagccgugguggagaagagacuggccgccugcgugaaccugaucccccagaucaccagcaucuacgaguggaagggcaagaucgaggaggacagcgaggugcugaugaugaucaagacccagagcagccuggugcccgcccugaccgacuucgugagaagcgugcaccccuacgagguggccgaggugaucgcccugcccguggagcagggcaacuuccccuaccugcagugggugagacaggugaccgagagcgugagcgacagcaucaccgugcugcccuaa

SEQ ID NO: 15801 - RNA, 4551 nt, Artificial Sequence
  CUX1__Homo_sapiens__NP_001189472
auggccgccaacgugggcagcauguuccaguacuggaagagauucgaccugcagcagcugcagagagagcuggacgccaccgccaccgugcuggccaacagacaggacgagagcgagcagagcagaaagagacugaucgagcagagcagagaguucaagaagaacacccccgaggaccugagaaagcagguggccccccugcugaagagcuuccagggcgagaucgacgcccugagcaagagaagcaaggaggccgaggccgccuuccugaacguguacaagagacugaucgacgugcccgaccccgugcccgcccuggaccugggccagcagcugcagcugaaggugcagagacugcacgacaucgagaccgagaaccagaagcugagagagacccuggaggaguacaacaaggaguucgccgaggugaagaaccaggaggugaccaucaaggcccugaaggagaagaucagagaguacgagcagacccugaagaaccaggccgagaccaucgcccuggagaaggagcagaagcugcagaacgacuucgccgagaaggagagaaagcugcaggagacccagaugagcaccaccagcaagcuggaggaggccgagcacaaggugcagagccugcagaccgcccuggagaagaccagaaccgagcuguucgaccugaagaccaaguacgacgaggagaccaccgccaaggccgacgagaucgagaugaucaugaccgaccuggagagagccaaccagagagccgagguggcccagagagaggccgagacccugagagagcagcugagcagcgccaaccacagccugcagcuggccagccagauccagaaggcccccgacguggagcaggccaucgaggugcugaccagaagcagccuggagguggagcuggccgccaaggagagagagaucgcccagcugguggaggacgugcagagacugcaggccagccugaccaagcugagagagaacagcgccagccagaucagccagcuggagcagcagcugagcgccaagaacagcacccugaagcagcuggaggagaagcugaagggccaggccgacuacgaggaggugaagaaggagcugaacauccugaagagcauggaguucgcccccagcgagggcgccggcacccaggacgccgccaagccccuggaggugcugcugcuggagaagaacagaagccugcagagcgagaacgccgcccugagaaucagcaacagcgaccugagcggcagcgccagaagaaagggcaaggaccagcccgagagcagaagacccggcagccugcccgcccccccccccagccagcugcccagaaaccccggcgagcaggccagcaacaccaacggcacccaccaguucagccccgccggccugagccaggacuucuucagcagcagccuggccagccccagccugccccuggccagcaccggcaaguucgcccugaacagccugcugcagagacagcugaugcagagcuucuacagcaaggccaugcaggaggccggcagcaccagcaugaucuucagcaccggccccuacagcaccaacagcaucagcagccagagcccccugcagcagagccccgacgugaacggcauggcccccagccccagccagagcgagagcgccggcagcgugagcgagggcgaggagauggacaccgccgagaucgccagacaggugaaggagcagcugaucaagcacaacaucggccagagaaucuucggccacuacgugcugggccugagccagggcagcgugagcgagauccuggccagacccaagcccuggaacaagcugaccgugagaggcaaggagcccuuccacaagaugaagcaguuccugagcgacgagcagaacauccuggcccugagaagcauccagggcagacagagagagaaccccggccagagccugaacagacuguuccaggaggugcccaagagaagaaacggcagcgagggcaacaucaccaccagaaucagagccagcgagaccggcagcgacgaggccaucaagagcauccuggagcaggccaagagagagcugcaggugcagaagaccgccgagcccgcccagcccagcagcgccagcggcagcggcaacagcgacgacgccaucagaagcauccugcagcaggccagaagagagauggaggcccagcaggccgcccuggaccccgcccugaagcaggccccccugagccagagcgacaucaccauccugacccccaagcugcugagcaccagccccaugcccaccgugagcagcuaccccccccuggccaucagccugaagaagcccagcgccgcccccgaggccggcgccagcgcccugcccaacccccccgcccugaagaaggaggcccaggacgcccccggccuggacccccagggcgccgccgacugcgcccagggcgugcugagacaggugaagaacgaggugggcagaagcggcgccuggaaggaccacugguggagcgccgugcagcccgagagaagaaacgccgccagcagcgaggaggccaaggccgaggagaccggcggcggcaaggagaagggcagcggcggcagcggcggcggcagccagcccagagccgagagaagccagcugcagggccccagcagcagcgaguacuggaaggaguggcccagcgccgagagccccuacagccagagcagcgagcugagccugaccggcgccagcagaagcgagaccccccagaacagcccccugcccagcagccccaucgugcccaugagcaagcccaccaagcccagcgugcccccccugacccccgagcaguacgagguguacauguaccaggagguggacaccaucgagcugaccagacaggugaaggagaagcuggccaagaacggcaucugccagagaaucuucggcgagaaggugcugggccugagccagggcagcgugagcgacaugcugagcagacccaagcccuggagcaagcugacccagaagggcagagagcccuucaucagaaugcagcuguggcugaacggcgagcugggccagggcgugcugcccgugcagggccagcagcagggccccgugcugcacagcgugaccagccugcaggacccccugcagcagggcugcgugagcagcgagagcacccccaagaccagcgccagcugcagccccgcccccgagagccccaugagcagcagcgagagcgugaagagccugaccgagcuggugcagcagcccugcccccccaucgaggccagcaaggacagcaagccccccgagcccagcgacccccccgccagcgacagccagcccaccaccccccugccccugagcggccacagcgcccugagcauccaggagcugguggccaugagccccgagcuggacaccuacggcaucaccaagagagugaaggaggugcugaccgacaacaaccugggccagagacuguucggcgagaccauccugggccugacccagggcagcgugagcgaccugcuggccagacccaagcccuggcacaagcugagccugaagggcagagagcccuucgugagaaugcagcuguggcugaacgaccccaacaacguggagaagcugauggacaugaagagaauggagaagaaggccuacaugaagagaagacacagcagcgugagcgacagccagcccugcgagccccccagcgugggcaccgaguacagccagggcgccagcccccagccccagcaccagcugaagaagcccagaguggugcuggcccccgaggagaaggaggcccugaagagagccuaccagcagaagcccuaccccagccccaagaccaucgaggaccuggccacccagcugaaccugaagaccagcaccgugaucaacugguuccacaacuacagaagcagaaucagaagagagcuguucaucgaggagauccaggccggcagccagggccaggccggcgccagcgacagccccagcgccagaagcggcagagccgcccccagcagcgagggcgacagcugcgacggcguggaggccaccgagggccccggcagcgccgacaccgaggagcccaagagccagggcgaggccgagagagaggaggugcccagacccgccgagcagaccgagcccccccccagcggcacccccggccccgacgacgccagagacgacgaccacgagggcggccccguggagggccccggcccccugcccagccccgccagcgccaccgccaccgccgcccccgccgcccccgaggacgccgccaccagcgccgccgccgcccccggcgagggccccgccgcccccagcagcgcccccccccccagcaacagcagcagcagcagcgcccccagaagacccagcagccugcagagccuguucggccugcccgaggccgccggcgccagagacagcagagacaacccccugagaaagaagaaggccgccaaccugaacagcaucauccacagacuggagaaggccgccagcagagaggagcccaucgagugggaguucuaa

SEQ ID NO: 15802 - RNA, 4461 nt, Artificial Sequence
  CUX2__Homo_sapiens__NP_056082
auggccgccaacgugggcagcauguuccaguacuggaagagauucgaccugagaagacugcagaaggagcugaacagcguggccagcgagcugagcgccagacaggaggagagcgagcacagccacaagcaccugaucgagcugagaagagaguucaagaagaacgugcccgaggagaucagagagaugguggcccccgugcugaagagcuuccaggccgaggugguggcccugagcaagagaagccaggaggccgaggccgccuuccugagcguguacaagcagcugaucgaggcccccgaccccgugcccguguucgaggccgccagaagccuggacgacagacugcagccccccagcuucgaccccagcggccagcccagaagagaccugcacaccagcuggaagagaaaccccgagcugcugagccccaaggagcagagagagggcaccagccccgccggccccacccugaccgagggcagcagacugcccggcauccccggcaaggcccugcugaccgagacccugcugcagagaaacgaggccgagaagcagaagggccugcaggaggugcagaucacccuggccgccagacugggcgaggccgaggagaagaucaaggugcugcacagcgcccugaaggccacccaggccgagcugcuggagcugagaagaaaguacgacgaggaggccgccagcaaggccgacgaggugggccugaucaugaccaaccuggagaaggccaaccagagagccgaggccgcccagagagagguggagagccugagagagcagcuggccagcgugaacagcagcaucagacuggccugcugcagcccccagggccccagcggcgacaaggugaacuucacccugugcagcggccccagacuggaggccgcccuggccagcaaggacagagagauccugagacugcugaaggacgugcagcaccugcagagcagccugcaggagcuggaggaggccagcgccaaccagaucgccgaccuggagagacagcugaccgccaagagcgaggccaucgagaagcuggaggagaagcugcaggcccagagcgacuacgaggagaucaagaccgagcugagcauccugaaggccaugaagcuggccagcagcaccugcagccugccccagggcauggccaagcccgaggacagccugcugaucgccaaggaggccuucuuccccacccagaaguuccugcuggagaagcccagccugcuggccagccccgaggaggaccccagcgaggacgacagcaucaaggacagccugggcaccgagcagagcuaccccagcccccagcagcugccccccccccccggccccgaggacccccugagccccagccccggccagccccugcugggccccagccugggccccgacggcaccagaaccuucagccugagccccuuccccagccuggccagcggcgagagacugaugaugccccccgccgccuucaagggcgaggccggcggccugcugguguucccccccgccuucuacggcgccaagccccccaccgcccccgccacccccgcccccggccccgagccccugggcggccccgagcccgccgacggcggcggcggcggcgccgccggccccggcgccgaggaggagcagcuggacaccgccgagaucgccuuccaggugaaggagcagcugcugaagcacaacaucggccagagaguguucggccacuacgugcugggccugagccagggcagcgugagcgagauccuggccagacccaagcccuggagaaagcugaccgugaagggcaaggagcccuucaucaagaugaagcaguuccugagcgacgagcagaacgugcuggcccugagaaccauccaggugagacagagaggcagcaucacccccagaaucagaacccccgagaccggcagcgacgacgccaucaagagcauccuggagcaggccaagaaggagaucgagagccagaagggcggcgagcccaagaccagcguggccccccugagcaucgccaacggcaccacccccgccagcaccagcgaggacgccaucaagagcauccuggagcaggccagaagagagaugcaggcccagcagcaggcccugcuggagauggagguggcccccagaggcagaagcgugccccccagcccccccgagagacccagccuggccaccgccagccagaacggcgcccccgcccuggugaagcaggaggagggcagcggcggccccgcccaggccccccugcccgugcugagccccgccgccuucgugcagagcaucaucagaaaggugaagagcgagaucggcgacgccggcuacuucgaccaccacugggccagcgacagaggccugcugagcagacccuacgccagcgugagccccagccugagcagcagcagcagcagcggcuacagcggccagcccaacggcagagccuggcccagaggcgacgaggcccccgugccccccgaggacgaggccgccgccggcgccgaggacgagccccccagaaccggcgagcugaaggccgagggcgccaccgccgaggccggcgccagacugcccuacuaccccgccuacgugcccagaacccugaagcccaccgugcccccccugacccccgagcaguacgagcuguacauguacagagagguggacacccuggagcugaccagacaggugaaggagaagcuggccaagaacggcaucugccagagaaucuucggcgagaaggugcugggccugagccagggcagcgugagcgacaugcugagcagacccaagcccuggagcaagcugacccagaagggcagagagcccuucaucagaaugcagcuguggcugagcgaccagcugggccaggccgugggccagcagcccggcgccagccaggccagccccaccgagcccagaagcagccccagccccccccccagccccaccgagcccgagaagagcagccaggagccccugagccugagccuggagagcagcaaggagaaccagcagcccgagggcagaagcagcagcagccugagcggcaagauguacagcggcagccaggcccccggcggcauccaggagaucguggccaugagccccgagcuggacaccuacagcaucaccaagagagugaaggaggugcugaccgacaacaaccugggccagagacuguucggcgagagcauccugggccugacccagggcagcgugagcgaccugcugagcagacccaagcccuggcacaagcugagccugaagggcagagagcccuucgugagaaugcagcuguggcugaacgacccccacaacguggagaagcugagagacaugaagaagcuggagaagaaggccuaccugaagagaagauacggccugaucagcaccggcagcgacagcgagagccccgccaccagaagcgagugccccagccccugccugcagccccaggaccugagccugcugcagaucaagaagcccagaguggugcuggcccccgaggagaaggaggcccugagaaaggccuaccagcuggagcccuaccccagccagcagaccaucgagcugcugagcuuccagcugaaccugaagaccaacaccgugaucaacugguuccacaacuacagaagcagaaugagaagagagaugcugguggagggcacccaggacgagcccgaccuggaccccagcggcggccccggcauccugccccccggccacagccaccccgaccccaccccccagagccccgacagcgagaccgaggaccagaagcccaccgugaaggagcuggagcugcaggagggccccgaggagaacagcaccccccugaccacccaggacaaggcccaggugagaaucaagcaggagcagauggaggaggacgccgaggaggaggccggcagccagccccaggacagcggcgagcuggacaagggccagggcccccccaaggaggagcaccccgacccccccggcaacgacggccugcccaagguggcccccggcccccugcugcccggcggcagcacccccgacugccccagccugcacccccagcaggagagcgaggccggcgagagacugcaccccgacccccugagcuucaagagcgccagcgagagcagcagaugcagccuggaggugagccugaacagccccagcgccgccagcagccccggccugaugaugagcgugagccccgugcccagcagcagcgcccccaucagccccagcccccccggcgccccccccgccaaggugcccagcgccagccccaccgccgacauggccggcgcccugcaccccagcgccaaggugaaccccaaccugcagagaagacacgagaagauggccaaccugaacaacaucaucuacagaguggagagagccgccaacagagaggaggcccuggagugggaguucuaa

SEQ ID NO: 15803 - RNA, 1824 nt, Artificial Sequence
  CUZD1__Homo_sapiens__NP_071317
auggagcuggugagaagacugaugccccugacccugcugauccugagcugccuggccgagcugaccauggccgaggccgagggcaacgccagcugcaccgugagccugggcggcgccaacauggccgagacccacaaggccaugauccugcagcugaaccccagcgagaacugcaccuggaccaucgagagacccgagaacaagagcaucagaaucaucuucagcuacgugcagcuggaccccgacggcagcugcgagagcgagaacaucaagguguucgacggcaccagcagcaacggcccccugcugggccaggugugcagcaagaacgacuacgugcccguguucgagagcagcagcagcacccugaccuuccagaucgugaccgacagcgccagaauccagagaaccguguucguguucuacuacuucuucagccccaacaucagcauccccaacugcggcggcuaccuggacacccuggagggcagcuucaccagccccaacuaccccaagccccaccccgagcuggccuacugcguguggcacauccagguggagaaggacuacaagaucaagcugaacuucaaggagaucuuccuggagaucgacaagcagugcaaguucgacuuccuggccaucuacgacggccccagcaccaacagcggccugaucggccaggugugcggcagagugacccccaccuucgagagcagcagcaacagccugaccguggugcugagcaccgacuacgccaacagcuacagaggcuucagcgccagcuacaccagcaucuacgccgagaacaucaacaccaccagccugaccugcagcagcgacagaaugagagugaucaucagcaagagcuaccuggaggccuucaacagcaacggcaacaaccugcagcugaaggaccccaccugcagacccaagcugagcaacgugguggaguucagcgugccccugaacggcugcggcaccaucagaaagguggaggaccagagcaucaccuacaccaacaucaucaccuucagcgccagcagcaccagcgaggugaucaccagacagaagcagcugcagaucaucgugaagugcgagaugggccacaacagcaccguggagaucaucuacaucaccgaggacgacgugauccagagccagaacgcccugggcaaguacaacaccagcauggcccuguucgagagcaacagcuucgagaagaccauccuggagagccccuacuacguggaccugaaccagacccuguucgugcaggugagccugcacaccagcgaccccaaccuggugguguuccuggacaccugcagagccagccccaccagcgacuucgccagccccaccuacgaccugaucaagagcggcugcagcagagacgagaccugcaagguguacccccuguucggccacuacggcagauuccaguucaacgccuucaaguuccugagaagcaugagcagcguguaccugcagugcaaggugcugaucugcgacagcagcgaccaccagagcagaugcaaccagggcugcgugagcagaagcaagagagacaucagcagcuacaaguggaagaccgacagcaucaucggccccaucagacugaagagagacagaagcgccagcggcaacagcggcuuccagcacgagacccacgccgaggagacccccaaccagcccuucaacagcgugcaccuguucagcuucauggugcuggcccugaacguggugaccguggccaccaucaccgugagacacuucgugaaccagagagccgacuacaaguaccagaagcugcagaacuacuaa

SEQ ID NO: 15804 - RNA, 2727 nt, Artificial Sequence
  CWC22__Homo_sapiens__NP_065994
augaagagcagcguggcccagaucaagcccagcagcggccacgacagaagagagaaccugaacagcuaccagagaaacagcagccccgaggacagauacgaggagcaggagagaagccccagagacagagacuacuucgacuacagcagaagcgacuacgagcacagcagaagaggcagaagcuacgacagcagcauggagagcagaaacagagacagagagaagagaagagagagagagagagacaccgacagaaagagaagcagaaagagccccagccccggcagaagaaaccccgagaccagcgugacccagagcagcagcgcccaggacgagcccgccaccaagaagaagaaggacgagcuggacccccugcugaccagaaccggcggcgccuacaucccccccgccaagcugagaaugaugcaggagcagaucaccgacaagaacagccuggccuaccagagaaugagcugggaggcccugaagaagagcaucaacggccugaucaacaaggugaacaucagcaacaucagcaucaucauccaggagcugcugcaggagaacaucgugagaggcagaggccugcugagcagaagcgugcugcaggcccagagcgccagccccaucuucacccacguguacgccgcccugguggccaucaucaacagcaaguucccccagaucggcgagcugauccugaagagacugauccugaacuucagaaagggcuacagaagaaacgacaagcagcugugccugaccgccagcaaguucguggcccaccugaucaaccagaacguggcccacgaggugcugugccuggagaugcugacccugcugcuggagagacccaccgacgacagcguggagguggccaucggcuuccugaaggagugcggccugaagcugacccaggugagccccagaggcaucaacgccaucuucgagagacugagaaacauccugcacgagagcgagaucgacaagagagugcaguacaugaucgaggugauguucgccgugagaaaggacggcuucaaggaccaccccaucauccuggagggccuggaccugguggaggaggacgaccaguucacccacaugcugccccuggaggacgacuacaaccccgaggacgugcugaacguguucaagauggaccccaacuucauggagaacgaggagaaguacaaggccaucaagaaggagauccuggacgagggcgacaccgacagcaacaccgaccaggacgccggcagcagcgaggaggacgaggaggaggaggaggaggagggcgaggaggacgaggagggccagaaggugaccauccacgacaagaccgagaucaaccuggugagcuucagaagaaccaucuaccuggccauccagagcagccuggacuucgaggagugcgcccacaagcugcugaagauggaguuccccgagagccagaccaaggagcugugcaacaugauccuggacugcugcgcccagcagagaaccuacgagaaguucuucggccugcuggccggcagauucugcaugcugaagaaggaguacauggagagcuucgagggcaucuucaaggagcaguacgacaccauccacagacuggagaccaacaagcugagaaacguggccaagauguucgcccaccugcuguacaccgacagccugcccuggagcgugcuggagugcaucaagcugagcgaggagaccaccaccagcagcagcagaaucuucgugaagaucuucuuccaggagcugugcgaguacaugggccugcccaagcugaacgccagacugaaggacgagacccugcagcccuucuucgagggccugcugcccagagacaaccccagaaacaccagauucgccaucaacuucuucaccagcaucggccugggcggccugaccgacgagcugagagagcaccugaagaacacccccaaggugaucguggcccagaagcccgacguggagcagaacaagagcagccccagcagcagcagcagcgccagcagcagcagcgagagcgacagcagcgacagcgacagcgacagcagcgacagcagcagcgagagcagcagcgaggagagcgacagcagcagcaucagcagccacagcagcgccagcgccaacgacgugagaaagaagggccacggcaagaccagaagcaaggagguggacaagcugaucagaaaccagcagaccaacgacagaaagcagaaggagagaagacaggagcacggccaccaggagaccagaaccgagagagagagaagaagcgagaagcacagagaccagaacagcagcggcagcaacuggagagaccccaucaccaaguacaccagcgacaaggacgugcccagcgagagaaacaacuacagcagaguggccaacgacagagaccaggagaugcacaucgaccuggagaacaagcacggcgaccccaagaagaagagaggcgagagaagaaacagcuucagcgagaacgagaagcacacccacagaaucaaggacagcgagaacuucagaagaaaggacagaagcaagagcaaggagaugaacagaaagcacagcggcagcagaagcgacgaggacagauaccagaacggcgccgagagaagaugggagaagagcagcagauacagcgagcagagcagagagagcaagaagaaccaggacagaagaagagagaagagccccgccaagcagaaguaa

SEQ ID NO: 15805 - RNA, 1176 nt, Artificial Sequence
  CWC27__Homo_sapiens__NP_001284573
augagcaacaucuacauccaggagccccccaccaacggcaaggugcugcugaagaccaccgccggcgacaucgacaucgagcuguggagcaaggaggcccccaaggccugcagaaacuucauccagcugugccuggaggccuacuacgacaacaccaucuuccacagaguggugcccggcuucaucgugcagggcggcgaccccaccggcaccggcagcggcggcgagagcaucuacggcgcccccuucaaggacgaguuccacagcagacugagauucaacagaagaggccugguggccauggccaacgccggcagccacgacaacggcagccaguucuucuucacccugggcagagccgacgagcugaacaacaagcacaccaucuucggcaaggugaccggcgacaccguguacaacaugcugagacugagcgagguggacaucgacgacgacgagagaccccacaacccccacaagaucaagagcugcgaggugcuguucaaccccuucgacgacaucauccccagagagaucaagagacugaagaaggagaagcccgaggaggaggugaagaagcugaagcccaagggcaccaagaacuucagccugcugagcuucggcgaggaggccgaggaggaggaggaggaggugaacagagugagccagagcaugaagggcaagagcaagagcagccacgaccugcugaaggacgacccccaccugagcagcgugcccgugguggagagcgagaagggcgacgcccccgaccugguggacgacggcgaggacgagagcgccgagcacgacgaguacaucgacggcgacgagaagaaccugaugagagagagaaucgccaagaagcugaagaaggacaccagcgccaacgugaagagcgccggcgagggcgagguggagaagaagagcgugagcagaagcgaggagcugagaaaggaggccagacagcugaagagagagcugcuggccgccaagcagaagaagguggagaacgccgccaagcaggccgagaagagaagcgaggaggaggaggccccccccgacggcgccguggccgaguacagaagagagaagcagaaguacgaggcccugagaaagcagcagagcaagaagggcaccagcagagaggaccaggacgugaccugcaccagcguguaa

SEQ ID NO: 15806 - RNA, 1497 nt, Artificial Sequence
  CWF19L1__Homo_sapiens__NP_001290333
auggcccagaagccccugagacugcuggccugcggcgacguggagggcaaguucgacauccuguucaacagagugcaggccauccagaagaagagcggcaacuucgaccugcugcugugcgugggcaacuucuucggcagcacccaggacgccgagugggaggaguacaagaccggcaucaagaaggcccccauccagaccuacgugcugggcgccaacaaccaggagaccgugaaguacuuccaggacgccgacggcugcgagcuggccgagaacaucaccuaccugggcagaaagggcaucuucaccggcagcagcggccugcagaucguguaccugagcggcaccgagagccugaacgagcccgugcccggcuacagcuucagccccaaggacgugagcagccugagaaugaugcugugcaccaccagccaguucaagggcguggacauccugcugaccagccccuggcccaagugcgugggcaacuucggcaacagcagcggcgagguggacaccaagaagugcggcagcgcccuggugagcagccuggccaccggccugaagcccagauaccacuucgccgcccuggagaagaccuacuacgagagacugcccuacagaaaccacaucauccugcaggagaacgcccagcacgccaccagauucaucgcccuggccaacgugggcaaccccgagaagaagaaguaccuguacgccuucagcaucgugcccaugaagcugauggacgccgccgagcuggugaagcagccccccgacgugaccgagaaccccuacagaaagagcggccaggaggccagcaucggcaagcagauccuggcccccguggaggagagcgccugccaguucuucuucgaccugaacgagaagcagggcagaaagagaagcagcaccggcagagacagcaagagcagcccccaccccaagcagcccagaaagcccccccagccccccggccccugcugguucugccuggccagccccgagguggagaagcaccugguggugaacaucggcacccacugcuaccuggcccuggccaagggcggccugagcgacgaccacgugcugauccugcccaucggccacuaccagagcgugguggagcugagcgccgaggugguggaggagguggagaaguacaaggccacccugagaagauucuucaagagcagaggcaaguggugcgugguguucgagagaaacuacaagagccaccaccugcagcugcagaucgcccagcccggcgccgccuacuucuacguggagcuggacaccggcgagaagcuguuccacagaaucaagaagaacuucccccugcaguucggcagagaggugcuggccagcgaggccauccugaacgugcccgacaagagcgacuggagacagugccagaucagcaaggaggacgaggagacccuggccagaagauucagaaaggacuucgagcccuacgacuucacccuggacgacuaa

SEQ ID NO: 15807 - RNA, 2685 nt, Artificial Sequence
  CWF19L2__Homo_sapiens__NP_689647
auggccaccagcauggccgccgccagcggcagauucgagagcgccaagagcaucgaggagagaaaggagcagaccagaaacgccagagccgaggugcugagacaggccaaggccaacuucgagaaggaggagagaagaaaggagcugaagagacugagaggcgaggacaccuggaugcugcccgacgugaacgagagaaucgagcaguucagccaggagcacagcgugaagaagaagaagaagaaggacaagcacagcaagaaggccaagaaggagaagaagaagaagagcaagaagcagaaguacgagaagaacaacgagagcagcgacagcagcagcagcagcgaggacgaguggguggaggccgugcccagccagacccccgacaaggagaaggccuggaaggugaaggacgagaagagcggcaaggacgacacccagaucaucaagagagacgaguggaugaccguggacuucaugagcgugaagaccgugagcagcagcagccugaaggccgagaaggagaccaugagaaagaucgagcaggagaagaaccaggcccuggagcagagcaagcugauggagagagagcugaaccccuacuggaaggacggcggcaccggccugccccccgaggacugcagcgugagcagcaucaccaaggugagcgugguggaggacggcggccugagcuggcugagaaagagcuaccugagaaugaaggagcaggccgagaagcagagcagaaacuucgaggacaucguggccgagagauacggcagcauggagaucuuccagagcaagcuggaggacgccgagaaggccgccagcaccaaggaggacuacagaagagagagauggagaaagcccaccuacagcgacaaggcccagaacugccaggagagcagagagagcgaccuggugaaguacggcaacagcagcagagacagauacgccaccaccgacaccgccaagaacagcaacaacgagaaguucaucggcgacgagaaggacaagagacccggcagccuggagaccugcagaagagagagcaaccccagacagaaccaggaguucagcuucggcaaccugagagccaaguuccugagacccagcgacgacgaggagcugagcuuccacagcaagggcagaaaguucgagccccugagcagcagcagcgcccugguggcccagggcagccugugcagcggcuucagaaagcccaccaagaacagcgaggagagacugaccagcuggagcagaagcgacggcagaggcgacaagaagcacagcaaccagaagcccagcgagaccagcaccgacgagcaccagcacgugcccgaggaccccagagagaagagccaggacgaggugcugagagacgacccccccaagaaggagcaccugagagacaccaagagcaccuucgccggcagccccgagagagagagcauccacauccugagcguggacgagaagaacaagcugggcgccaagaucaucaaggccgagaugaugggcaacauggagcuggccgagcagcugaaggugcagcuggagaaggccaacaaguucaaggagaccaucacccagauccccaagaagagcggcguggagaacgaggaccagcaggaggugauccuggugagaaccgaccagagcggcagaguguggcccgugaacacccccggcaagagccuggagagccagggcggcagaagaaagagacagauggugagcacccacgaggagagagagagagugagauacuuccacgacgacgacaaccugagccugaacgaccuggugaagaacgagaagaugggcaccgccgagaaccagaacaagcuguucaugagaauggccagcaaguucaugggcaagaccgacggcgacuacuacacccuggacgacauguucgugagcaaggccgccgagagagagagacugggcgaggaggaggagaaccagagaaagaaggccaucgccgagcacagaagccuggccgcccagauggagaagugccuguacugcuucgacagcagccaguuccccaagcaccugaucguggccaucggcgugaagguguaccugugccugcccaacgugagaagccugaccgagggccacugccugaucgugccccugcagcaccacagagccgccacccugcuggacgaggacaucugggaggagauccagauguucagaaagagccuggugaagauguucgaggacaagggccuggacugcaucuuccuggagaccaacaugagcaugaagaagcaguaccacaugguguacgagugcaucccccugcccaaggaggugggcgacauggcccccaucuacuucaagaaggccaucauggagagcgacgaggaguggagcaugaacaagaagcugaucgaccugagcagcaaggacaucagaaagagcgugcccagaggccugcccuacuucagcguggacuucggccugcacggcggcuucgcccacgugaucgaggaccagcacaaguucccccacuacuucggcaaggagaucaucggcggcaugcuggacaucgagcccagacuguggagaaagggcaucagagagagcuucgaggaccagagaaagaaggcccugcaguucgcccagugguggaagcccuacgacuucaccaagagcaagaacuacuaa

SEQ ID NO: 15808 - RNA, 2100 nt, Artificial Sequence
  CWH43__Homo_sapiens__NP_079363
augcccagccuguggagagagauccugcuggagagccugcugggcugcgugagcuggagccuguaccacgaccugggccccaugaucuacuacuucccccugcagacccuggagcugaccggccuggagggcuucagcaucgccuuccugagccccaucuuccugaccaucacccccuucuggaagcuggugaacaagaaguggaugcugacccugcugagaaucaucaccaucggcagcaucgccagcuuccaggcccccaacgccaagcugagacugauggugcuggcccugggcgugagcagcagccugaucgugcaggccgugaccugguggagcggcagccaccugcagagauaccugagaaucuggggcuucauccugggccagaucgugcugguggugcugagaaucugguacaccagccugaaccccaucuggagcuaccagaugagcaacaaggugauccugacccugagcgccaucgccacccuggacagaaucggcaccgacggcgacugcagcaagcccgaggagaagaagaccggcgagguggccaccggcauggccagcagacccaacuggcugcuggccggcgccgccuucggcagccugguguuccugacccacuggguguucggcgaggugagccuggugagcagaugggccgugagcggccacccccaccccggccccgaccccaaccccuucggcggcgccgugcugcugugccuggccagcggccugaugcugcccagcugccugugguucagaggcaccggccugaucuggugggugaccggcaccgccagcgccgccggccugcuguaccugcacaccugggccgccgccgugagcggcugcguguucgccaucuucaccgccagcauguggccccagacccugggccaccugaucaacagcggcaccaaccccggcaagaccaugaccaucgccaugaucuucuaccugcuggagaucuucuucugcgccuggugcaccgccuucaaguucgugcccggcggcguguacgccagagagagaagcgacgugcugcugggcaccaugaugcugaucaucggccugaacaugcuguucggccccaagaagaaccuggaccugcugcugcagaccaagaacagcagcaaggugcuguucagaaagagcgagaaguacaugaagcuguuccuguggcugcuggugggcgugggccugcugggccugggccugagacacaaggccuacgagagaaagcugggcaagguggcccccaccaaggaggugagcgccgccaucuggcccuucagauucggcuacgacaacgagggcuggagcagccuggagagaagcgcccaccugcugaacgagaccggcgccgacuucaucaccauccuggagagcgacgccagcaagcccuacaugggcaacaacgaccugaccauguggcugggcgagaagcugggcuucuacaccgacuucggccccagcaccagauaccacaccuggggcaucauggcccugagcagauaccccaucgugaagagcgagcaccaccugcugcccagccccgagggcgagaucgcccccgccaucacccugaccgugaacaucagcggcaagcugguggacuucguggugacccacuucggcaaccacgaggacgaccuggacagaaagcugcaggccaucgccgugagcaagcugcugaagagcagcagcaaccaggugaucuuccugggcuacaucaccagcgcccccggcagcagagacuaccugcagcugaccgagcacggcaacgugaaggacaucgacagcaccgaccacgacagauggugcgaguacaucauguacagaggccugaucagacugggcuacgccagaaucagccacgccgagcugagcgacagcgagauccagauggccaaguucagaauccccgacgaccccaccaacuacagagacaaccagaagguggugaucgaccacagagaggugagcgagaagauccacuucaaccccagauucggcagcuacaaggagggccacaacuacgagaacaaccaccacuuccacaugaacacccccaaguacuuccuguaa

SEQ ID NO: 15809 - RNA, 1194 nt, Artificial Sequence
  CX3CL1__Homo_sapiens__NP_002987
auggcccccaucagccugagcuggcugcugagacuggccaccuucugccaccugaccgugcugcuggccggccagcaccacggcgugaccaagugcaacaucaccugcagcaagaugaccagcaagauccccguggcccugcugauccacuaccagcagaaccaggccagcugcggcaagagagccaucauccuggagaccagacagcacagacuguucugcgccgaccccaaggagcagugggugaaggacgccaugcagcaccuggacagacaggccgccgcccugaccagaaacggcggcaccuucgagaagcagaucggcgaggugaagcccagaaccacccccgccgccggcggcauggacgagagcguggugcuggagcccgaggccaccggcgagagcagcagccuggagcccacccccagcagccaggaggcccagagagcccugggcaccagccccgagcugcccaccggcgugaccggcagcagcggcaccagacugccccccacccccaaggcccaggacggcggccccgugggcaccgagcuguucagagugccccccgugagcaccgccgccaccuggcagagcagcgccccccaccagcccggccccagccugugggccgaggccaagaccagcgaggcccccagcacccaggaccccagcacccaggccagcaccgccagcagccccgcccccgaggagaacgcccccagcgagggccagagaguguggggccagggccagagccccagacccgagaacagccuggagagagaggagaugggccccgugcccgcccacaccgacgccuuccaggacuggggccccggcagcauggcccacgugagcguggugcccgugagcagcgagggcacccccagcagagagcccguggccagcggcagcuggacccccaaggccgaggagcccauccacgccaccauggacccccagagacugggcgugcugaucacccccgugcccgacgcccaggccgccaccagaagacaggccgugggccugcuggccuuccugggccugcuguucugccugggcguggccauguucaccuaccagagccugcagggcugccccagaaagauggccggcgagauggccgagggccugagauacauccccagaagcugcggcagcaacagcuacgugcuggugcccguguaa

SEQ ID NO: 15810 - RNA, 1164 nt, Artificial Sequence
  CX3CR1__Homo_sapiens__NP_001164645
augagagagccccuggaggccuucaagcuggccgaccuggacuucagaaagagcagccuggccagcggcuggagaauggccagcggcgccuucaccauggaccaguuccccgagagcgugaccgagaacuucgaguacgacgaccuggccgaggccugcuacaucggcgacaucgugguguucggcaccguguuccugagcaucuucuacagcgugaucuucgccaucggccuggugggcaaccugcuggugguguucgcccugaccaacagcaagaagcccaagagcgugaccgacaucuaccugcugaaccuggcccugagcgaccugcuguucguggccacccugcccuucuggacccacuaccugaucaacgagaagggccugcacaacgccaugugcaaguucaccaccgccuucuucuucaucggcuucuucggcagcaucuucuucaucaccgugaucagcaucgacagauaccuggccaucgugcuggccgccaacagcaugaacaacagaaccgugcagcacggcgugaccaucagccugggcgugugggccgccgccauccugguggccgccccccaguucauguucaccaagcagaaggagaacgagugccugggcgacuaccccgaggugcugcaggagaucuggcccgugcugagaaacguggagaccaacuuccugggcuuccugcugccccugcugaucaugagcuacugcuacuucagaaucauccagacccuguucagcugcaagaaccacaagaaggccaaggccaucaagcugauccugcugguggugaucguguucuuccuguucuggacccccuacaacgugaugaucuuccuggagacccugaagcuguacgacuucuuccccagcugcgacaugagaaaggaccugagacuggcccugagcgugaccgagaccguggccuucagccacugcugccugaacccccugaucuacgccuucgccggcgagaaguucagaagauaccuguaccaccuguacggcaagugccuggccgugcugugcggcagaagcgugcacguggacuucagcagcagcgagagccagagaagcagacacggcagcgugcugagcagcaacuucaccuaccacaccagcgacggcgacgcccugcugcugcuguaa

SEQ ID NO: 15811 - RNA, 603 nt, Artificial Sequence
  CXADR__Homo_sapiens__NP_001193993
auggcccugcugcugugcuucgugcugcugugcggcgugguggacuucgccagaagccugagcaucaccacccccgaggagaugaucgagaaggccaagggcgagaccgccuaccugcccugcaaguucacccugagccccgaggaccagggcccccuggacaucgaguggcugaucagccccgccgacaaccagaagguggaccaggugaucauccuguacagcggcgacaagaucuacgacgacuacuaccccgaccugaagggcagagugcacuucaccagcaacgaccugaagagcggcgacgccagcaucaacgugaccaaccugcagcugagcgacaucggcaccuaccagugcaaggugaagaaggcccccggcguggccaacaagaagauccaccugguggugcugggcaagaugugccaccugcagagagccgugagaccccugcccgaggccaccagcgccgugaucauccaccccuggggccccugccugcugcccaccuggaaggacauccccagacugagcaucaccaaguaccaggugaagacccugaacgcccugcugagagugagacugagccaccugcugagauaa

SEQ ID NO: 15812 - RNA, 297 nt, Artificial Sequence
  CXCL10__Homo_sapiens__NP_001556
augaaccagaccgccauccugaucugcugccugaucuuccugacccugagcggcauccagggcgugccccugagcagaaccgugagaugcaccugcaucagcaucagcaaccagcccgugaaccccagaagccuggagaagcuggagaucauccccgccagccaguucugccccagaguggagaucaucgccaccaugaagaagaagggcgagaagagaugccugaaccccgagagcaaggccaucaagaaccugcugaaggccgugagcaaggagagaagcaagagaagccccuaa

SEQ ID NO: 15813 - RNA, 285 nt, Artificial Sequence
  CXCL11__Homo_sapiens__NP_005400
augagcgugaagggcauggccaucgcccuggccgugauccugugcgccaccguggugcagggcuuccccauguucaagagaggcagaugccugugcaucggccccggcgugaaggccgugaagguggccgacaucgagaaggccagcaucauguaccccagcaacaacugcgacaagaucgaggugaucaucacccugaaggagaacaagggccagagaugccugaaccccaagagcaagcaggccagacugaucaucaagaagguggagagaaagaacuucuaa

SEQ ID NO: 15814 - RNA, 282 nt, Artificial Sequence
  CXCL12__Homo_sapiens__NP_000600
augaacgccaagguggugguggugcuggugcuggugcugaccgcccugugccugagcgacggcaagcccgugagccugagcuacagaugccccugcagauucuucgagagccacguggccagagccaacgugaagcaccugaagauccugaacacccccaacugcgcccugcagaucguggccagacugaagaacaacaacagacaggugugcaucgaccccaagcugaaguggauccaggaguaccuggagaaggcccugaacaagagauucaagauguaa

SEQ ID NO: 15815 - RNA, 330 nt, Artificial Sequence
  CXCL13__Homo_sapiens__NP_006410
augaaguucaucagcaccagccugcugcugaugcugcuggugagcagccugagccccgugcagggcgugcuggagguguacuacaccagccugagaugcagaugcgugcaggagagcagcguguucauccccagaagauucaucgacagaauccagauccugcccagaggcaacggcugccccagaaaggagaucaucguguggaagaagaacaagagcaucgugugcguggacccccaggccgaguggauccagagaaugauggaggugcugagaaagagaagcagcagcacccugcccgugcccguguucaagagaaagauccccuaa

SEQ ID NO: 15816 - RNA, 336 nt, Artificial Sequence
  CXCL14__Homo_sapiens__NP_004878
augagccugcugcccagaagagccccccccgugagcaugagacugcuggccgccgcccugcugcugcugcugcuggcccuguacaccgccagaguggacggcagcaagugcaagugcagcagaaagggccccaagaucagauacagcgacgugaagaagcuggagaugaagcccaaguacccccacugcgaggagaagauggugaucaucaccaccaagagcgugagcagauacagaggccaggagcacugccugcaccccaagcugcagagcaccaagagauucaucaagugguacaacgccuggaacgagaagagaagaguguacgaggaguaa

SEQ ID NO: 15817 - RNA, 822 nt, Artificial Sequence
  CXCL16__Homo_sapiens__NP_001094282
augagcggcagccagagcgagguggcccccagcccccagagccccagaagccccgagaugggcagagaccugagacccggcagcagagugcugcugcugcugcugcugcugcugcugguguaccugacccagcccggcaacggcaacgagggcagcgugaccggcagcugcuacugcggcaagagaaucagcagcgacagcccccccagcgugcaguucaugaacagacugagaaagcaccugagagccuaccacagaugccuguacuacaccagauuccagcugcugagcuggagcgugugcggcggcaacaaggaccccugggugcaggagcugaugagcugccuggaccugaaggagugcggccacgccuacagcggcaucguggcccaccagaagcaccugcugcccaccagcccccccaucagccaggccagcgagggcgccagcagcgacauccacacccccgcccagaugcugcugagcacccugcagagcacccagagacccacccugcccgugggcagccugagcagcgacaaggagcugaccagacccaacgagaccaccauccacaccgccggccacagccuggccgccggccccgaggccggcgagaaccagaagcagcccgagaagaacgccggccccaccgccagaaccagcgccaccgugcccgugcugugccugcuggccaucaucuucauccugaccgccgcccugagcuacgugcugugcaagagaagaagaggccagagcccccagagcagccccgaccugcccgugcacuacauccccguggcccccgacagcaacaccuaa

SEQ ID NO: 15818 - RNA, 360 nt, Artificial Sequence
  CXCL17__Homo_sapiens__NP_940879
augaaggugcugaucagcagccugcugcugcugcugccccugaugcugaugagcauggugagcagcagccugaaccccggcguggccagaggccacagagacagaggccaggccagcagaagauggcugcaggagggcggccaggagugcgagugcaaggacugguuccugagagcccccagaagaaaguucaugaccgugagcggccugcccaagaagcagugccccugcgaccacuucaagggcaacgugaagaagaccagacaccagagacaccacagaaagcccaacaagcacagcagagccugccagcaguuccugaagcagugccagcugagaagcuucgcccugccccuguaa

SEQ ID NO: 15819 - RNA, 324 nt, Artificial Sequence
  CXCL1__Homo_sapiens__NP_001502
auggccagagccgcccugagcgccgcccccagcaaccccagacugcugagaguggcccugcugcugcugcugcugguggccgccggcagaagagccgccggcgccagcguggccaccgagcugagaugccagugccugcagacccugcagggcauccaccccaagaacauccagagcgugaacgugaagagccccggcccccacugcgcccagaccgaggugaucgccacccugaagaacggcagaaaggccugccugaaccccgccagccccaucgugaagaagaucaucgagaagaugcugaacagcgacaagagcaacuaa

SEQ ID NO: 15820 - RNA, 324 nt, Artificial Sequence
  CXCL2__Homo_sapiens__NP_002080
auggccagagccacccugagcgccgcccccagcaaccccagacugcugagaguggcccugcugcugcugcugcugguggccgccagcagaagagccgccggcgccccccuggccaccgagcugagaugccagugccugcagacccugcagggcauccaccugaagaacauccagagcgugaaggugaagagccccggcccccacugcgcccagaccgaggugaucgccacccugaagaacggccagaaggccugccugaaccccgccagccccauggugaagaagaucaucgagaagaugcugaagaacggcaagagcaacuaa

SEQ ID NO: 15821 - RNA, 324 nt, Artificial Sequence
  CXCL3__Homo_sapiens__NP_002081
auggcccacgccacccugagcgccgcccccagcaaccccagacugcugagaguggcccugcugcugcugcugcugguggccgccagcagaagagccgccggcgccagcguggugaccgagcugagaugccagugccugcagacccugcagggcauccaccugaagaacauccagagcgugaacgugagaagccccggcccccacugcgcccagaccgaggugaucgccacccugaagaacggcaagaaggccugccugaaccccgccagccccauggugcagaagaucaucgagaagauccugaacaagggcagcaccaacuaa

SEQ ID NO: 15822 - RNA, 345 nt, Artificial Sequence
  CXCL5__Homo_sapiens__NP_002985
augagccugcugagcagcagagccgccagagugcccggccccagcagcagccugugcgcccugcuggugcugcugcugcugcugacccagcccggccccaucgccagcgccggccccgccgccgccgugcugagagagcugagaugcgugugccugcagaccacccagggcgugcaccccaagaugaucagcaaccugcagguguucgccaucggcccccagugcagcaagguggaggugguggccagccugaagaacggcaaggagaucugccuggaccccgaggcccccuuccugaagaaggugauccagaagauccuggacggcggcaacaaggagaacuaa

SEQ ID NO: 15823 - RNA, 345 nt, Artificial Sequence
  CXCL6__Homo_sapiens__NP_002984
augagccugcccagcagcagagccgccagagugcccggccccagcggcagccugugcgcccugcuggcccugcugcugcugcugaccccccccggcccccuggccagcgccggccccgugagcgccgugcugaccgagcugagaugcaccugccugagagugacccugagagugaaccccaagaccaucggcaagcugcagguguuccccgccggcccccagugcagcaagguggaggugguggccagccugaagaacggcaagcaggugugccuggaccccgaggcccccuuccugaagaaggugauccagaagauccuggacagcggcaacaagaagaacuaa

SEQ ID NO: 15824 - RNA, 300 nt, Artificial Sequence
  CXCL8__Homo_sapiens__NP_000575
augaccagcaagcuggccguggcccugcuggccgccuuccugaucagcgccgcccugugcgagggcgccgugcugcccagaagcgccaaggagcugagaugccagugcaucaagaccuacagcaagcccuuccaccccaaguucaucaaggagcugagagugaucgagagcggcccccacugcgccaacaccgagaucaucgugaagcugagcgacggcagagagcugugccuggaccccaaggagaacugggugcagagagugguggagaaguuccugaagagagccgagaacagcuaa

SEQ ID NO: 15825 - RNA, 378 nt, Artificial Sequence
  CXCL9__Homo_sapiens__NP_002407
augaagaagagcggcgugcuguuccugcugggcaucauccugcuggugcugaucggcgugcagggcacccccguggugagaaagggcagaugcagcugcaucagcaccaaccagggcaccauccaccugcagagccugaaggaccugaagcaguucgcccccagccccagcugcgagaagaucgagaucaucgccacccugaagaacggcgugcagaccugccugaaccccgacagcgccgacgugaaggagcugaucaagaagugggagaagcaggugagccagaagaagaagcagaagaacggcaagaagcaccagaagaagaaggugcugaaggugagaaagagccagagaagcagacagaagaagaccaccuaa

SEQ ID NO: 15826 - RNA, 1053 nt, Artificial Sequence
  CXCR1__Homo_sapiens__NP_000625
augagcaacaucaccgacccccagaugugggacuucgacgaccugaacuucaccggcaugccccccgccgacgaggacuacagccccugcaugcuggagaccgagacccugaacaaguacguggugaucaucgccuacgcccugguguuccugcugagccugcugggcaacagccuggugaugcuggugauccuguacagcagagugggcagaagcgugaccgacguguaccugcugaaccuggcccuggccgaccugcuguucgcccugacccugcccaucugggccgccagcaaggugaacggcuggaucuucggcaccuuccugugcaagguggugagccugcugaaggaggugaacuucuacagcggcauccugcugcuggccugcaucagcguggacagauaccuggccaucgugcacgccaccagaacccugacccagaagagacaccuggugaaguucgugugccugggcugcuggggccugagcaugaaccugagccugcccuucuuccuguucagacaggccuaccaccccaacaacagcagccccgugugcuacgaggugcugggcaacgacaccgccaaguggagaauggugcugagaauccugccccacaccuucggcuucaucgugccccuguucgugaugcuguucugcuacggcuucacccugagaacccuguucaaggcccacaugggccagaagcacagagccaugagagugaucuucgccguggugcugaucuuccugcugugcuggcugcccuacaaccuggugcugcuggccgacacccugaugagaacccaggugauccaggagagcugcgagagaagaaacaacaucggcagagcccuggacgccaccgagauccugggcuuccugcacagcugccugaaccccaucaucuacgccuucaucggccagaacuucagacacggcuuccugaagauccuggccaugcacggccuggugagcaaggaguuccuggccagacacagagugaccagcuacaccagcagcagcgugaacgugagcagcaaccuguaa

SEQ ID NO: 15827 - RNA, 1083 nt, Artificial Sequence
  CXCR2__Homo_sapiens__NP_001161770
auggaggacuucaacauggagagcgacagcuucgaggacuucuggaagggcgaggaccugagcaacuacagcuacagcagcacccugccccccuuccugcuggacgccgcccccugcgagcccgagagccuggagaucaacaaguacuucguggugaucaucuacgcccugguguuccugcugagccugcugggcaacagccuggugaugcuggugauccuguacagcagagugggcagaagcgugaccgacguguaccugcugaaccuggcccuggccgaccugcuguucgcccugacccugcccaucugggccgccagcaaggugaacggcuggaucuucggcaccuuccugugcaagguggugagccugcugaaggaggugaacuucuacagcggcauccugcugcuggccugcaucagcguggacagauaccuggccaucgugcacgccaccagaacccugacccagaagagauaccuggugaaguucaucugccugagcaucuggggccugagccugcugcuggcccugcccgugcugcuguucagaagaaccguguacagcagcaacgugagccccgccugcuacgaggacaugggcaacaacaccgccaacuggagaaugcugcugagaauccugccccagagcuucggcuucaucgugccccugcugaucaugcuguucugcuacggcuucacccugagaacccuguucaaggcccacaugggccagaagcacagagccaugagagugaucuucgccguggugcugaucuuccugcugugcuggcugcccuacaaccuggugcugcuggccgacacccugaugagaacccaggugauccaggagaccugcgagagaagaaaccacaucgacagagcccuggacgccaccgagauccugggcauccugcacagcugccugaacccccugaucuacgccuucaucggccagaaguucagacacggccugcugaagauccuggccauccacggccugaucagcaaggacagccugcccaaggacagcagacccagcuucgugggcagcagcagcggccacaccagcaccacccuguaa

SEQ ID NO: 15828 - RNA, 1248 nt, Artificial Sequence
  CXCR3__Homo_sapiens__NP_001136269
auggagcugagaaaguacggccccggcagacuggccggcaccgugaucggcggcgccgcccagagcaagagccagaccaagagcgacagcaucaccaaggaguuccugcccggccuguacaccgcccccagcagccccuucccccccagccaggugagcgaccaccaggugcugaacgacgccgagguggccgcccugcuggagaacuucagcagcagcuacgacuacggcgagaacgagagcgacagcugcugcaccagcccccccugcccccaggacuucagccugaacuucgacagagccuuccugcccgcccuguacagccugcuguuccugcugggccugcugggcaacggcgccguggccgccgugcugcugagcagaagaaccgcccugagcagcaccgacaccuuccugcugcaccuggccguggccgacacccugcuggugcugacccugccccugugggccguggacgccgccgugcaguggguguucggcagcggccugugcaagguggccggcgcccuguucaacaucaacuucuacgccggcgcccugcugcuggccugcaucagcuucgacagauaccugaacaucgugcacgccacccagcuguacagaagaggcccccccgccagagugacccugaccugccuggccguguggggccugugccugcuguucgcccugcccgacuucaucuuccugagcgcccaccacgacgagagacugaacgccacccacugccaguacaacuucccccaggugggcagaaccgcccugagagugcugcagcugguggccggcuuccugcugccccugcuggugauggccuacugcuacgcccacauccuggccgugcugcuggugagcagaggccagagaagacugagagccaugagacuggugguggugguggugguggccuucgcccugugcuggacccccuaccaccugguggugcugguggacauccugauggaccugggcgcccuggccagaaacugcggcagagagagcagaguggacguggccaagagcgugaccagcggccugggcuacaugcacugcugccugaacccccugcuguacgccuucgugggcgugaaguucagagagagaauguggaugcugcugcugagacugggcugccccaaccagagaggccugcagagacagcccagcagcagcagaagagacagcagcuggagcgagaccagcgaggccagcuacagcggccuguaa

SEQ ID NO: 15829 - RNA, 1071 nt, Artificial Sequence
  CXCR4__Homo_sapiens__NP_001008540
augagcaucccccugccccugcugcagaucuacaccagcgacaacuacaccgaggagaugggcagcggcgacuacgacagcaugaaggagcccugcuucagagaggagaacgccaacuucaacaagaucuuccugcccaccaucuacagcaucaucuuccugaccggcaucgugggcaacggccuggugauccuggugaugggcuaccagaagaagcugagaagcaugaccgacaaguacagacugcaccugagcguggccgaccugcuguucgugaucacccugcccuucugggccguggacgccguggccaacugguacuucggcaacuuccugugcaaggccgugcacgugaucuacaccgugaaccuguacagcagcgugcugauccuggccuucaucagccuggacagauaccuggccaucgugcacgccaccaacagccagagacccagaaagcugcuggccgagaaggugguguacgugggcguguggauccccgcccugcugcugaccauccccgacuucaucuucgccaacgugagcgaggccgacgacagauacaucugcgacagauucuaccccaacgaccuguggguggugguguuccaguuccagcacaucauggugggccugauccugcccggcaucgugauccugagcugcuacugcaucaucaucagcaagcugagccacagcaagggccaccagaagagaaaggcccugaagaccaccgugauccugauccuggccuucuucgccugcuggcugcccuacuacaucggcaucagcaucgacagcuucauccugcuggagaucaucaagcagggcugcgaguucgagaacaccgugcacaaguggaucagcaucaccgaggcccuggccuucuuccacugcugccugaaccccauccuguacgccuuccugggcgccaaguucaagaccagcgcccagcacgcccugaccagcgugagcagaggcagcagccugaagauccugagcaagggcaagagaggcggccacagcagcgugagcaccgagagcgagagcagcagcuuccacagcagcuaa

SEQ ID NO: 15830 - RNA, 1119 nt, Artificial Sequence
  CXCR5__Homo_sapiens__NP_001707
augaacuacccccugacccuggagauggaccuggagaaccuggaggaccuguucugggagcuggacagacuggacaacuacaacgacaccagccugguggagaaccaccugugccccgccaccgagggcccccugauggccagcuucaaggccguguucgugcccguggccuacagccugaucuuccugcugggcgugaucggcaacgugcuggugcuggugauccuggagagacacagacagaccagaagcagcaccgagaccuuccuguuccaccuggccguggccgaccugcugcugguguucauccugcccuucgccguggccgagggcagcgugggcugggugcugggcaccuuccugugcaagaccgugaucgcccugcacaaggugaacuucuacugcagcagccugcugcuggccugcaucgccguggacagauaccuggccaucgugcacgccgugcacgccuacagacacagaagacugcugagcauccacaucaccugcggcaccaucuggcuggugggcuuccugcuggcccugcccgagauccuguucgccaaggugagccagggccaccacaacaacagccugcccagaugcaccuucagccaggagaaccaggccgagacccacgccugguucaccagcagauuccuguaccacguggccggcuuccugcugcccaugcuggugaugggcuggugcuacgugggcguggugcacagacugagacaggcccagagaagaccccagagacagaaggccgugagaguggccauccuggugaccagcaucuucuuccugugcuggagccccuaccacaucgugaucuuccuggacacccuggccagacugaaggccguggacaacaccugcaagcugaacggcagccugcccguggccaucaccaugugcgaguuccugggccuggcccacugcugccugaaccccaugcuguacaccuucgccggcgugaaguucagaagcgaccugagcagacugcugaccaagcugggcugcaccggccccgccagccugugccagcuguuccccagcuggagaagaagcagccugagcgagagcgagaacgccaccagccugaccaccuucuaa

SEQ ID NO: 15831 - RNA, 1029 nt, Artificial Sequence
  CXCR6__Homo_sapiens__NP_006555
auggccgagcacgacuaccacgaggacuacggcuucagcagcuucaacgacagcagccaggaggagcaccaggacuuccugcaguucagcaagguguuccugcccugcauguaccuggugguguucgugugcggccuggugggcaacagccuggugcuggugaucagcaucuucuaccacaagcugcagagccugaccgacguguuccuggugaaccugccccuggccgaccugguguucgugugcacccugcccuucugggccuacgccggcauccacgaguggguguucggccaggugaugugcaagagccugcugggcaucuacaccaucaacuucuacaccagcaugcugauccugaccugcaucaccguggacagauucaucgugguggugaaggccaccaaggccuacaaccagcaggccaagagaaugaccuggggcaaggugaccagccugcugaucugggugaucagccugcuggugagccugccccagaucaucuacggcaacguguucaaccuggacaagcugaucugcggcuaccacgacgaggccaucagcaccguggugcuggccacccagaugacccugggcuucuuccugccccugcugaccaugaucgugugcuacagcgugaucaucaagacccugcugcacgccggcggcuuccagaagcacagaagccugaagaucaucuuccuggugauggccguguuccugcugacccagaugcccuucaaccugaugaaguucaucagaagcacccacugggaguacuacgccaugaccagcuuccacuacaccaucauggugaccgaggccaucgccuaccugagagccugccugaaccccgugcuguacgccuucgugagccugaaguucagaaagaacuucuggaagcuggugaaggacaucggcugccugcccuaccugggcgugagccaccaguggaagagcagcgaggacaacagcaagaccuucagcgccagccacaacguggaggccaccagcauguuccagcuguaa

SEQ ID NO: 15832 - RNA, 549 nt, Artificial Sequence
  CXorf36__Homo_sapiens__NP_078965
auggagccccagcugggccccgaggccgccgcccugagacccggcuggcuggcccugcugcugugggugagcgcccugagcugcagcuucagccugcccgccagcagccugagcagccuggugccccaggugagaaccagcuacaacuucggcagaaccuuccugggccuggacaagugcaacgccugcaucggcaccagcaucugcaagaaguucuucaaggaggagaucagaagcgacaacuggcuggccagccaccugggccugccccccgacagccugcugagcuaccccgccaacuacagcgacgacagcaagaucuggagacccguggagaucuucagacuggugagcaaguaccagaacgagaucagcgacagaagaaucugcgccagcgccagcgcccccaagaccugcagcaucgagagagugcugagaaagaccgagagauuccagaaguggcugcaggccaagagacugacccccgaccuggugcaggacugccaccagggccagagagagcugaaguuccugugcaugcugagauaa

SEQ ID NO: 15833 - RNA, 1086 nt, Artificial Sequence
  CXorf66__Homo_sapiens__NP_001013421
augaaccuggugaucugcgugcugcugcugagcaucuggaagaacaacugcaugaccaccaaccagaccaacggcagcagcaccaccggcgacaagcccguggagagcaugcagaccaagcugaacuaccugagaagaaaccugcugauccuggugggcaucaucaucaugguguucguguucaucugcuucugcuaccugcacuacaacugccugagcgacgacgccagcaaggccggcauggugaagaagaagggcaucgccgccaagagcagcaagaccagcuucagcgaggccaagaccgccagccagugcagccccgagacccagcccaugcugagcaccgccgacaagagcagcgacagcagcagccccgagagagccagcgcccagagcagcaccgagaagcugaucagacccagcagccugcagaagcccagcauccccaacagcgccggcaagcugaccagacccagcuaccccaagagaagcagcaagagcagcugcagcaagaagcugagcaagagcagccaccuggagaaggcccacaagaagggcagccuggagaagcugugcaagcuggacuacgccugcaagcuggccagcagcgacaagcccgugagacccccccagcuguucaagccccuguacagcagccacccccagaacgagaucagccccagcaagcccuucggcccccaggagcuggccaagccccccaagcacuucaaccccaagagaagcgugagccugggcagagccgcccugcugagcaacagcgagcuggccgagaccugccagcccuacaagaagaagcaccugguggccaagaccuacagaccccuggugaacgacaucagcgaggccaaggagaagaacacccagaaccugcacgugagcagcaaggugaagagcagcagcagaagcuucagaaagcuggacagcagaaacaacgccuacggcgaccacgugaacgacagcgacaccaugaaguacuacagcgagguggacagcgacaaggugaucaucaucaccugcgacagaggcuacaaccaggugaccagcgaggugacccugaacgacuaa

SEQ ID NO: 15834 - RNA, 1512 nt, Artificial Sequence
  CXorf67__Homo_sapiens__NP_981952
auggccacccagagcgacauggagaaggagcagaagcaccagcaggacgagggccagggcggccugaacaacgagaccgcccuggccagcggcgacgccugcggcaccggcaaccaggaccccgccgccagcgugaccaccgugagcagccaggccagccccagcggcggcgccgcccugagcagcagcaccgccggcagcagcgccgccgccgccaccagcgccgccaucuucaucaccgacgaggccagcggccugcccaucaucgccgccgugcugaccgagagacacagcgacagacaggacugcagaagcccccacgagguguucggcugcguggugcccgagggcggcagccaggccgccgugggcccccagaaggccaccggccacgccgacgagcaccuggcccagaccaagagccccggcaacagcagaagaagaaagcagcccugcagaaaccaggccgcccccgcccagaagccccccggcagaagacuguuccccgagccccugccccccagcagccccggcuucagacccagcagcuaccccugcagcggcgccagcaccagcagccaggccacccagcccggccccgcccugcugagccacgccagcgaggccagacccgccaccagaagcagaaucacccugguggccagcgcccugagaagaagagccagcggccccggccccgugaucagaggcugcaccgcccagcccggccccgccuucccccacagagccacccaccuggaccccgccagacugagccccgagagcgcccccggccccgccagaagaggcagagccagcgugcccggccccgccagaagaggcugcgacagcgcccccggccccgccagaagaggcagagacagcgcccccgugagcgcccccagaggcagagacagcgcccccggcagcgccagaagaggcagagacagcgcccccggccccgcccugagagugagaaccgccagaagcgacgccggccacagaagcaccagcaccacccccggcaccggccugagaagcagaagcacccagcagagaagcgcccugcugagcagaagaagccugagcggcagcgccgacgagaaccccagcugcggcaccggcagcgagagacuggccuuccagagcagaagcggcagccccgaccccgaggugcccagcagagccagcccccccguguggcacgccgugagaaugagagccagcagccccagcccccccggcagauucuuccugcccaucccccagcagugggacgagagcagcagcagcagcuacgccagcaacagcagcagccccagcagaagccccggccugagccccagcagccccagccccgaguuccugggccugagaagcaucagcacccccagccccgagagccugagauacgcccugaugcccgaguucuacgcccugagccccgugccccccgaggagcaggccgagaucgagagcaccgcccaccccgccaccccccccgagcccuaa

SEQ ID NO: 15835 - RNA, 1983 nt, Artificial Sequence
  CXXC1__Homo_sapiens__NP_001095124
auggagggcgacggcagcgaccccgagccccccgacgccggcgaggacagcaagagcgagaacggcgagaacgcccccaucuacugcaucugcagaaagcccgacaucaacugcuucaugaucggcugcgacaacugcaacgagugguuccacggcgacugcaucagaaucaccgagaagauggccaaggccaucagagagugguacugcagagagugcagagagaaggaccccaagcuggagaucagauacagacacaagaagagcagagagagagacggcaacgagagagacagcagcgagcccagagacgagggcggcggcagaaagagacccgugcccgaccccgaccugcagagaagagccggcagcggcaccggcgugggcgccaugcuggccagaggcagcgccagcccccacaagagcagcccccagccccugguggccacccccagccagcaccaccagcagcagcagcagcagaucaagagaagcgccagaaugugcggcgagugcgaggccugcagaagaaccgaggacugcggccacugcgacuucugcagagacaugaagaaguucggcggccccaacaagaucagacagaagugcagacugagacagugccagcugagagccagagagagcuacaaguacuuccccagcagccugagccccgugacccccagcgagagccugcccagacccagaagaccccugcccacccagcagcagccccagcccagccagaagcugggcagaaucagagaggacgagggcgccguggccagcagcaccgugaaggagccccccgaggccaccgccacccccgagccccugagcgacgaggaccugccccuggaccccgaccuguaccaggacuucugcgccggcgccuucgacgaccacggccugcccuggaugagcgacaccgaggagagccccuuccuggaccccgcccugagaaagagagccgugaaggugaagcacgugaagagaagagagaagaagagcgagaagaaggugauggagagaaaggaggagagauacaagagacacagacagaagcagaagcacaaggacaaguggaagcaccccgagagagccgacgccaaggaccccgccagccugccccagugccugggccccggcugcgugagacccgcccagcccagcagcaaguacugcagcgacgacugcggcaugaagcuggccgccaacagaaucuacgagauccugccccagagaauccagcaguggcagcagagccccugcaucgccgaggagcacggcaagaagcugcuggagagaaucagaagagagcagcagagcgccagaaccagacugcaggagauggagagaagauuccacgagcuggaggccaucauccugagagccaagcagcaggccgugagagaggacgaggagagcaacgagggcgacagcgacgacaccgaccugcagaucuucugcgugagcugcggccaccccaucaaccccagaguggcccugagacacauggagagaugcuacgccaaguacgagagccagaccagcuucggcagcauguaccccaccagaaucgagggcgccaccagacuguucugcgacguguacaacccccagagcaagaccuacugcaagagacugcaggugcugugccccgagcacagcagagaccccaaggugcccgccgacgaggugugcggcugcccccuggugagagacguguucgagcugaccggcgacuucugcagacugcccaagagacagugcaacagacacuacugcugggagaagcugagaagagccgagguggaccuggagagagugagagugugguacaagcuggacgagcuguucgagcaggagagaaacgugagaaccgccaugaccaacagagccggccugcuggcccugaugcugcaccagaccauccagcacgacccccugaccaccgaccugagaagcagcgccgacagauaa

SEQ ID NO: 15836 - RNA, 1104 nt, Artificial Sequence
  CXXC4__Homo_sapiens__NP_079488
augaacaccaacgugugcguggagcccggccccagccccgaggcccccggccugcccaaggagagccaccugcccgagggcgcccugaacagccugguggacuacaacagcgagauggagagauacagaagcuucgccaccagcuucuacaagaccaacggcggcgccuucccccaggccgccaagaucgccagaaucaccacccccaucuuccccagcagcgccgccgccgccgccgccgccgccagaaucggcaugagccccuggaacugcgacaacgccgccaccgccgccgccgccaccgccaugcuguggggcagcggcggcggcggcggcggcggcggcggcggcggcggcggcggcggcggcggcggcggcggcggcggcggcggcggcggcggcagaaagagcagcagcgccgccgccagcagcagcgccagcagcagcagcgccauccugcccgccggcggcggcggcggcggcggcggcggcggcagcagaaccagcaugcaccacagaaacgacagccagagacugggcaaggccggcugcccccccgagcccagccugcagauggccaacaccaacuuccugagcacccugagccccgagcacugcagaccccuggccggcgagugcaugaacaagcugaagugcggcgccgccgaggccgagaucaugaaccugcccgagagagugggcaccuucagcgccauccccgcccugggcggcaucagccugccccccggcgugaucgugaugaccgcccugcacagccccgccgccgccagcgccgccgugaccgacagcgccuuccagaucgccaaccuggccgacugcccccagaaccacagcagcagcagcagcagcagcagcggcggcgccggcggcgccaaccccgccaagaagaagagaaagagaugcggcgugugcgugcccugcaagagacugaucaacugcggcgugugcagcagcugcagaaacagaaagaccggccaccagaucugcaaguucagaaagugcgaggagcugaagaagaagcccggcaccagccuggagagaacccccgugcccagcgccgaggccuucagaugguucuucuaa

SEQ ID NO: 15837 - RNA, 669 nt, Artificial Sequence
  CYB561D2__Homo_sapiens__NP_001278213
auggcccugagcgccgagaccgagagccacaucuacagagcccugagaaccgccagcggcgccgccgcccaccugguggcccugggcuucaccaucuucguggccgugcuggccagacccggcagcagccuguucagcuggcaccccgugcugaugagccuggccuucagcuuccugaugaccgaggcccugcugguguucagccccgagagcagccugcugcacagccugagcagaaagggcagagccagaugccacugggugcugcagcugcuggcccugcugugcgcccugcugggccugggccuggugauccugcacaaggagcagcugggcaaggcccaccuggugaccagacacggccaggccggccugcuggccgugcugugggccggccugcagugcagcggcggcgugggccugcuguaccccaagcugcugcccagauggccccuggccaagcugaagcuguaccacgccaccagcggccuggugggcuaccugcugggcagcgccagccugcugcugggcaugugcagccugugguucaccgccagcgugaccggcgccgccugguaccuggccgugcugugccccgugcugaccagccuggugaucaugaaccaggugagcaacgccuaccuguacagaaagagaauccagcccuaa

SEQ ID NO: 15838 - RNA, 756 nt, Artificial Sequence
  CYB561__Homo_sapiens__XP_005257148
auggagggcggcgccgccgccgccacccccaccgcccugcccuacuacguggccuucagccagcugcugggccugacccugguggccaugaccggcgccuggcugggccuguacagaggcggcaucgccugggagagcgaccugcaguucaacgcccacccccugugcauggugaucggccugaucuuccugcagggcaacgcccugcugguguacagaguguucagaaacgaggccaagagaaccaccaaggugcugcacggccugcugcacaucuucgcccuggugaucgcccuggugggccugguggccguguucgacuaccacagaaagaagggcuacgccgaccuguacagccugcacagcuggugcggcauccugguguucgugcuguacuucgugcaguggcuggugggcuucagcuucuuccuguuccccggcgccagcuucagccugagaagcagauacagaccccagcacaucuucuucggcgccaccaucuuccugcugagcgugggcaccgcccugcugggccugaaggaggcccugcuguucaaccugggcggcaaguacagcgccuucgagcccgagggcgugcuggccaacgugcugggccugcugcuggccugcuucggcggcgccgugcuguacauccugaccagagccgacuggaagagacccagccaggccgaggagcaggcccugagcauggacuucaagacccugaccgagggcgacagccccggcagccaguaa

SEQ ID NO: 15839 - RNA, 375 nt, Artificial Sequence
  CYB5A__Homo_sapiens__NP_001177736
auggccgagcagagcgacgaggccgugaaguacuacacccuggaggagauccagaagcacaaccacagcaagagcaccuggcugauccugcaccacaagguguacgaccugaccaaguuccuggaggagcaccccggcggcgaggaggugcugagagagcaggccggcggcgacgccaccgagaacuucgaggacgugggccacagcaccgacgccagagagaugagcaagaccuucaucaucggcgagcugcaccccgagacccugaucaccaccaucgacagcagcagcagcugguggaccaacugggugauccccgccaucagcgccguggccguggcccugauguacagacuguacauggccgaggacuaa

SEQ ID NO: 15840 - RNA, 453 nt, Artificial Sequence
  CYB5B__Homo_sapiens__NP_085056
augagcggcagcauggccaccgccgaggccagcggcagcgacggcaagggccaggagguggagaccagcgugaccuacuacagacuggaggagguggccaagagaaacagccugaaggagcuguggcuggugauccacggcagaguguacgacgugaccagauuccugaacgagcaccccggcggcgaggaggugcugcuggagcaggccggcguggacgccagcgagagcuucgaggacgugggccacagcagcgacgccagagagaugcugaagcaguacuacaucggcgacauccaccccagcgaccugaagcccgagagcggcagcaaggaccccagcaagaacgacaccugcaagagcugcugggccuacuggauccugcccaucaucggcgccgugcugcugggcuuccuguacagauacuacaccagcgagagcaagagcagcuaa

SEQ ID NO: 15841 - RNA, 906 nt, Artificial Sequence
  CYB5R3__Homo_sapiens__NP_000389
augggcgcccagcugagcacccugggccacauggugcuguuccccgugugguuccuguacagccugcugaugaagcuguuccagagaagcacccccgccaucacccuggagagccccgacaucaaguacccccugagacugaucgacagagagaucaucagccacgacaccagaagauucagauucgcccugcccagcccccagcacauccugggccugcccgugggccagcacaucuaccugagcgccagaaucgacggcaaccugguggugagacccuacacccccaucagcagcgacgacgacaagggcuucguggaccuggugaucaagguguacuucaaggacacccaccccaaguuccccgccggcggcaagaugagccaguaccuggagagcaugcagaucggcgacaccaucgaguucagaggccccagcggccugcugguguaccagggcaagggcaaguucgccaucagacccgacaagaagagcaaccccaucaucagaaccgugaagagcgugggcaugaucgccggcggcaccggcaucacccccaugcugcaggugaucagagccaucaugaaggaccccgacgaccacaccgugugccaccugcuguucgccaaccagaccgagaaggacauccugcugagacccgagcuggaggagcugagaaacaagcacagcgccagauucaagcugugguacacccuggacagagcccccgaggccugggacuacggccagggcuucgugaacgaggagaugaucagagaccaccugcccccccccgaggaggagccccuggugcugaugugcggccccccccccaugauccaguacgccugccugcccaaccuggaccacgugggccaccccaccgagagaugcuucguguucuaa

SEQ ID NO: 15842 - RNA, 1566 nt, Artificial Sequence
  CYB5R4__Homo_sapiens__NP_057314
augcugaacgugcccagccagagcuuccccgcccccagaagccagcagagaguggccagcggcggcagaagcaaggugccccugaagcagggcagaagccugauggacuggaucagacugaccaagagcggcaaggaccugaccggccugaagggcagacugaucgaggugaccgaggaggagcugaagaagcacaacaagaaggacgacugcuggaucugcaucagaggcuucguguacaacgugagccccuacauggaguaccaccccggcggcgaggacgagcugaugagagccgccggcagcgacggcaccgagcuguucgaccaggugcacagaugggugaacuacgagagcaugcugaaggagugccuggugggcagaauggccaucaagcccgccgugcugaaggacuacagagaggaggagaagaaggugcugaacggcaugcugcccaagagccaggugaccgacacccuggccaaggagggccccagcuaccccagcuacgacugguuccagaccgacagccuggugaccaucgccaucuacaccaagcagaaggacaucaaccuggacagcaucaucguggaccaccagaacgacagcuucagagccgagaccaucaucaaggacugccuguaccugauccacaucggccugagccacgaggugcaggaggacuucagcgugagagugguggagagcgugggcaagaucgagaucgugcugcagaagaaggagaacaccagcugggacuuccugggccacccccugaagaaccacaacagccugauccccagaaaggacaccggccuguacuacagaaagugccagcugaucagcaaggaggacgugacccacgacaccagacuguucugccugaugcugccccccagcacccaccugcaggugcccaucggccagcacguguaccugaagcugcccaucaccggcaccgagaucgugaagcccuacacccccgugagcggcagccugcugagcgaguucaaggagcccgugcugcccaacaacaaguacaucuacuuccugaucaagaucuaccccaccggccuguucacccccgagcuggacagacugcagaucggcgacuucgugagcgugagcagccccgagggcaacuucaagaucagcaaguuccaggagcuggaggaccuguuccugcuggccgccggcaccggcuucacccccauggugaagauccugaacuacgcccugaccgacauccccagccugagaaaggugaagcugauguucuucaacaagaccgaggacgacaucaucuggagaagccagcuggagaagcuggccuucaaggacaagagacuggacguggaguucgugcugagcgcccccaucagcgaguggaacggcaagcagggccacaucagccccgcccugcugagcgaguuccugaagagaaaccuggacaagagcaaggugcuggugugcaucugcggccccgugcccuucaccgagcagggcgugagacugcugcacgaccugaacuucagcaagaacgagauccacagcuucaccgccuaa

SEQ ID NO: 15843 - RNA, 588 nt, Artificial Sequence
  CYBA__Homo_sapiens__NP_000092
augggccagaucgagugggccaugugggccaacgagcaggcccuggccagcggccugauccugaucaccggcggcaucguggccaccgccggcagauucacccagugguacuucggcgccuacagcaucguggccggcguguucgugugccugcuggaguaccccagaggcaagagaaagaagggcagcaccauggagagauggggccagaaguacaugaccgccguggugaagcuguucggccccuucaccagaaacuacuacgugagagccgugcugcaccugcugcugagcgugcccgccggcuuccugcuggccaccauccugggcaccgccugccuggccaucgccagcggcaucuaccugcuggccgccgugagaggcgagcaguggacccccaucgagcccaagcccagagagagaccccagaucggcggcaccaucaagcagccccccagcaaccccccccccagaccccccgccgaggccagaaagaagcccagcgaggaggaggccgccguggccgccggcggcccccccggcggcccccaggugaaccccauccccgugaccgacgaggugguguaa

SEQ ID NO: 15844 - RNA, 1713 nt, Artificial Sequence
  CYBB__Homo_sapiens__NP_000388
augggcaacugggccgugaacgagggccugagcaucuucgugauccugguguggcugggccugaacguguuccuguucgugugguacuacagaguguacgacaucccccccaaguucuucuacaccagaaagcugcugggcagcgcccuggcccuggccagagcccccgccgccugccugaacuucaacugcaugcugauccugcugcccgugugcagaaaccugcugagcuuccugagaggcagcagcgccugcugcagcaccagagugagaagacagcuggacagaaaccugaccuuccacaagaugguggccuggaugaucgcccugcacagcgccauccacaccaucgcccaccuguucaacguggaguggugcgugaacgccagagugaacaacagcgaccccuacagcguggcccugagcgagcugggcgacagacagaacgagagcuaccugaacuucgccagaaagagaaucaagaaccccgagggcggccuguaccuggccgugacccugcuggccggcaucaccggcguggugaucacccugugccugauccugaucaucaccagcagcaccaagaccaucagaagaagcuacuucgagguguucugguacacccaccaccuguucgugaucuucuucaucggccuggccauccacggcgccgagagaaucgugagaggccagaccgccgagagccuggccgugcacaacaucaccgugugcgagcagaagaucagcgaguggggcaagaucaaggagugccccaucccccaguucgccggcaacccccccaugaccuggaaguggaucgugggccccauguuccuguaccugugcgagagacuggugagauucuggagaagccagcagaagguggugaucaccaagguggugacccaccccuucaagaccaucgagcugcagaugaagaagaagggcuucaagauggaggugggccaguacaucuucgugaagugccccaaggugagcaagcuggaguggcaccccuucacccugaccagcgcccccgaggaggacuucuucagcauccacaucagaaucgugggcgacuggaccgagggccuguucaacgccugcggcugcgacaagcaggaguuccaggacgccuggaagcugcccaagaucgccguggacggccccuucggcaccgccagcgaggacguguucagcuacgagguggugaugcuggugggcgccggcaucggcgugacccccuucgccagcauccugaagagcgugugguacaaguacugcaacaacgccaccaaccugaagcugaagaagaucuacuucuacuggcugugcagagacacccacgccuucgagugguucgccgaccugcugcagcugcuggagagccagaugcaggagagaaacaacgccggcuuccugagcuacaacaucuaccugaccggcugggacgagagccaggccaaccacuucgccgugcaccacgacgaggagaaggacgugaucaccggccugaagcagaagacccuguacggcagacccaacugggacaacgaguucaagaccaucgccagccagcaccccaacaccagaaucggcguguuccugugcggccccgaggcccuggccgagacccugagcaagcagagcaucagcaacagcgagagcggccccagaggcgugcacuucaucuucaacaaggagaacuucuaa

SEQ ID NO: 15845 - RNA, 474 nt, Artificial Sequence
  CYBRD1__Homo_sapiens__NP_001120855
auggccauggagggcuacuggagauuccuggcccugcugggcagcgcccugcuggugggcuuccugagcgugaucuucgcccuggugugggugcugcacuacagagagggccugggcugggacggcagcgcccuggaguucaacuggcaccccgugcugauggugaccggcuucguguucauccagggcaucgccagcuucagauucuucagccugagcgccagcaugggcagcgccuucagccccagcaucagccacgcccacaccugccuguucuggaacugccaccuguggaacagcgacugcaacagcaccuacggcaucgacagagagaccgacuucuuccccgagagaagcugcauccaguacauccccgccagaagaugcuucagaaaguacgccuggcccagcgaccccggcgugagaggcccccacuuccuggacagccaccagaccgccauggagaccagcuaa

SEQ ID NO: 15846 - RNA, 978 nt, Artificial Sequence
  CYC1__Homo_sapiens__NP_001907
auggccgccgccgccgccagccugagaggcguggugcugggccccagaggcgccggccugcccggcgccagagccagaggccugcugugcagcgccagacccggccagcugccccugagaaccccccaggccguggcccugagcagcaagagcggccugagcagaggcagaaaggugaugcugagcgcccugggcaugcuggccgccggcggcgccggccuggccguggcccugcacagcgccgugagcgccagcgaccuggagcugcacccccccagcuaccccuggagccacagaggccugcugagcagccuggaccacaccagcaucagaagaggcuuccagguguacaagcaggugugcgccagcugccacagcauggacuucguggccuacagacaccuggugggcgugugcuacaccgaggacgaggccaaggagcuggccgccgagguggaggugcaggacggccccaacgaggacggcgagauguucaugagacccggcaagcuguucgacuacuuccccaagcccuaccccaacagcgaggccgccagagccgccaacaacggcgcccugccccccgaccugagcuacaucgugagagccagacacggcggcgaggacuacguguucagccugcugaccggcuacugcgagccccccaccggcgugagccugagagagggccuguacuucaaccccuacuuccccggccaggccaucgccauggccccccccaucuacaccgacgugcuggaguucgacgacggcacccccgccaccaugagccagaucgccaaggacgugugcaccuuccugagaugggccagcgagcccgagcacgaccacagaaagagaaugggccugaagaugcugaugaugauggcccugcuggugccccugguguacaccaucaagagacacaaguggagcgugcugaagagcagaaagcuggccuacagaccccccaaguaa

SEQ ID NO: 15847 - RNA, 318 nt, Artificial Sequence
  CYCS__Homo_sapiens__NP_061820
augggcgacguggagaagggcaagaagaucuucaucaugaagugcagccagugccacaccguggagaagggcggcaagcacaagaccggccccaaccugcacggccuguucggcagaaagaccggccaggcccccggcuacagcuacaccgccgccaacaagaacaagggcaucaucuggggcgaggacacccugauggaguaccuggagaaccccaagaaguacauccccggcaccaagaugaucuucgugggcaucaagaagaaggaggagagagccgaccugaucgccuaccugaagaaggccaccaacgaguaa

SEQ ID NO: 15848 - RNA, 3762 nt, Artificial Sequence
  CYFIP1__Homo_sapiens__NP_001274739
auggccgcccaggugacccuggaggacgcccugagcaacguggaccugcuggaggagcugccccugcccgaccagcagcccugcaucgagcccccccccagcagccugcuguaccagcccaacuucaacaccaacuucgaggacagaaacgccuucgugaccggcaucgccagauacaucgagcaggccaccgugcacagcagcaugaacgagaugcuggaggagggccaggaguacgccgugaugcuguacaccuggagaagcugcagcagagccaucccccaggugaagugcaacgagcagcccaacagaguggagaucuacgagaagaccguggaggugcuggagcccgaggugaccaagcugaugaacuucauguacuuccagagaaacgccaucgagagauucugcggcgaggugagaagacugugccacgccgagagaagaaaggacuucgugagcgaggccuaccugaucacccugggcaaguucaucaacauguucgccgugcuggacgagcugaagaacaugaagugcagcgugaagaacgaccacagcgccuacaagagagccgcccaguuccugagaaagauggccgacccccagagcauccaggagagccagaaccugagcauguuccuggccaaccacaacaagaucacccagagccugcagcagcagcuggaggugaucagcggcuacgaggagcugcuggccgacaucgugaaccugugcguggacuacuacgagaacagaauguaccugacccccagcgagaagcacaugcugcugaaggugaugggcuucggccuguaccugauggacggcagcgugagcaacaucuacaagcuggacgccaagaagagaaucaaccugagcaagaucgacaaguacuucaagcagcugcagguggugccccuguucggcgacaugcagaucgagcuggccagauacaucaagaccagcgcccacuacgaggagaacaagagcagauggaccugcaccagcagcggcagcagcccccaguacaacaucugcgagcagaugauccagaucagagaggaccacaugagauucaucagcgagcuggccagauacagcaacagcgagguggugaccggcagcggcagacaggaggcccagaagaccgacgccgaguacagaaagcuguucgaccuggcccugcagggccugcagcugcugagccaguggagcgcccacgugauggagguguacagcuggaagcuggugcaccccaccgacaaguacagcaacaaggacugccccgacagcgccgaggaguacgagagagccaccagauacaacuacaccagcgaggagaaguucgcccugguggaggugaucgccaugaucaagggccugcaggugcugaugggcagaauggagagcguguucaaccacgccaucagacacaccguguacgccgcccugcaggacuucagccaggugacccugagagagccccugagacaggccaucaagaagaagaagaacgugauccagagcgugcugcaggccaucagaaagaccgugugcgacugggagaccggccacgagcccuucaacgaccccgcccugagaggcgagaaggaccccaagagcggcuucgacaucaaggugcccagaagagccgugggccccagcagcacccagcuguacauggugagaaccaugcuggagagccugaucgccgacaagagcggcagcaagaagacccugagaagcagccuggagggccccaccauccuggacaucgagaaguuccacagagagagcuucuucuacacccaccugaucaacuucagcgagacccugcagcagugcugcgaccugagccagcugugguucagagaguucuuccuggagcugaccaugggcagaagaauccaguuccccaucgagaugagcaugcccuggauccugaccgaccacauccuggagaccaaggaggccagcaugauggaguacgugcuguacagccuggaccuguacaacgacagcgcccacuacgcccugaccagauucaacaagcaguuccuguacgacgagaucgaggccgaggugaaccugugcuucgaccaguucguguacaagcuggccgaccagaucuucgccuacuacaaggugauggccggcagccugcugcuggacaagagacugagaagcgagugcaagaaccagggcgccaccauccaccugccccccagcaacagauacgagacccugcugaagcagagacacgugcagcugcugggcagaagcaucgaccugaacagacugaucacccagagagugagcgccgccauguacaagagccuggagcuggccaucggcagauucgagagcgaggaccugaccagcaucguggagcuggacggccugcuggagaucaacagaaugacccacaagcugcugagcagauaccugacccuggacggcuucgacgccauguucagagaggccaaccacaacgugagcgcccccuacggcagaaucacccugcacguguucugggagcugaacuacgacuuccugcccaacuacugcuacaacggcagcaccaacagauucgugagaaccgugcugcccuucagccaggaguuccagagagacaagcagcccaacgcccagccccaguaccugcacggcagcaaggcccugaaccuggccuacagcagcaucuacggcagcuacagaaacuucgugggccccccccacuuccaggugaucugcagacugcugggcuaccagggcaucgccguggugauggaggagcugcugaagguggugaagagccugcugcagggcaccauccugcaguacgugaagacccugauggaggugaugcccaagaucugcagacugcccagacacgaguacggcagccccggcauccuggaguucuuccaccaccagcugaaggacaucguggaguacgccgagcugaagaccgugugcuuccagaaccugagagaggugggcaacgccauccuguucugccugcugaucgagcagagccugagccuggaggaggugugcgaccugcugcacgccgcccccuuccagaacauccugcccagagugcacgugaaggagggcgagagacuggacgccaagaugaagagacuggagagcaaguacgccccccugcaccuggugccccugaucgagagacugggcaccccccagcagaucgccaucgccagagagggcgaccugcugaccaaggagagacugugcugcggccugagcauguucgaggugauccugaccagaaucagaagcuuccuggacgaccccaucuggagaggcccccugcccagcaacggcgugaugcacguggacgagugcguggaguuccacagacuguggagcgccaugcaguucguguacugcauccccgugggcacccacgaguucaccguggagcagugcuucggcgacggccugcacugggccggcugcaugaucaucgugcugcugggccagcagagaagauucgccgugcuggacuucugcuaccaccugcugaaggugcagaagcacgacggcaaggacgagaucaucaagaacgugccccugaagaagaugguggagagaaucagaaaguuccagauccugaacgacgagaucaucaccauccuggacaaguaccugaagagcggcgacggcgagggcacccccguggagcacgugagaugcuuccagccccccauccaccagagccuggccagcagcuaa

SEQ ID NO: 15849 - RNA, 3684 nt, Artificial Sequence
  CYFIP2__Homo_sapiens__NP_001278650
augaccacccacgugacccuggaggacgcccugagcaacguggaccugcuggaggagcugccccugcccgaccagcagcccugcaucgagcccccccccagcagcaucauguaccaggccaacuucgacaccaacuucgaggacagaaacgccuucgugaccggcaucgccagauacaucgagcaggccaccgugcacagcagcauggugaagugcaacgagcagcccaacagaguggagaucuacgagaagaccguggaggugcuggagcccgaggugaccaagcugaugaaguucauguacuuccagagaaaggccaucgagagauucugcagcgaggugaagagacugugccacgccgagagaagaaaggacuucgugagcgaggccuaccugcugacccugggcaaguucaucaacauguucgccgugcuggacgagcugaagaacaugaagugcagcgugaagaacgaccacagcgccuacaagagagccgcccaguuccugagaaagauggccgacccccagagcauccaggagagccagaaccugagcauguuccuggccaaccacaacagaaucacccagugccugcaccagcagcuggaggugauccccggcuacgaggagcugcuggccgacaucgugaacaucugcguggacuacuacgagaacaagauguaccugacccccagcgagaagcacaugcugcugaaggugaugggcuucggccuguaccugauggacggcaacgugagcaacaucuacaagcuggacgccaagaagagaaucaaccugagcaagaucgacaaguucuucaagcagcugcagguggugccccuguucggcgacaugcagaucgagcuggccagauacaucaagaccagcgcccacuacgaggagaacaagagcaaguggaccugcacccagagcagcaucagcccccaguacaacaucugcgagcagauggugcagaucagagacgaccacaucagauucaucagcgagcuggccagauacagcaacagcgagguggugaccggcagcggccuggacagccagaagagcgacgaggaguacagagagcuguucgaccuggcccugagaggccugcagcugcugagcaaguggagcgcccacgugauggagguguacagcuggaagcuggugcaccccaccgacaaguucugcaacaaggacugccccggcaccgccgaggaguacgagagagccaccagauacaacuacaccagcgaggagaaguucgccuucguggaggugaucgccaugaucaagggccugcaggugcugaugggcagaauggagagcguguucaaccaggccaucagaaacaccaucuacgccgcccugcaggacuucgcccaggugacccugagagagccccugagacaggccgugagaaagaagaagaacgugcugaucagcgugcugcaggccaucagaaagaccaucugcgacugggagggcggcagagagccccccaacgaccccugccugagaggcgagaaggaccccaagggcggcuucgacaucaaggugcccagaagagccgugggccccagcagcacccagcuguacauggugagaaccaugcuggagagccugaucgccgacaagagcggcagcaagaagacccugagaagcagccuggacggccccaucgugcuggccaucgaggacuuccacaagcagagcuucuucuucacccaccugcugaacaucagcgaggcccugcagcagugcugcgaccugagccagcugugguucagagaguucuuccuggagcugaccaugggcagaagaauccaguuccccaucgagaugagcaugcccuggauccugaccgaccacauccuggagaccaaggagcccagcaugauggaguacgugcuguacccccuggaccuguacaacgacagcgccuacuacgcccugaccaaguucaagaagcaguuccuguacgacgagaucgaggccgaggugaaccugugcuucgaccaguucguguacaagcuggccgaccagaucuucgccuacuacaaggccauggccggcagcgugcugcuggacaagagauucagagccgagugcaagaacuacggcgugaucauccccuacccccccagcaacagauacgagacccugcugaagcagagacacgugcagcugcugggcagaagcaucgaccugaacagacugaucacccagagaaucagcgccgccauguacaagagccuggaccaggccaucagcagauucgagagcgaggaccugaccagcaucguggagcuggaguggcugcuggagaucaacagacugacccacagacugcugugcaagcacaugacccuggacagcuucgacgccauguucagagaggccaaccacaacgugagcgcccccuacggcagaaucacccugcacguguucugggagcugaacuucgacuuccugcccaacuacugcuacaacggcagcaccaacagauucgugagaaccgccauccccuucacccaggagccccagagagacaagcccgccaacgugcagcccuacuaccuguacggcagcaagccccugaacaucgccuacagccacaucuacagcagcuacagaaacuucgugggccccccccacuucaagaccaucugcagacugcugggcuaccagggcaucgccguggugauggaggagcugcugaagaucgugaagagccugcugcagggcaccauccugcaguacgugaagacccugaucgaggugaugcccaagaucugcagacugcccagacacgaguacggcagccccggcauccuggaguucuuccaccaccagcugaaggacaucaucgaguacgccgagcugaagaccgacguguuccagagccugagagaggugggcaacgccauccuguucugccugcugaucgagcaggcccugagccaggaggaggugugcgaccugcugcacgccgcccccuuccagaacauccugcccagaguguacaucaaggagggcgagagacuggaggugagaaugaagagacuggaggccaaguacgccccccugcaccuggugccccugaucgagagacugggcaccccccagcagaucgccaucgccagagagggcgaccugcugaccaaggagagacugugcugcggccugagcauguucgaggugauccugaccagaaucagaagcuaccugcaggaccccaucuggagaggccccccccccaccaacggcgugaugcacguggacgagugcguggaguuccacagacuguggagcgccaugcaguucguguacugcauccccgugggcaccaacgaguucaccgccgagcagugcuucggcgacggccugaacugggccggcugcagcaucaucgugcugcugggccagcagagaagauucgaccuguucgacuucugcuaccaccugcugaaggugcagagacaggacggcaaggacgagaucaucaagaacgugccccugaagaagauggccgacagaaucagaaaguaccagauccugaacaacgagguguucgccauccugaacaaguacaugaagagcguggagaccgacagcagcaccguggagcacgugagaugcuuccagccccccauccaccagagccuggccaccaccugcuaa

SEQ ID NO: 15850 - RNA, 573 nt, Artificial Sequence
  CYGB__Homo_sapiens__NP_599030
auggagaaggugcccggcgagauggagaucgagagaagagagagaagcgaggagcugagcgaggccgagagaaaggccgugcaggccaugugggccagacuguacgccaacugcgaggacgugggcguggccauccuggugagauucuucgugaacuuccccagcgccaagcaguacuucagccaguucaagcacauggaggacccccuggagauggagagaagcccccagcugagaaagcacgccugcagagugaugggcgcccugaacaccgugguggagaaccugcacgaccccgacaaggugagcagcgugcuggcccuggugggcaaggcccacgcccugaagcacaagguggagcccguguacuucaagauccugagcggcgugauccuggaggugguggccgaggaguucgccagcgacuucccccccgagacccagagagccugggccaagcugagaggccugaucuacagccacgugaccgccgccuacaaggaggugggcugggugcagcaggugcccaacgccaccaccccccccgccacccugcccagcagcggccccuaa

SEQ ID NO: 15851 - RNA, 1956 nt, Artificial Sequence
  CYLC1__Homo_sapiens__NP_066941
augagccugcccagacugcugaaggugaacaucagaaccuacgacaacagcauccccaucagcgagagcagcagaaagagcuggaaccagaagcacuucgcccugaccuuccccaagccccugcagagaggcaccaacgacaagagcagaccccugaagagccagaucaccgugaccagacacgacaagagaaagcuggaggagggccagaagcccgcccacaaguggaucagacacagcuucagaaagauccugcaguggccccccaucuacaccgccgccagagagcagacccccuucagacaccuguacaccagcaagacccaccugaagaaggccgaguacaagaagagcaaggacgagaagggcggcaccccccugaagaaggacagcaagaagaagggcggcagcuacgccaccaaccccgagagcaagcagaucguggaggagaagaccaagagacagaacgaggccgacaagaccccccugaagagcagccacgagaacgagcagagcaagaagagcaagagcagcagcgagaccaaccccgagagccagaacagcaagaccgugagcaagaacugcagccagaaggacaagaaggacagcaagaacagcaagaagaccaacaccgaguuccugcacaccaagaacaaccccaagaaggaccugaagagaagcaagaccagcaacgaccccaucagcgagaucugcagcgagaacagccugaacguggacuuccugaugcuggugggccagagcgacgacgagagcaucaacuucgacgccuggcugagaaacuacagccagaacaacagcaagaacuacagccugaaguacaccaaguacaccaagaaggacaccaagaagaacgccaagaagagcagcgacgccgagagcgaggacagcaaggacgccaagaaggacagcaagaaggugaagaagaacgugaagaaggacgacaagaagaaggacgugaagaaggacaccgagagcaccgacgccgagagcggcgacagcaaggacgagagaaaggacaccaagaaggacaagaagaagcugaagaaggacgacaagaagaaggacaccaagaaguaccccgagagcaccgacaccgagagcggcgacgccaaggacgccagaaacgacagcagaaaccugaagaaggccagcaagaacgacgacaagaagaaggacgccaagaagaucaccuucagcaccgacagcgagagcgagcuggagagcaaggagagccagaaggacgagaagaaggacaagaaggacagcaagaccgacaacaagaagagcgugaagaacgacgaggagagcaccgacgccgacagcgagcccaagggcgacagcaagaagggcaagaaggacgagaagaagggcaagaaggacagcaagaaggacgacaagaagaaggacgccaagaagaacgccgagagcaccgagauggagagcgaccuggagcugaagaaggacaagaagcacagcaaggagaagaagggcagcaagaaggacaucaagaaggacgccagaaaggacaccgagagcaccgacgccgaguucgacgagagcagcaagaccggcuucaagaccagcaccaagaucaagggcagcgacaccgagagcgaggagagccuguacaagcccggcgccaagaagaagaucgacgagagcgacggcaccagcgccaacagcaagauggagggccuggagagcaagagaggcuucagaaugagcagcaagaagaccaccuucaacgagaagggcgagaaggccagcaccggcagagugccccccagcagagagaagcccccccugcccgccugcgagcccagccugcccagccccaaggugagaagacugugcuggugcaagaugcccccccccccccccaagcccagauacgccccccugcccgaggcccccuggauccacaagcugcuguaa

SEQ ID NO: 15852 - RNA, 1047 nt, Artificial Sequence
  CYLC2__Homo_sapiens__NP_001331
augagccugcccagauuccagagagugaacuucggccccuacgacaacuacauccccgugagcgagcugagcaagaagagcuggaaccagcagcacuucgcccugcuguuccccaagccccagagacccggcaccaagagaagaagcaagcccagccagaucagagacaacaccgugagcaucaucgacgaggagcagcugagaggcgacagaagacagccccuguggauguacagaagccugaugagaaucagcgagagacccagcguguaccuggccgccagaagacagccccugaagcccaccagaaccguggagguggacagcaaggccgccgagaucggcaagaagggcgaggacaagaccacccagaaggacaccaccgacagcgagagcgagcugaagcagggcaagaaggacagcaagaagggcaaggacaucgagaagggcaaggaggagaagcuggacgccaagaaggacagcaagaagggcaagaaggacgccgagaagggcaaggacagcgccaccgagagcgaggacgagaagggcggcgccaagaaggacaacaagaaggacaagaaggacagcaacaagggcaaggacagcgccaccgagagcgagggcgagaagggcggcaccgagaaggacagcaagaagggcaagaaggacagcaagaagggcaaggacagcgccaucgagcugcaggccgugaaggccgacgagaagaaggacgaggacggcaagaaggacgccaacaagggcgacgagagcaaggacgccaagaaggacgccaaggagaucaagaagggcaagaaggacaagaagaagcccagcagcaccgacagcgacagcaaggacgacgugaagaaggagagcaagaaggacgccaccaaggacgccaagaagguggccaagaaggacaccgagaaggagagcgccgacagcaagaaggacgccaagaagaacgccaagaaggacgccaagaaggacgccaagaagaacgccaagaaggacgagaagaaggacgccaagaagaagggcaaguaa

SEQ ID NO: 15853 - RNA, 2862 nt, Artificial Sequence
  CYLD__Homo_sapiens__NP_001035877
augagcagcggccuguggagccaggagaaggugaccagccccuacugggaggagagaaucuucuaccugcugcugcaggagugcagcgugaccgacaagcagacccagaagcugcugaaggugcccaagggcagcaucggccaguacauccaggacagaagcgugggccacagcagaauccccagcgccaagggcaagaagaaccagaucggccugaagauccuggagcagccccacgccgugcuguucguggacgagaaggacgugguggagaucaacgagaaguucaccgagcugcugcuggccaucaccaacugcgaggagagauucagccuguucaagaacagaaacagacugagcaagggccugcagaucgacgugggcugccccgugaaggugcagcugagaagcggcgaggagaaguuccccggcguggugagauucagaggcccccugcuggccgagagaaccgugagcggcaucuucuucggcguggagcugcuggaggagggcagaggccagggcuucaccgacggcguguaccagggcaagcagcuguuccagugcgacgaggacugcggcguguucguggcccuggacaagcuggagcugaucgaggacgacgacaccgcccuggagagcgacuacgccggccccggcgacaccaugcagguggagcugcccccccuggagaucaacagcagagugagccugaaggugggcgagaccaucgagagcggcaccgugaucuucugcgacgugcugcccggcaaggagagccugggcuacuucgugggcguggacauggacaaccccaucggcaacugggacggcagauucgacggcgugcagcugugcagcuucgccugcguggagagcaccauccugcugcacaucaacgacaucauccccgagagcgugacccaggagagaagaccccccaagcuggccuucaugagcagaggcgugggcgacaagggcagcagcagccacaacaagcccaaggccaccggcagcaccagcgaccccggcaacagaaacagaagcgagcuguucuacacccugaacggcagcagcguggacagccagccccagagcaagagcaagaacaccugguacaucgacgagguggccgaggaccccgccaagagccugaccgagaucagcaccgacuucgacagaagcagccccccccugcagcccccccccgugaacagccugaccaccgagaacagauuccacagccugcccuucagccugaccaagaugcccaacaccaacggcagcaucggccacagcccccugagccugagcgcccagagcgugauggaggagcugaacaccgcccccgugcaggagagccccccccuggccaugccccccggcaacagccacggccuggaggugggcagccuggccgaggugaaggagaacccccccuucuacggcgugaucagauggaucggccagccccccggccugaacgaggugcuggccggccuggagcuggaggacgagugcgccggcugcaccgacggcaccuucagaggcaccagauacuucaccugcgcccugaagaaggcccuguucgugaagcugaagagcugcagacccgacagcagauucgccagccugcagcccgugagcaaccagaucgagagaugcaacagccuggccuucggcggcuaccugagcgaggugguggaggagaacaccccccccaagauggagaaggagggccuggagaucaugaucggcaagaagaagggcauccagggccacuacaacagcugcuaccuggacagcacccuguucugccuguucgccuucagcagcgugcuggacaccgugcugcugagacccaaggagaagaacgacguggaguacuacagcgagacccaggagcugcugagaaccgagaucgugaacccccugagaaucuacggcuacgugugcgccaccaagaucaugaagcugagaaagauccuggagaagguggaggccgccagcggcuucaccagcgaggagaaggaccccgaggaguuccugaacauccuguuccaccacauccugagaguggagccccugcugaagaucagaagcgccggccagaaggugcaggacugcuacuucuaccagaucuucauggagaagaacgagaaggugggcgugcccaccauccagcagcugcuggaguggagcuucaucaacagcaaccugaaguucgccgaggcccccagcugccugaucauccagaugcccagauucggcaaggacuucaagcuguucaagaagaucuuccccagccuggagcugaacaucaccgaccugcuggaggacacccccagacagugcagaaucugcggcggccuggccauguacgagugcagagagugcuacgacgaccccgacaucagcgccggcaagaucaagcaguucugcaagaccugcaacacccaggugcaccugcaccccaagagacugaaccacaaguacaaccccgugagccugcccaaggaccugcccgacugggacuggagacacggcugcauccccugccagaacauggagcuguucgccgugcugugcaucgagaccagccacuacguggccuucgugaaguacggcaaggacgacagcgccuggcuguucuucgacagcauggccgacagagacggcggccagaacggcuucaacaucccccaggugacccccugccccgaggugggcgaguaccugaagaugagccuggaggaccugcacagccuggacagcagaagaauccagggcugcgccagaagacugcugugcgacgccuacaugugcauguaccagagccccaccaugagccuguacaaguaa

SEQ ID NO: 15854 - RNA, 1566 nt, Artificial Sequence
  CYP11A1__Homo_sapiens__NP_000772
augcuggccaagggccugccccccagaagcgugcuggugaagggcugccagaccuuccugagcgcccccagagagggccugggcagacugagagugcccaccggcgagggcgccggcaucagcaccagaagccccagacccuucaacgagauccccagccccggcgacaacggcuggcugaaccuguaccacuucuggagagagaccggcacccacaaggugcaccugcaccacgugcagaacuuccagaaguacggccccaucuacagagagaagcugggcaacguggagagcguguacgugaucgaccccgaggacguggcccugcuguucaagagcgagggccccaaccccgagagauuccugaucccccccuggguggccuaccaccaguacuaccagagacccaucggcgugcugcugaagaagagcgccgccuggaagaaggacagaguggcccugaaccaggaggugauggcccccgaggccaccaagaacuuccugccccugcuggacgccgugagcagagacuucgugagcgugcugcacagaagaaucaagaaggccggcagcggcaacuacagcggcgacaucagcgacgaccuguucagauucgccuucgagagcaucaccaacgugaucuucggcgagagacagggcaugcuggaggagguggugaaccccgaggcccagagauucaucgacgccaucuaccagauguuccacaccagcgugcccaugcugaaccugccccccgaccuguucagacuguucagaaccaagaccuggaaggaccacguggccgccugggacgugaucuucagcaaggccgacaucuacacccagaacuucuacugggagcugagacagaagggcagcgugcaccacgacuacagaggcauccuguacagacugcugggcgacagcaagaugagcuucgaggacaucaaggccaacgugaccgagaugcuggccggcggcguggacaccaccagcaugacccugcaguggcaccuguacgagauggccagaaaccugaaggugcaggacaugcugagagccgaggugcuggccgccagacaccaggcccagggcgacauggccaccaugcugcagcuggugccccugcugaaggccagcaucaaggagacccugagacugcaccccaucagcgugacccugcagagauaccuggugaacgaccuggugcugagagacuacaugauccccgccaagacccuggugcagguggccaucuacgcccugggcagagagcccaccuucuucuucgaccccgagaacuucgaccccaccagauggcugagcaaggacaagaacaucaccuacuucagaaaccugggcuucggcuggggcgugagacagugccugggcagaagaaucgccgagcuggagaugaccaucuuccugaucaacaugcuggagaacuucagaguggagauccagcaccugagcgacgugggcaccaccuucaaccugauccugaugcccgagaagcccaucagcuucaccuucuggcccuucaaccaggaggccacccagcaguaa

SEQ ID NO: 15855 - RNA, 1512 nt, Artificial Sequence
  CYP11B1__Homo_sapiens__NP_000488
auggcccugagagccaaggccgaggugugcauggccgugcccuggcugagccugcagagagcccaggcccugggcaccagagccgccagagugcccagaaccgugcugcccuucgaggccaugcccagaagacccggcaacagauggcugagacugcugcagaucuggagagagcagggcuacgaggaccugcaccuggaggugcaccagaccuuccaggagcugggccccaucuucagauacgaccugggcggcgccggcauggugugcgugaugcugcccgaggacguggagaagcugcagcagguggacagccugcacccccacagaaugagccuggagcccuggguggccuacagacagcacagaggccacaagugcggcguguuccugcugaacggccccgaguggagauucaacagacugagacugaaccccgaggugcugagccccaacgccgugcagagauuccugcccaugguggacgccguggccagagacuucagccaggcccugaagaagaaggugcugcagaacgccagaggcagccugacccuggacgugcagcccagcaucuuccacuacaccaucgaggccagcaaccuggcccuguucggcgagagacugggccuggugggccacagccccagcagcgccagccugaacuuccugcacgcccuggaggugauguucaagagcaccgugcagcugauguucaugcccagaagccugagcagauggaccagccccaagguguggaaggagcacuucgaggccugggacugcaucuuccaguacggcgacaacugcauccagaagaucuaccaggagcuggccuucagcagaccccagcaguacaccagcaucguggccgagcugcugcugaacgccgagcugagccccgacgccaucaaggccaacagcauggagcugaccgccggcagcguggacaccaccguguucccccugcugaugacccuguucgagcuggccagaaaccccaacgugcagcaggcccugagacaggagagccuggccgccgccgccagcaucagcgagcacccccagaaggccaccaccgagcugccccugcugagagccgcccugaaggagacccugagacuguaccccgugggccuguuccuggagagaguggccagcagcgaccuggugcugcagaacuaccacauccccgccggcacccuggugagaguguuccuguacagccugggcagaaaccccgcccuguuccccagacccgagagauacaacccccagagauggcuggacaucagaggcagcggcagaaacuucuaccacgugcccuucggcuucggcaugagacagugccugggcagaagacuggccgaggccgagaugcugcugcugcugcaccacgugcugaagcaccugcagguggagacccugacccaggaggacaucaagaugguguacagcuucauccugagacccagcauguucccccugcugaccuucagagccaucaacuaa

SEQ ID NO: 15856 - RNA, 1512 nt, Artificial Sequence
  CYP11B2__Homo_sapiens__NP_000489
auggcccugagagccaaggccgaggugugcguggccgcccccuggcugagccugcagagagccagagcccugggcaccagagccgccagagcccccagaaccgugcugcccuucgaggccaugccccagcaccccggcaacagauggcugagacugcugcagaucuggagagagcagggcuacgagcaccugcaccuggagaugcaccagaccuuccaggagcugggccccaucuucagauacaaccugggcggccccagaauggugugcgugaugcugcccgaggacguggagaagcugcagcagguggacagccugcaccccugcagaaugauccuggagcccuggguggccuacagacagcacagaggccacaagugcggcguguuccugcugaacggccccgaguggagauucaacagacugagacugaaccccgacgugcugagccccaaggccgugcagagauuccugcccaugguggacgccguggccagagacuucagccaggcccugaagaagaaggugcugcagaacgccagaggcagccugacccuggacgugcagcccagcaucuuccacuacaccaucgaggccagcaaccuggcccuguucggcgagagacugggccuggugggccacagccccagcagcgccagccugaacuuccugcacgcccuggaggugauguucaagagcaccgugcagcugauguucaugcccagaagccugagcagauggaucagccccaagguguggaaggagcacuucgaggccugggacugcaucuuccaguacggcgacaacugcauccagaagaucuaccaggagcuggccuucaacagaccccagcacuacaccggcaucguggccgagcugcugcugaaggccgagcugagccuggaggccaucaaggccaacagcauggagcugaccgccggcagcguggacaccaccgccuucccccugcugaugacccuguucgagcuggccagaaaccccgacgugcagcagauccugagacaggagagccuggccgccgccgccagcaucagcgagcacccccagaaggccaccaccgagcugccccugcugagagccgcccugaaggagacccugagacuguaccccgugggccuguuccuggagagaguggugagcagcgaccuggugcugcagaacuaccacauccccgccggcacccuggugcagguguuccuguacagccugggcagaaacgccgcccuguuccccagacccgagagauacaacccccagagauggcuggacaucagaggcagcggcagaaacuuccaccacgugcccuucggcuucggcaugagacagugccugggcagaagacuggccgaggccgagaugcugcugcugcugcaccacgugcugaagcacuuccugguggagacccugacccaggaggacaucaagaugguguacagcuucauccugagacccggcaccagcccccugcugaccuucagagccaucaacuaa

SEQ ID NO: 15857 - RNA, 1527 nt, Artificial Sequence
  CYP17A1__Homo_sapiens__NP_000093
augugggagcugguggcccugcugcugcugacccuggccuaccuguucuggcccaagagaagaugccccggcgccaaguaccccaagagccugcugagccugccccuggugggcagccugcccuuccugcccagacacggccacaugcacaacaacuucuucaagcugcagaagaaguacggccccaucuacagcgugagaaugggcaccaagaccaccgugaucgugggccaccaccagcuggccaaggaggugcugaucaagaagggcaaggacuucagcggcagaccccagauggccacccuggacaucgccagcaacaacagaaagggcaucgccuucgccgacagcggcgcccacuggcagcugcacagaagacuggccauggccaccuucgcccuguucaaggacggcgaccagaagcuggagaagaucaucugccaggagaucagcacccugugcgacaugcuggccacccacaacggccagagcaucgacaucagcuuccccguguucguggccgugaccaacgugaucagccugaucugcuucaacaccagcuacaagaacggcgaccccgagcugaacgugauccagaacuacaacgagggcaucaucgacaaccugagcaaggacagccugguggaccuggugcccuggcugaagaucuuccccaacaagacccuggagaagcugaagagccacgugaagaucagaaacgaccugcugaacaagauccuggagaacuacaaggagaaguucagaagcgacagcaucaccaacaugcuggacacccugaugcaggccaagaugaacagcgacaacggcaacgccggccccgaccaggacagcgagcugcugagcgacaaccacauccugaccaccaucggcgacaucuucggcgccggcguggagaccaccaccagcguggugaaguggacccuggccuuccugcugcacaacccccaggugaagaagaagcuguacgaggagaucgaccagaacgugggcuucagcagaacccccaccaucagcgacagaaacagacugcugcugcuggaggccaccaucagagaggugcugagacugagacccguggcccccaugcugaucccccacaaggccaacguggacagcagcaucggcgaguucgccguggacaagggcaccgaggugaucaucaaccugugggcccugcaccacaacgagaaggaguggcaccagcccgaccaguucaugcccgagagauuccugaaccccgccggcacccagcugaucagccccagcgugagcuaccugcccuucggcgccggccccagaagcugcaucggcgagauccuggccagacaggagcuguuccugaucauggccuggcugcugcagagauucgaccuggaggugcccgacgacggccagcugcccagccuggagggcauccccaaggugguguuccugaucgacagcuucaaggugaagaucaaggugagacaggccuggagagaggcccaggccgagggcagcaccuaa

SEQ ID NO: 15858 - RNA, 1512 nt, Artificial Sequence
  CYP19A1__Homo_sapiens__NP_112503
auggugcuggagaugcugaaccccauccacuacaacaucaccagcaucgugcccgaggccaugcccgccgccaccaugcccgugcugcugcugaccggccuguuccugcugguguggaacuacgagggcaccagcagcauccccggccccggcuacugcaugggcaucggcccccugaucagccacggcagauuccuguggaugggcaucggcagcgccugcaacuacuacaacagaguguacggcgaguucaugagaguguggaucagcggcgaggagacccugaucaucagcaagagcagcagcauguuccacaucaugaagcacaaccacuacagcagcagauucggcagcaagcugggccugcagugcaucggcaugcacgagaagggcaucaucuucaacaacaaccccgagcuguggaagaccaccagacccuucuucaugaaggcccugagcggccccggccuggugagaauggugaccgugugcgccgagagccugaagacccaccuggacagacuggaggaggugaccaacgagagcggcuacguggacgugcugacccugcugagaagagugaugcuggacaccagcaacacccuguuccugagaaucccccuggacgagagcgccaucguggugaagauccagggcuacuucgacgccuggcaggcccugcugaucaagcccgacaucuucuucaagaucagcuggcuguacaagaaguacgagaagagcgugaaggaccugaaggacgccaucgaggugcugaucgccgagaagagaagaagaaucagcaccgaggagaagcuggaggagugcauggacuucgccaccgagcugauccuggccgagaagagaggcgaccugaccagagagaacgugaaccagugcauccuggagaugcugaucgccgcccccgacaccaugagcgugagccuguucuucaugcuguuccugaucgccaagcaccccaacguggaggaggccaucaucaaggagauccagaccgugaucggcgagagagacaucaagaucgacgacauccagaagcugaaggugauggagaacuucaucuacgagagcaugagauaccagcccgugguggaccuggugaugagaaaggcccuggaggacgacgugaucgacggcuaccccgugaagaagggcaccaacaucauccugaacaucggcagaaugcacagacuggaguucuuccccaagcccaacgaguucacccuggagaacuucgccaagaacgugcccuacagauacuuccagcccuucggcuucggccccagaggcugcgccggcaaguacaucgccauggugaugaugaaggccauccuggugacccugcugagaagauuccacgugaagacccugcagggccagugcguggagagcauccagaagauccacgaccugagccugcaccccgacgagaccaagaacaugcuggagaugaucuucacccccagaaacagcgacagaugccuggagcacuaa

SEQ ID NO: 15859 - RNA, 1539 nt, Artificial Sequence
  CYP1A1__Homo_sapiens__NP_000490
augcuguuccccaucagcaugagcgccaccgaguuccugcuggccagcgugaucuucugccugguguucugggugaucagagccagcagaccccaggugcccaagggccugaagaacccccccggccccuggggcuggccccugaucggccacaugcugacccugggcaagaacccccaccuggcccugagcagaaugagccagcaguacggcgacgugcugcagaucagaaucggcagcacccccgugguggugcugagcggccuggacaccaucagacaggcccuggugagacagggcgacgacuucaagggcagacccgaccuguacaccuucacccugaucagcaacggccagagcaugagcuucagccccgacagcggccccgugugggccgccagaagaagacuggcccagaacggccugaagagcuucagcaucgccagcgaccccgccagcagcaccagcugcuaccuggaggagcacgugagcaaggaggccgaggugcugaucagcacccugcaggagcugauggccggccccggccacuucaaccccuacagauacgugguggugagcgugaccaacgugaucugcgccaucugcuucggcagaagauacgaccacaaccaccaggagcugcugagccuggugaaccugaacaacaacuucggcgagguggugggcagcggcaaccccgccgacuucauccccauccugagauaccugcccaaccccagccugaacgccuucaaggaccugaacgagaaguucuacagcuucaugcagaagauggugaaggagcacuacaagaccuucgagaagggccacaucagagacaucaccgacagccugaucgagcacugccaggagaagcagcuggacgagaacgccaacgugcagcugagcgacgagaagaucaucaacaucgugcuggaccuguucggcgccggcuucgacaccgugaccaccgccaucagcuggagccugauguaccuggugaugaaccccagagugcagagaaagauccaggaggagcuggacaccgugaucggcagaagcagaagacccagacugagcgacagaagccaccugcccuacauggaggccuucauccuggagaccuucagacacagcagcuucgugcccuucaccaucccccacagcaccaccagagacaccagccugaagggcuucuacauccccaagggcagaugcguguucgugaaccaguggcagaucaaccacgaccagaagcugugggugaaccccagcgaguuccugcccgagagauuccugacccccgacggcgccaucgacaaggugcugagcgagaaggugaucaucuucggcaugggcaagagaaagugcaucggcgagaccaucgccagaugggagguguuccuguuccuggccauccugcugcagagaguggaguucagcgugccccugggcgugaagguggacaugacccccaucuacggccugaccaugaagcacgccugcugcgagcacuuccagaugcagcugagaagcuaa

SEQ ID NO: 15860 - RNA, 1551 nt, Artificial Sequence
  CYP1A2__Homo_sapiens__NP_000752
auggcccugagccagagcgugcccuucagcgccaccgagcugcugcuggccagcgccaucuucugccugguguucugggugcugaagggccugagacccagagugcccaagggccugaagagcccccccgagcccuggggcuggccccugcugggccacgugcugacccugggcaagaacccccaccuggcccugagcagaaugagccagagauacggcgacgugcugcagaucagaaucggcagcacccccgugcuggugcugagcagacuggacaccaucagacaggcccuggugagacagggcgacgacuucaagggcagacccgaccuguacaccagcacccugaucaccgacggccagagccugaccuucagcaccgacagcggccccgugugggccgccagaagaagacuggcccagaacgcccugaacaccuucagcaucgccagcgaccccgccagcagcagcagcugcuaccuggaggagcacgugagcaaggaggccaaggcccugaucagcagacugcaggagcugauggccggccccggccacuucgaccccuacaaccaggugguggugagcguggccaacgugaucggcgccaugugcuucggccagcacuuccccgagagcagcgacgagaugcugagccuggugaagaacacccacgaguucguggagaccgccagcagcggcaacccccuggacuucuuccccauccugagauaccugcccaaccccgcccugcagagauucaaggccuucaaccagagauuccugugguuccugcagaagaccgugcaggagcacuaccaggacuucgacaagaacagcgugagagacaucaccggcgcccuguucaagcacagcaagaagggccccagagccagcggcaaccugaucccccaggagaagaucgugaaccuggugaacgacaucuucggcgccggcuucgacaccgugaccaccgccaucagcuggagccugauguaccuggugaccaagcccgagauccagagaaagauccagaaggagcuggacaccgugaucggcagagagagaagacccagacugagcgacagaccccagcugcccuaccuggaggccuucauccuggagaccuucagacacagcagcuuccugcccuucaccaucccccacagcaccaccagagacaccacccugaacggcuucuacauccccaagaagugcugcguguucgugaaccaguggcaggugaaccacgaccccgagcugugggaggaccccagcgaguucagacccgagagauuccugaccgccgacggcaccgccaucaacaagccccugagcgagaagaugaugcuguucggcaugggcaagagaagaugcaucggcgaggugcuggccaagugggagaucuuccuguuccuggccauccugcugcagcagcuggaguucagcgugccccccggcgugaagguggaccugacccccaucuacggccugaccaugaagcacgccagaugcgagcacgugcaggccagacugagauucagcaucaacuaa

SEQ ID NO: 15861 - RNA, 1632 nt, Artificial Sequence
  CYP1B1__Homo_sapiens__NP_000095
augggcaccagccugagccccaacgaccccuggccccugaacccccugagcauccagcagaccacccugcugcugcugcugagcgugcuggccaccgugcacgugggccagagacugcugagacagagaagaagacagcugagaagcgccccccccggccccuucgccuggccccugaucggcaacgccgccgccgugggccaggccgcccaccugagcuucgccagacuggccagaagauacggcgacguguuccagaucagacugggcagcugccccaucguggugcugaacggcgagagagccauccaccaggcccuggugcagcagggcagcgccuucgccgacagacccgccuucgccagcuucagaguggugagcggcggcagaagcauggccuucggccacuacagcgagcacuggaaggugcagagaagagccgcccacagcaugaugagaaacuucuucaccagacagcccagaagcagacaggugcuggagggccacgugcugagcgaggccagagagcugguggcccugcuggugagaggcagcgccgacggcgccuuccuggaccccagaccccugaccgugguggccguggccaacgugaugagcgccgugugcuucggcugcagauacagccacgacgaccccgaguucagagagcugcugagccacaacgaggaguucggcagaaccgugggcgccggcagccugguggacgugaugcccuggcugcaguacuuccccaaccccgugagaaccguguucagagaguucgagcagcugaacagaaacuucagcaacuucauccuggacaaguuccugagacacugcgagagccugagacccggcgccgcccccagagacaugauggacgccuucauccugagcgccgagaagaaggccgccggcgacagccacggcggcggcgccagacuggaccuggagaacgugcccgccaccaucaccgacaucuucggcgccagccaggacacccugagcaccgcccugcaguggcugcugcugcuguucaccagauaccccgacgugcagaccagagugcaggccgagcuggaccagguggugggcagagacagacugcccugcaugggcgaccagcccaaccugcccuacgugcuggccuuccuguacgaggccaugagauucagcagcuucgugcccgugaccaucccccacgccaccaccgccaacaccagcgugcugggcuaccacauccccaaggacaccgugguguucgugaaccaguggagcgugaaccacgacccccugaaguggcccaaccccgagaacuucgaccccgccagauuccuggacaaggacggccugaucaacaaggaccugaccagcagagugaugaucuucagcgugggcaagagaagaugcaucggcgaggagcugagcaagaugcagcuguuccuguucaucagcauccuggcccaccagugcgacuucagagccaaccccaacgagcccgccaagaugaacuucagcuacggccugaccaucaagcccaagagcuucaaggugaacgugacccugagagagagcauggagcugcuggacagcgccgugcagaaccugcaggccaaggagaccugccaguaa

SEQ ID NO: 15862 - RNA, 1488 nt, Artificial Sequence
  CYP21A2__Homo_sapiens__NP_000491
augcugcugcugggccugcugcugcugcugccccugcuggccggcgccagacugcuguggaacugguggaagcugagaagccugcaccugcccccccuggcccccggcuuccugcaccugcugcagcccgaccugcccaucuaccugcugggccugacccagaaguucggccccaucuacagacugcaccugggccugcaggacgugguggugcugaacagcaagagaaccaucgaggaggccauggugaagaagugggccgacuucgccggcagacccgagccccugaccuacaagcuggugagcagaaacuaccccgaccugagccugggcgacuacagccugcuguggaaggcccacaagaagcugaccagaagcgcccugcugcugggcaucagagacagcauggagcccgugguggagcagcugacccaggaguucugcgagagaaugagagcccagcccggcacccccguggccaucgaggaggaguucagccugcugaccugcagcaucaucugcuaccugaccuucggcgacaagaucaaggacgacaaccugaugcccgccuacuacaagugcauccaggaggugcugaagaccuggagccacuggagcauccagaucguggacgugauccccuuccugagauucuuccccaaccccggccugagaagacugaagcaggccaucgagaagagagaccacaucguggagaugcagcugagacagcacaaggagagccugguggccggccaguggagagacaugauggacuacaugcugcagggcguggcccagcccagcauggaggagggcagcggccagcugcuggagggccacgugcacauggccgccguggaccugcugaucggcggcaccgagaccaccgccaacacccugagcugggccgugguguuccugcugcaccaccccgagauccagcagagacugcaggaggagcuggaccacgagcugggccccggcgccagcagcagcagagugcccuacaaggacagagccagacugccccugcugaacgccaccaucgccgaggugcugagacugagacccguggugccccuggcccugccccacagaaccaccagacccagcagcaucagcggcuacgacauccccgagggcaccgugaucauccccaaccugcagggcgcccaccuggacgagaccgugugggagagaccccacgaguucuggcccgacagauuccuggagcccggcaagaacagcagagcccuggccuucggcugcggcgccagagugugccugggcgagccccuggccagacuggagcuguucguggugcugaccagacugcugcaggccuucacccugcugcccagcggcgacgcccugcccagccugcagccccugccccacugcagcgugauccugaagaugcagcccuuccaggugagacugcagcccagaggcaugggcgcccacagccccggccagagccaguaa

SEQ ID NO: 15863 - RNA, 1545 nt, Artificial Sequence
  CYP24A1__Homo_sapiens__NP_000773
augagcagccccaucagcaagagcagaagccuggccgccuuccugcagcagcugagaagccccagacagccccccagacuggugaccagcaccgccuacaccagcccccagcccagagaggugcccgugugcccccugaccgccggcggcgagacccagaacgccgccgcccugcccggccccaccagcuggccccugcugggcagccugcugcagauccuguggaagggcggccugaagaagcagcacgacacccugguggaguaccacaagaaguacggcaagaucuucagaaugaagcugggcagcuucgagagcgugcaccugggcagccccugccugcuggaggcccuguacagaaccgagagcgccuacccccagagacuggagaucaagcccuggaaggccuacagagacuacagaaaggagggcuacggccugcugauccuggagggcgaggacuggcagagagugagaagcgccuuccagaagaagcugaugaagcccggcgaggugaugaagcuggacaacaagaucaacgaggugcuggccgacuucaugggcagaaucgacgagcugugcgacgagagaggccacguggaggaccuguacagcgagcugaacaaguggagcuucgagagcaucugccuggugcuguacgagaagagauucggccugcugcagaagaacgccggcgacgaggccgugaacuucaucauggccaucaagaccaugaugagcaccuucggcagaaugauggugacccccguggagcugcacaagagccugaacaccaagguguggcaggaccacacccuggccugggacaccaucuucaagagcgugaaggccugcaucgacaacagacuggagaaguacagccagcagcccagcgccgacuuccugugcgacaucuaccaccagaacagacugagcaagaaggagcuguacgccgccgugaccgagcugcagcuggccgccguggagaccaccgccaacagccugauguggauccuguacaaccugagcagaaacccccaggugcagcagaagcugcugaaggagauccagagcgugcugcccgagaaccaggugcccagagccgaggaccugagaaacaugcccuaccugaaggccugccugaaggagagcaugagacugacccccagcgugcccuucaccaccagaacccuggacaaggccaccgugcugggcgaguacgcccugcccaagggcaccgugcugaugcugaacacccaggugcugggcagcagcgaggacaacuucgaggacagcagccaguucagacccgagagauggcugcaggagaaggagaagaucaaccccuucgcccaccugcccuucggcgugggcaagagaaugugcaucggcagaagacuggccgagcugcagcugcaccuggcccugugcuggaucgugagaaaguacgacauccaggccaccgacaacgagcccguggagaugcugcacagcggcacccuggugcccagcagagagcugcccaucgccuucugccagagauaa

SEQ ID NO: 15864 - RNA, 1494 nt, Artificial Sequence
  CYP26A1__Homo_sapiens__NP_000774
augggccugcccgcccugcuggccagcgcccugugcaccuucgugcugccccugcugcuguuccuggccgccaucaagcugugggaccuguacugcgugagcggcagagacagaagcugcgcccugccccugccccccggcaccaugggcuuccccuucuucggcgagacccugcagauggugcugcagagaagaaaguuccugcagaugaagagaagaaaguacggcuucaucuacaagacccaccuguucggcagacccaccgugagagugaugggcgccgacaacgugagaagaauccugcugggcgagcacagacuggugagcgugcacuggcccgccagcgugagaaccauccugggcagcggcugccugagcaaccugcacgacagcagccacaagcagagaaagaaggugaucaugagagccuucagcagagaggcccuggagugcuacgugcccgugaucaccgaggaggugggcagcagccuggagcaguggcugagcugcggcgagagaggccugcugguguaccccgaggugaagagacugauguucagaaucgccaugagaauccugcugggcugcgagccccagcuggccggcgacggcgacagcgagcagcagcugguggaggccuucgaggagaugaccagaaaccuguucagccugcccaucgacgugcccuucagcggccuguacagaggcaugaaggccagaaaccugauccacgccagaaucgagcagaacaucagagccaagaucugcggccugagagccagcgaggccggccagggcugcaaggacgcccugcagcugcugaucgagcacagcugggagagaggcgagagacuggacaugcaggcccugaagcagagcagcaccgagcugcuguucggcggccacgagaccaccgccagcgccgccaccagccugaucaccuaccugggccuguacccccacgugcugcagaaggugagagaggagcugaagagcaagggccugcugugcaagagcaaccaggacaacaagcuggacauggagauccuggagcagcugaaguacaucggcugcgugaucaaggagacccugagacugaacccccccgugcccggcggcuucagaguggcccugaagaccuucgagcugaacggcuaccagauccccaagggcuggaacgugaucuacagcaucugcgacacccacgacguggccgagaucuucaccaacaaggaggaguucaaccccgacagauucaugcugccccaccccgaggacgccagcagauucagcuucauccccuucggcggcggccugagaagcugcgugggcaaggaguucgccaagauccugcugaagaucuucaccguggagcuggccagacacugcgacuggcagcugcugaacggcccccccaccaugaagaccagccccaccguguaccccguggacaaccugcccgccagauucacccacuuccacggcgagaucuaa

SEQ ID NO: 15865 - RNA, 1314 nt, Artificial Sequence
  CYP26B1__Homo_sapiens__NP_001264671
augcuguucgagggccuggaccuggugagcgcccuggccacccuggccgccugccuggugagcgugacccugcugcuggccgugagccagcagcuguggcagcugagaugggccgccaccagagacaagagcugcaagcugcccauccccaagggcagcaugggcuucccccugaucggcgagaccggccacuggcugcugcagguguucagcaagaucuucagccacgaggcccuggagagcuaccugcccaagauccagcuggugauccaggacacccugagagccuggagcagccaccccgaggccaucaacguguaccaggaggcccagaagcugaccuucagaauggccaucagagugcugcugggcuucagcauccccgaggaggaccugggccaccuguucgagguguaccagcaguucguggacaacguguucagccugcccguggaccugcccuucagcggcuacagaagaggcauccaggccagacagauccugcagaagggccuggagaaggccaucagagagaagcugcagugcacccagggcaaggacuaccuggacgcccuggaccugcugaucgagagcagcaaggagcacggcaaggagaugaccaugcaggagcugaaggacggcacccuggagcugaucuucgccgccuacgccaccaccgccagcgccagcaccagccugaucaugcagcugcugaagcaccccaccgugcuggagaagcugagagacgagcugagagcccacggcauccugcacagcggcggcugccccugcgagggcacccugagacuggacacccugagcggccugagauaccuggacugcgugaucaaggaggugaugagacuguucacccccaucagcggcggcuacagaaccgugcugcagaccuucgagcuggacggcuuccagauccccaagggcuggagcgugauguacagcaucagagacacccacgacaccgcccccguguucaaggacgugaacguguucgaccccgacagauucagccaggccagaagcgaggacaaggacggcagauuccacuaccugcccuucggcggcggcgugagaaccugccugggcaagcaccuggccaagcuguuccugaaggugcuggccguggagcuggccagcaccagcagauucgagcuggccaccagaaccuuccccagaaucacccuggugcccgugcugcaccccguggacggccugagcgugaaguucuucggccuggacagcaaccagaacgagauccugcccgagaccgaggccaugcugagcgccaccguguaa

SEQ ID NO: 15866 - RNA, 1569 nt, Artificial Sequence
  CYP26C1__Homo_sapiens__NP_899230
auguuccccuggggccugagcugccugagcgugcugggcgccgccggcaccgcccugcugugcgccggccugcugcugagccuggcccagcaccuguggacccugagauggaugcugagcagagacagagccagcacccugccccugcccaagggcagcaugggcuggcccuucuucggcgagacccugcacuggcuggugcagggcagcagauuccacagcagcagaagagagagauacggcaccguguucaagacccaccugcugggcagacccgugaucagagugagcggcgccgagaacgugagaaccauccugcugggcgagcacagacuggugagaagccaguggccccagagcgcccacauccugcugggcagccacacccugcugggcgccgugggcgagccccacagaagaagaagaaaggugcuggccagaguguucagcagagccgcccuggagagauacgugcccagacugcagggcgcccugagacacgaggugagaagcuggugcgccgccggcggccccgugagcguguacgacgccagcaaggcccugaccuucagaauggccgccagaauccugcugggccugagacuggacgaggcccagugcgccacccuggccagaaccuucgagcagcugguggagaaccuguucagccugccccuggacgugcccuucagcggccugagaaagggcaucagagccagagaccagcugcacagacaccuggagggcgccaucagcgagaagcugcacgaggacaaggccgccgagcccggcgacgcccuggaccugaucauccacagcgccagagagcugggccacgagcccagcaugcaggagcugaaggagagcgccguggagcugcuguucgccgccuucuucaccaccgccagcgccagcaccagccuggugcugcugcugcugcagcaccccgccgccaucgccaagaucagagaggagcugguggcccagggccugggcagagccugcggcugcgcccccggcgccgccggcggcagcgagggccccccccccgacugcggcugcgagcccgaccugagccuggccgcccugggcagacugagauacguggacugcguggugaaggaggugcugagacugcugccccccgugagcggcggcuacagaaccgcccugagaaccuucgagcuggacggcuaccagauccccaagggcuggagcgugauguacagcaucagagacacccacgagaccgccgccguguacagaagcccccccgagggcuucgaccccgagagauucggcgccgccagagaggacagcagaggcgccagcagcagauuccacuacauccccuucggcggcggcgccagaagcugccugggccaggagcuggcccaggccgugcugcagcugcuggccguggagcuggugagaaccgccagaugggagcuggccacccccgccuuccccgccaugcagaccgugcccaucgugcaccccguggacggccugagacuguucuuccacccccugacccccagcguggccggcaacggccugugccuguaa

SEQ ID NO: 15867 - RNA, 1596 nt, Artificial Sequence
  CYP27A1__Homo_sapiens__NP_000775
auggccgcccugggcugcgccagacugagaugggcccugagaggcgccggcagaggccugugcccccacggcgccagagccaaggccgccauccccgccgcccugcccagcgacaaggccaccggcgcccccggcgccggccccggcgugagaagaagacagagaagccuggaggagauccccagacugggccagcugagauucuucuuccagcuguucgugcagggcuacgcccugcagcugcaccagcugcaggugcuguacaaggccaaguacggccccauguggaugagcuaccugggcccccagaugcacgugaaccuggccagcgccccccugcuggagcaggugaugagacaggagggcaaguaccccgugagaaacgacauggagcuguggaaggagcacagagaccagcacgaccugaccuacggccccuucaccaccgagggccaccacugguaccagcugagacaggcccugaaccagagacugcugaagcccgccgaggccgcccuguacaccgacgccuucaacgaggugaucgacgacuucaugaccagacuggaccagcugagagccgagagcgccagcggcaaccaggugagcgacauggcccagcuguucuacuacuucgcccuggaggccaucugcuacauccuguucgagaagagaaucggcugccugcagagaagcauccccgaggacaccgugaccuucgugagaagcaucggccugauguuccagaacagccuguacgccaccuuccugcccaaguggaccagacccgugcugcccuucuggaagagauaccuggacggcuggaacgccaucuucagcuucggcaagaagcugaucgacgagaagcuggaggacauggaggcccagcugcaggccgccggccccgacggcauccaggugagcggcuaccugcacuuccugcuggccagcggccagcugagccccagagaggccaugggcagccugcccgagcugcugauggccggcguggacaccaccagcaacacccugaccugggcccuguaccaccugagcaaggaccccgagauccaggaggcccugcacgaggagguggugggcguggugcccgccggccaggugccccagcacaaggacuucgcccacaugccccugcugaaggccgugcugaaggagacccugagacuguaccccguggugcccaccaacagcagaaucaucgagaaggagaucgagguggacggcuuccuguuccccaagaacacccaguucguguucugccacuacguggugagcagagaccccaccgccuucagcgagcccgagagcuuccagccccacagauggcugagaaacagccagcccgccacccccagaauccagcaccccuucggcagcgugcccuucggcuacggcgugagagccugccugggcagaagaaucgccgagcuggagaugcagcugcugcuggccagacugauccagaaguacaagguggugcuggcccccgagaccggcgagcugaagagcguggccagaaucgugcuggugcccaacaagaaggugggccugcaguuccugcagagacagugcuaa

SEQ ID NO: 15868 - RNA, 1527 nt, Artificial Sequence
  CYP27B1__Homo_sapiens__NP_000776
augacccagacccugaaguacgccagcagaguguuccacagagugagaugggcccccgagcugggcgccagccugggcuacagagaguaccacagcgccagaagaagccuggccgacauccccggccccagcacccccagcuuccuggccgagcuguucugcaagggcggccugagcagacugcacgagcugcaggugcagggcgccgcccacuucggccccguguggcuggccagcuucggcaccgugagaaccguguacguggccgcccccgcccugguggaggagcugcugagacaggagggccccagacccgagagaugcagcuucagccccuggaccgagcacagaagaugcagacagagagccugcggccugcugaccgccgagggcgaggaguggcagagacugagaagccugcuggccccccugcugcugagaccccaggccgccgccagauacgccggcacccugaacaacguggugugcgaccuggugagaagacugagaagacagagaggcagaggcaccggcccccccgcccuggugagagacguggccggcgaguucuacaaguucggccuggagggcaucgccgccgugcugcugggcagcagacugggcugccuggaggcccaggugccccccgacaccgagaccuucaucagagccgugggcagcguguucgugagcacccugcugaccauggccaugccccacuggcugagacaccuggugcccggccccuggggcagacugugcagagacugggaccagauguucgccuucgcccagagacacguggagagaagagaggccgaggccgccaugagaaacggcggccagcccgagaaggaccuggagagcggcgcccaccugacccacuuccuguucagagaggagcugcccgcccagagcauccugggcaacgugaccgagcugcugcuggccggcguggacaccgugagcaacacccugagcugggcccuguacgagcugagcagacaccccgaggugcagaccgcccugcacagcgagaucaccgccgcccugagccccggcagcagcgccuaccccagcgccaccgugcugagccagcugccccugcugaaggccguggugaaggaggugcugagacuguaccccguggugcccggcaacagcagagugcccgacaaggacauccacgugggcgacuacaucauccccaagaacacccuggugacccugugccacuacgccaccagcagagaccccgcccaguuccccgagcccaacagcuucagacccgccagauggcugggcgagggccccaccccccaccccuucgccagccugcccuucggcuucggcaagagaagcugcaugggcagaagacuggccgagcuggagcugcagauggcccuggcccagauccugacccacuucgaggugcagcccgagcccggcgccgcccccgugagacccaagaccagaaccgugcuggugcccgagagaagcaucaaccugcaguuccuggacagauaa

SEQ ID NO: 15869 - RNA, 1119 nt, Artificial Sequence
  CYP27C1__Homo_sapiens__NP_001001665
augagaagcgugcugagacagagaauccugaagcccaaggacguggccaucuacagcggcgaggugaaccaggugaucgccgaccugaucaagagaaucuaccugcugagaagccaggccgaggacggcgagaccgugaccaacgugaacgaccuguucuucaaguacagcauggagggcguggccaccauccuguacgagagcagacugggcugccuggagaacagcaucccccagcugaccguggaguacaucgaggcccuggagcugauguucagcauguucaagaccagcauguacgccggcgccauccccagauggcugagacccuucauccccaagcccuggagagaguucugcagaagcugggacggccuguucaaguucagccagauccacguggacaacaagcugagagacauccaguaccagauggacagaggcagaagagugagcggcggccugcugaccuaccuguuccugagccaggcccugacccugcaggagaucuacgccaacgugaccgagaugcugcuggccggcguggacaccaccagcuucacccugagcuggaccguguaccugcuggccagacaccccgaggugcagcagaccguguacagagagaucgugaagaaccugggcgagagacacgugcccaccgccgccgacgugcccaaggugccccuggugagagcccugcugaaggagacccugagacuguuccccgugcugcccggcaacggcagagugacccaggaggaccuggugaucggcggcuaccugauccccaagggcacccagcuggcccugugccacuacgccaccagcuaccaggacgagaacuuccccagagccaaggaguucagacccgagagauggcugagaaagggcgaccuggacagaguggacaacuucggcagcauccccuucggccacggcgugagaagcugcaucggcagaagaaucgccgagcuggagauccaccugguggugauccagcugcugcagcacuucgagaucaagaccagcagccagaccaacgccgugcacgccaagacccacggccugcugacccccggcggccccauccacgugagauucgugaacagaaaguaa

SEQ ID NO: 15870 - RNA, 1485 nt, Artificial Sequence
  CYP2A13__Homo_sapiens__NP_000757
augcuggccagcggccugcugcuggugacccugcuggccugccugaccgugauggugcugaugagcguguggagacagagaaagagcagaggcaagcugccccccggccccaccccccugcccuucaucggcaacuaccugcagcugaacaccgagcagauguacaacagccugaugaagaucagcgagagauacggccccguguucaccauccaccugggccccagaagagugguggugcugugcggccacgacgccgugaaggaggcccugguggaccaggccgaggaguucagcggcagaggcgagcaggccaccuucgacuggcuguucaagggcuacggcguggccuucagcaacggcgagagagccaagcagcugagaagauucagcaucgccacccugagaggcuucggcgugggcaagagaggcaucgaggagagaauccaggaggaggccggcuuccugaucgacgcccugagaggcacccacggcgccaacaucgaccccaccuucuuccugagcagaaccgugagcaacgugaucagcagcaucguguucggcgacagauucgacuacgaggacaaggaguuccugagccugcugagaaugaugcugggcagcuuccaguucaccgccaccagcaccggccagcuguacgagauguucagcagcgugaugaagcaccugcccggcccccagcagcaggccuucaaggagcugcagggccuggaggacuucaucgccaagaagguggagcacaaccagagaacccuggaccccaacagccccagagacuucaucgacagcuuccugaucagaaugcaggaggaggagaagaaccccaacaccgaguucuaccugaagaaccuggugaugaccacccugaaccuguucuucgccggcaccgagaccgugagcaccacccugagauacggcuuccugcugcugaugaagcaccccgagguggaggccaaggugcacgaggagaucgacagagugaucggcaagaacagacagcccaaguucgaggacagagccaagaugcccuacaccgaggccgugauccacgagauccagagauucggcgacaugcugcccaugggccuggcccacagagugaacaaggacaccaaguucagagacuucuuccugcccaagggcaccgagguguuccccaugcugggcagcgugcugagagaccccagauucuucagcaaccccagagacuucaacccccagcacuuccuggacaagaagggccaguucaagaagagcgacgccuucgugcccuucagcaucggcaagagauacugcuucggcgagggccuggccagaauggagcuguuccuguucuucaccaccaucaugcagaacuucagauucaagagcccccagagccccaaggacaucgacgugagccccaagcacgugggcuucgccaccauccccagaaacuacaccaugagcuuccugcccagauaa

SEQ ID NO: 15871 - RNA, 1485 nt, Artificial Sequence
  CYP2A6__Homo_sapiens__NP_000753
augcuggccagcggcaugcugcugguggcccugcuggugugccugaccgugauggugcugaugagcguguggcagcagagaaagagcaagggcaagcugccccccggccccaccccccugcccuucaucggcaacuaccugcagcugaacaccgagcagauguacaacagccugaugaagaucagcgagagauacggccccguguucaccauccaccugggccccagaagagugguggugcugugcggccacgacgccgugagagaggcccugguggaccaggccgaggaguucagcggcagaggcgagcaggccaccuucgacuggguguucaagggcuacggcgugguguucagcaacggcgagagagccaagcagcugagaagauucagcaucgccacccugagagacuucggcgugggcaagagaggcaucgaggagagaauccaggaggaggccggcuuccugaucgacgcccugagaggcaccggcggcgccaacaucgaccccaccuucuuccugagcagaaccgugagcaacgugaucagcagcaucguguucggcgacagauucgacuacaaggacaaggaguuccugagccugcugagaaugaugcugggcaucuuccaguucaccagcaccagcaccggccagcuguacgagauguucagcagcgugaugaagcaccugcccggcccccagcagcaggccuuccagcugcugcagggccuggaggacuucaucgccaagaagguggagcacaaccagagaacccuggaccccaacagccccagagacuucaucgacagcuuccugaucagaaugcaggaggaggagaagaaccccaacaccgaguucuaccugaagaaccuggugaugaccacccugaaccuguucaucggcggcaccgagaccgugagcaccacccugagauacggcuuccugcugcugaugaagcaccccgagguggaggccaaggugcacgaggagaucgacagagugaucggcaagaacagacagcccaaguucgaggacagagccaagaugcccuacauggaggccgugauccacgagauccagagauucggcgacgugauccccaugagccuggccagaagagugaagaaggacaccaaguucagagacuucuuccugcccaagggcaccgagguguaccccaugcugggcagcgugcugagagaccccagcuucuucagcaacccccaggacuucaacccccagcacuuccugaacgagaagggccaguucaagaagagcgacgccuucgugcccuucagcaucggcaagagaaacugcuucggcgagggccuggccagaauggagcuguuccuguucuucaccaccgugaugcagaacuucagacugaagagcagccagagccccaaggacaucgacgugagccccaagcacgugggcuucgccaccauccccagaaacuacaccaugagcuuccugcccagauaa

SEQ ID NO: 15872 - RNA, 1485 nt, Artificial Sequence
  CYP2A7__Homo_sapiens__NP_000755
augcuggccagcggccugcugcugguggcccugcuggccugccugaccgugauggugcugaugagcguguggcagcagagaaagagcagaggcaagcugccccccggccccaccccccugcccuucaucggcaacuaccugcagcugaacaccgagcacaucugcgacagcaucaugaaguucagcgagugcuacggccccguguucaccauccaccugggccccagaagagugguggugcugugcggccacgacgccgugagagaggcccugguggaccaggccgaggaguucagcggcagaggcgagcaggccaccuucgacuggguguucaagggcuacggcguggccuucagcaacggcgagagagccaagcagcugcugagauucgccaucgccacccugagagacuucggcgugggcaagagaggcaucgaggagagaauccaggaggagagcggcuuccugaucgaggccaucagaagcacccacggcgccaacaucgaccccaccuucuuccugagcagaaccgugagcaacgugaucagcagcaucguguucggcgacagauucgacuacgaggacaaggaguuccugagccugcugagcaugaugcugggcaucuuccaguucaccagcaccagcaccggccagcuguacgagauguucagcagcgugaugaagcaccugcccggcccccagcagcaggccuucaagcugcugcagggccuggaggacuucaucgccaagaagguggagcacaaccagagaacccuggaccccaacagcccccaggacuucaucgacagcuuccugauccacaugcaggaggaggagaagaaccccaacaccgaguucuaccugaagaaccugaugaugagcacccugaaccuguucaucgccggcaccgagaccgugagcaccacccugagauacggcuuccugcugcugaugaagcaccccgagguggaggccaaggugcacgaggagaucgacagagugaucggcaagaacagacagcccaaguucgaggacagaaccaagaugcccuacauggaggccgugauccacgagauccagagauucggcgacgugauccccaugagccuggccagaagagugaagaaggacaccaaguucagagacuucuuccugcccaagggcaccgagguguuccccaugcugggcagcgugcugagagaccccagcuucuucagcaacccccaggacuucaacccccagcacuuccuggacgacaagggccaguucaagaagagcgacgccuucgugcccuucagcaucggcaagagaaacugcuucggcgagggccuggccagaauggagcuguuccuguucuucaccaccgugaugcagaacuucagacugaagagcagccagagccccaaggacaucgacgugagccccaagcacgugguguucgccaccauccccagaaacuacaccaugagcuuccugcccagauaa

SEQ ID NO: 15873 - RNA, 1476 nt, Artificial Sequence
  CYP2B6__Homo_sapiens__NP_000758
auggagcugagcgugcugcuguuccuggcccugcugaccggccugcugcugcugcuggugcagagacaccccaacacccacgacagacugccccccggccccagaccccugccccugcugggcaaccugcugcagauggacagaagaggccugcugaagagcuuccugagauucagagagaaguacggcgacguguucaccgugcaccugggccccagacccguggugaugcugugcggcguggaggccaucagagaggcccugguggacaaggccgaggccuucagcggcagaggcaagaucgccaugguggaccccuucuucagaggcuacggcgugaucuucgccaacggcaacagauggaaggugcugagaagauucagcgugaccaccaugagagacuucggcaugggcaagagaagcguggaggagagaauccaggaggaggcccagugccugaucgaggagcugagaaagagcaagggcgcccugauggaccccaccuuccuguuccagagcaucaccgccaacaucaucugcagcaucguguucggcaagagauuccacuaccaggaccaggaguuccugaagaugcugaaccuguucuaccagaccuucagccugaucagcagcguguucggccagcuguucgagcuguucagcggcuuccugaaguacuuccccggcgcccacagacagguguacaagaaccugcaggagaucaacgccuacaucggccacagcguggagaagcacagagagacccuggaccccagcgcccccaaggaccugaucgacaccuaccugcugcacauggagaaggagaagagcaacgcccacagcgaguucagccaccagaaccugaaccugaacacccugagccuguucuucgccggcaccgagaccaccagcaccacccugagauacggcuuccugcugaugcugaaguacccccacguggccgagagaguguacagagagaucgagcaggugaucggcccccacagaccccccgagcugcacgacagagccaagaugcccuacaccgaggccgugaucuacgagauccagagauucagcgaccugcugcccaugggcgugccccacaucgugacccagcacaccagcuucagaggcuacaucauccccaaggacaccgagguguuccugauccugagcaccgcccugcacgacccccacuacuucgagaagcccgacgccuucaaccccgaccacuuccuggacgccaacggcgcccugaagaagaccgaggccuucauccccuucagccugggcaagagaaucugccugggcgagggcaucgccagagccgagcuguuccuguucuucaccaccauccugcagaacuucagcauggccagccccguggcccccgaggacaucgaccugaccccccaggagugcggcgugggcaagaucccccccaccuaccagaucagauuccugcccagauaa

SEQ ID NO: 15874 - RNA, 1473 nt, Artificial Sequence
  CYP2C18__Homo_sapiens__NP_000763
auggaccccgccguggcccuggugcugugccugagcugccuguuccugcugagccuguggagacagagcagcggcagaggcagacugcccagcggccccaccccccugcccaucaucggcaacauccugcagcuggacgugaaggacaugagcaagagccugaccaacuucagcaagguguacggccccguguucaccguguacuucggccugaagcccaucguggugcugcacggcuacgaggccgugaaggaggcccugaucgaccacggcgaggaguucagcggcagaggcagcuuccccguggccgagaaggugaacaagggccugggcauccuguucagcaacggcaagagauggaaggagaucagaagauucugccugaugacccugagaaacuucggcaugggcaagagaagcaucgaggacagagugcaggaggaggccagaugccugguggaggagcugagaaagaccaacgccagccccugcgaccccaccuucauccugggcugcgcccccugcaacgugaucugcagcgugaucuuccacgacagauucgacuacaaggaccagagauuccugaaccugauggagaaguucaacgagaaccugagaauccugagcagccccuggauccaggugugcaacaacuuccccgcccugaucgacuaccugcccggcagccacaacaagaucgccgagaacuucgccuacaucaagagcuacgugcuggagagaaucaaggagcaccaggagagccuggacaugaacagcgccagagacuucaucgacugcuuccugaucaagauggagcaggagaagcacaaccagcagagcgaguucaccguggagagccugaucgccaccgugaccgacauguucggcgccggcaccgagaccaccagcaccacccugagauacggccugcugcugcugcugaaguaccccgaggugaccgccaaggugcaggaggagaucgagugcguggugggcagaaacagaagccccugcaugcaggacagaagccacaugcccuacaccgacgccguggugcacgagauccagagauacaucgaccugcugcccaccaaccugccccacgccgugaccugcgacgugaaguucaagaacuaccugauccccaagggcaccaccaucaucaccagccugaccagcgugcugcacaacgacaaggaguuccccaaccccgagauguucgaccccggccacuuccuggacaagagcggcaacuucaagaagagcgacuacuucaugcccuucagcgccggcaagagaaugugcaugggcgagggccuggccagaauggagcuguuccuguuccugaccaccauccugcagaacuucaaccugaagagccagguggaccccaaggacaucgacaucacccccaucgccaacgccuucggcagagugcccccccuguaccagcugugcuucauccccguguaa

SEQ ID NO: 15875 - RNA, 1473 nt, Artificial Sequence
  CYP2C19__Homo_sapiens__NP_000760
auggaccccuucguggugcuggugcugugccugagcugccugcugcugcugagcaucuggagacagagcagcggcagaggcaagcugccccccggccccaccccccugcccgugaucggcaacauccugcagaucgacaucaaggacgugagcaagagccugaccaaccugagcaagaucuacggccccguguucacccuguacuucggccuggagagaaugguggugcugcacggcuacgagguggugaaggaggcccugaucgaccugggcgaggaguucagcggcagaggccacuucccccuggccgagagagccaacagaggcuucggcaucguguucagcaacggcaagagauggaaggagaucagaagauucagccugaugacccugagaaacuucggcaugggcaagagaagcaucgaggacagagugcaggaggaggccagaugccugguggaggagcugagaaagaccaaggccagccccugcgaccccaccuucauccugggcugcgcccccugcaacgugaucugcagcaucaucuuccagaagagauucgacuacaaggaccagcaguuccugaaccugauggagaagcugaacgagaacaucagaaucgugagcacccccuggauccagaucugcaacaacuuccccaccaucaucgacuacuuccccggcacccacaacaagcugcugaagaaccuggccuucauggagagcgacauccuggagaaggugaaggagcaccaggagagcauggacaucaacaaccccagagacuucaucgacugcuuccugaucaagauggagaaggagaagcagaaccagcagagcgaguucaccaucgagaaccuggugaucaccgccgccgaccugcugggcgccggcaccgagaccaccagcaccacccugagauacgcccugcugcugcugcugaagcaccccgaggugaccgccaaggugcaggaggagaucgagagagugaucggcagaaacagaagccccugcaugcaggacagaggccacaugcccuacaccgacgccguggugcacgaggugcagagauacaucgaccugauccccaccagccugccccacgccgugaccugcgacgugaaguucagaaacuaccugauccccaagggcaccaccauccugaccagccugaccagcgugcugcacgacaacaaggaguuccccaaccccgagauguucgaccccagacacuuccuggacgagggcggcaacuucaagaagagcaacuacuucaugcccuucagcgccggcaagagaaucugcgugggcgagggccuggccagaauggagcuguuccuguuccugaccuucauccugcagaacuucaaccugaagagccugaucgaccccaaggaccuggacaccacccccguggugaacggcuucgccagcgugccccccuucuaccagcugugcuucauccccguguaa

SEQ ID NO: 15876 - RNA, 1473 nt, Artificial Sequence
  CYP2C8__Homo_sapiens__NP_000761
auggagcccuucguggugcuggugcugugccugagcuucaugcugcuguucagccuguggagacagagcugcagaagaagaaagcugccccccggccccaccccccugcccaucaucggcaacaugcugcagaucgacgugaaggacaucugcaagagcuucaccaacuucagcaagguguacggccccguguucaccguguacuucggcaugaaccccaucgugguguuccacggcuacgaggccgugaaggaggcccugaucgacaacggcgaggaguucagcggcagaggcaacagccccaucagccagagaaucaccaagggccugggcaucaucagcagcaacggcaagagauggaaggagaucagaagauucagccugaccacccugagaaacuucggcaugggcaagagaagcaucgaggacagagugcaggaggaggcccacugccugguggaggagcugagaaagaccaaggccagccccugcgaccccaccuucauccugggcugcgcccccugcaacgugaucugcagcgugguguuccagaagagauucgacuacaaggaccagaacuuccugacccugaugaagagauucaacgagaacuucagaauccugaacagccccuggauccaggugugcaacaacuucccccugcugaucgacugcuuccccggcacccacaacaaggugcugaagaacguggcccugaccagaagcuacaucagagagaaggugaaggagcaccaggccagccuggacgugaacaaccccagagacuucaucgacugcuuccugaucaagauggagcaggagaaggacaaccagaagagcgaguucaacaucgagaaccuggugggcaccguggccgaccuguucguggccggcaccgagaccaccagcaccacccugagauacggccugcugcugcugcugaagcaccccgaggugaccgccaaggugcaggaggagaucgaccacgugaucggcagacacagaagccccugcaugcaggacagaagccacaugcccuacaccgacgccguggugcacgagauccagagauacagcgaccuggugcccaccggcgugccccacgccgugaccaccgacaccaaguucagaaacuaccugauccccaagggcaccaccaucauggcccugcugaccagcgugcugcacgacgacaaggaguuccccaaccccaacaucuucgaccccggccacuuccuggacaagaacggcaacuucaagaagagcgacuacuucaugcccuucagcgccggcaagagaaucugcgccggcgagggccuggccagaauggagcuguuccuguuccugaccaccauccugcagaacuucaaccugaagagcguggacgaccugaagaaccugaacaccaccgccgugaccaagggcaucgugagccugccccccagcuaccagaucugcuucauccccguguaa

SEQ ID NO: 15877 - RNA, 1473 nt, Artificial Sequence
  CYP2C9__Homo_sapiens__NP_000762
auggacagccugguggugcuggugcugugccugagcugccugcugcugcugagccuguggagacagagcagcggcagaggcaagcugccccccggccccaccccccugcccgugaucggcaacauccugcagaucggcaucaaggacaucagcaagagccugaccaaccugagcaagguguacggccccguguucacccuguacuucggccugaagcccaucguggugcugcacggcuacgaggccgugaaggaggcccugaucgaccugggcgaggaguucagcggcagaggcaucuucccccuggccgagagagccaacagaggcuucggcaucguguucagcaacggcaagaaguggaaggagaucagaagauucagccugaugacccugagaaacuucggcaugggcaagagaagcaucgaggacagagugcaggaggaggccagaugccugguggaggagcugagaaagaccaaggccagccccugcgaccccaccuucauccugggcugcgcccccugcaacgugaucugcagcaucaucuuccacaagagauucgacuacaaggaccagcaguuccugaaccugauggagaagcugaacgagaacaucaagauccugagcagccccuggauccagaucugcaacaacuucagccccaucaucgacuacuuccccggcacccacaacaagcugcugaagaacguggccuucaugaagagcuacauccuggagaaggugaaggagcaccaggagagcauggacaugaacaacccccaggacuucaucgacugcuuccugaugaagauggagaaggagaagcacaaccagcccagcgaguucaccaucgagagccuggagaacaccgccguggaccuguucggcgccggcaccgagaccaccagcaccacccugagauacgcccugcugcugcugcugaagcaccccgaggugaccgccaaggugcaggaggagaucgagagagugaucggcagaaacagaagccccugcaugcaggacagaagccacaugcccuacaccgacgccguggugcacgaggugcagagauacaucgaccugcugcccaccagccugccccacgccgugaccugcgacaucaaguucagaaacuaccugauccccaagggcaccaccauccugaucagccugaccagcgugcugcacgacaacaaggaguuccccaaccccgagauguucgacccccaccacuuccuggacgagggcggcaacuucaagaagagcaaguacuucaugcccuucagcgccggcaagagaaucugcgugggcgaggcccuggccggcauggagcuguuccuguuccugaccagcauccugcagaacuucaaccugaagagccugguggaccccaagaaccuggacaccacccccguggugaacggcuucgccagcgugccccccuucuaccagcugugcuucauccccguguaa

SEQ ID NO: 15878 - RNA, 1494 nt, Artificial Sequence
  CYP2D6__Homo_sapiens__NP_000097
augggccuggaggcccuggugccccuggccgugaucguggccaucuuccugcugcugguggaccugaugcacagaagacagagaugggccgccagauacccccccggcccccugccccugcccggccugggcaaccugcugcacguggacuuccagaacacccccuacugcuucgaccagcugagaagaagauucggcgacguguucagccugcagcuggccuggacccccgugguggugcugaacggccuggccgccgugagagaggcccuggugacccacggcgaggacaccgccgacagaccccccgugcccaucacccagauccugggcuucggccccagaagccagggcguguuccuggccagauacggccccgccuggagagagcagagaagauucagcgugagcacccugagaaaccugggccugggcaagaagagccuggagcagugggugaccgaggaggccgccugccugugcgccgccuucgccaaccacagcggcagacccuucagacccaacggccugcuggacaaggccgugagcaacgugaucgccagccugaccugcggcagaagauucgaguacgacgaccccagauuccugagacugcuggaccuggcccaggagggccugaaggaggagagcggcuuccugagagaggugcugaacgccgugcccgugcugcugcacauccccgcccuggccggcaaggugcugagauuccagaaggccuuccugacccagcuggacgagcugcugaccgagcacagaaugaccugggaccccgcccagccccccagagaccugaccgaggccuuccuggccgagauggagaaggccaagggcaaccccgagagcagcuucaacgacgagaaccugagaaucgugguggccgaccuguucagcgccggcauggugaccaccagcaccacccuggccuggggccugcugcugaugauccugcaccccgacgugcagagaagagugcagcaggagaucgacgacgugaucggccaggugagaagacccgagaugggcgaccaggcccacaugcccuacaccaccgccgugauccacgaggugcagagauucggcgacaucgugccccugggcgugacccacaugaccagcagagacaucgaggugcagggcuucagaauccccaagggcaccacccugaucaccaaccugagcagcgugcugaaggacgaggccgugugggagaagcccuucagauuccaccccgagcacuuccuggacgcccagggccacuucgugaagcccgaggccuuccugcccuucagcgccggcagaagagccugccugggcgagccccuggccagaauggagcuguuccuguucuucaccagccugcugcagcacuucagcuucagcgugcccaccggccagcccagacccagccaccacggcguguucgccuuccuggugagccccagccccuacgagcugugcgccgugcccagauaa

SEQ ID NO: 15879 - RNA, 1482 nt, Artificial Sequence
  CYP2E1__Homo_sapiens__NP_000764
augagcgcccugggcgugaccguggcccugcuggugugggccgccuuccugcugcuggugagcauguggagacaggugcacagcagcuggaaccugccccccggccccuucccccugcccaucaucggcaaccuguuccagcuggagcugaagaacauccccaagagcuucaccagacuggcccagagauucggccccguguucacccuguacgugggcagccagagaaugguggugaugcacggcuacaaggccgugaaggaggcccugcuggacuacaaggacgaguucagcggcagaggcgaccugcccgccuuccacgcccacagagacagaggcaucaucuucaacaacggccccaccuggaaggacaucagaagauucagccugaccacccugagaaacuacggcaugggcaagcagggcaacgagagcagaauccagagagaggcccacuuccugcuggaggcccugagaaagacccagggccagcccuucgaccccaccuuccugaucggcugcgcccccugcaacgugaucgccgacauccuguucagaaagcacuucgacuacaacgacgagaaguuccugagacugauguaccuguucaacgagaacuuccaccugcugagcacccccuggcugcagcuguacaacaacuuccccagcuuccugcacuaccugcccggcagccacagaaaggugaucaagaacguggccgaggugaaggaguacgugagcgagagagugaaggagcaccaccagagccuggaccccaacugccccagagaccugaccgacugccugcugguggagauggagaaggagaagcacagcgccgagagacuguacaccauggacggcaucaccgugaccguggccgaccuguucuucgccggcaccgagaccaccagcaccacccugagauacggccugcugauccugaugaaguaccccgagaucgaggagaagcugcacgaggagaucgacagagugaucggccccagcagaauccccgccaucaaggacagacaggagaugcccuacauggacgccguggugcacgagauccagagauucaucacccuggugcccagcaaccugccccacgaggccaccagagacaccaucuucagaggcuaccugauccccaagggcaccgugguggugcccacccuggacagcgugcuguacgacaaccaggaguuccccgaccccgagaaguucaagcccgagcacuuccugaacgagaacggcaaguucaaguacagcgacuacuucaagcccuucagcaccggcaagagagugugcgccggcgagggccuggccagaauggagcuguuccugcugcugugcgccauccugcagcacuucaaccugaagccccugguggaccccaaggacaucgaccugagccccauccacaucggcuucggcugcaucccccccagauacaagcugugcgugauccccagaagcuaa

SEQ ID NO: 15880 - RNA, 1476 nt, Artificial Sequence
  CYP2F1__Homo_sapiens__NP_000765
auggacagcaucagcaccgccauccugcugcugcugcuggcccuggugugccugcugcugacccugagcagcagagacaagggcaagcugccccccggccccagaccccugagcauccugggcaaccugcugcugcugugcagccaggacaugcugaccagccugaccaagcugagcaaggaguacggcagcauguacaccgugcaccugggccccagaagagugguggugcugagcggcuaccaggccgugaaggaggcccugguggaccagggcgaggaguucagcggcagaggcgacuaccccgccuucuucaacuucaccaagggcaacggcaucgccuucagcagcggcgacagauggaaggugcugagacaguucagcauccagauccugagaaacuucggcaugggcaagagaagcaucgaggagagaauccuggaggagggcagcuuccugcuggccgagcugagaaagaccgagggcgagcccuucgaccccaccuucgugcugagcagaagcgugagcaacaucaucugcagcgugcuguucggcagcagauucgacuacgacgacgagagacugcugaccaucaucagacugaucaacgacaacuuccagaucaugagcagccccuggggcgagcuguacgacaucuuccccagccugcuggacugggugcccggcccccaccagagaaucuuccagaacuucaagugccugagagaccugaucgcccacagcgugcacgaccaccaggccagccuggaccccagaagccccagagacuucauccagugcuuccugaccaagauggccgaggagaaggaggacccccugagccacuuccacauggacacccugcugaugaccacccacaaccugcuguucggcggcaccaagaccgugagcaccacccugcaccacgccuuccuggcccugaugaaguaccccaaggugcaggccagagugcaggaggagaucgaccugguggugggcagagccagacugcccgcccugaaggacagagccgccaugcccuacaccgacgccgugauccacgaggugcagagauucgccgacaucauccccaugaaccugccccacagagugaccagagacaccgccuucagaggcuuccugauccccaagggcaccgacgugaucacccugcugaacaccgugcacuacgaccccagccaguuccugaccccccaggaguucaaccccgagcacuuccuggacgccaaccagagcuucaagaagagccccgccuucaugcccuucagcgccggcagaagacugugccugggcgagagccuggccagaauggagcuguuccuguaccugaccgccauccugcagagcuucagccugcagccccugggcgcccccgaggacaucgaccugaccccccugagcagcggccugggcaaccugcccagacccuuccagcugugccugagacccagauaa

SEQ ID NO: 15881 - RNA, 1506 nt, Artificial Sequence
  CYP2R1__Homo_sapiens__NP_078790
auguggaagcuguggagagccgaggagggcgccgccgcccugggcggcgcccuguuccugcugcuguucgcccugggcgugagacagcugcugaagcagagaagacccaugggcuucccccccggcccccccggccugcccuucaucggcaacaucuacagccuggccgccagcagcgagcugccccacguguacaugagaaagcagagccagguguacggcgagaucuucagccuggaccugggcggcaucagcaccguggugcugaacggcuacgacguggugaaggagugccuggugcaccagagcgagaucuucgccgacagacccugccugccccuguucaugaagaugaccaagaugggcggccugcugaacagcagauacggcagaggcuggguggaccacagaagacuggccgugaacagcuucagauacuucggcuacggccagaagagcuucgagagcaagauccuggaggagaccaaguucuucaacgacgccaucgagaccuacaagggcagacccuucgacuucaagcagcugaucaccaacgccgugagcaacaucaccaaccugaucaucuucggcgagagauucaccuacgaggacaccgacuuccagcacaugaucgagcuguucagcgagaacguggagcuggccgccagcgccagcguguuccuguacaacgccuuccccuggaucggcauccugcccuucggcaagcaccagcagcuguucagaaacgccgccgugguguacgacuuccugagcagacugaucgagaaggccagcgugaacagaaagccccagcugccccagcacuucguggacgccuaccuggacgagauggaccagggcaagaacgaccccagcagcaccuucagcaaggagaaccugaucuucagcgugggcgagcugaucaucgccggcaccgagaccaccaccaacgugcugagaugggccauccuguucauggcccuguaccccaacauccagggccaggugcagaaggagaucgaccugaucaugggccccaacggcaagcccagcugggacgacaagugcaagaugcccuacaccgaggccgugcugcacgaggugcugagauucugcaacaucgugccccugggcaucuuccacgccaccagcgaggacgccguggugagaggcuacagcauccccaagggcaccaccgugaucaccaaccuguacagcgugcacuucgacgagaaguacuggagagaccccgagguguuccaccccgagagauuccuggacagcagcggcuacuucgccaagaaggaggcccuggugcccuucagccugggcagaagacacugccugggcgagcaccuggccagaauggagauguuccuguucuucaccgcccugcugcagagauuccaccugcacuucccccacgagcuggugcccgaccugaagcccagacugggcaugacccugcagccccagcccuaccugaucugcgccgagagaagauaa

SEQ ID NO: 15882 - RNA, 1515 nt, Artificial Sequence
  CYP2S1__Homo_sapiens__NP_085125
auggaggccaccggcaccugggcccugcugcuggcccuggcccugcugcugcugcugacccuggcccugagcggcaccagagccagaggccaccugccccccggccccaccccccugccccugcugggcaaccugcugcagcugagacccggcgcccuguacagcggccugaugagacugagcaagaaguacggccccguguucaccaucuaccugggccccuggagacccgugguggugcuggugggccaggaggccgugagagaggcccugggcggccaggccgaggaguucagcggcagaggcaccguggccaugcuggagggcaccuucgacggccacggcguguucuucagcaacggcgagagauggagacagcugagaaaguucaccaugcuggcccugagagaccugggcaugggcaagagagagggcgaggagcugauccaggccgaggccagaugccugguggagaccuuccagggcaccgagggcagacccuucgaccccagccugcugcuggcccaggccaccagcaacguggugugcagccugcuguucggccugagauucagcuacgaggacaaggaguuccaggccguggugagagccgccggcggcacccugcugggcgugagcagccagggcggccagaccuacgagauguucagcugguuccugagaccccugcccggcccccacaagcagcugcugcaccacgugagcacccuggccgccuucaccgugagacaggugcagcagcaccagggcaaccuggacgccagcggccccgccagagaccugguggacgccuuccugcugaagauggcccaggaggagcagaaccccggcaccgaguucaccaacaagaacaugcugaugaccgugaucuaccugcuguucgccggcaccaugaccgugagcaccaccgugggcuacacccugcugcugcugaugaaguacccccacgugcagaagugggugagagaggagcugaacagagagcugggcgccggccaggcccccagccugggcgacagaaccagacugcccuacaccgacgccgugcugcacgaggcccagagacugcuggcccuggugcccaugggcauccccagaacccugaugagaaccaccagauucagaggcuacacccugccccagggcaccgagguguucccccugcugggcagcauccugcacgaccccaacaucuucaagcaccccgaggaguucaaccccgacagauuccuggacgccgacggcagauucagaaagcacgaggccuuccugcccuucagccugggcaagagagugugccugggcgagggccuggccaaggccgagcuguuccuguucuucaccaccauccugcaggccuucagccuggagagccccugcccccccgacacccugagccugaagcccaccgugagcggccuguucaacaucccccccgccuuccagcugcaggugagacccaccgaccugcacagcaccacccagaccagauaa

SEQ ID NO: 15883 - RNA, 1635 nt, Artificial Sequence
  CYP2U1__Homo_sapiens__NP_898898
augagcagccccggccccagccagccccccgccgaggacccccccuggcccgccagacugcugagagccccccugggccugcugagacuggaccccagcggcggcgcccugcugcugugcggccugguggcccugcugggcuggagcuggcugagaagaagaagagccagaggcaucccccccggccccacccccuggccccuggugggcaacuucggccacgugcugcugccccccuuccugagaagaagaagcuggcugagcagcagaaccagagccgccggcaucgaccccagcgugaucggcccccaggugcugcuggcccaccuggccagaguguacggcagcaucuucagcuucuucaucggccacuaccuggugguggugcugagcgacuuccacagcgugagagaggcccuggugcagcaggccgagguguucagcgacagacccagagugccccugaucagcaucgugaccaaggagaagggcgugguguucgcccacuacggccccguguggagacagcagagaaaguucagccacagcacccugagacacuucggccugggcaagcugagccuggagcccaagaucaucgaggaguucaaguacgugaaggccgagaugcagaagcacggcgaggaccccuucugccccuucagcaucaucagcaacgccgugagcaacaucaucugcagccugugcuucggccagagauucgacuacaccaacagcgaguucaagaagaugcugggcuucaugagcagaggccuggagaucugccugaacagccaggugcugcuggugaacaucugccccuggcuguacuaccugcccuucggccccuucaaggagcugagacagaucgagaaggacaucaccagcuuccugaagaagaucaucaaggaccaccaggagagccuggacagagagaacccccaggacuucaucgacauguaccugcugcacauggaggaggagagaaagaacaacagcaacagcagcuucgacgaggaguaccuguucuacaucaucggcgaccuguucaucgccggcaccgacaccaccaccaacagccugcuguggugccugcuguacaugagccugaaccccgacgugcaggagaaggugcacgaggagaucgagagagugaucggcgccaacagagcccccagccugaccgacaaggcccagaugcccuacaccgaggccaccaucauggaggugcagagacugaccgugguggugccccuggccaucccccacaugaccagcgagaacaccgugcugcagggcuacaccauccccaagggcacccugauccugcccaaccuguggagcgugcacagagaccccgccaucugggagaagcccgaggacuucuaccccaacagauuccuggacgaccagggccagcugaucaagaaggagaccuucauccccuucggcaucggcaagagagugugcaugggcgagcagcuggccaagauggagcuguuccugauguucgugagccugaugcagagcuucgccuucgcccugcccgaggacagcaagaagccccugcugaccggcagauucggccugacccuggccccccaccccuucaacaucaccaucagcagaagauaa

SEQ ID NO: 15884 - RNA, 1473 nt, Artificial Sequence
  CYP2W1__Homo_sapiens__NP_060251
auggcccugcugcugcugcuguuccugggccugcugggccuguggggccugcugugcgccugcgcccaggaccccagccccgccgccagauggccccccggccccagaccccugccccuggugggcaaccugcaccugcugagacugagccagcaggacagaagccugauggagcugagcgagagauacggccccguguucaccgugcaccugggcagacagaagaccguggugcugaccggcuucgaggccgugaaggaggcccuggccggccccggccaggagcuggccgacagaccccccaucgccaucuuccagcugauccagagaggcggcggcaucuucuucagcagcggcgccagauggagagccgccagacaguucaccgugagagcccugcacagccugggcgugggcagagagcccguggccgacaagauccugcaggagcugaagugccugagcggccagcuggacggcuacagaggcagacccuucccccuggcccugcugggcugggcccccagcaacaucaccuucgcccugcuguucggcagaagauucgacuacagagaccccguguucgugagccugcugggccugaucgacgaggugauggugcugcugggcagccccggccugcagcuguucaacguguaccccuggcugggcgcccugcugcagcugcacagacccgugcugagaaagaucgaggaggugagagccauccugagaacccugcuggaggccagaagaccccacgugugccccggcgaccccgugugcagcuacguggacgcccugauccagcagggccagggcgacgaccccgagggccuguucgccgaggccaacgccguggccugcacccuggacauggugauggccggcaccgagaccaccagcgccacccugcagugggccgcccugcugaugggcagacaccccgacgugcagggcagagugcaggaggagcuggacagagugcugggccccggcagaacccccagacuggaggaccagcaggcccugcccuacaccagcgccgugcugcacgaggugcagagauucaucacccugcugccccacgugcccagaugcaccgccgccgacacccagcugggcggcuuccugcugcccaagggcacccccgugaucccccugcugaccagcgugcugcuggacgagacccaguggcagacccccggccaguucaaccccggccacuuccuggacgccaacggccacuucgugaagagagaggccuuccugcccuucagcgccggcagaagagugugcgugggcgagagacuggccagaaccgagcuguuccugcuguucgccggccugcugcagagauacagacugcugcccccccccggcgugagccccgccagccuggacaccacccccgccagagccuucaccaugagacccagagcccaggcccugugcgccgugcccagacccuaa

SEQ ID NO: 15885 - RNA, 1410 nt, Artificial Sequence
  CYP39A1__Homo_sapiens__NP_057677
auggagcugaucagccccaccgugaucaucauccugggcugccuggcccuguuccugcugcugcagagaaagaaccugagaagaccccccugcaucaagggcuggauccccuggaucggcgugggcuucgaguucggcaaggccccccuggaguucaucgagaaggccagaaucaaguacggccccaucuucaccguguucgccaugggcaacagaaugaccuucgugaccgaggaggagggcaucaacguguuccugaagagcaagaagguggacuucgagcuggccgugcagaacaucguguacagaaccgccagcauccccaagaacguguuccuggcccugcacgagaagcuguacaucaugcugaagggcaagaugggcaccgugaaccugcaccaguucaccggccagcugaccgaggagcugcacgagcagcuggagaaccugggcacccacggcaccauggaccugaacaaccuggugagacaccugcuguaccccgugaccgugaacaugcuguucaacaagagccuguucagcaccaacaagaagaagaucaaggaguuccaccaguacuuccagguguacgacgaggacuucgaguacggcagccagcugcccgagugccugcugagaaacuggagcaagagcaagaagugguuccuggagcuguucgagaagaacauccccgacaucaaggccugcaagagcgccaaggacaacagcaugacccugcugcaggccacccuggacaucguggagaccgagaccagcaaggagaacagccccaacuacggccugcugcugcugugggccagccugagcaacgccgugcccguggccuucuggacccuggccuacgugcugagccaccccgacauccacaaggccaucauggagggcaucagcagcguguucggcaaggccggcaaggacaagaucaaggugagcgaggacgaccuggagaaccugcugcugaucaaguggugcgugcuggagaccaucagacugaaggcccccggcgugaucaccagaaagguggugaagcccguggagauccugaacuacaucauccccagcggcgaccugcugaugcugagccccuucuggcugcacagaaaccccaaguacuuccccgagcccgagcuguucaagcccgagagauggaagaaggccaaccuggagaagcacagcuuccuggacugcuucauggccuucggcagcggcaaguuccagugccccgccagaugguucgcccugcuggaggugcagaugugcaucauccugauccuguacaaguacgacugcagccugcuggacccccugcccaagcagagcuaccugcaccuggugggcgugccccagcccgagggccagugcagaaucgaguacaagcagagaaucuaa

SEQ ID NO: 15886 - RNA, 1182 nt, Artificial Sequence
  CYP3A43__Homo_sapiens__NP_001265850
auggaccugauccccaacuucgccauggagaccugggugcugguggccaccagccuggugcugcuguacaucuacggcacccacagccacaagcuguucaagaagcugggcauccccggccccaccccccugcccuuccugggcaccauccuguucuaccugagaagaagccugaacaagauccccagcugggccugguggcugacccccgugauccccgcccugugggaggccgaggccggcggcagccccaaggugagaagcagcagacccgcccugcccaccuggguguucggcauccugaccgagaacgugaugaagaacaccgagaagugcggcgcccuguuccccuuccugacccccguguucgaggcccugaacaucggccuguuccccaaggacgugacccacuuccugaagaacagcaucgagagaaugaaggagagcagacugaaggacaagcagaagcacagaguggacuucuuccagcagaugaucgacagccagaacagcaaggagaccaagagccacaaggcccugagcgaccuggagcugguggcccagagcaucaucaucaucuucgccgccuacgacaccaccagcaccacccugcccuucaucauguacgagcuggccacccaccccgacgugcagcagaagcugcaggaggagaucgacgccgugcugcccaacaaggcccccgugaccuacgacgcccuggugcagauggaguaccuggacaugguggugaacgagacccugagacuguuccccguggugagcagagugaccagagugugcaagaaggacaucgagaucaacggcguguucauccccaagggccuggccgugauggugcccaucuacgcccugcaccacgaccccaaguacuggaccgagcccgagaaguucugccccgagagauucagcaagaagaacaaggacagcaucgaccuguacagauacauccccuucggcgccggccccagaaacugcaucggcaugagauucgcccugaccaacaucaagcuggccgugaucagagcccugcagaacuucagcuucaagcccugcaaggagacccagaucccccugaagcuggacaaccugcccauccugcagcccgagaagcccaucgugcugaaggugcaccugagagacggcaucaccagcggccccuaa

SEQ ID NO: 15887 - RNA, 1509 nt, Artificial Sequence
  CYP3A4__Homo_sapiens__NP_001189784
auggcccugauccccgaccuggccauggagaccuggcugcugcuggccgugagccuggugcugcuguaccuguacggcacccacagccacggccuguucaagaagcugggcauccccggccccaccccccugcccuuccugggcaacauccugagcuaccacaagggcuucugcauguucgacauggagugccacaagaaguacggcaagguguggggcuucuacgacggccagcagcccgugcuggccaucaccgaccccgacaugaucaagaccgugcuggugaaggagugcuacagcguguucaccaacagaagacccuucggccccgugggcuucaugaagagcgccaucagcaucgccgaggacgaggaguggaagagacugagaagccugcugagccccaccuucaccagcggcaagcugaaggagauggugcccaucaucgcccaguacggcgacgugcuggugagaaaccugagaagagaggccgagaccggcaagcccgugacccugaaggacguguucggcgccuacagcauggacgugaucaccagcaccagcuucggcgugaacaucgacagccugaacaacccccaggaccccuucguggagaacaccaagaagcugcugagauucgacuuccuggaccccuucuuccugagcaucaucuuccccuuccugauccccauccuggaggugcugaacaucugcguguuccccagagaggugaccaacuuccugagaaagagcgugaagagaaugaaggagagcagacuggaggacacccagaagcacagaguggacuuccugcagcugaugaucgacagccagaacagcaaggagaccgagagccacaaggcccugagcgaccuggagcugguggcccagagcaucaucuucaucuucgccggcuacgagaccaccagcagcgugcugagcuucaucauguacgagcuggccacccaccccgacgugcagcagaagcugcaggaggagaucgacgccgugcugcccaacaaggccccccccaccuacgacaccgugcugcagauggaguaccuggacaugguggugaacgagacccugagacuguuccccaucgccaugagacuggagagagugugcaagaaggacguggagaucaacggcauguucauccccaagggcgugguggugaugauccccagcuacgcccugcacagagaccccaaguacuggaccgagcccgagaaguuccugcccgagagauucagcaagaagaacaaggacaacaucgaccccuacaucuacacccccuucggcagcggccccagaaacugcaucggcaugagauucgcccugaugaacaugaagcuggcccugaucagagugcugcagaacuucagcuucaagcccugcaaggagacccagaucccccugaagcugagccugggcggccugcugcagcccgagaagcccguggugcugaagguggagagcagagacggcaccgugagcggcgccuaa

SEQ ID NO: 15888 - RNA, 1509 nt, Artificial Sequence
  CYP3A5__Homo_sapiens__NP_000768
auggaccugauccccaaccuggccguggagaccuggcugcugcuggccgugagccuggugcugcuguaccuguacggcaccagaacccacggccuguucaagagacugggcauccccggccccaccccccugccccugcugggcaacgugcugagcuacagacagggccuguggaaguucgacaccgagugcuacaagaaguacggcaagauguggggcaccuacgagggccagcugcccgugcuggccaucaccgaccccgacgugaucagaaccgugcuggugaaggagugcuacagcguguucaccaacagaagaagccugggccccgugggcuucaugaagagcgccaucagccuggccgaggacgaggaguggaagagaaucagaagccugcugagccccaccuucaccagcggcaagcugaaggagauguuccccaucaucgcccaguacggcgacgugcuggugagaaaccugagaagagaggccgagaagggcaagcccgugacccugaaggacaucuucggcgccuacagcauggacgugaucaccggcaccagcuucggcgugaacaucgacagccugaacaacccccaggaccccuucguggagagcaccaagaaguuccugaaguucggcuuccuggacccccuguuccugagcaucauccuguuccccuuccugacccccguguucgaggcccugaacgugagccuguuccccaaggacaccaucaacuuccugagcaagagcgugaacagaaugaagaagagcagacugaacgacaagcagaagcacagacuggacuuccugcagcugaugaucgacagccagaacagcaaggagaccgagagccacaaggcccugagcgaccuggagcuggccgcccagagcaucaucuucaucuucgccggcuacgagaccaccagcagcgugcugagcuucacccuguacgagcuggccacccaccccgacgugcagcagaagcugcagaaggagaucgacgccgugcugcccaacaaggccccccccaccuacgacgccguggugcagauggaguaccuggacaugguggugaacgagacccugagacuguuccccguggccaucagacuggagagaaccugcaagaaggacguggagaucaacggcguguucauccccaagggcagcaugguggugauccccaccuacgcccugcaccacgaccccaaguacuggaccgagcccgaggaguucagacccgagagauucagcaagaagaaggacagcaucgaccccuacaucuacacccccuucggcaccggccccagaaacugcaucggcaugagauucgcccugaugaacaugaagcuggcccugaucagagugcugcagaacuucagcuucaagcccugcaaggagacccagaucccccugaagcuggacacccagggccugcugcagcccgagaagcccaucgugcugaagguggacagcagagacggcacccugagcggcgaguaa

SEQ ID NO: 15889 - RNA, 1608 nt, Artificial Sequence
  CYP3A7-CYP3A51P__Homo_sapiens__NP_001243426
auggaccugauccccaaccuggccguggagaccuggcugcugcuggccgugagccugauccugcuguaccuguacggcaccagaacccacggccuguucaagaagcugggcauccccggccccaccccccugcccuuccugggcaacgcccugagcuucagaaagggcuacuggaccuucgacauggagugcuacaagaaguacagaaagguguggggcaucuacgacugccagcagcccaugcuggccaucaccgaccccgacaugaucaagaccgugcuggugaaggagugcuacagcguguucaccaacagaagacccuucggccccgugggcuucaugaagaacgccaucagcaucgccgaggacgaggaguggaagagaaucagaagccugcugagccccaccuucaccagcggcaagcugaaggagauggugcccaucaucgcccaguacggcgacgugcuggugagaaaccugagaagagaggccgagaccggcaagcccgugacccugaagcacguguucggcgccuacagcauggacgugaucaccagcaccagcuucggcgugagcaucgacagccugaacaacccccaggaccccuucguggagaacaccaagaagcugcugagauucaacccccuggaccccuucgugcugagcaucaagguguuccccuuccugacccccauccuggaggcccugaacaucaccguguuccccagaaaggugaucagcuuccugaccaagagcgugaagcagaucaaggagggcagacugaaggagacccagaagcacagaguggacuuccugcagcugaugaucgacagccagaacagcaaggacagcgagacccacaaggcccugagcgaccuggagcugauggcccagagcaucaucuucaucuucgccggcuacgagaccaccagcagcgugcugagcuucaucaucuacgagcuggccacccaccccgacgugcagcagaaggugcagaaggagaucgacaccgugcugcccaacaaggccccccccaccuacgacaccgugcugcagcuggaguaccuggacaugguggugaacgagacccugagacuguuccccguggccaugagacuggagagagugugcaagaaggacguggagaucaacggcauguucauccccaagggcgugguggugaugauccccagcuacgugcugcaccacgaccccaaguacuggaccgagcccgagaaguuccugcccgagagauucagcaagaagaacaaggacaacaucgaccccuacaucuacacccccuucggcagcggccccagaaacugcaucggcaugagauucgcccuggugaacaugaagcuggcccuggugagagugcugcagaacuucagcuucaagcccugcaaggagacccagaucccccugaagcugagauucggcggccugcugcugaccgagaagcccaucgugcugaaggccgagagcagagacgagaccuucguggacauggagcccauccacauggacuuccugagaagccuggccuuccagggcccccaccugugcuucuucugggagcugcugugccccaccaucagaagcagauaa

SEQ ID NO: 15890 - RNA, 1512 nt, Artificial Sequence
  CYP3A7__Homo_sapiens__NP_000756
auggaccugauccccaaccuggccguggagaccuggcugcugcuggccgugagccugauccugcuguaccuguacggcaccagaacccacggccuguucaagaagcugggcauccccggccccaccccccugcccuuccugggcaacgcccugagcuucagaaagggcuacuggaccuucgacauggagugcuacaagaaguacagaaagguguggggcaucuacgacugccagcagcccaugcuggccaucaccgaccccgacaugaucaagaccgugcuggugaaggagugcuacagcguguucaccaacagaagacccuucggccccgugggcuucaugaagaacgccaucagcaucgccgaggacgaggaguggaagagaaucagaagccugcugagccccaccuucaccagcggcaagcugaaggagauggugcccaucaucgcccaguacggcgacgugcuggugagaaaccugagaagagaggccgagaccggcaagcccgugacccugaagcacguguucggcgccuacagcauggacgugaucaccagcaccagcuucggcgugagcaucgacagccugaacaacccccaggaccccuucguggagaacaccaagaagcugcugagauucaacccccuggaccccuucgugcugagcaucaagguguuccccuuccugacccccauccuggaggcccugaacaucaccguguuccccagaaaggugaucagcuuccugaccaagagcgugaagcagaucaaggagggcagacugaaggagacccagaagcacagaguggacuuccugcagcugaugaucgacagccagaacagcaaggacagcgagacccacaaggcccugagcgaccuggagcugauggcccagagcaucaucuucaucuucgccggcuacgagaccaccagcagcgugcugagcuucaucaucuacgagcuggccacccaccccgacgugcagcagaaggugcagaaggagaucgacaccgugcugcccaacaaggccccccccaccuacgacaccgugcugcagcuggaguaccuggacaugguggugaacgagacccugagacuguuccccguggccaugagacuggagagagugugcaagaaggacguggagaucaacggcauguucauccccaagggcgugguggugaugauccccagcuacgugcugcaccacgaccccaaguacuggaccgagcccgagaaguuccugcccgagagauucagcaagaagaacaaggacaacaucgaccccuacaucuacacccccuucggcagcggccccagaaacugcaucggcaugagauucgcccuggugaacaugaagcuggcccuggugagagugcugcagaacuucagcuucaagcccugcaaggagacccagaucccccugaagcugagauucggcggccugcugcugaccgagaagcccaucgugcugaaggccgagagcagagacgagaccgugagcggcgccuaa

SEQ ID NO: 15891 - RNA, 1503 nt, Artificial Sequence
  CYP46A1__Homo_sapiens__NP_006659
augagccccggccugcugcugcugggcagcgccgugcugcuggccuucggccugugcugcaccuucgugcacagagccagaagcagauacgagcacauccccggcccccccagacccagcuuccugcugggccaccugcccugcuucuggaagaaggacgaggugggcggcagagugcugcaggacguguuccuggacugggccaagaaguacggccccguggugagagugaacguguuccacaagaccagcgugaucgugaccagccccgagagcgugaagaaguuccugaugagcaccaaguacaacaaggacagcaagauguacagagcccugcagaccguguucggcgagagacuguucggccagggccuggugagcgagugcaacuacgagagauggcacaagcagagaagagugaucgaccuggccuucagcagaagcagccuggugagccugauggagaccuucaacgagaaggccgagcagcugguggagauccuggaggccaaggccgacggccagacccccgugagcaugcaggacaugcugaccuacaccgccauggacauccuggccaaggccgccuucggcauggagaccagcaugcugcugggcgcccagaagccccugagccaggccgugaagcugaugcuggagggcaucaccgccagcagaaacacccuggccaaguuccugcccggcaagagaaagcagcugagagaggugagagagagcaucagauuccugagacaggugggcagagacugggugcagagaagaagagaggcccugaagagaggcgaggaggugcccgccgacauccugacccagauccugaaggccgaggagggcgcccaggacgacgagggccugcuggacaacuucgugaccuucuucaucgccggccacgagaccagcgccaaccaccuggccuucaccgugauggagcugagcagacagcccgagaucguggccagacugcaggccgagguggacgaggugaucggcagcaagagauaccuggacuucgaggaccugggcagacugcaguaccugagccaggugcugaaggagagccugagacuguacccccccgccuggggcaccuucagacugcuggaggaggagacccugaucgacggcgugagagugcccggcaacaccccccugcuguucagcaccuacgugaugggcagaauggacaccuacuucgaggacccccugaccuucaaccccgacagauucggccccggcgcccccaagcccagauucaccuacuuccccuucagccugggccacagaagcugcaucggccagcaguucgcccagauggaggugaagguggugauggccaagcugcugcagagacuggaguucagacuggugcccggccagagauucggccugcaggagcaggccacccugaagccccuggaccccgugcugugcacccugagacccagaggcuggcagcccgcccccccccccccccccugcuaa

SEQ ID NO: 15892 - RNA, 804 nt, Artificial Sequence
  CYP4A11__Homo_sapiens__XP_011539132
augagcgugagcgugcugagccccagcagacugcugggcgacgugagcggcauccugcaggccgccagccugcugauccugcugcugcugcugaucaaggccgugcagcuguaccugcacagacaguggcugcugaaggcccugcagcaguuccccugcccccccagccacuggcuguucggccacauccaggagcugcagcaggaccaggagcugcagagaauccagaaguggguggagaccuuccccagcgccugcccccacuggcuguggggcggcaaggugagagugcagcuguacgaccccgacuacaugaaggugauccugggcagaagcgcccugagcugccugagcgaccccaagagccacggcagcuacagauuccuggcccccuggaucggcuacggccugcugcugcugaacggccagaccugguuccagcacagaagaaugcugacccccgccuuccacuacgacauccugaagcccuacgugggccugauggccgacagcgugagagugaugcuggacaagugggaggagcugcugggccaggacagcccccuggagguguuccagcacgugagccugaugacccuggacaccaucaugaagugcgccuucagccaccagggcagcauccagguggacagacccagcgaccccaccgaggagggcagcaccaccgagggcggcggcgccggcgaggaccaggaggaggaggccuucggcuucagcggcuaccccccccugggccagaacggcgagugggagcaccuggugagacagggcccccccugcuaa

SEQ ID NO: 15893 - RNA, 1494 nt, Artificial Sequence
  CYP4B1__Homo_sapiens__NP_001306090
auggugcccagcuuccugagccugagcuucagcagccugggccugugggccagcggccugauccuggugcugggcuuccugaagcugauccaccugcugcugagaagacagacccuggccaaggccauggacaaguuccccggcccccccacccacuggcuguucggccacgcccuggagauccaggagaccggcagccuggacaagguggugagcugggcccaccaguuccccuacgcccacccccugugguucggccaguucaucggcuuccugaacaucuacgagcccgacuacgccaaggccguguacagcagaggcggcagaggccugcuggugcuggagggccccaaguggcugcagcacagaaagcugcugacccccggcuuccacuacgacgugcugaagcccuacguggccguguucaccgagagcaccagaaucaugcuggacaagugggaggagaaggccagagagggcaagagcuucgacaucuucugcgacgugggccacauggcccugaacacccugaugaagugcaccuucggcagaggcgacaccggccugggccacagcagagacagcagcuacuaccuggccgugagcgaccugacccugcugaugcagcagagacuggugagcuuccaguaccacaacgacuucaucuacuggcugaccccccacggcagaagauuccugagagccugccagguggcccacgaccacaccgaccaggugaucagagagagaaaggccgcccugcaggacgagaaggugagaaagaagauccagaacagaagacaccuggacuuccuggacauccugcugggcgccagagacgaggacgacaucaagcugagcgacgccgaccugagagccgagguggacaccuucauguucgagggccacgacaccaccaccagcggcaucagcugguuccuguacugcauggcccuguaccccgagcaccagcacagaugcagagaggaggugagagagauccugggcgaccaggacuucuuccagugggacgaccugggcaagaugaccuaccugaccaugugcaucaaggagagcuucagacuguacccccccgugccccagguguacagacagcugagcaagcccgugaccuucguggacggcagaagccugcccgccggcagccugaucagcaugcacaucuacgcccugcacagaaacagcgccguguggcccgaccccgagguguucgacagccugagauucagcaccgagaacgccagcaagagacaccccuucgccuucaugcccuucagcgccggccccagaaacugcaucggccagcaguucgccaugagcgagaugaagguggugaccgccaugugccugcugagauucgaguucagccuggaccccagcagacugcccaucaagaugccccagcuggugcugagaagcaagaacggcuuccaccugcaccugaagccccugggccccggcagcggcaaguaa

SEQ ID NO: 15894 - RNA, 1575 nt, Artificial Sequence
  CYP4F11__Homo_sapiens__NP_067010
augccccagcugagccugagcuggcugggccugggccccguggccgccagccccuggcugcugcugcugcuggugggcggcagcuggcugcuggccagagugcuggccuggaccuacaccuucuacgacaacugcagaagacugcagugcuucccccagccccccaagcagaacugguucuggggccaccagggccuggugacccccaccgaggagggcaugaagacccugacccagcuggugaccaccuacccccagggcuucaagcuguggcugggccccaccuucccccugcugauccugugccaccccgacaucaucagacccaucaccagcgccagcgccgccguggcccccaaggacaugaucuucuacggcuuccugaagcccuggcugggcgacggccugcugcugagcggcggcgacaaguggagcagacacagaagaaugcugacccccgccuuccacuucaacauccugaagcccuacaugaagaucuucaacaagagcgugaacaucaugcacgacaaguggcagagacuggccagcgagggcagcgccagacuggacauguucgagcacaucagccugaugacccuggacagccugcagaagugcguguucagcuucgagagcaacugccaggagaagcccagcgaguacaucgccgccauccuggagcugagcgccuucguggagaagagaaaccagcagauccugcugcacaccgacuuccuguacuaccugacccccgacggccagagauucagaagagccugccaccuggugcacgacuucaccgacgccgugauccaggagagaagaugcacccugcccacccagggcaucgacgacuuccugaagaacaaggccaagagcaagacccuggacuucaucgacgugcugcugcugagcaaggacgaggacggcaaggagcugagcgacgaggacaucagagccgaggccgacaccuucauguucgagggccacgacaccaccgccagcggccugagcugggugcuguaccaccuggccaagcaccccgaguaccaggagcagugcagacaggaggugcaggagcugcugaaggacagagagcccaucgagaucgagugggacgaccuggcccagcugcccuuccugaccaugugcaucaaggagagccugagacugcacccccccgugcccgugaucagcagaugcugcacccaggacuucgugcugcccgacggcagagugauccccaagggcaucgugugccugaucaacaucaucggcauccacuacaaccccaccguguggcccgaccccgagguguacgaccccuucagauucgaccaggagaacaucaaggagagaagcccccuggccuucauccccuucagcgccggccccagaaacugcaucggccaggccuucgccauggccgagaugaagguggugcuggcccugacccugcugcacuucagaauccugcccacccacaccgagcccagaagaaagcccgagcugauccugagagccgagggcggccuguggcugagaguggagccccugggcgccaacagccaguaa

SEQ ID NO: 15895 - RNA, 1575 nt, Artificial Sequence
  CYP4F12__Homo_sapiens__NP_076433
augagccugcugagccugcccuggcugggccugagacccguggccaccagccccuggcugcugcugcugcugguggugggcagcuggcugcuggccagaauccuggccuggaccuacgccuucuacaacaacugcagaagacugcagugcuucccccagccccccaagagaaacugguucuggggccaccugggccugaucacccccaccgaggagggccugaagaacagcacccagaugagcgccaccuacagccagggcuucaccguguggcugggccccaucauccccuucaucgugcugugccaccccgacaccaucagaagcaucaccaacgccagcgccgccaucgcccccaaggacaaccuguucaucagauuccugaagcccuggcugggcgagggcauccugcugagcggcggcgacaaguggagcagacacagaagaaugcugacccccgccuuccacuucaacauccugaagagcuacaucaccaucuucaacaagagcgccaacaucaugcuggacaaguggcagcaccuggccagcgagggcagcagcagacuggacauguucgagcacaucagccugaugacccuggacagccugcagaagugcaucuucagcuucgacagccacugccaggagagacccagcgaguacaucgccaccauccuggagcugagcgcccugguggagaagagaagccagcacauccugcagcacauggacuuccuguacuaccugagccacgacggcagaagauuccacagagccugcagacuggugcacgacuucaccgacgccgugaucagagagagaagaagaacccugcccacccagggcaucgacgacuucuucaaggacaaggccaagagcaagacccuggacuucaucgacgugcugcugcugagcaaggacgaggacggcaaggcccugagcgacgaggacaucagagccgaggccgacaccuucauguucggcggccacgacaccaccgccagcggccugagcugggugcuguacaaccuggccagacaccccgaguaccaggagagaugcagacaggaggugcaggagcugcugaaggacagagaccccaaggagaucgagugggacgaccuggcccagcugcccuuccugaccaugugcgugaaggagagccugagacugcacccccccgcccccuucaucagcagaugcugcacccaggacaucgugcugcccgacggcagagugauccccaagggcaucaccugccugaucgacaucaucggcgugcaccacaaccccaccguguggcccgaccccgagguguacgaccccuucagauucgaccccgagaacagcaagggcagaagcccccuggccuucauccccuucagcgccggccccagaaacugcaucggccaggccuucgccauggccgagaugaagguggugcuggcccugaugcugcugcacuucagauuccugcccgaccacaccgagcccagaagaaagcuggagcugaucaugagagccgagggcggccuguggcugagaguggagccccugaacgugagccugcaguaa

SEQ ID NO: 15896 - RNA, 1596 nt, Artificial Sequence
  CYP4F22__Homo_sapiens__NP_775754
augcugcccaucaccgacagacugcugcaccugcugggccuggagaagaccgccuucagaaucuacgccgugagcacccugcugcuguuccugcuguucuuccuguucagacugcugcugagauuccugagacugugcagaagcuucuacaucaccugcagaagacugagaugcuucccccagccccccagaagaaacuggcugcugggccaccugggcauguaccugcccaacgaggccggccugcaggacgagaagaaggugcuggacaacaugcaccacgugcugcugguguggaugggccccgugcugccccugcuggugcuggugcaccccgacuacaucaagccccugcugggcgccagcgccgccaucgcccccaaggacgaccuguucuacggcuuccugaagcccuggcugggcgacggccugcugcugagcaagggcgacaaguggagcagacacagaagacugcugacccccgccuuccacuucgacauccugaagcccuacaugaagaucuucaaccagagcgccgacaucaugcacgccaaguggagacaccuggccgagggcagcgccgugagccuggacauguucgagcacaucagccugaugacccuggacagccugcagaagugcguguucagcuacaacagcaacugccaggagaagaugagcgacuacaucagcgccaucaucgagcugagcgcccugagcgugagaagacaguacagacugcaccacuaccuggacuucaucuacuacagaagcgccgacggcagaagauucagacaggccugcgacauggugcaccacuucaccaccgaggugauccaggagagaagaagagcccugagacagcagggcgccgaggccuggcugaaggccaagcagggcaagacccuggacuucaucgacgugcugcugcuggccagagacgaggacggcaaggagcugagcgacgaggacaucagagccgaggccgacaccuucauguucgagggccacgacaccaccagcagcggcaucagcuggaugcuguucaaccuggccaaguaccccgaguaccaggagaagugcagagaggagauccaggaggugaugaagggcagagagcuggaggagcuggagugggacgaccugacccagcugcccuucaccaccaugugcaucaaggagagccugagacaguacccccccgugacccuggugagcagacagugcaccgaggacaucaagcugcccgacggcagaaucauccccaagggcaucaucugccuggugagcaucuacggcacccaccacaaccccaccguguggcccgacagcaagguguacaaccccuacagauucgaccccgacaacccccagcagagaagcccccuggccuacgugcccuucagcgccggccccagaaacugcaucggccagagcuucgccauggccgagcugagaguggugguggcccugacccugcugagauucagacugagcguggacagaaccagaaaggugagaagaaagcccgagcugauccugagaaccgagaacggccuguggcugaagguggagccccugccccccagagccuaa

SEQ ID NO: 15897 - RNA, 1563 nt, Artificial Sequence
  CYP4F2__Homo_sapiens__NP_001073
augagccagcugagccugagcuggcugggccuguggcccguggccgccagccccuggcugcugcugcugcuggugggcgccagcuggcugcuggcccacgugcuggccuggaccuacgccuucuacgacaacugcagaagacugagaugcuucccccagccccccagaagaaacugguucuggggccaccagggcauggugaaccccaccgaggagggcaugagagugcugacccagcugguggccaccuacccccagggcuucaagguguggaugggccccaucagcccccugcugagccugugccaccccgacaucaucagaagcgugaucaacgccagcgccgccaucgcccccaaggacaaguucuucuacagcuuccuggagcccuggcugggcgacggccugcugcugagcgccggcgacaaguggagcagacacagaagaaugcugacccccgccuuccacuucaacauccugaagcccuacaugaagaucuucaacgagagcgugaacaucaugcacgccaaguggcagcugcuggccagcgagggcagcgccugccuggacauguucgagcacaucagccugaugacccuggacagccugcagaagugcguguucagcuucgacagccacugccaggagaagcccagcgaguacaucgccgccauccuggagcugagcgcccuggugagcaagagacaccacgagauccugcugcacaucgacuuccuguacuaccugacccccgacggccagagauucagaagagccugcagacuggugcacgacuucaccgacgccgugauccaggagagaagaagaacccugcccagccagggcguggacgacuuccugcaggccaaggccaagagcaagacccuggacuucaucgacgugcugcugcugagcaaggacgaggacggcaagaagcugagcgacgaggacaucagagccgaggccgacaccuucauguucgagggccacgacaccaccgccagcggccugagcugggugcuguaccaccuggccaagcaccccgaguaccaggagagaugcagacaggaggugcaggagcugcugaaggacagagagcccaaggagaucgagugggacgaccuggcccaccugcccuuccugaccaugugcaugaaggagagccugagacugcacccccccgugcccgugaucagcagacacgugacccaggacaucgugcugcccgacggcagagugauccccaagggcaucaucugccugaucagcguguucggcacccaccacaaccccgccguguggcccgaccccgagguguacgaccccuucagauucgaccccgagaacaucaaggagagaagcccccuggccuucauccccuucagcgccggccccagaaacugcaucggccagaccuucgccauggccgagaugaagguggugcuggcccugacccugcugagauucagagugcugcccgaccacaccgagcccagaagaaagcccgagcuggugcugagagccgagggcggccuguggcugagaguggagccccugagcuaa

SEQ ID NO: 15898 - RNA, 1563 nt, Artificial Sequence
  CYP4F3__Homo_sapiens__NP_000887
augccccagcugagccugagcagccugggccuguggcccauggccgccagccccuggcugcugcugcugcuggugggcgccagcuggcugcuggccagaauccuggccuggaccuacaccuucuacgacaacugcugcagacugagaugcuucccccagccccccaagagaaacugguuccugggccaccugggccugauccacagcagcgaggagggccugcuguacacccagagccuggccugcaccuucggcgacaugugcugcuggugggugggccccuggcacgccaucgugagaaucuuccaccccaccuacaucaagcccgugcuguucgcccccgccgccaucgugcccaaggacaagguguucuacagcuuccugaagcccuggcugggcgacggccugcugcugagcgccggcgagaaguggagcagacacagaagaaugcugacccccgccuuccacuucaacauccugaagcccuacaugaagaucuucaacgagagcgugaacaucaugcacgccaaguggcagcugcuggccagcgagggcagcgccagacuggacauguucgagcacaucagccugaugacccuggacagccugcagaagugcguguucagcuucgacagccacugccaggagaagcccagcgaguacaucgccgccauccuggagcugagcgcccuggugaccaagagacaccagcagauccugcuguacaucgacuuccuguacuaccugacccccgacggccagagauucagaagagccugcagacuggugcacgacuucaccgacgccgugauccaggagagaagaagaacccugcccagccagggcguggacgacuuccugcaggccaaggccaagagcaagacccuggacuucaucgacgugcugcugcugagcaaggacgaggacggcaagaagcugagcgacgaggacaucagagccgaggccgacaccuucauguucgagggccacgacaccaccgccagcggccugagcugggugcuguaccaccuggccaagcaccccgaguaccaggagagaugcagacaggaggugcaggagcugcugaaggacagagagcccaaggagaucgagugggacgaccuggcccagcugcccuuccugaccaugugcaucaaggagagccugagacugcacccccccgugcccgccgugagcagaugcugcacccaggacaucgugcugcccgacggcagagugauccccaagggcaucaucugccugaucagcguguucggcacccaccacaaccccgccguguggcccgaccccgagguguacgaccccuucagauucgaccccaagaacaucaaggagagaagcccccuggccuucauccccuucagcgccggccccagaaacugcaucggccaggccuucgccauggccgagaugaagguggugcugggccugacccugcugagauucagagugcugcccgaccacaccgagcccagaagaaagcccgagcuggugcugagagccgagggcggccuguggcugagaguggagccccugagcuaa

SEQ ID NO: 15899 - RNA, 1563 nt, Artificial Sequence
  CYP4F8__Homo_sapiens__NP_009184
augagccugcugagccugagcuggcugggccugagacccguggccgccagccccuggcugcugcugcugguggugggcgccagcuggcugcuggccagaauccuggccuggaccuacgccuucuaccacaacggcagaagacugagaugcuucccccagcccagaaagcagaacugguuccugggccaccugggccuggugacccccaccgaggagggccugagagugcugacccagcugguggccaccuacccccagggcuucgugagauggcugggccccaucacccccaucaucaaccugugccaccccgacaucgugagaagcgugaucaacaccagcgacgccaucaccgacaaggacaucguguucuacaagacccugaagcccuggcugggcgacggccugcugcugagcgugggcgacaaguggagacaccacagaagacugcugacccccgccuuccacuucaacauccugaagcccuacaucaagaucuucagcaagagcgccaacaucaugcacgccaaguggcagagacuggccauggagggcagcaccugccuggacguguucgagcacaucagccugaugacccuggacagccugcagaagugcaucuucagcuucgacagcaacugccaggagaagcccagcgaguacaucaccgccaucauggagcugagcgcccugguggugaagagaaacaaccaguucuucagauacaaggacuuccuguacuuccugacccccugcggcagaagauuccacagagccugcagacuggugcacgacuucaccgacgccgugauccaggagagaagaagaacccugaccagccagggcguggacgacuuccugcaggccaaggccaagagcaagacccuggacuucaucgacgugcugcugcugagcgaggacaagaacggcaaggagcugagcgacgaggacaucagagccgaggccgacaccuucauguucggcggccacgacaccaccgccagcggccugagcugggugcuguacaaccuggccagacaccccgaguaccaggagagaugcagacaggaggugcaggagcugcugaaggacagagagcccaaggagaucgagugggacgaccuggcccagcugcccuuccugaccaugugccugaaggagagccugagacugcacccccccauccccaccuucgccagaggcugcacccaggacguggugcugcccgacagcagagugauccccaagggcaacgugugcaacaucaacaucuucgccauccaccacaaccccagcguguggcccgaccccgagguguacgaccccuucagauucgaccccgagaacgcccagaagagaagccccauggccuucauccccuucagcgccggccccagaaacugcaucggccagaaguucgccauggccgagaugaagguggugcuggcccugacccugcugagauucagaauccugcccgaccacagagagcccagaagaacccccgagaucgugcugagagccgaggacggccuguggcugagaguggagccccugggcuaa

SEQ ID NO: 15900 - RNA, 1578 nt, Artificial Sequence
  CYP4V2__Homo_sapiens__NP_997235
auggccggccuguggcugggccugguguggcagaagcugcugcuguggggcgccgccagcgcccugagccuggccggcgccagccuggugcugagccugcugcagagaguggccagcuacgccagaaaguggcagcagaugagacccauccccaccguggccagagccuacccccuggugggccacgcccugcugaugaagcccgacggcagagaguucuuccagcagaucaucgaguacaccgaggaguacagacacaugccccugcugaagcugugggugggccccgugcccaugguggcccuguacaacgccgagaacguggaggugauccugaccagcagcaagcagaucgacaagagcagcauguacaaguuccuggagcccuggcugggccugggccugcugaccagcaccggcaacaaguggagaagcagaagaaagaugcugacccccaccuuccacuucaccauccuggaggacuuccuggacaucaugaacgagcaggccaacauccuggugaagaagcuggagaagcacaucaaccaggaggccuucaacugcuucuucuacaucacccugugcgcccuggacaucaucugcgagaccgccaugggcaagaacaucggcgcccagagcaacgacgacagcgaguacgugagagccguguacagaaugagcgagaugaucuucagaagaaucaagaugcccuggcuguggcuggaccugugguaccugauguucaaggagggcugggagcacaagaagagccugcagauccugcacaccuucaccaacagcgugaucgccgagagagccaacgagaugaacgccaacgaggacugcagaggcgacggcagaggcagcgcccccagcaagaacaagagaagagccuuccuggaccugcugcugagcgugaccgacgacgagggcaacagacugagccacgaggacaucagagaggagguggacaccuucauguucgagggccacgacaccaccgccgccgccaucaacuggagccuguaccugcugggcagcaaccccgaggugcagaagaagguggaccacgagcuggacgacguguucggcaagagcgacagacccgccaccguggaggaccugaagaagcugagauaccuggagugcgugaucaaggagacccugagacuguuccccagcgugccccuguucgccagaagcgugagcgaggacugcgagguggccggcuacagagugcugaagggcaccgaggccgugaucauccccuacgcccugcacagagaccccagauacuuccccaaccccgaggaguuccagcccgagagauucuuccccgagaacgcccagggcagacaccccuacgccuacgugcccuucagcgccggccccagaaacugcaucggccagaaguucgccgugauggaggagaagaccauccugagcugcauccugagacacuucuggaucgagagcaaccagaagagagaggagcugggccuggagggccagcugauccugagacccagcaacggcaucuggaucaagcugaagagaagaaacgccgacgagagauaa

SEQ ID NO: 15901 - RNA, 1530 nt, Artificial Sequence
  CYP51A1__Homo_sapiens__NP_000777
auggccgccgccgccggcaugcugcugcugggccugcugcaggccggcggcagcgugcugggccaggccauggagaaggugaccggcggcaaccugcugagcaugcugcugaucgccugcgccuucacccugagccugguguaccugaucagacuggccgccggccaccuggugcagcugcccgccggcgugaagagcccccccuacaucuucagccccauccccuuccugggccacgccaucgccuucggcaagagccccaucgaguuccuggagaacgccuacgagaaguacggccccguguucagcuucaccauggugggcaagaccuucaccuaccugcugggcagcgacgccgccgcccugcuguucaacagcaagaacgaggaccugaacgccgaggacguguacagcagacugaccacccccguguucggcaagggcguggccuacgacgugcccaaccccguguuccuggagcagaagaagaugcugaagagcggccugaacaucgcccacuucaagcagcacgugagcaucaucgagaaggagaccaaggaguacuucgagagcuggggcgagagcggcgagaagaacguguucgaggcccugagcgagcugaucauccugaccgccagccacugccugcacggcaaggagaucagaagccagcugaacgagaagguggcccagcuguacgccgaccuggacggcggcuucagccacgccgccuggcugcugcccggcuggcugccccugcccagcuucagaagaagagacagagcccacagagagaucaaggacaucuucuacaaggccauccagaagagaagacagagccaggagaagaucgacgacauccugcagacccugcuggacgccaccuacaaggacggcagaccccugaccgacgacgagguggccggcaugcugaucggccugcugcuggccggccagcacaccagcagcaccaccagcgccuggaugggcuucuuccuggccagagacaagacccugcagaagaagugcuaccuggagcagaagaccgugugcggcgagaaccugcccccccugaccuacgaccagcugaaggaccugaaccugcuggacagaugcaucaaggagacccugagacugagaccccccaucaugaucaugaugagaauggccagaaccccccagaccguggccggcuacaccaucccccccggccaccaggugugcgugagccccaccgugaaccagagacugaaggacagcuggguggagagacuggacuucaaccccgacagauaccugcaggacaaccccgccagcggcgagaaguucgccuacgugcccuucggcgccggcagacacagaugcaucggcgagaacuucgccuacgugcagaucaagaccaucuggagcaccaugcugagacuguacgaguucgaccugaucgacggcuacuuccccaccgugaacuacaccaccaugauccacacccccgagaaccccgugaucagauacaagagaagaagcaaguaa

SEQ ID NO: 15902 - RNA, 1515 nt, Artificial Sequence
  CYP7A1__Homo_sapiens__NP_000771
augaugaccaccagccugaucuggggcaucgccaucgccgccugcugcugccuguggcugauccugggcaucagaagaagacagaccggcgagcccccccuggagaacggccugauccccuaccugggcugcgcccugcaguucggcgccaacccccuggaguuccugagagccaaccagagaaagcacggccacguguucaccugcaagcugaugggcaaguacgugcacuucaucaccaacccccugagcuaccacaaggugcugugccacggcaaguacuucgacuggaagaaguuccacuucgccaccagcgccaaggccuucggccacagaagcaucgaccccauggacggcaacaccaccgagaacaucaacgacaccuucaucaagacccugcagggccacgcccugaacagccugaccgagagcaugauggagaaccugcagagaaucaugagaccccccgugagcagcaacagcaagaccgccgccugggugaccgagggcauguacagcuucugcuacagagugauguucgaggccggcuaccugaccaucuucggcagagaccugaccagaagagacacccagaaggcccacauccugaacaaccuggacaacuucaagcaguucgacaagguguuccccgcccugguggccggccugcccauccacauguucagaaccgcccacaacgccagagagaagcuggccgagagccugagacacgagaaccugcagaagagagagagcaucagcgagcugaucagccugagaauguuccugaacgacacccugagcaccuucgacgaccuggagaaggccaagacccaccugguggugcugugggccagccaggccaacaccauccccgccaccuucuggagccuguuccagaugaucagaaaccccgaggccaugaaggccgccaccgaggaggugaagagaacccuggagaacgccggccagaaggugagccuggagggcaaccccaucugccugagccaggccgagcugaacgaccugcccgugcuggacagcaucaucaaggagagccugagacugagcagcgccagccugaacaucagaaccgccaaggaggacuucacccugcaccuggaggacggcagcuacaacaucagaaaggacgacaucaucgcccuguacccccagcugaugcaccuggaccccgagaucuaccccgacccccugaccuucaaguacgacagauaccuggacgagaacggcaagaccaagaccaccuucuacugcaacggccugaagcugaaguacuacuacaugcccuucggcagcggcgccaccaucugccccggcagacuguucgccauccacgagaucaagcaguuccugauccugaugcugagcuacuucgagcuggagcugaucgagggccaggccaagugccccccccuggaccagagcagagccggccugggcauccugcccccccugaacgacaucgaguucaaguacaaguucaagcaccuguaa

SEQ ID NO: 15903 - RNA, 1521 nt, Artificial Sequence
  CYP7B1__Homo_sapiens__NP_004811
auggccggcgaggugagcgccgccaccggcagauucagccuggagagacugggccugcccggccuggcccuggccgccgcccugcugcugcuggcccugugccugcuggugagaagaaccagaagacccggcgagcccccccugaucaagggcuggcugcccuaccugggcguggugcugaaccugagaaaggacccccugagauucaugaagacccugcagaagcagcacggcgacaccuucaccgugcugcugggcggcaaguacaucaccuucauccuggaccccuuccaguaccagcuggugaucaagaaccacaagcagcugagcuucagaguguucagcaacaagcugcuggagaaggccuucagcaucagccagcugcagaagaaccacgacaugaacgacgagcugcaccugugcuaccaguuccugcagggcaagagccuggacauccugcuggagagcaugaugcagaaccugaagcagguguucgagccccagcugcugaagaccaccagcugggacaccgccgagcuguaccccuucugcagcagcaucaucuucgagaucaccuucaccaccaucuacggcaaggugaucgugugcgacaacaacaaguucaucagcgagcugagagacgacuuccugaaguucgacgacaaguucgccuaccuggugagcaacauccccaucgagcugcugggcaacgugaagagcaucagagagaagaucaucaagugcuucagcagcgagaagcuggccaagaugcagggcuggagcgagguguuccagagcagacaggacgugcuggagaaguacuacgugcacgaggaccuggagaucggcgcccaccaccugggcuuccugugggccagcguggccaacaccauccccaccauguucugggccauguacuaccugcugagacaccccgaggccauggccgccgugagagacgagaucgacagacugcugcagagcaccggccagaagaagggcagcggcuuccccauccaccugaccagagagcagcuggacagccugaucugccuggagagcagcaucuucgaggcccugagacugagcagcuacagcaccaccaucagauucguggaggaggaccugacccugagcagcgagaccggcgacuacugcgugagaaagggcgaccugguggccaucuucccccccgugcugcacggcgaccccgagaucuucgaggcccccgaggaguucagauacgacagauucaucgaggacggcaagaagaagaccaccuucuucaagagaggcaagaagcugaagugcuaccugaugcccuucggcaccggcaccagcaagugccccggcagauucuucgcccugauggagaucaagcagcugcuggugauccugcugaccuacuucgaccuggagaucaucgacgacaagcccaucggccugaacuacagcagacugcuguucggcauccaguaccccgacagcgacgugcuguucagauacaaggugaagagcuaa

SEQ ID NO: 15904 - RNA, 1506 nt, Artificial Sequence
  CYP8B1__Homo_sapiens__NP_004382
auggugcuguggggccccgugcugggcgcccugcugguggugaucgccggcuaccugugccugcccggcaugcugagacagagaagacccugggagcccccccuggacaagggcaccgugcccuggcugggccacgccauggccuucagaaagaacauguucgaguuccugaagagaaugagaaccaagcacggcgacguguucaccgugcagcugggcggccaguacuucaccuucgugauggacccccugagcuucggcagcauccugaaggacacccagagaaagcuggacuucggccaguacgccaagaagcuggugcugaagguguucggcuacagaagcgugcagggcgaccacgagaugauccacagcgccagcaccaagcaccugagaggcgacggccugaaggaccugaacgagaccaugcuggacagccugagcuucgugaugcugaccagcaagggcuggagccuggacgccagcugcuggcacgaggacagccuguucagauucugcuacuacauccuguucaccgccggcuaccugagccuguucggcuacaccaaggacaaggagcaggaccugcugcaggccggcgagcuguucauggaguucagaaaguucgaccugcuguuccccagauucguguacagccugcuguggcccagagaguggcuggaggugggcagacugcagagacuguuccacaagaugcugagcgugagccacagccaggagaaggagggcaucagcaacuggcugggcaacaugcugcaguuccugagagagcagggcgugcccagcgccaugcaggacaaguucaacuucaugaugcugugggccagccagggcaacaccggccccaccagcuucugggcccugcuguaccugcugaagcaccccgaggccaucagagccgugagagaggaggccacccaggugcugggcgaggccagacuggagaccaagcagagcuucgccuucaagcugggcgcccugcagcacacccccgugcuggacagcgugguggaggagacccugagacugagagccgcccccacccugcugagacuggugcacgaggacuacacccugaagaugagcagcggccaggaguaccuguucagacacggcgacauccuggcccuguuccccuaccugagcgugcacauggaccccgacauccaccccgagcccaccguguucaaguacgacagauuccugaaccccaacggcagcagaaagguggacuucuucaagaccggcaagaagauccaccacuacaccaugcccuggggcagcggcgugagcaucugccccggcagauucuucgcccugagcgaggugaagcuguucauccugcugauggugacccacuucgaccuggagcugguggaccccgacaccccccugccccacguggacccccagagauggggcuucggcaccaugcagcccagccacgacgugagauucagauacagacugcaccccaccgaguaa

SEQ ID NO: 15905 - RNA, 477 nt, Artificial Sequence
  CYS1__Homo_sapiens__NP_001032237
augggcagcggcagcagcagaagcagcagaacccugagaagaagaagaagccccgagagccugcccgccggccccggcgccgccgcccuggagggcggcaccagaagaagagugcccguggccgccgccgaggugcccggcgccgccgccgaggaggcccccggcagagaccccagccccguggccccccccgacggcagagacgagacccugagacugcuggacgagcugcuggccgagagcgccgccuggggcccccccgagcccgcccccagaagacccgccagacugagacccaccgccguggccggcagcgccgugugcgccgagcagagcaccgagggccaccccggcagcggcaacgugagcgaggcccccggcagcggcagaaagaagcccgagagacccgccgccaucagcuacgaccacagcgaggagggccugauggccagcaucgagagagaguacugcagauaa

SEQ ID NO: 15906 - RNA, 1014 nt, Artificial Sequence
  CYSLTR1__Homo_sapiens__NP_001269117
auggacgagaccggcaaccugaccgugagcagcgccaccugccacgacaccaucgacgacuucagaaaccagguguacagcacccuguacagcaugaucagcguggugggcuucuucggcaacggcuucgugcuguacgugcugaucaagaccuaccacaagaagagcgccuuccagguguacaugaucaaccuggccguggccgaccugcugugcgugugcacccugccccugagagugguguacuacgugcacaagggcaucuggcuguucggcgacuuccugugcagacugagcaccuacgcccuguacgugaaccuguacugcagcaucuucuucaugaccgccaugagcuucuucagaugcaucgccaucguguuccccgugcagaacaucaaccuggugacccagaagaaggccagauucgugugcgugggcaucuggaucuucgugauccugaccagcagccccuuccugauggccaagccccagaaggacgagaagaacaacaccaagugcuucgagcccccccaggacaaccagaccaagaaccacgugcuggugcugcacuacgugagccuguucgugggcuucaucauccccuucgugaucaucaucgugugcuacaccaugaucauccugacccugcugaagaagagcaugaagaagaaccugagcagccacaagaaggccaucggcaugaucaugguggugaccgccgccuuccuggugagcuucaugcccuaccacauccagagaaccauccaccugcacuuccugcacaacgagaccaagcccugcgacagcgugcugagaaugcagaagagcguggugaucacccugagccuggccgccagcaacugcugcuucgacccccugcuguacuucuucagcggcggcaacuucagaaagagacugagcaccuucagaaagcacagccugagcagcgugaccuacgugcccagaaagaaggccagccugcccgagaagggcgaggagaucugcaagguguaa

SEQ ID NO: 15907 - RNA, 1197 nt, Artificial Sequence
  CYTH1__Homo_sapiens__NP_004753
auggaggaggacgacagcuacgugcccagcgaccugaccgccgaggagagacaggagcuggagaacaucagaagaagaaagcaggagcugcuggccgacauccagagacugaaggacgagaucgccgagguggccaacgagaucgagaaccugggcagcaccgaggagagaaagaacaugcagagaaacaagcagguggccaugggcagaaagaaguucaacauggaccccaagaagggcauccaguuccugaucgagaacgaccugcugaagaacaccugcgaggacaucgcccaguuccuguacaagggcgagggccugaacaagaccgccaucggcgacuaccugggcgagagagacgaguucaacauccaggugcugcacgccuucguggagcugcacgaguucaccgaccugaaccuggugcaggcccugagacaguuccuguggagcuucagacugcccggcgaggcccagaagaucgacagaaugauggaggccuucgcccagagauacugccagugcaacaacggcguguuccagagcaccgacaccugcuacgugcugagcuucgccaucaucaugcugaacaccagccugcacaaccccaacgugaaggacaagcccaccguggagagauucaucgccaugaacagaggcaucaacgacggcggcgaccugcccgaggagcugcugagaaaccuguacgagagcaucaagaacgagcccuucaagauccccgaggacgacggcaacgaccugacccacaccuucuucaaccccgacagagagggcuggcugcugaagcugggcggcggcagagugaagaccuggaagagaagaugguucauccugaccgacaacugccuguacuacuucgaguacaccaccgacaaggagcccagaggcaucaucccccuggagaaccugagcaucagagagguggaggacagcaagaagcccaacugcuucgagcuguacauccccgacaacaaggaccaggugaucaaggccugcaagaccgaggccgacggcagagugguggagggcaaccacaccguguacagaaucagcgcccccacccccgaggagaaggaggaguggaucaagugcaucaaggccgccaucagcagagaccccuucuacgagaugcuggccgccagaaagaagaaggugagcagcaccaagagacacuaa

SEQ ID NO: 15908 - RNA, 1200 nt, Artificial Sequence
  CYTH3__Homo_sapiens__NP_004218
auggacgaggacggcggcggcgagggcggcggcgugcccgaggaccugagccuggaggagagagaggagcugcuggacaucagaagaagaaagaaggagcugaucgacgacaucgagagacugaaguacgagaucgccgaggugaugaccgagaucgacaaccugaccagcguggaggagagcaagaccacccagagaaacaagcagaucgccaugggcagaaagaaguucaacauggaccccaagaagggcauccaguuccugaucgagaacgaccugcugcagagcagccccgaggacguggcccaguuccuguacaagggcgagggccugaacaagaccgugaucggcgacuaccugggcgagagagacgaguucaacaucaaggugcugcaggccuucguggagcugcacgaguucgccgaccugaaccuggugcaggcccugagacaguuccuguggagcuucagacugcccggcgaggcccagaagaucgacagaaugauggaggccuucgccagcagauacugccugugcaaccccggcguguuccagagcaccgacaccugcuacgugcugagcuucgccaucaucaugcugaacaccagccugcacaaccacaacgugagagacaagcccaccgccgagagauucaucgccaugaacagaggcaucaacgagggcggcgaccugcccgaggagcugcugagaaaccuguacgagagcaucaagaacgagcccuucaagauccccgaggacgacggcaacgaccugacccacaccuucuucaaccccgacagagagggcuggcugcugaagcugggcggcagagugaagaccuggaagagaagaugguucauccugaccgacaacugccuguacuacuucgaguacaccaccgacaaggagcccagaggcaucaucccccuggagaaccugagcaucagagagguggaggaccccagaaagcccaacugcuucgagcuguacaaccccagccacaagggccaggugaucaaggccugcaagaccgaggccgacggcagagugguggagggcaaccacgugguguacagaaucagcgcccccagccccgaggagaaggaggaguggaugaagagcaucaaggccagcaucagcagagaccccuucuacgacaugcuggccaccagaaagagaagaaucgccaacaagaaguaa

SEQ ID NO: 15909 - RNA, 1080 nt, Artificial Sequence
  CYTIP__Homo_sapiens__NP_004279
augagccugcagagacugcugcagcacagcagcaacggcaaccuggccgacuucugcgccggccccgccuacagcagcuacagcacccugaccggcagccugaccauggacgacaacagaagaauccagaugcuggccgacaccguggccacccugcccagaggcagaaagcagcuggcccugaccagaagcagcagccugagcgacuucagcuggagccagagaaagcuggugaccguggagaagcaggacaacgagaccuucggcuucgagauccagagcuacagaccccagaaccagaacgccugcagcagcgagauguucacccugaucugcaagauccaggaggacagccccgcccacugcgccggccugcaggccggcgacgugcuggccaacaucaacggcgugagcaccgagggcuucaccuacaagcaggugguggaccugaucagaagcagcggcaaccugcugaccaucgagacccugaacggcaccaugauccugaagagaaccgagcuggaggccaagcugcaggugcugaagcagacccugaagcagaaguggguggaguacagaagccugcagcugcaggagcacagacugcugcacggcgacgccgccaacugccccagccuggagaacauggaccuggacgagcugagccuguucggcccccugcccggccccggccccgcccugguggacagaaacagacugagcagcgagagcagcugcaagagcuggcugagcagcaugaccauggacagcgaggacggcuaccagaccugcgugagcgaggacagcagcagaggcgccuucagcagacagaccagcaccgacgacgagugcuucauccccaaggagggcgacgacuuccugagaagaagcagcagcagaagaaacagaagcaucagcaacaccagcagcggcagcaugagcccccugugggagggcaaccugagcagcauguucggcacccugcccagaaagagcagaaagggcagcgugagaaagcagcugcugaaguucauccccggccugcacagagccguggaggaggaggagagcagauucuaa

SEQ ID NO: 15910 - RNA, 411 nt, Artificial Sequence
  CYTL1__Homo_sapiens__NP_061129
augagaacccccggcccccugcccgugcugcugcugcugcuggccggcgcccccgccgccagacccaccccccccaccugcuacagcagaaugagagcccugagccaggagaucaccagagacuucaaccugcugcaggugagcgagcccagcgagcccugcgugagauaccugcccagacuguaccuggacauccacaacuacugcgugcuggacaagcugagagacuucguggccagcccccccugcuggaagguggcccagguggacagccugaaggacaaggccagaaagcuguacaccaucaugaacagcuucugcagaagagaccugguguuccugcuggacgacugcaacgcccuggaguaccccauccccgugaccaccgugcugcccgacagacagagauaa

SEQ ID NO: 15911 - RNA, 789 nt, Artificial Sequence
  CYYR1__Homo_sapiens__NP_443186
augaagugcgagcccggcuggcccagaacccccgaguggccccccagccccagacugagcgccgugggcagagacaaggagaccugggcccccagcgccgccagacugggccccagagccccccagcugagaggcgugccccagagccuggccagagacgcccccggccccggcagccugggcagacugcccagacaguggcccggccugugcagcaccagacugagcggcgcccugcugagccccagcgacagaccccccagcagccccuucccccccgugcccggcagccccuucgcccccagccugagaccccccgccuggauggacgcccccagacugcccgugagacccggcgugcugcugcccaagcuggugcugcuguucguguacgccgacgacugccuggcccagugcggcaaggacugcaagagcuacugcugcgacggcaccacccccuacugcugcagcuacuacgccuacaucggcaacauccugagcggcaccgccaucgccggcaucguguucggcaucguguucaucaugggcgugaucgccggcaucgccaucugcaucugcaugugcaugaagaaccacagagccaccagagugggcauccugagaaccacccacaucaacaccgugagcagcuaccccggccccccccccuacggccacgaccacgagauggaguacugcgccgaccugcccccccccuacagccccaccccccagggccccgcccagagaagcccccccccccccuaccccggcaacgccagaaaguaa

SEQ ID NO: 15912 - RNA, 1164 nt, Artificial Sequence
  D2HGDH__Homo_sapiens__NP_001274178
auggugggcggcagcgugcccguguucgacgagaucauccugagcaccgccagaaugaacagagugcugagcuuccacagcgugagcggcauccuggugugccaggccggcugcgugcuggaggagcugagcagauacguggaggagagagacuucaucaugccccuggaccugggcgccaagggcagcugccacaucggcggcaacguggccaccaacgccggcggccugagauuccugagauacggcagccugcacggcaccgugcugggccuggagguggugcuggccgacggcaccgugcuggacugccugaccagccugagaaaggacaacaccggcuacgaccugaagcagcuguucaucggcagcgagggcacccugggcaucaucaccaccgugagcauccugugcccccccaagcccagagccgugaacguggccuuccugggcugccccggcuucgccgaggugcugcagaccuucagcaccugcaagggcaugcugggcgagauccugagcgccuucgaguucauggacgccgugugcaugcagcuggugggcagacaccugcaccuggccagccccgugcaggagagccccuucuacgugcugaucgagaccagcggcagcaacgccggccacgacgccgagaagcugggccacuuccuggagcacgcccugggcagcggccuggugaccgacggcaccauggccaccgaccagagaaaggugaagaugcugugggcccugagagagagaaucaccgaggcccugagcagagacggcuacguguacaaguacgaccugagccugcccguggagagacuguacgacaucgugaccgaccugagagccagacugggcccccacgccaagcacguggugggcuacggccaccugggcgacggcaaccugcaccugaacgugaccgccgaggccuucagccccagccugcuggccgcccuggagccccacguguacgaguggaccgccggccagcagggcagcgugagcgccgagcacggcgugggcuucagaaagagagacgugcugggcuacagcaagccccccggcgcccugcagcugaugcagcagcugaaggcccugcuggaccccaagggcauccugaaccccuacaagacccugcccagccaggccuaa

SEQ ID NO: 15913 - RNA, 3207 nt, Artificial Sequence
  DAAM1__Homo_sapiens__NP_001257449
auggcccccagaaagagaggcggcagaggcaucagcuucaucuucugcugcuucagaaacaacgaccaccccgagaucaccuacagacugagaaacgacagcaacuucgcccugcagaccauggagcccgcccugcccaugccccccguggaggagcuggacgugauguucagcgagcugguggacgagcuggaccugaccgacaagcacagagaggccauguucgcccugcccgccgagaagaaguggcagaucuacugcagcaagaagaaggaccaggaggagaacaagggcgccaccagcuggcccgaguucuacaucgaccagcugaacagcauggccgccagaaagagccugcuggcccuggagaaggaggaggaggaggagagaagcaagaccaucgagagccugaagaccgcccugagaaccaagcccaugagauucgugaccagauucaucgaccuggacggccugagcugcauccugaacuuccugaagaccauggacuacgagaccagcgagagcagaauccacaccagccugaucggcugcaucaaggcccugaugaacaacagccagggcagagcccacgugcuggcccacagcgagagcaucaacgugaucgcccagagccugagcaccgagaacaucaagaccaagguggccgugcuggagauccugggcgccgugugccuggugcccggcggccacaagaaggugcugcaggccaugcugcacuaccagaaguacgccagcgagagaaccagauuccagacccugaucaacgaccuggacaagagcaccggcagauacagagacgaggugagccugaagaccgccaucaugagcuucaucaacgccgugcugagccagggcgccggcguggagagccuggacuucagacugcaccugagauacgaguuccugaugcugggcauccagcccgugaucgacaagcugagagagcacgagaacagcacccuggacagacaccuggacuucuucgagaugcugagaaacgaggacgagcuggaguucgccaagagauucgagcuggugcacaucgacaccaagagcgccacccagauguucgagcugaccagaaagagacugacccacagcgaggccuacccccacuucaugagcauccugcaccacugccugcagaugcccuacaagagaagcggcaacaccgugcaguacuggcugcugcuggacagaaucauccagcagaucgugauccagaacgacaagggccaggaccccgacagcaccccccuggagaacuucaacaucaagaacguggugagaaugcuggugaacgagaacgaggugaagcaguggaaggagcaggccgagaagaugagaaaggagcacaacgagcugcagcagaagcuggagaagaaggagagagagugcgacgccaagacccaggagaaggaggagaugaugcagacccugaacaagaugaaggagaagcuggagaaggagaccaccgagcacaagcaggugaagcagcagguggccgaccugaccgcccagcugcacgagcugagcagaagagccgugugcgccagcauccccggcggccccagccccggcgcccccggcggccccuuccccagcagcgugcccggcagccugcugccccccccccccccccccccccugcccggcggcaugcugcccccccccccccccccccugccccccggcggccccccccccccccccggcccccccccccugggcgccaucaugcccccccccggcgcccccaugggccuggcccugaagaagaagagcaucccccagcccaccaacgcccugaagagcuucaacuggagcaagcugcccgagaacaagcuggagggcaccguguggaccgagaucgacgacaccaagguguucaagauccuggaccuggaggaccuggagagaaccuucagcgccuaccagagacagcagaaggaggccgacgccaucgacgacacccugagcagcaagcugaaggugaaggagcugagcgugaucgacggcagaagagcccagaacugcaacauccugcugagcagacugaagcugagcaacgacgagaucaagagagccauccugaccauggacgagcaggaggaccugcccaaggacaugcuggagcagcugcugaaguucgugcccgagaagagcgacaucgaccugcuggaggagcacaagcacgagcuggacagaauggccaaggccgacagauuccuguucgagaugagcagaaucaaccacuaccagcagagacugcagagccuguacuucaagaagaaguucgccgagagaguggccgaggugaagcccaagguggaggccaucagaagcggcagcgaggagguguucagaagcggcgcccugaagcagcugcuggagguggugcuggccuucggcaacuacaugaacaagggccagagaggcaacgccuacggcuucaagaucagcagccugaacaagaucgccgacaccaagagcagcaucgacaagaacaucacccugcugcacuaccugaucaccaucguggagaacaaguaccccagcgugcugaaccugaacgaggagcugagagacaucccccaggccgccaaggugaacaugaccgagcuggacaaggagaucagcacccugagaagcggccugaaggccguggagaccgagcuggaguaccagaagagccagcccccccagcccggcgacaaguucgugagcguggugagccaguucaucaccguggccagcuucagcuucagcgacguggaggaccugcuggccgaggccaaggaccuguucaccaaggccgugaagcacuucggcgaggaggccggcaagauccagcccgacgaguucuucggcaucuucgaccaguuccugcaggccgugagcgaggccaagcaggagaacgagaacaugagaaagaagaaggaggaggaggagagaagagccagaauggaggcccagcugaaggagcagagagagagagagagaaagaugagaaaggccaaggagaacagcgaggagagcggcgaguucgacgaccuggugagcgcccugagaagcggcgagguguucgacaaggaccugagcaagcugaagagaaacagaaagagaaucaccaaccagaugaccgacagcagcagagagagacccaucaccaagcugaacuucuaa

SEQ ID NO: 15914 - RNA, 3207 nt, Artificial Sequence
  DAAM2__Homo_sapiens__NP_001188356
auggcccccagaaagagaagccaccacggccugggcuuccugugcugcuucggcggcagcgacauccccgagaucaaccugagagacaaccacccccugcaguucauggaguucagcagccccauccccaacgccgaggagcugaacaucagauucgccgagcugguggacgagcuggaccugaccgacaagaacagagaggccauguucgcccugccccccgagaagaaguggcagaucuacugcagcaagaagaaggagcaggaggaccccaacaagcuggccaccagcuggcccgacuacuacaucgacagaaucaacagcauggccgccaugcagagccuguacgccuucgacgaggaggagaccgagaugagaaaccaggugguggaggaccugaagaccgcccugagaacccagcccaugagauucgugaccagauucaucgagcuggagggccugaccugccugcugaacuuccugagaagcauggaccacgccaccugcgagagcagaauccacaccagccugaucggcugcaucaaggcccugaugaacaacagccagggcagagcccacgugcuggcccagcccgaggccaucagcaccaucgcccagagccugagaaccgagaacagcaagaccaagguggccgugcuggagauccugggcgccgugugccuggugcccggcggccacaagaaggugcugcaggccaugcugcacuaccagguguacgccgccgagagaaccagauuccagacccugcugaacgagcuggacagaagccugggcagauacagagacgaggugaaccugaagaccgccaucaugagcuucaucaacgccgugcugaacgccggcgccggcgaggacaaccuggaguucagacugcaccugagauacgaguuccugaugcugggcauccagcccgugaucgacaagcugagacagcacgagaacgccauccuggacaagcaccuggacuucuucgagauggugagaaacgaggacgaccuggagcuggccagaagauucgacauggugcacaucgacaccaagagcgccagccagauguucgagcugauccacaagaagcugaaguacaccgaggccuaccccugccugcugagcgugcugcaccacugccugcagaugcccuacaagagaaacggcggcuacuuccagcaguggcagcugcuggacagaauccugcagcagaucgugcugcaggacgagagaggcguggaccccgaccuggccccccuggagaacuucaacgugaagaacaucgugaacaugcugaucaacgagaacgaggugaagcaguggagagaccaggccgagaaguucagaaaggagcacauggagcuggugagcagacuggagagaaaggagagagagugcgagaccaagacccuggagaaggaggagaugaugagaacccugaacaagaugaaggacaagcuggccagagagagccaggagcugagacaggccagaggccagguggccgagcugguggcccagcugagcgagcugagcaccggccccgugagcagcccccccccccccggcggcccccugacccugagcagcagcaugaccaccaacgaccugcccccccccccccccccccugcccuucgccugcugcccccccccccccccccccccccugccccccggcggcccccccaccccccccggcgccccccccugccugggcaugggccugccccugccccaggaccccuaccccagcagcgacgugccccugagaaagaagagagugccccagcccagccacccccugaagagcuucaacugggugaagcugaacgaggagagagugcccggcaccguguggaacgagaucgacgacaugcagguguucagaauccuggaccuggaggacuucgagaagauguucagcgccuaccagagacaccagaaggagcugggcagcaccgaggacaucuaccuggccagcagaaaggugaaggagcugagcgugaucgacggcagaagagcccagaacugcaucauccugcugagcaagcugaagcugagcaacgaggagaucagacaggccauccugaagauggacgagcaggaggaccuggccaaggacaugcuggagcagcugcugaaguucauccccgagaagagcgacaucgaccugcuggaggagcacaagcacgagaucgagagaauggccagagccgacagauuccuguacgagaugagcagaaucgaccacuaccagcagagacugcaggcccuguucuucaagaagaaguuccaggagagacuggccgaggccaagcccaagguggaggccauccugcuggccagcagagagcuggugagaagcaagagacugagacagaugcuggaggugauccuggccaucggcaacuucaugaacaagggccagagaggcggcgccuacggcuucagaguggccagccugaacaagaucgccgacaccaagagcagcaucgacagaaacaucagccugcugcacuaccugaucaugauccuggagaagcacuuccccgacauccugaacaugcccagcgagcugcagcaccugcccgaggccgccaaggugaaccuggccgagcuggagaaggaggugggcaaccugagaagaggccugagagccguggagguggagcuggaguaccagagaagacaggugagagagcccagcgacaaguucgugcccgugaugagcgacuucaucaccgugagcagcuucagcuucagcgagcuggaggaccagcugaacgaggccagagacaaguucgccaaggcccugaugcacuucggcgagcacgacagcaagaugcagcccgacgaguucuucggcaucuucgacaccuuccugcaggccuucagcgaggccagacaggaccuggaggccaugagaagaagaaaggaggaggaggagagaagagccagaauggaggccaugcugaaggagcagagagagagagagagauggcagagacagagaaaggugcuggccgccggcagcagccuggaggagggcggcgaguucgacgaccuggugagcgcccugagaagcggcgagguguucgacaaggaccugugcaagcugaagagaagcagaaagagaagcggcagccaggcccuggaggugaccagagagagagccaucaacagacugaacuacuaa

SEQ ID NO: 15915 - RNA, 2250 nt, Artificial Sequence
  DAB2__Homo_sapiens__NP_001231800
augagcaacgagguggagaccagcgccaccaacggccagcccgaccagcaggccgcccccaaggcccccagcaagaaggagaagaagaagggccccgagaagaccgacgaguaccugcuggccagauucaagggcgacggcgugaaguacaaggccaagcugaucggcaucgacgacgugcccgacgccagaggcgacaagaugagccaggacagcaugaugaagcugaagggcauggccgccgccggcagaagccagggccagcacaagcagagaaucugggugaacaucagccugagcggcaucaagaucaucgacgagaagaccggcgugaucgagcacgagcaccccgugaacaagaucagcuucaucgccagagacgugaccgacaacagagccuucggcuacgugugcggcggcgagggccagcaccaguucuucgccaucaagaccggccagcaggccgagccccuggugguggaccugaaggaccuguuccaggugaucuacaacgugaagaagaaggaggaggagaagaagaagaucgaggaggccagcaaggccguggagaacggcagcgaggcccugaugauccuggacgaccagaccaacaagcugaagagcgagagcaaggacauccugcugguggaccugaacagcgagaucgacaccaaccagaacagccugagagagaaccccuuccugaccaacggcaucaccagcugcagccugcccagacccaccccccaggccagcuuccugcccgagaacgccuucagcgccaaccugaacuucuuccccacccccaaccccgaccccuucagagacgaccccuucacccagcccgaccagagcacccccagcagcuucgacagccugaagagccccgaccagaagaaggagaacagcagcagcagcagcaccccccugagcaacggcccccugaacggcgacguggacuacuucggccagcaguucgaccagaucagcaacagaaccggcaagcaggaggcccaggccggccccuggcccuucagcagcagccagacccagcccgccgugagaacccagaacggcgugagcgagagagagcagaacggcuucagcgugaagagcagccccaaccccuucgugggcagcccccccaagggccugagcauccagaacggcgugaagcaggaccuggagagcagcgugcagagcagcccccacgacagcaucgccaucaucccccccccccagagcaccaagcccggcagaggcagaagaaccgccaagagcagcgccaacgaccugcuggccagcgacaucuucgccccccccgugagcgagcccagcggccaggccagccccaccggccagcccaccgcccugcagcccaacccccuggaccuguucaagaccagcgcccccgcccccgugggcccccuggugggccugggcggcgugaccgugacccugccccaggccggccccuggaacaccgccagccugguguucaaccagagccccagcauggcccccggcgccaugaugggcggccagcccagcggcuucagccagcccgugaucuucggcaccagccccgccgugagcggcuggaaccagcccagccccuucgccgccagcacccccccccccgugcccgugguguggggccccagcgccagcguggcccccaacgccuggagcaccaccagcccccugggcaaccccuuccagagcaacaucuuccccgcccccgccgugagcacccagccccccagcaugcacagcagccugcuggugacccccccccagcccccccccagagccggcccccccaaggacaucagcagcgacgccuucaccgcccuggacccccugggcgacaaggagaucaaggacgugaaggagauguucaaggacuuccagcugagacagccccccgccgugcccgccagaaagggcgagcagaccagcagcggcacccugagcgccuucgccagcuacuucaacagcaaggugggcaucccccaggagaacgccgaccacgacgacuucgacgccaaccagcugcugaacaagaucaacgagccccccaagcccgcccccagacaggugagccugcccgugaccaagagcaccgacaacgccuucgagaaccccuucuucaaggacagcuucggcagcagccaggccagcguggccagcagccagcccgugagcagcgagauguacagagaccccuucggcaaccccuucgccuaa

SEQ ID NO: 15916 - RNA, 3399 nt, Artificial Sequence
  DAB2IP__Homo_sapiens__NP_115941
auggagcccgacagccugcuggaccaggacgacagcuacgagagcccccaggagagacccggcagcagaagaagccugcccggcagccugagcgagaagagccccagcauggagcccagcgccgccacccccuucagagugaccggcuuccugagcagaagacugaagggcagcaucaagagaaccaagagccagcccaagcuggacagaaaccacagcuucagacacauccugcccggcuucagaagcgccgccgccgccgccgccgacaacgagagaagccaccugaugcccagacugaaggagagcagaagccacgagagccugcugagccccagcagcgccguggaggcccuggaccugagcauggaggaggagguggugaucaagcccgugcacagcagcauccugggccaggacuacugcuucgaggugaccaccagcagcggcagcaagugcuucagcugcagaagcgccgccgagagagacaaguggauggagaaccugagaagagccgugcaccccaacaaggacaacagcagaagaguggagcacauccugaagcugugggugaucgaggccaaggaccugcccgccaagaagaaguaccugugcgagcugugccuggacgacgugcuguacgccagaaccaccggcaagcugaagaccgacaacguguucuggggcgagcacuucgaguuccacaaccugcccccccugagaaccgugaccgugcaccuguacagagagaccgacaagaagaagaagaaggagagaaacagcuaccugggccuggugagccugcccgccgccagcguggccggcagacaguucguggagaagugguaccccguggugacccccaaccccaagggcggcaagggccccggccccaugaucagaaucaaggccagauaccagaccaucaccauccugcccauggagauguacaaggaguucgccgagcacaucaccaaccacuaccugggccugugcgccgcccuggagcccauccugagcgccaagaccaaggaggagauggccagcgcccuggugcacauccugcagagcaccggcaaggugaaggacuuccugaccgaccugaugaugagcgagguggacagaugcggcgacaacgagcaccugaucuucagagagaacacccuggccaccaaggccaucgaggaguaccugaagcuggugggccagaaguaccugcaggacgcccugggcgaguucaucaaggcccuguacgagagcgacgagaacugcgagguggaccccagcaagugcagcgccgccgaccugcccgagcaccagggcaaccugaagaugugcugcgagcuggccuucugcaagaucaucaacagcuacugcguguuccccagagagcugaaggagguguucgccagcuggagacaggagugcagcagcagaggcagacccgacaucagcgagagacugaucagcgccagccuguuccugagauuccugugccccgccaucaugagccccagccuguucaaccugcugcaggaguaccccgacgacagaaccgccagaacccugacccugaucgccaaggugacccagaaccuggccaacuucgccaaguucggcagcaaggaggaguacaugagcuucaugaaccaguuccuggagcacgaguggaccaacaugcagagauuccugcuggagaucagcaaccccgagacccugagcaacaccgccggcuucgagggcuacaucgaccugggcagagagcugagcagccugcacagccugcugugggaggccgugagccagcuggagcagagcaucgugagcaagcugggcccccugcccagaauccugagagacgugcacaccgcccugagcacccccggcagcggccagcugcccggcaccaacgaccuggccagcacccccggcagcggcagcagcagcaucagcgccggccugcagaagauggugaucgagaacgaccugagcggccugaucgacuucaccagacugcccagccccacccccgagaacaaggaccuguucuucgugaccagaagcagcggcgugcagcccagccccgccagaagcagcagcuacagcgaggccaacgagcccgaccugcagauggccaacggcggcaagagccugagcaugguggaccugcaggacgccagaacccuggacggcgaggccggcagccccgccggccccgacgugcugcccaccgacggccaggccgccgccgcccagcugguggccggcuggcccgccagagccacccccgugaaccuggccggccuggccaccgugagaagagccggccagacccccaccacccccggcaccagcgagggcgcccccggcagaccccagcugcuggccccccugagcuuccagaaccccguguaccagauggccgccggccugccccugagccccagaggccugggcgacagcggcagcgagggccacagcagccugagcagccacagcaacagcgaggagcuggccgccgccgccaagcugggcagcuucagcaccgccgccgaggagcuggccagaagacccggcgagcuggccagaagacagaugagccugaccgagaagggcggccagcccaccgugcccagacagaacagcgccggcccccagagaagaaucgaccagccccccccccccccccccccccccccccccgcccccagaggcagaaccccccccaaccugcugagcacccugcaguaccccagacccagcagcggcacccuggccagcgccagccccgacugggugggccccagcaccagacugagacagcagagcagcagcagcaagggcgacagccccgagcugaagcccagagccgugcacaagcagggccccagccccgugagccccaacgcccuggacagaaccgccgccuggcugcugaccaugaacgcccagcugcuggaggacgagggccugggccccgaccccccccacagagacagacugagaagcaaggacgagcugagccaggccgagaaggaccuggccgugcugcaggacaagcugagaaucagcaccaagaagcuggaggaguacgagacccuguucaagugccaggaggagaccacccagaagcuggugcuggaguaccaggccagacuggaggagggcgaggagagacugagaagacagcaggaggacaaggacauccagaugaagggcaucaucagcagacugaugagcguggaggaggagcugaagaaggaccacgccgagaugcaggccgccguggacagcaagcagaagaucaucgacgcccaggagaagagaaucgccagccuggacgccgccaacgccagacugaugagcgcccugacccagcugaaggagagcaugcacuaa

SEQ ID NO: 15917 - RNA, 1515 nt, Artificial Sequence
  DACH1__Homo_sapiens__NP_004383
auggccgugcccgccgcccugaucccccccacccagcuggugcccccccagccccccaucagcaccagcgccagcagcagcggcaccaccaccagcaccagcagcgccaccagcagccccgcccccagcaucggcccccccgccagcagcggccccacccuguucagacccgagcccaucgccagcgccgccgccgccgccgccaccgugaccagcaccggcggcggcggcggcggcggcggcagcggcggcggcggcggcagcagcggcaacggcggcggcggcggcggcggcggcggcggcagcaacugcaaccccaaccuggccgccgccagcaacggcagcggcggcggcggcggcggcaucagcgccggcggcggcguggccagcagcacccccaucaacgccagcaccggcagcagcagcagcagcagcagcagcagcagcagcagcagcagcagcagcagcagcagcagcagcagcagcagcugcggcccccugcccggcaagcccguguacagcacccccagccccguggagaacaccccccagaacaacgagugcaagaugguggaccugagaggcgccaagguggccagcuucaccguggagggcugcgagcugaucugccugccccaggccuucgaccuguuccugaagcaccuggugggcggccugcacaccguguacaccaagcugaagagacuggagaucacccccguggugugcaacguggagcaggugagaauccugagaggccugggcgccauccagcccggcgugaacagaugcaagcugaucagcagaaaggacuucgagacccuguacaacgacugcaccaacgccagcagcagacccggcagaccccccaagagaacccagagcgugaccagccccgagaacagccacaucaugccccacagcgugcccggccugaugagccccggcaucaucccccccaccgacgagaccccccugagcacccccaccgccagagacagccuggacaagcugagccugaccggccacggccagccccugccccccggcuuccccagccccuuccuguuccccgacggccugagcagcaucgagacccugcugaccaacauccagggccugcugaagguggccaucgacaacgccagagcccaggagaagcaggugcagcuggagaagaccgagcugaagauggacuuccugagagagagagagcugagagagacccuggagaagcagcuggccauggagcagaagaacagagccaucgugcagaagagacugaagaaggagaagaaggccaagagaaagcugcaggaggcccuggaguucgagaccaagagaagagagcaggccgagcagacccugaagcaggccgccagcaccgacagccugagagugcugaacgacagccugacccccgagaucgaggccgacagaagcggcggcagaaccgacgccgagagaaccauccaggacggcagacuguaccugaagaccaccgugauguacuaa

SEQ ID NO: 15918 - RNA, 1716 nt, Artificial Sequence
  DACH2__Homo_sapiens__NP_001132986
auggccgugagcgccagccccgugaucagcgccaccagcagcggcgccggcgugcccggcggccuguucagagccgagccccuguacagcacccccagagagccccccagacugacccccaacaugaucaacagcuucguggugaacaaccacagcaacagcgccggcggcggcggcagaggcaacaccaacaccaacgagugcagaaugguggacaugcacggcaugaagguggccagcuuccugauggacggccaggagcugaucugccugccccagguguucgaccuguuccugaagcaccuggugggcggccugcacaccguguacaccaagcugaagagacuggacaucagccccguggugugcaccguggagcaggugagaauccugagaggccugggcgccauccagcccggcgugaacagaugcaagcugaucaccagaaaggacuucgagacccuguucaccgacugcaccaacgccagcagcagacccggcagaccccccaagagaagccugggcgugcugcaggagaacgccagacugcugacccacgccgugcccggccugcugagccccggccugaucacccccaccggcaucaccgccgccgccauggccgaggccaugaagcugcagaagaugaagcugauggccaugaacacccugcagggcaacggcagccagaacggcaccgagagcgagcccgacgaccugaacagcaacaccggcggcagcgagagcagcugggacaaggacaagaugcagagccccuucgccgcccccggcccccagcacggcaucgcccacgccgcccuggccggccagcccggcaucggcggcgcccccacccugaacccccugcagcagaaccaccugcugaccaacagacuggaccugcccuucaugaugaugccccacccccugcugcccgugagccugccccccgccagcguggccauggccaugaaccagaugaaccaccugaacaccaucgccaacauggccgccgccgcccagauccacagcccccugagcagagccggcaccagcgugaucaaggagagaauccccgagagccccagccccgcccccagccuggaggagaaccacagacccggcagccagaccagcagccacaccagcagcagcgugagcagcagccccagccagauggaccaccaccuggagagaauggaggaggugcccgugcagauccccaucaugaagagcccccuggacaagauccagcugacccccggccaggcccugcccgccggcuuccccggccccuucaucuucgccgacagccugagcagcguggagacccugcugaccaacauccagggccugcugaagguggcccuggacaacgccagaauccaggagaagcagauccagcaggagaagaaggagcugagacuggagcuguacagagagagagagaucagagagaaccuggagagacagcuggccguggagcugcagagcagaaccaccaugcagaagagacugaagaaggagaagaagaccaagagaaagcugcaggaggcccuggaguucgagagcaagagaagagagcagguggagcaggcccugaagcaggccaccaccagcgacagcggccugagaaugcugaaggacaccggcauccccgacaucgagaucgagaacaacggcaccccccacgacagcgccgccaugcaggccuaa

SEQ ID NO: 15919 - RNA, 2400 nt, Artificial Sequence
  DACT1__Homo_sapiens__NP_001072988
augaagcccagccccgccggcaccgccaaggagcuggagccccccgcccccgccagaggcgagcagagaaccgccgagcccgagggcagauggagagagaagggcgaggccgacaccgagagacagagaaccagagagagacaggaggccacccuggccggccuggccgagcuggaguaccugagacagagacaggagcugcuggugagaggcgcccugagaggcgccggcggcgccggcgccgccgcccccagagccggcgagcugcugggcgaggccgcccagagaagcagacuggaggagaaguuccuggaggagaacauccugcugcugagaaagcagcugaacugccugagaagaagagacgccggccugcugaaccagcugcaggagcuggacaagcagaucagcgaccugagacuggacguggagaagaccagcgaggagcaccuggagaccgacagcagacccagcagcggcuucuacgagcugagcgacggcgccagcggcagccugagcaacagcagcaacagcguguucagcgagugccugagcagcugccacagcagcaccugcuucugcagcccccuggaggccacccugagccugagcgacggcugccccaagagcgccgacgugaaccccaaguaccagugcgaccuggugagcaagaacggcaacgacguguacagauaccccagcccccugcacgccguggccgugcagagccccauguuccugcugugccugaccggcaacccccugagagaggaggacagacugggcaaccacgccagcgacaucugcggcggcagcgagcuggacgccgugaagaccgacagcagccugcccagccccagcagccuguggagcgccagccaccccagcagcagcaagaagauggacggcuacauccugagccuggugcagaagaagacccaccccgugagaaccaacaagcccagaaccagcgugaacgccgaccccaccaagggccugcugagaaacggcagcgugugcgugagagcccccggcggcgugagccagggcaacagcgugaaccugaagaacagcaagcaggccugccugcccagcggcggcauccccagccugaacaacggcaccuucagcccccccaagcaguggagcaaggagagcaaggccgagcaggccgagagcaagagagugccccugcccgagggcugccccagcggcgccgccagcgaccugcagagcaagcaccugcccaagaccgccaagcccgccagccaggagcacgccagaugcagcgccaucggcaccggcgagagccccaaggagagcgcccagcugagcggcgccagccccaaggagagccccagcagaggccccgcccccccccaggagaacaagguggugcagccccugaagaagaugagccagaagaacagccugcagggcgugccccccgccacccccccccugcugagcaccgccuuccccguggaggagagacccgcccuggacuucaagagcgagggcagcagccagagccuggaggaggcccaccuggugaaggcccaguucauccccggccagcagcccagcgugagacugcacagaggccacagaaacaugggcguggugaagaacagcagccugaagcacagaggccccgcccugcagggccuggagaacggccugcccaccgugagagagaagaccagagccggcagcaagaagugcagauuccccgacgaccuggacaccaacaagaagcugaagaaggccagcagcaagggcagaaagagcggcggcggccccgaggccggcgugcccggcagacccgccggcggcggccacagagccggcagcagagcccacggccacggcagagaggccgugguggccaagcccaagcacaagagaaccgacuacagaagauggaagagcagcgccgagaucagcuacgaggaggcccugagaagagccagaagaggcagaagagagaacgugggccuguaccccgcccccgugccccugcccuacgccagccccuacgccuacguggccagcgacagcgaguacagcgccgagugcgagagccuguuccacagcaccgugguggacaccagcgaggacgagcagagcaacuacaccaccaacugcuucggcgacagcgagagcagcgugagcgagggcgaguucgugggcgagagcaccaccaccagcgacagcgaggagagcggcggccugaucuggagccaguucgugcagacccugcccauccagaccgugaccgcccccgaccugcacaaccaccccgccaagaccuucgugaagaucaaggccagccacaaccugaagaagaagauccugagauucagaagcggcagccugaagcugaugaccaccguguaa

SEQ ID NO: 15920 - RNA, 843 nt, Artificial Sequence
  DACT2__Homo_sapiens__NP_001273280
auguggacccccggcggcccccccggcagcgccggcugggacagaagaagacugggcgccagacugagagccgccuucgccggccugcaggagcugcagggccugagagccacccagcaggagagagugagaggcgcccuggcccugcagcccccccccgcccccgccgcccccugcggcccccacggccugcacggccccgagcagcagcuggaggccgcccuggccgcccugcaggagcagcugagcagacugagacagcaggacaucggccugaagacccaccuggaccagcuggaccugcagaucagcaagcugcagcuggacgugggcaccgccagcggcgaggcccuggacagcgacagcagacccagcagcggcuucuacgagaugagcgacggcggcagcugcagccugagcaccagcugcgccagcgugugcagcgaccacaucagccccagccugggcagccugcugcccguggcccaggcccacaaggccagacccagcaugggcgacuggagacccagaagcguggacgagaccaccgugcccgccuggagaccccaggccaccgaggagggcgccagaccccccggcagcguggaggacgccggccagcccuggggcaccuucuggcccagacccgugagcaccgagcugugcaacgcccccggcgagcuggacaugcacgccccccccgccggcugcaccagcagcagccugaccggcgugggcagcggccugagaggcaagugcggccugugcggcugccagcugcccuucugcagcgugaacaccagcagcaagaccaagagcagcggcaucagcagacagcaguaa

SEQ ID NO: 15921 - RNA, 1890 nt, Artificial Sequence
  DACT3__Homo_sapiens__NP_659493
augaucagagccuucagcuuccccgugagccccgagagaggcagacugagaggcuggcuggagggcagccuggccggccugugcgagcugcacuggcugagagagagacaggaguacagagugcagcaggcccugagacuggcccagcccggcaugggcggcgccgaggccgaggacgaggaggacgccgacgaggacgaggacgccgccgccgccagaagagccgccgccgcccuggaggagcagcuggaggcccugcccggccuggugugggaccugggccagcagcugggcgaccugagccuggagagcggcggccuggagcaggagagcggcagaagcagcggcuucuacgaggaccccagcagcaccggcggccccgacagcccccccagcaccuucugcggcgacagcggcuucagcggcagcagcagcuacggcagacugggccccagcgagcccagaggcaucuacgccagcgagagacccaagagccugggcgacgccagccccagcgcccccgagguggugggcgccagagccgccgugcccagaagcuucagcgcccccuaccccaccgccggcggcagcgccggccccgaggccugcagcagcgccgagagaagagccagagccggccccuuccugacccccagcccccugcacgccguggccaugagaagccccagacccugcggcagaccccccaccgacagccccgacgccggcggcgccggcagaccccuggacggcuacaucagcgcccugcugagaagaagaagaagaagaggcgccggccagcccagaaccagccccggcggcgccgacggcggccccagaagacagaacagcgugagacagagaccccccgacgccagccccagccccggcagcgccagacccgccagagagcccagccuggagagagugggcggccaccccaccagccccgccgcccugagcagagccugggccagcagcugggagagcgaggccgcccccgagcccgccgccccccccgccgcccccagcccccccgacagccccgccgagggcagacuggugaaggcccaguacauccccggcgcccaggccgccaccagaggccugcccggcagagccgccagaagaaagccccccccccugaccagaggcagaagcguggagcagagcccccccagagagagacccagagccgccggcagaagaggcagaauggccgaggccagcggcagaagaggcagccccagagccagaaaggccagcagaagccagagcgagaccagccugcugggcagagccagcgccgugcccagcggcccccccaaguaccccaccgccgagagagaggagcccagaccccccagacccagaagaggccccgcccccacccuggccgcccaggccgccggcagcugcagaagauggagaagcaccgccgagaucgacgccgccgacggcagaagagugagacccagagcccccgccgccagagugcccggccccggccccagccccagcgccccccagagaagacugcuguacggcugcgccggcagcgacagcgagugcagcgccggcagacugggcccccugggcagaagaggccccgccggcggcgugggcggcggcuacggcgagagcgagagcagcgccagcgagggcgagagccccgccuucagcagcgccagcagcgacagcgacggcagcggcggccugguguggccccagcagcugguggccgccaccgccgccagcggcggcggcgccggcgccggcgcccccgccggccccgccaagguguucgugaagaucaaggccagccacgcccugaagaagaagauccugagauucagaagcggcagccugaaggugaugaccaccguguaa

SEQ ID NO: 15922 - RNA, 342 nt, Artificial Sequence
  DAD1__Homo_sapiens__NP_001335
augagcgccagcguggugagcgugaucagcagauuccuggaggaguaccugagcagcaccccccagagacugaagcugcuggacgccuaccugcuguacauccugcugaccggcgcccugcaguucggcuacugccugcuggugggcaccuuccccuucaacagcuuccugagcggcuucaucagcugcgugggcagcuucauccuggccgugugccugagaauccagaucaacccccagaacaaggccgacuuccagggcaucagccccgagagagccuucgccgacuuccuguucgccagcaccauccugcaccugguggugaugaacuucgugggcuaa

SEQ ID NO: 15923 - RNA, 2688 nt, Artificial Sequence
  DAG1__Homo_sapiens__NP_001171113
augagaaugagcgugggccugagccugcugcugccccuguggggcagaaccuuccugcugcugcugagcguggugauggcccagagccacuggcccagcgagcccagcgaggccgugagagacugggagaaccagcuggaggccagcaugcacagcgugcugagcgaccugcacgaggccgugcccaccguggugggcauccccgacggcaccgccguggugggcagaagcuucagagugaccauccccaccgaccugaucgccagcagcggcgacaucaucaaggugagcgccgccggcaaggaggcccugcccagcuggcugcacugggacagccagagccacacccuggagggccugccccuggacaccgacaagggcgugcacuacaucagcgugagcgccaccagacugggcgccaacggcagccacaucccccagaccagcagcguguucagcaucgagguguaccccgaggaccacagcgagcugcagagcgugagaaccgccagccccgaccccggcgagguggugagcagcgccugcgccgccgacgagcccgugaccgugcugaccgugauccuggacgccgaccugaccaagaugacccccaagcagagaaucgaccugcugcacagaaugagaagcuucagcgagguggagcugcacaacaugaagcuggugcccguggugaacaacagacuguucgacaugagcgccuucauggccggccccggcaacgccaagaaggugguggagaacggcgcccugcugagcuggaagcugggcugcagccugaaccagaacagcgugcccgacauccacggcguggaggcccccgccagagagggcgccaugagcgcccagcugggcuaccccguggugggcuggcacaucgccaacaagaagcccccccugcccaagagagugagaagacagauccacgccacccccacccccgugaccgccaucggcccccccaccaccgccauccaggagccccccagcagaaucgugcccacccccaccagccccgccaucgccccccccaccgagaccauggccccccccgugagagaccccgugcccggcaagcccaccgugaccaucagaaccagaggcgccaucauccagacccccacccugggccccauccagcccaccagagugagcgaggccggcaccaccgugcccggccagaucagacccaccaugaccauccccggcuacguggagcccaccgccguggccaccccccccaccaccaccaccaagaagcccagagugagcacccccaagcccgccacccccagcaccgacagcaccaccaccaccaccagaagacccaccaagaagcccagaacccccagacccgugcccagagugaccaccaaggugagcaucaccagacuggagaccgccagcccccccaccagaaucagaaccaccaccagcggcgugcccagaggcggcgagcccaaccagagacccgagcugaagaaccacaucgacagaguggacgccugggugggcaccuacuucgaggugaagauccccagcgacaccuucuacgaccacgaggacaccaccaccgacaagcugaagcugacccugaagcugagagagcagcagcuggugggcgagaagagcugggugcaguucaacagcaacagccagcugauguacggccugcccgacagcagccacgugggcaagcacgaguacuucaugcacgccaccgacaagggcggccugagcgccguggacgccuucgagauccacgugcacagaagaccccagggcgacagagcccccgccagauucaaggccaaguucgugggcgaccccgcccuggugcugaacgacauccacaagaagaucgcccuggugaagaagcuggccuucgccuucggcgacagaaacugcagcaccaucacccugcagaacaucaccagaggcagcaucgugguggaguggaccaacaacacccugccccuggagcccugccccaaggagcagaucgccggccugagcagaagaaucgccgaggacgacggcaagcccagacccgccuucagcaacgcccuggagcccgacuucaaggccaccagcaucaccgugaccggcagcggcagcugcagacaccugcaguucauccccguggugccccccagaagagugcccagcgaggccccccccaccgaggugcccgacagagaccccgagaagagcagcgaggacgacguguaccugcacaccgugauccccgccguggugguggccgccauccugcugaucgccggcaucaucgccaugaucugcuacagaaagaagagaaagggcaagcugacccuggaggaccaggccaccuucaucaagaagggcgugcccaucaucuucgccgacgagcuggacgacagcaagcccccccccagcagcagcaugccccugauccugcaggaggagaaggccccccugcccccccccgaguaccccaaccagagcgugcccgagaccaccccccugaaccaggacaccaugggcgaguacaccccccugagagacgaggaccccaacgccccccccuaccagccccccccccccuucaccgcccccauggagggcaagggcagcagacccaagaacaugacccccuacagaagccccccccccuacgugccccccuaa

SEQ ID NO: 15924 - RNA, 570 nt, Artificial Sequence
  DAND5__Homo_sapiens__NP_689867
augcugcugggccagcugagcacccugcugugccugcugagcggcgcccugcccaccggcagcggcagacccgagccccagagccccagaccccagagcugggccgccgccaaccagaccugggcccugggccccggcgcccugcccccccuggugcccgccagcgcccugggcagcuggaaggccuuccugggccugcagaaggccagacagcugggcaugggcagacugcagagaggccaggacgagguggccgccgugacccugccccugaacccccaggaggugauccagggcaugugcaaggccgugcccuucgugcagguguucagcagacccggcugcagcgccaucagacugagaaaccaccugugcuucggccacugcagcagccuguacauccccggcagcgaccccaccccccuggugcugugcaacagcugcaugcccgccagaaagagaugggcccccguggugcuguggugccugaccggcagcagcgccagcagaagaagagugaagaucagcaccaugcugaucgagggcugccacugcagccccaaggccuaa

SEQ ID NO: 15925 - RNA, 378 nt, Artificial Sequence
  DAOA__Homo_sapiens__NP_001155284
augagaaccgccaucuggaaguggcacagaggcaucuacagagaccacuacgugcugggcagccugaccuuccugagccccaugcagagagccggcaccagcaaccaguggaacaugggcaaggugaugacccuggacagcggcgacgaggugaccuuccacaagaccuggcccaccgagaccggcagccccuacagacuggaggaggugagcagccacgugggcaagguguucauggccagaaacuacgaguuccuggccuacgaggccagcaaggacagaagacagccccuggagagaauguggaccugcaacuacaaccagcagaaggaccagagcugcaaccacaaggagaucaccagcaccaaggccgaguaa

SEQ ID NO: 15926 - RNA, 1044 nt, Artificial Sequence
  DAO__Homo_sapiens__XP_011536307
augagagugguggugaucggcgccggcgugaucggccugagcaccgcccugugcauccacgagagauaccacagcgugcugcagccccuggacaucaagguguacgccgacagauucaccccccugaccaccaccgacguggccgccggccuguggcagcccuaccugagcgaccccaacaacccccaggaggccgacuggagccagcagaccuucgacuaccugcugagccacgugcacagccccaacgccgagaaccugggccuguuccugaucagcggcuacaaccuguuccacgaggccauccccgaccccagcuggaaggacaccgugcugggcuucagaaagcugacccccagagagcuggacauguuccccgacuacggcuacggcugguuccacaccagccugauccuggagggcaagaacuaccugcaguggcugaccgagagacugaccgagagaggcgugaaguucuuccagagaaagguggagagcuucgaggagguggccagagagggcgccgacgugaucgugaacugcaccggcgugugggccggcgcccugcagagagacccccugcugcagcccggcagaggccagaucaugaagguggacgcccccuggaugaagcacuucauccugacccacgaccccgagagaggcaucuacaacagccccuacaucauccccggcacccagaccgugacccugggcggcaucuuccagcugggcaacuggagcgagcugaacaacauccaggaccacaacaccaucugggagggcugcugcagacuggagcccacccugaagaacgccagaaucaucggcgagagaaccggcuucagacccgugagaccccagaucagacuggagagagagcagcugagaaccggccccagcaacaccgaggugauccacaacuacggccacggcggcuacggccugaccauccacuggggcugcgcccuggaggccgccaagcuguucggcagaauccuggaggagaagaagcugagcagaaugccccccagccaccuguaa

SEQ ID NO: 15927 - RNA, 1197 nt, Artificial Sequence
  DAP3__Homo_sapiens__NP_001186778
augaugcugaagggcaucaccagacugaucagcagaauccacaagcuggaccccggcagauuccugcacaugggcacccaggccagacagagcaucgccgcccaccuggacaaccaggugcccguggagagccccagagccaucagcagaaccaacgagaacgaccccgccaagcacggcgaccagcacgagggccagcacuacaacaucagcccccaggaccuggagaccguguucccccacggccugccccccagauucgugaugcaggugaagaccuucagcgaggccugccugauggugagaaagcccgcccuggagcugcugcacuaccugaagaacaccagcuucgccuaccccgccaucagauaccugcuguacggcgagaagggcaccggcaagacccugagccugugccacgugauccacuucugcgccaagcaggacuggcugauccugcacauccccgacgcccaccugugggugaagaacugcagagaccugcugcagagcagcuacaacaagcagagauucgaccagccccuggaggccagcaccuggcugaagaacuucaagaccaccaacgagagauuccugaaccagaucaaggugcaggagaaguacguguggaacaagagagagagcaccgagaagggcagcccccugggcgaggugguggagcagggcaucaccagagugagaaacgccaccgacgccgugggcaucgugcugaaggagcugaagagacagagcagccugggcauguuccaccugcugguggccguggacggcaucaacgcccuguggggcagaaccacccugaagagagaggacaagagccccaucgcccccgaggagcuggcccuggugcacaaccugagaaagaugaugaagaacgacuggcacggcggcgccaucgugagcgcccugagccagaccggcagccuguucaagcccagaaaggccuaccugccccaggagcugcugggcaaggagggcuucgacgcccuggaccccuucauccccauccuggugagcaacuacaaccccaaggaguucgagagcugcauccaguacuaccuggagaacaacuggcugcagcacgagaaggcccccaccgaggagggcaagaaggagcugcuguuccugagcaacgccaaccccagccugcuggagagacacugcgccuaccuguaa

SEQ ID NO: 15928 - RNA, 615 nt, Artificial Sequence
  DAP__Homo_sapiens__NP_001278892
augagcagcccccccgagggcaagcuggagaccaaggccggccacccccccgccgugaaggccggcggcaugagaaucgugcagaagcacccccacaccggcgacaccaaggaggagaaggacaaggacgaccaggagugggagagccccagagugaccaagaucagccccagaagacugagaagauggcugaccagaagcagaaugccccccuggaccagcauccugccccaggagcccagcaccagcagcagccacgccagcgagcccggcgugcaccagcccgcccccuggcccagacugugcugcaccugguacuuccccgacagagagaaccagcaguucagacccaaccccacccugcugggcaaccugagacagaaccaggugcugugcccccugcccuacaucagcaucuucaagaccagaaacagcagcagccccaaccugguguacggcgagagcggcuggaugagcuucgaggaccacugcgcccccagaggcgccaucagcagaaucugccaggaccccagaaagauccuggcccuggugcuguuccagcagagccccgacgugcugguguacggccugaagaacaagaaggcccacaucuaa

SEQ ID NO: 15929 - RNA, 4293 nt, Artificial Sequence
  DAPK1__Homo_sapiens__NP_004929
augaccguguucagacaggagaacguggacgacuacuacgacaccggcgaggagcugggcagcggccaguucgccguggugaagaagugcagagagaagagcaccggccugcaguacgccgccaaguucaucaagaagagaagaaccaagagcagcagaagaggcgugagcagagaggacaucgagagagaggugagcauccugaaggagauccagcaccccaacgugaucacccugcacgagguguacgagaacaagaccgacgugauccugauccuggagcugguggccggcggcgagcuguucgacuuccuggccgagaaggagagccugaccgaggaggaggccaccgaguuccugaagcagauccugaacggcguguacuaccugcacagccugcagaucgcccacuucgaccugaagcccgagaacaucaugcugcuggacagaaacgugcccaagcccagaaucaagaucaucgacuucggccuggcccacaagaucgacuucggcaacgaguucaagaacaucuucggcacccccgaguucguggcccccgagaucgugaacuacgagccccugggccuggaggccgacauguggagcaucggcgugaucaccuacauccugcugagcggcgccagccccuuccugggcgacaccaagcaggagacccuggccaacgugagcgccgugaacuacgaguucgaggacgaguacuucagcaacaccagcgcccuggccaaggacuucaucagaagacugcuggugaaggaccccaagaagagaaugaccauccaggacagccugcagcaccccuggaucaagcccaaggacacccagcaggcccugagcagaaaggccagcgccgugaacauggagaaguucaagaaguucgccgccagaaagaaguggaagcagagcgugagacugaucagccugugccagagacugagcagaagcuuccugagcagaagcaacaugagcguggccagaagcgacgacacccuggacgaggaggacagcuucgugaugaaggccaucauccacgccaucaacgacgacaacgugcccggccugcagcaccugcugggcagccugagcaacuacgacgugaaccagcccaacaagcacggcacccccccccugcugaucgccgccggcugcggcaacauccagauccugcagcugcugaucaagagaggcagcagaaucgacgugcaggacaagggcggcagcaacgccguguacugggccgccagacacggccacguggacacccugaaguuccugagcgagaacaagugcccccuggacgugaaggacaagagcggcgagauggcccugcacguggccgccagauacggccacgccgacguggcccagcugcugugcagcuucggcagcaaccccaacauccaggacaaggaggaggagaccccccugcacugcgccgccuggcacggcuacuacagcguggccaaggcccugugcgaggccggcugcaacgugaacaucaagaacagagagggcgagaccccccugcugaccgccagcgccagaggcuaccacgacaucguggagugccuggccgagcacggcgccgaccugaacgccugcgacaaggacggccacaucgcccugcaccuggccgugagaagaugccagauggaggugaucaagacccugcugagccagggcugcuucguggacuaccaggacagacacggcaacaccccccugcacguggccugcaaggacggcaacaugcccaucgugguggcccugugcgaggccaacugcaaccuggacaucagcaacaaguacggcagaaccccccugcaccuggccgccaacaacggcauccuggacguggugagauaccugugccugaugggcgccagcguggaggcccugaccaccgacggcaagaccgccgaggaccuggccagaagcgagcagcacgagcacguggccggccugcuggccagacugagaaaggacacccacagaggccuguucauccagcagcugagacccacccagaaccugcagcccagaaucaagcugaagcuguucggccacagcggcagcggcaagaccacccugguggagagccugaagugcggccugcugagaagcuucuucagaagaagaagacccagacugagcagcaccaacagcagcagauucccccccagcccccuggccagcaagcccaccgugagcgugagcaucaacaaccuguaccccggcugcgagaacgugagcgugagaagcagaagcaugauguucgagcccggccugaccaagggcaugcuggagguguucguggcccccacccaccacccccacugcagcgccgacgaccagagcaccaaggccaucgacauccagaacgccuaccugaacggcgugggcgacuucagcgugugggaguucagcggcaaccccguguacuucugcugcuacgacuacuucgccgccaacgaccccaccagcauccacguggugguguucagccuggaggagcccuacgagauccagcugaaccaggugaucuucuggcugagcuuccugaagagccuggugcccguggaggagcccaucgccuucggcggcaagcugaagaacccccugcagguggugcugguggccacccacgccgacaucaugaacgugcccagacccgccggcggcgaguucggcuacgacaaggacaccagccugcugaaggagaucagaaacagauucggcaacgaccugcacaucagcaacaagcuguucgugcuggacgccggcgccagcggcagcaaggacaugaaggugcugagaaaccaccugcaggagaucagaagccagaucgugagcgugugcccccccaugacccaccugugcgagaagaucaucagcacccugcccagcuggagaaagcugaacggccccaaccagcugaugagccugcagcaguucguguacgacgugcaggaccagcugaacccccuggccagcgaggaggaccugagaagaaucgcccagcagcugcacagcaccggcgagaucaacaucaugcagagcgagaccgugcaggacgugcugcugcuggaccccagauggcugugcaccaacgugcugggcaagcugcugagcguggagacccccagagcccugcaccacuacagaggcagauacaccguggaggacauccagagacuggugcccgacagcgacguggaggagcugcugcagauccuggacgccauggacaucugcgccagagaccugagcagcggcaccaugguggacgugcccgcccugaucaagaccgacaaccugcacagaagcugggccgacgaggaggacgaggugaugguguacggcggcgugagaaucgugcccguggagcaccugacccccuuccccugcggcaucuuccacaaggugcaggugaaccugugcagauggauccaccagcagagcaccgagggcgacgccgacaucagacugugggugaacggcugcaagcuggccaacagaggcgccgagcugcuggugcugcuggugaaccacggccagggcaucgaggugcaggugagaggccuggagaccgagaagaucaagugcugccugcugcuggacagcgugugcagcaccaucgagaacgugauggccaccacccugcccggccugcugaccgugaagcacuaccugagcccccagcagcugagagagcaccacgagcccgugaugaucuaccagcccagagacuucuucagagcccagacccugaaggagaccagccugaccaacaccaugggcggcuacaaggagagcuucagcagcaucaugugcuucggcugccacgacguguacagccaggccagccugggcauggacauccacgccagcgaccugaaccugcugaccagaagaaagcugagcagacugcuggacccccccgacccccugggcaaggacuggugccugcuggccaugaaccugggccugcccgaccugguggccaaguacaacaccagcaacggcgcccccaaggacuuccugcccagcccccugcacgcccugcugagagaguggaccaccuaccccgagagcaccgugggcacccugaugagcaagcugagagagcugggcagaagagacgccgccgacuuccugcugaaggccagcagcguguucaagaucaaccuggacggcaacggccaggaggccuacgccagcagcugcaacagcggcaccagcuacaacagcaucagcagcguggugagcagauaa

SEQ ID NO: 15930 - RNA, 1113 nt, Artificial Sequence
  DAPK2__Homo_sapiens__NP_055141
auguuccaggccagcaugagaagccccaacauggagcccuucaagcagcagaagguggaggacuucuacgacaucggcgaggagcugggcagcggccaguucgccaucgugaagaagugcagagagaagagcaccggccuggaguacgccgccaaguucaucaagaagagacagagcagagccagcagaagaggcgugagcagagaggagaucgagagagaggugagcauccugagacaggugcugcaccacaacgugaucacccugcacgacguguacgagaacagaaccgacguggugcugauccuggagcuggugagcggcggcgagcuguucgacuuccuggcccagaaggagagccugagcgaggaggaggccaccagcuucaucaagcagauccuggacggcgugaacuaccugcacaccaagaagaucgcccacuucgaccugaagcccgagaacaucaugcugcuggacaagaacauccccaucccccacaucaagcugaucgacuucggccuggcccacgagaucgaggacggcguggaguucaagaacaucuucggcacccccgaguucguggcccccgagaucgugaacuacgagccccugggccuggaggccgacauguggagcaucggcgugaucaccuacauccugcugagcggcgccagccccuuccugggcgacaccaagcaggagacccuggccaacaucaccgccgugagcuacgacuucgacgaggaguucuucagccagaccagcgagcuggccaaggacuucaucagaaagcugcuggugaaggagaccagaaagagacugaccauccaggaggcccugagacaccccuggaucacccccguggacaaccagcaggccauggugagaagagagagcguggugaaccuggagaacuucagaaagcaguacgugagaagaagauggaagcugagcuucagcaucgugagccugugcaaccaccugaccagaagccugaugaagaaggugcaccugagacccgacgaggaccugagaaacugcgagagcgacaccgaggaggacaucgccagaagaaaggcccugcaccccagaagaagaagcagcaccagcuaa

SEQ ID NO: 15931 - RNA, 1365 nt, Artificial Sequence
  DAPK3__Homo_sapiens__XP_005259565
augagcaccuucagacaggaggacguggaggaccacuacgagaugggcgaggagcugggcagcggccaguucgccaucgugagaaagugcagacagaagggcaccggcaaggaguacgccgccaaguucaucaagaagagaagacugagcagcagcagaagaggcgugagcagagaggagaucgagagagaggugaacauccugagagagaucagacaccccaacaucaucacccugcacgacaucuucgagaacaagaccgacguggugcugauccuggagcuggugagcggcggcgagcuguucgacuuccuggccgagaaggagagccugaccgaggacgaggccacccaguuccugaagcagauccuggacggcgugcacuaccugcacagcaagagaaucgcccacuucgaccugaagcccgagaacaucaugcugcuggacaagaacgugcccaaccccagaaucaagcugaucgacuucggcaucgcccacaagaucgaggccggcaacgaguucaagaacaucuucggcacccccgaguucguggcccccgagaucgugaacuacgagccccugggccuggaggccgacauguggagcaucggcgugaucaccuacauccugcugagcggcgccagccccuuccugggcgagaccaagcaggagacccugaccaacaucagcgccgugaacuacgacuucgacgaggaguacuucagcaacaccagcgagcuggccaaggacuucaucagaagacugcuggugaaggaccccaagagaagaaugaccaucgcccagagccuggagcacagcuggaucaaggccaucagaagaagaaacgugagaggcgaggacagcggcagaaagcccgagagaagaagacugaagaccaccagacugaaggaguacaccaucaagagccacagcagccugccccccaacaacagcuacgccgacuucgagagauucagcaaggugcuggaggaggccgccgccgccgaggagggccugagagagcugcagagaagcagaagacugugccacgaggacguggaggcccuggccgccaucuacgaggagaaggaggccugguacagagaggagagcgacagccugggccaggaccugagaagacugagacaggagcugcugaagaccgaggcccugaagagacaggcccaggaggaggccaagggcgcccugcugggcaccagcggccugaagagaagauucagcagacuggagaacagauacgaggcccuggccaagcagguggccagcgagaugagauucgugcaggaccuggugagagcccuggagcaggagaagcugcagggcguggagugcggccugagauaa

SEQ ID NO: 15932 - RNA, 1938 nt, Artificial Sequence
  DARS2__Homo_sapiens__NP_060592
auguacuuccccagcuggcugagccagcuguacagaggccugagcagacccaucagaagaaccacccagcccaucuggggcagccuguacagaagccugcugcagagcagccagagaagaauccccgaguucagcagcuucguggugagaaccaacaccugcggcgagcugagaagcagccaccugggccaggaggugacccugugcggcuggauccaguacagaagacagaacaccuuccuggugcugagagacuucgacggccuggugcaggugaucaucccccaggacgagagcgccgccagcgugaagaagauccugugcgaggcccccguggagagcguggugcaggugagcggcaccgugaucagcagacccgccggccaggagaaccccaagaugcccaccggcgagaucgagaucaaggugaagaccgccgagcugcugaacgccugcaagaagcugcccuucgagaucaagaacuucgugaagaagaccgaggcccugagacugcaguacagauaccuggaccugagaagcuuccagaugcaguacaaccugagacugagaagccagauggugaugaagaugagagaguaccugugcaaccugcacggcuucguggacaucgagacccccacccuguucaagagaacccccggcggcgccaaggaguuccuggugcccagcagagagcccggcaaguucuacagccugccccagagcccccagcaguucaagcagcugcugauggugggcggccuggacagauacuuccagguggccagaugcuacagagacgagggcagcagacccgacagacagcccgaguucacccagaucgacaucgagaugagcuucguggaccagaccggcauccagagccugaucgagggccugcugcaguacagcuggcccaacgacaaggaccccgugguggugcccuuccccaccaugaccuucgccgaggugcuggccaccuacggcaccgacaagcccgacaccagauucggcaugaagaucaucgacaucagcgacguguucagaaacaccgagaucggcuuccugcaggacgcccugagcaagccccacggcaccgugaaggccaucugcauccccgagggcgccaaguaccugaagagaaaggacaucgagagcaucagaaacuucgccgccgaccacuucaaccaggagauccugcccguguuccugaacgccaacagaaacuggaacagccccguggccaacuucaucauggagagccagagacuggagcugaucagacugauggagacccaggaggaggacguggugcugcugaccgccggcgagcacaacaaggccugcagccugcugggcaagcugagacuggagugcgccgaccugcuggagaccagaggcguggugcugagagaccccacccuguucagcuuccugugggugguggacuucccccuguuccugcccaaggaggagaaccccagagagcuggagagcgcccaccaccccuucaccgccccccaccccagcgacauccaccugcuguacaccgagcccaagaaggccagaagccagcacuacgaccuggugcugaacggcaacgagaucggcggcggcagcaucagaauccacaacgccgagcugcagagauacauccuggccacccugcugaaggaggacgugaagaugcugagccaccugcugcaggcccuggacuacggcgcccccccccacggcggcaucgcccugggccuggacagacugaucugccuggugaccggcagccccagcaucagagacgugaucgccuuccccaagagcuucagaggccacgaccugaugagcaacacccccgacagcgugccccccgaggagcugaagcccuaccacaucagagugagcaagcccaccgacagcaaggccgagagagcccacuaa

SEQ ID NO: 15933 - RNA, 1206 nt, Artificial Sequence
  DARS__Homo_sapiens__NP_001280241
auggugaaguucgccgccaacaucaacaaggagagcaucguggacguggagggcguggugagaaaggugaaccagaagaucggcagcugcacccagcaggacguggagcugcacgugcagaagaucuacgugaucagccuggccgagcccagacugccccugcagcuggacgacgccgugagacccgaggccgagggcgaggaggagggcagagccaccgugaaccaggacaccagacuggacaacagagugaucgaccugagaaccagcaccagccaggccguguucagacugcagagcggcaucugccaccuguucagagagacccugaucaacaagggcuucguggagauccagacccccaagaucaucagcgccgccagcgagggcggcgccaacguguucaccgugagcuacuucaagaacaacgccuaccuggcccagagcccccagcuguacaagcagaugugcaucugcgccgacuucgagaagguguucagcaucggccccguguucagagccgaggacagcaacacccacagacaccugaccgaguucgugggccuggacaucgagauggccuucaacuaccacuaccacgaggugauggaggagaucgccgacaccauggugcagaucuucaagggccugcaggagagauuccagaccgagauccagaccgugaacaagcaguuccccugcgagcccuucaaguuccuggagcccacccugagacuggaguacugcgaggcccuggccaugcugagagaggccggcguggagaugggcgacgaggacgaccugagcacccccaacgagaagcugcugggccaccuggugaaggagaaguacgacaccgacuucuacauccuggacaaguacccccuggccgugagacccuucuacaccaugcccgaccccagaaaccccaagcagagcaacagcuacgacauguucaugagaggcgaggagauccugagcggcgcccagagaauccacgacccccagcugcugaccgagagagcccugcaccacggcaucgaccuggagaagaucaaggccuacaucgacagcuucagauucggcgcccccccccacgccggcggcggcaucggccuggagagagugaccaugcuguuccugggccugcacaacgugagacagaccagcauguuccccagagaccccaagagacugacccccuaa

SEQ ID NO: 15934 - RNA, 1248 nt, Artificial Sequence
  DAW1__Homo_sapiens__NP_849143
augaagcugaagagccugcugcugagauacuacccccccggcaucaugcuggaguacgagaagcacggcgagcugaagaccaagagcaucgaccugcuggaccugggccccagcaccgacgugagcgcccugguggaggagauccagaaggccgagccccugcugaccgccagcagaaccgagcaggugaagcugcugauccagagacugcaggagaagcugggccagaacagcaaccacaccuucuaccuguucaaggugcugaaggcccacauccugccccugaccaacguggcccugaacaagagcggcagcugcuucaucaccggcagcuacgacagaaccugcaagcugugggacaccgccagcggcgaggagcugaacacccuggagggccacagaaacgugguguacgccaucgccuucaacaaccccuacggcgacaagaucgccaccggcagcuucgacaagaccugcaagcuguggagcguggagaccggcaagugcuaccacaccuucagaggccacaccgccgagaucgugugccugagcuucaacccccagagcacccugguggccaccggcagcauggacaccaccgccaagcugugggacauccagaacggcgaggagguguacacccugagaggccacagcgccgagaucaucagccugagcuucaacaccagcggcgacagaaucaucaccggcagcuucgaccacaccgugguggugugggacgccgacaccggcagaaaggugaacauccugaucggccacugcgccgagaucagcagcgccagcuucaacugggacugcagccugauccugaccggcagcauggacaagaccugcaagcugugggacgccaccaacggcaagugcguggccacccugaccggccacgacgacgagauccuggacagcugcuucgacuacaccggcaagcugaucgccaccgccagcgccgacggcaccgccagaaucuucagcgccgccaccagaaagugcaucgccaagcuggagggccacgagggcgagaucagcaagaucagcuucaacccccagggcaaccaccugcugaccggcagcagcgacaagaccgccagaaucugggacgcccagaccggccagugccugcaggugcuggagggccacaccgacgagaucuucagcugcgccuucaacuacaagggcaacaucgugaucaccggcagcaaggacaacaccugcagaaucuggagauaa

SEQ ID NO: 15935 - RNA, 2259 nt, Artificial Sequence
  DAXX__Homo_sapiens__NP_001135442
augagaggcagcgagaacugcggcgagggcagacuggagagaagauuccugagcaucaucgugcuggacgacgacgacgaggacgaggccgccgcccagcccggccccagccacccccugcccaacgccgccagccccggcgccgaggcccccagcagcagcgagccccacggcgccagaggcagcagcagcagcggcggcaagaagugcuacaagcuggagaacgagaagcuguucgaggaguuccuggagcugugcaagaugcagaccgccgaccaccccgagguggugcccuuccuguacaacagacagcagagagcccacagccuguuccuggccagcgccgaguucugcaacauccugagcagagugcugagcagagccagaagcagacccgccaagcuguacguguacaucaacgagcugugcaccgugcugaaggcccacagcgccaagaagaagcugaaccuggcccccgccgccaccaccagcaacgagcccagcggcaacaacccccccacccaccugagccuggaccccaccaacgccgagaacaccgccagccagagccccagaaccagaggcagcagaagacagauccagagacuggagcagcugcuggcccuguacguggccgagaucagaagacugcaggagaaggagcuggaccugagcgagcuggacgaccccgacagcgccuaccugcaggaggccagacugaagagaaagcugaucagacuguucggcagacugugcgagcugaaggacugcagcagccugaccggcagagugaucgagcagagaauccccuacagaggcaccagauaccccgaggugaacagaagaaucgagagacugaucaacaagcccggccccgacaccuuccccgacuacggcgacgugcugagagccguggagaaggccgccgccagacacagccugggccugcccagacagcagcugcagcugauggcccaggacgccuucagagacgugggcaucagacugcaggagagaagacaccuggaccugaucuacaacuucggcugccaccugaccgacgacuacagacccggcguggaccccgcccugagcgaccccgugcuggccagaagacugagagagaacagaagccuggccaugagcagacuggacgaggugaucagcaaguacgccaugcugcaggacaagagcgaggagggcgagagaaagaagagaagagccagacugcagggcaccagcagccacagcgccgacacccccgaggccagccuggacagcggcgagggccccagcggcauggccagccagggcugccccagcgccagcagagccgagaccgacgacgaggacgacgaggagagcgacgaggaggaggaggaggaggaggaggaggaggaggaggaggccaccgacagcgaggaggaggaggaccuggagcagaugcaggagggccaggaggacgacgaggaggaggacgaggaggaggaggccgccgccggcaaggacggcgacaagagccccaugagcagccugcagaucagcaacgagaagaaccuggagcccggcaagcagaucagcagaagcagcggcgagcagcagaacaagggcagaaucgugagccccagccugcugagcgaggagccccuggcccccagcagcaucgacgccgagagcaacggcgagcagcccgaggagcugacccuggaggaggagagccccgugagccagcuguucgagcuggagaucgaggcccugccccuggacacccccagcagcguggagaccgacaucagcagcagcagaaagcagagcgaggagcccuucaccaccgugcuggagaacggcgccggcauggugagcagcaccagcuucaacggcggcgugagcccccacaacuggggcgacagcggcccccccugcaagaagagcagaaaggagaagaagcagaccggcagcggcccccugggcaacagcuacguggagagacagagaagcgugcacgagaagaacggcaagaagaucugcacccugcccagcccccccagcccccuggccagccuggcccccguggccgacagcagcaccagaguggacagccccagccacggccuggugaccagcagccugugcauccccagccccgccagacugagccagaccccccacagccagccccccagacccggcaccugcaagaccagcguggccacccagugcgaccccgaggagaucaucgugcugagcgacagcgacuaa

SEQ ID NO: 15936 - RNA, 2235 nt, Artificial Sequence
  DAZ1__Homo_sapiens__NP_004072
augagcgccgccaaccccgagacccccaacagcaccaucagcagagaggccagcacccagagcagcagcgccgccgccagccagggcugggugcugcccgagggcaagaucgugcccaacaccguguucgugggcggcaucgacgccagaauggacgagaccgagaucggcagcugcuucggcagauacggcagcgugaaggaggugaagaucaucaccaacagaaccggcgugagcaagggcuacggcuucgugagcuucgugaacgacguggacgugcagaagaucgugggcagccagauccacuuccacggcaagaagcugaagcugggccccgccaucagaaagcagaagcugugcgccagacacgugcagcccagaccccugguggugaacccccccccccccccccaguuccagaacguguggagaaaccccaacaccgagaccuaccugcagccccagaucacccccaaccccgugacccagcacgugcagagcgccgccaaccccgagacccccaacagcaccaucagcagagaggccagcacccagagcagcagcgccgccgccagccagggcugggugcugcccgagggcaagaucgugcccaacaccguguucgugggcggcaucgacgccagaauggacgagaccgagaucggcagcugcuucggcagauacggcagcgugaaggaggugaagaucaucaccaacagaaccggcgugagcaagggcuacggcuucgugagcuucgugaacgacguggacgugcagaagaucgugggcagccagauccacuuccacggcaagaagcugaagcugggccccgccaucagaaagcagaagcugugcgccagacacgugcagcccagaccccugguggugaacccccccccccccccccaguuccagaacguguggagaaaccccaacaccgagaccuaccugcagccccagaucacccccaaccccgugacccagcacgugcagagcgccgccaaccccgagacccccaacagcaccaucagcagagaggccagcacccagagcagcagcgccgccgccagccagggcugggugcugcccgagggcaagaucgugcccaacaccguguucgugggcggcaucgacgccagaauggacgagaccgagaucggcagcugcuucggcagauacggcagcgugaaggaggugaagaucaucaccaacagaaccggcgugagcaagggcuacggcuucgugagcuucgugaacgacguggacgugcagaagaucgugggcagccagauccacuuccacggcaagaagcugaagcugggccccgccaucagaaagcagaagcugugcgccagacacgugcagcccagaccccugguggugaacccccccccccccccccaguuccagaacguguggagaaaccccaacaccgagaccuaccugcagccccagaucacccccaaccccgugacccagcacgugcaggccuacagcgccuacccccacagccccggccaggugaucaccggcugccagcugcugguguacaacuaccaggaguaccccaccuaccccgacagcgccuuccaggugaccaccggcuaccagcugcccguguacaacuaccagcccuuccccgccuaccccagaagccccuuccaggugaccgccggcuaccagcugcccguguacaacuaccaggccuuccccgccuaccccaacagccccuuccagguggccaccggcuaccaguuccccguguacaacuaccagcccuuccccgccuaccccagcagccccuuccaggugaccgccggcuaccagcugcccguguacaacuaccaggccuuccccgccuaccccaacagccccuuccagguggccaccggcuaccaguuccccguguacaacuaccaggccuuccccgccuaccccaacagccccgugcaggugaccaccggcuaccagcugcccguguacaacuaccaggccuuccccgccuaccccagcagccccuuccaggugaccaccggcuaccagcugcccguguacaacuaccaggccuuccccgccuaccccaacagcgccgugcaggugaccaccggcuaccaguuccacguguacaacuaccagaugcccccccagugccccgugggcgagcagagaagaaaccuguggaccgaggccuacaaguggugguaccuggugugccugauccagagaagagacuaa

SEQ ID NO: 15937 - RNA, 1605 nt, Artificial Sequence
  DAZ2__Homo_sapiens__NP_001005785
augagcgccgccaaccccgagacccccaacagcaccaucagcagagaggccagcacccagagcagcagcgccgccgccagccagggcugggugcugcccgagggcaagaucgugcccaacaccguguucgugggcggcaucgacgccagaauggacgagaccgagaucggcagcugcuucggcagauacggcagcgugaaggaggugaagaucaucaccaacagaaccggcgugagcaagggcuacggcuucgugagcuucgugaacgacguggacgugcagaagaucgugggcagccagauccacuuccacggcaagaagcugaagcugggccccgccaucagaaagcagaagcugugcgccagacacgugcagcccagaccccugguggugaacccccccccccccccccaguuccagaacguguggagaaaccccaacaccgagaccuaccugcagccccagaucacccccaaccccgugacccagcacgugcaggccuacagcgccuacccccacagccccggccaggugaucaccggcugccagcugcugguguacaacuaccaggaguaccccaccuaccccgacagcgccuuccaggugaccaccggcuaccagcugcccguguacaacuaccagcccuuccccgccuaccccagaagccccuuccaggugaccgccggcuaccagcugcccguguacaacuaccaggccuuccccgccuaccccaacagccccuuccagguggccaccggcuaccaguuccccguguacaacuaccagcccuuccccgccuaccccagcagccccuuccaggugaccgccggcuaccagcugcccguguacaacuaccaggccuuccccgccuaccccaacagccccuuccagguggccaccggcuaccaguuccccguguacaacuaccaggccuuccccgccuaccccaacagccccgugcaggugaccaccggcuaccagcugcccguguacaacuaccaggccuuccccgccuaccccagcagccccuuccaggugaccaccggcuaccagcugcccguguacaacuaccaggccuuccccgccuaccccagcagccccuuccaggugaccaccggcuaccagcugcccguguacaacuaccaggccuuccccgccuaccccagcagccccuuccaggugaccaccggcuaccagcugcccguguacaacuaccaggccuuccccgccuaccccagcagccccuuccaggugaccaccggcuaccagcugcccguguacaacuaccaggccuuccccgccuaccccagcagccccuuccaggugaccaccggcuaccagcugcccguguacaacuaccaggccuuccccgccuaccccagcagccccuuccaggugaccaccggcuaccagcugcccguguacaacuaccaggccuuccccgccuaccccaacagcgccgugcaggugaccaccggcuaccaguuccacguguacaacuaccagaugcccccccagugccccgugggcgagcagagaagaaaccuguggaccgaggccuacaaguggugguaccuggugugccugauccagagaagagacuaa

SEQ ID NO: 15938 - RNA, 1317 nt, Artificial Sequence
  DAZ3__Homo_sapiens__NP_065097
augagcgccgccaaccccgagacccccaacagcaccaucagcagagaggccagcacccagagcagcagcgccgccgccagccagggcugggugcugcccgagggcaagaucgugcccaacaccguguucgugggcggcaucgacgccagaauggacgagaccgagaucggcagcugcuucggcagauacggcagcgugaaggaggugaagaucaucaccaacagaaccggcgugagcaagggcuacggcuucgugagcuucgugaacgacguggacgugcagaagaucgugggcagccagauccacuuccacggcaagaagcugaagcugggccccgccaucagaaagcagaagcugugcgccagacacgugcagcccagaccccugguggugaacccccccccccccccccaguuccagaacguguggagaaaccccaacaccgagaccuaccugcagccccagaucacccccaaccccgugacccagcacgugcaggccuacagcgccuacccccacagccccggccaggugaucaccggcugccagcugcugguguacaacuaccaggaguaccccaccuaccccgacagcgccuuccaggugaccaccggcuaccagcugcccguguacaacuaccagcccuuccccgccuaccccagaagccccuuccaggugaccgccggcuaccagcugcccguguacaacuaccaggccuuccccgccuaccccaacagccccuuccagguggccaccggcuaccaguuccccguguacaacuaccaggccuuccccgccuaccccaacagccccgugcaggugaccaccggcuaccagcugcccguguacaacuaccaggccuuccccgccuaccccaacagccccuuccagguggccaccggcuaccaguuccccguguacaacuaccaggccuuccccgccuaccccaacagccccgugcaggugaccaccggcuaccagcugcccguguacaacuaccaggccuuccccgccuaccccaacagccccuuccagguggccaccggcuaccaguuccccguguacaacuaccaggccuuccccgccuaccccaacagccccgugcaggugaccaccggcuaccagcugcccguguacaacuaccaggccuuccccgccuaccccaacagcgccgugcaggugaccaccggcuaccaguuccacguguacaacuaccagaugcccccccagugccccgugggcgagcagagaagaaaccuguggaccgaggccuacaaguggugguaccuggugugccugauccagagaagagacuaa

SEQ ID NO: 15939 - RNA, 1740 nt, Artificial Sequence
  DAZ4__Homo_sapiens__NP_001005375
augagcgccgccaaccccgagacccccaacagcaccaucagcagagaggccagcacccagagcagcagcgccgccgccagccagggcugggugcugcccgagggcaagaucgugcccaacaccguguucgugggcggcaucgacgccagaauggacgagaccgagaucggcagcugcuucggcagauacggcagcgugaaggaggugaagaucaucaccaacagaaccggcgugagcaagggcuacggcuucgugagcuucgugaacgacguggacgugcagaagaucgugggcagccagauccacuuccacggcaagaagcugaagcugggccccgccaucagaaagcagaagcugugcgccagacacgugcagcccagaccccugguggugaacccccccccccccccccaguuccagaacguguggagaaaccccaacaccgagaccuaccugcagccccagaucacccccaaccccgugacccagcacgugcagagcgccgccaaccccgagacccccaacagcaccaucagcagagaggccagcacccagagcagcagcgccgccgccagccagggcugggugcugcccgagggcaagaucgugcccaacaccguguucgugggcggcaucgacgccagaauggacgagaccgagaucggcagcugcuucggcagauacggcagcgugaaggaggugaagaucaucaccaacagaaccggcgugagcaagggcuacggcuucgugagcuucgugaacgacguggacgugcagaagaucgugggcagccagauccacuuccacggcaagaagcugaagcugggccccgccaucagaaagcagaagcugugcgccagacacgugcagcccagaccccugguggugaacccccccccccccccccaguuccagaacguguggagaaaccccaacaccgagaccuaccugcagccccagaucacccccaaccccgugacccagcacgugcaggccuacagcgccuacccccacagccccggccaggugaucaccggcugccagcugcugguguacaacuaccaggaguaccccaccuaccccgacagcgccuuccaggugaccaccggcuaccagcugcccguguacaacuaccagcccuuccccgccuaccccagaagccccuuccaggugaccgccggcuaccagcugcccguguacaacuaccaggccuuccccgccuaccccaacagccccuuccagguggccaccggcuaccaguuccccguguacaacuaccagcccuuccccgccuaccccagcagccccuuccaggugaccgccggcuaccagcugcccguguacaacuaccaggccuuccccgccuaccccaacagccccuuccagguggccaccggcuaccaguuccccguguacaacuaccaggccuuccccgccuaccccaacagccccgugcaggugaccaccggcuaccagcugcccguguacaacuaccaggccuuccccgccuaccccagcagccccuuccaggugaccaccggcuaccagcugcccguguacaacuaccaggccuuccccgccuaccccaacagcgccgugcaggugaccaccggcuaccaguuccacguguacaacuaccagaugcccccccagugccccgugggcgagcagagaagaaaccuguggaccgaggccuacaaguggugguaccuggugugccugauccagagaagagacuaa

SEQ ID NO: 15940 - RNA, 1224 nt, Artificial Sequence
  DAZAP1__Homo_sapiens__NP_061832
augaacaacagcggcgccgacgagaucggcaagcuguucgugggcggccuggacuggagcaccacccaggagacccugagaagcuacuucagccaguacggcgaggugguggacugcgugaucaugaaggacaagaccaccaaccagagcagaggcuucggcuucgugaaguucaaggaccccaacugcgugggcaccgugcuggccagcagaccccacacccuggacggcagaaacaucgaccccaagcccugcacccccagaggcaugcagcccgagagaaccagacccaaggagggcuggcagaagggccccagaagcgacaacagcaagagcaacaagaucuucgugggcggcaucccccacaacugcggcgagaccgagcugagagaguacuucaagaaguucggcguggugaccgagguggugaugaucuacgacgccgagaagcagagacccagaggcuucggcuucaucaccuucgaggacgagcagagcguggaccaggccgugaacaugcacuuccacgacaucaugggcaagaagguggaggugaagagagccgagcccagagacagcaagagccaggcccccggccagcccggcgccagccaguggggcagcagaguggugcccaacgccgccaacggcugggccggccagcccccccccaccuggcagcagggcuacggcccccagggcaugugggugcccgccggccaggccaucggcggcuacggccccccccccgccggcagaggcgccccccccccccccccccccuucaccagcuacaucgugagcaccccccccggcggcuucccccccccccagggcuucccccagggcuacggcgcccccccccaguucagcuucggcuacggcccccccccccccccccccgaccaguucgccccccccggcgugccccccccccccgccacccccggcgccgccccccuggccuucccccccccccccagccaggccgcccccgacaugagcaagccccccaccgcccagcccgacuuccccuacggccaguacgccggcuacggccaggaccugagcggcuucggccagggcuucagcgaccccagccagcagccccccagcuacggcggccccagcgugcccggcagcggcggcccccccgccggcggcagcggcuucggcagaggccagaaccacaacgugcagggcuuccaccccuacagaagauaa

SEQ ID NO: 15941 - RNA, 441 nt, Artificial Sequence
  DAZAP2__Homo_sapiens__NP_001129736
augaacagcaagggccaguaccccacccagcccaccuaccccgugcagccccccggcaaccccguguacccccagacccugcaccugccccaggccccccccuacaccgacgccccccccgccuacagcgagcuguacagacccagcuucgugcaccccggcgccgccaccgugcccaccaugagcgccgccauccccauggccuacuaccccgugggccccaucuacccccccggcagcaccgugcugguggagggcggcuacgacgccggcgccagauucggcgccggcgccaccgccggcaacauccccccccccccccccggcugcccccccaacgccgcccagcuggccgugaugcagggcgccaacgugcuggugacccagagaaagggcaacuucuucaugggcggcagcgacggcggcuacaccaucugguaa

SEQ ID NO: 15942 - RNA, 948 nt, Artificial Sequence
  DAZL__Homo_sapiens__NP_001177740
auggccgcccccagcugcggcggcgacagaaaggccagacugacccccagccugccccacgagagcaccgccaaccccgagacccccaacagcaccaucagcagagaggccagcacccagagcagcagcgccgccaccagccagggcuacauccugcccgagggcaagaucaugcccaacaccguguucgugggcggcaucgacgugagaauggacgagaccgagaucagaagcuucuucgccagauacggcagcgugaaggaggugaagaucaucaccgacagaaccggcgugagcaagggcuacggcuucgugagcuucuucaacgacguggacgugcagaagaucguggagagccagaucaacuuccacggcaagaagcugaagcugggccccgccaucagaaagcagaaccugugcgccuaccacgugcagcccagaccccugguguucaaccaccccccccccccccaguuccagaacguguggaccaaccccaacaccgagaccuacaugcagcccaccaccaccaugaaccccaucacccaguacgugcaggccuaccccaccuaccccaacagccccgugcaggugaucaccggcuaccagcugcccguguacaacuaccagaugcccccccaguggcccgugggcgagcagagaagcuacguggugccccccgccuacagcgccgugaacuaccacugcaacgagguggaccccggcgccgagguggugcccaacgagugcagcgugcacgaggccaccccccccagcggcaacggcccccagaagaagagcguggacagaagcauccagaccguggugagcugccuguucaaccccgagaacagacugagaaacagcguggugacccaggacgacuacuucaaggacaagagagugcaccacuucagaagaagcagagccaugcugaagagcguguaa

SEQ ID NO: 15943 - RNA, 2025 nt, Artificial Sequence
  DBF4__Homo_sapiens__NP_006707
augaacagcggcgccaugagaauccacagcaagggccacuuccagggcggcauccaggugaagaacgagaagaacagacccagccugaagagccugaagaccgacaacagacccgagaagagcaagugcaagccccuguggggcaagguguucuaccuggaccugcccagcgugaccaucagcgagaagcugcagaaggacaucaaggaccugggcggcagaguggaggaguuccugagcaaggacaucagcuaccugaucagcaacaagaaggaggccaaguucgcccagacccugggcagaaucagccccgugcccagccccgagagcgccuacaccgccgagaccaccagcccccaccccagccacgacggcagcagcuucaagagccccgacaccgugugccugagcagaggcaagcugcugguggagaaggccaucaaggaccacgacuucauccccagcaacagcauccugagcaacgcccugagcuggggcgugaagauccugcacaucgacgacaucagauacuacaucgagcagaagaagaaggagcuguaccugcugaagaagagcagcaccagcgugagagacggcggcaagagagugggcagcggcgcccagaagaccagaaccggcagacugaagaagcccuucgugaagguggaggacaugagccagcuguacagacccuucuaccugcagcugaccaacaugcccuucaucaacuacagcauccagaagcccugcagccccuucgacguggacaagcccagcagcaugcagaagcagacccaggugaagcugagaauccagaccgacggcgacaaguacggcggcaccagcauccagcugcagcugaaggagaagaagaagaagggcuacugcgagugcugccugcagaaguacgaggaccuggagacccaccugcugagcgagcagcacagaaacuucgcccagagcaaccaguaccaggugguggacgacaucgugagcaagcugguguucgacuucguggaguacgagaaggacacccccaagaagaagagaaucaaguacagcgugggcagccugagccccgugagcgccagcgugcugaagaagaccgagcagaaggagaagguggagcugcagcacaucagccagaaggacugccaggaggacgacaccaccgugaaggagcagaacuuccuguacaaggagacccaggagaccgagaagaagcugcuguucaucagcgagcccaucccccaccccagcaacgagcugagaggccugaacgagaagaugagcaacaagugcagcaugcugagcaccgccgaggacgacaucagacagaacuucacccagcugccccugcacaagaacaagcaggagugcauccuggacaucagcgagcacacccugagcgagaacgaccuggaggagcugagaguggaccacuacaagugcaacauccaggccagcgugcacgugagcgacuucagcaccgacaacagcggcagccagcccaagcagaagagcgacaccgugcuguuccccgccaaggaccugaaggagaaggaccugcacagcaucuucacccacgacagcggccugaucaccaucaacagcagccaggagcaccugaccgugcaggccaaggcccccuuccacaccccccccgaggagcccaacgagugcgacuucaagaacauggacagccugcccagcggcaagauccacagaaaggugaagaucauccugggcagaaacagaaaggagaaccuggagcccaacgccgaguucgacaagagaaccgaguucaucacccaggaggagaacagaaucugcagcagccccgugcagagccugcuggaccuguuccagaccagcgaggagaagagcgaguuccugggcuucaccagcuacaccgagaagagcggcaucugcaacgugcuggacaucugggaggaggagaacagcgacaaccugcugaccgccuucuucagcagccccagcaccagcaccuucaccggcuucuaa

SEQ ID NO: 15944 - RNA, 1854 nt, Artificial Sequence
  DBH__Homo_sapiens__NP_000778
augcccgcccugagcagaugggccagccugcccggccccagcaugagagaggccgccuucauguacagcaccgccguggccaucuuccuggugauccugguggccgcccugcagggcagcgcccccagagagagcccccugcccuaccacaucccccuggaccccgagggcagccuggagcugagcuggaacgugagcuacacccaggaggccauccacuuccagcugcuggugagaagacugaaggccggcgugcuguucggcaugagcgacagaggcgagcuggagaacgccgaccugguggugcuguggaccgacggcgacaccgccuacuucgccgacgccuggagcgaccagaagggccagauccaccuggacccccagcaggacuaccagcugcugcaggugcagagaacccccgagggccugacccugcuguucaagagacccuucggcaccugcgaccccaaggacuaccugaucgaggacggcaccgugcaccugguguacggcauccuggaggagcccuucagaagccuggaggccaucaacggcagcggccugcagaugggccugcagagagugcagcugcugaagcccaacauccccgagcccgagcugcccagcgacgccugcaccauggaggugcaggcccccaacauccagauccccagccaggagaccaccuacuggugcuacaucaaggagcugcccaagggcuucagcagacaccacaucaucaaguacgagcccaucgugaccaagggcaacgaggcccuggugcaccacauggagguguuccagugcgcccccgagauggacagcgugccccacuucagcggccccugcgacagcaagaugaagcccgacagacugaacuacugcagacacgugcuggccgccugggcccugggcgccaaggccuucuacuaccccgaggaggccggccuggccuucggcggccccggcagcagcagauaccugagacuggaggugcacuaccacaacccccuggugaucgagggcagaaacgacagcagcggcaucagacuguacuacaccgccaagcugagaagauucaacgccggcaucauggagcugggccugguguacacccccgugauggccaucccccccagagagaccgccuucauccugaccggcuacugcaccgacaagugcacccagcuggcccugccccccagcggcauccacaucuucgccagccagcugcacacccaccugaccggcagaaagguggugaccgugcuggugagagacggcagagagugggagaucgugaaccaggacaaccacuacagcccccacuuccaggagaucagaaugcugaagaagguggugagcgugcaccccggcgacgugcugaucaccagcugcaccuacaacaccgaggacagagagcuggccaccgugggcggcuucggcauccuggaggagaugugcgugaacuacgugcacuacuacccccagacccagcuggagcugugcaagagcgccguggacgccggcuuccugcagaaguacuuccaccugaucaacagauucaacaacgaggacgugugcaccugcccccaggccagcgugagccagcaguucaccagcgugcccuggaacagcuucaacagagacgugcugaaggcccuguacagcuucgcccccaucagcaugcacugcaacaagagcagcgccgugagauuccagggcgaguggaaccugcagccccugcccaaggugaucagcacccuggaggagcccaccccccagugccccaccagccagggcagaagccccgccggccccaccguggugagcaucggcggcggcaagggcuaa

SEQ ID NO: 15945 - RNA, 264 nt, Artificial Sequence
  DBI__Homo_sapiens__NP_001073331
augagccaggccgaguucgagaaggccgccgaggaggugagacaccugaagaccaagcccagcgacgaggagaugcuguucaucuacggccacuacaagcaggccaccgugggcgacaucaacaccgagagacccggcaugcuggacuucaccggcaaggccaagugggacgccuggaacgagcugaagggcaccagcaaggaggacgccaugaaggccuacaucaacaagguggaggagcugaagaagaaguacggcaucuaa

SEQ ID NO: 15946 - RNA, 1950 nt, Artificial Sequence
  DBN1__Homo_sapiens__NP_004386
auggccggcgugagcuucagcggccacagacuggagcugcuggccgccuacgaggaggugaucagagaggagagcgccgccgacugggcccuguacaccuacgaggacggcagcgacgaccugaagcuggccgccagcggcgagggcggccugcaggagcugagcggccacuucgagaaccagaaggugauguacggcuucugcagcgugaaggacagccaggccgcccugcccaaguacgugcugaucaacugggugggcgaggacgugcccgacgccagaaagugcgccugcgccagccacguggccaagguggccgaguucuuccagggcguggacgugaucgugaacgccagcagcguggaggacaucgacgccggcgccaucggccagagacugagcaacggccuggccagacugagcagccccgugcugcacagacugagacugagagaggacgagaacgccgagcccgugggcaccaccuaccagaagaccgacgccgccguggagaugaagagaaucaacagagagcaguucugggagcaggccaagaaggaggaggagcugagaaaggaggaggagagaaagaaggcccuggacgagagacugagauucgagcaggagagaauggagcaggagagacaggagcaggaggagagagagagaagauacagagagagagagcagcagaucgaggagcacagaagaaagcagcagacccuggaggccgaggaggccaagagaagacugaaggagcagagcaucuucggcgaccacagagacgaggaggaggagacccacaugaagaagagcgagagcgagguggaggaggccgccgccaucaucgcccagagacccgacaaccccagagaguucuucaagcagcaggagagaguggccagcgccagcgccggcagcugcgacgugcccagccccuucaaccacagacccggcagccaccuggacagccacagaagaauggcccccacccccauccccaccagaagccccagcgacagcagcaccgccagcacccccguggccgagcagaucgagagagcccuggacgaggugaccagcagccagccccccccccugccccccccccccccccccgcccaggagacccaggagcccagccccauccuggacagcgaggagaccagagccgccgccccccaggccugggccggccccauggaggagcccccccaggcccaggccccccccagaggccccggcagccccgccgaggaccugauguucauggagagcgccgagcaggccgugcuggccgcccccguggagcccgccaccgccgacgccaccgagauccacgacgccgccgacaccaucgagaccgacaccgccaccgccgacaccaccguggccaacaacgugccccccgccgccaccagccugaucgaccuguggcccggcaacggcgagggcgccagcacccugcagggcgagcccagagcccccaccccccccagcggcaccgaggugacccuggccgaggugccccugcuggacgagguggcccccgagccccugcugcccgccggcgagggcugcgccacccugcugaacuucgacgagcugcccgagccccccgccaccuucugcgaccccgaggagguggagggcgagccccuggccgccccccagacccccacccugcccagcgcccuggaggagcuggagcaggagcaggagcccgagccccaccugcugaccaacggcgagaccacccagaaggagggcacccaggccagcgagggcuacuucagccagagccaggaggaggaguucgcccagagcgaggagcugugcgccaaggcccccccccccguguucuacaacaagccccccgagaucgacaucaccugcugggacgccgaccccgugcccgaggaggaggagggcuucgagggcggcgacuaa

SEQ ID NO: 15947 - RNA, 1293 nt, Artificial Sequence
  DBNL__Homo_sapiens__NP_001014436
auggccgccaaccugagcagaaacggccccgcccugcaggaggccuacgugagaguggugaccgagaagagccccaccgacugggcccuguucaccuacgagggcaacagcaacgacaucagaguggccggcaccggcgagggcggccuggaggagaugguggaggagcugaacagcggcaaggugauguacgccuucugcagagugaaggaccccaacagcggccugcccaaguucgugcugaucaacuggaccggcgagggcgugaacgacgugagaaagggcgccugcgccagccacgugagcaccauggccagcuuccugaagggcgcccacgugaccaucaacgccagagccgaggaggacguggagcccgagugcaucauggagaagguggccaaggccagcggcgccaacuacagcuuccacaaggagagcggcagauuccaggacgugggcccccaggcccccgugggcagcguguaccagaagaccaacgccgugagcgagaucaagagagugggcaaggacagcuucugggccaaggccgagaaggaggaggagaacagaagacuggaggagaagagaagagccgaggaggcccagagacagcuggagcaggagagaagagagagagagcugagagaggccgccagaagagagcagagauaccaggagcagggcggcgaggccagcccccagagaaccugggagcagcagcaggagguggugagcagaaacagaaacgagcaggagagcgccgugcaccccagagagaucuucaagcagaaggagagagccaugagcaccaccagcaucagcagcccccagcccggcaagcugagaagccccuuccugcagaagcagcugacccagcccgagacccacuucggcagagagcccgccgccgccaucagcagacccagagccgaccugcccgccgaggagcccgcccccagcaccccccccugccuggugcaggccgaggaggaggccguguacgaggagccccccgagcaggagaccuucuacgagcagcccccccuggugcagcagcagggcgccggcagcgagcacaucgaccaccacauccagggccagggccugagcggccagggccugugcgccagagcccuguacgacuaccaggccgccgacgacaccgagaucagcuucgaccccgagaaccugaucaccggcaucgaggugaucgacgagggcugguggagaggcuacggccccgacggccacuucggcauguuccccgccaacuacguggagcugaucgaguaa

SEQ ID NO: 15948 - RNA, 978 nt, Artificial Sequence
  DBP__Homo_sapiens__NP_001343
auggccagacccgugagcgacagaacccccgccccccugcugcugggcggccccgccggcaccccccccggcggcggcgcccugcugggccugagaagccugcugcagggcaccagcaagcccaaggagcccgccagcugccugcugaaggagaaggagagaaaggccgcccugcccgccgccaccacccccggccccggccuggagaccgccggccccgccgacgcccccgccggcgccguggugggcggcggcagccccagaggcagacccggccccgugcccgcccccggccugcuggccccccugcugugggagagaacccugcccuucggcgacguggaguacguggaccuggacgccuuccugcuggagcacggccugccccccagcccccccccccccggcggccccagccccgagcccagccccgccagaacccccgcccccagccccggccccggcagcugcggcagcgccagccccagaagcagccccggccacgcccccgccagagccgcccugggcaccgccagcggccacagagccggccugaccagcagagacacccccagccccguggaccccgacaccguggaggugcugaugaccuucgagcccgaccccgccgaccuggcccugagcagcauccccggccacgagaccuucgaccccagaagacacagauucagcgaggaggagcugaagccccagcccaucaugaagaaggccagaaagauccaggugcccgaggagcagaaggacgagaaguacuggagcagaagauacaagaacaacgaggccgccaagagaagcagagacgccagaagacugaaggagaaccagaucagcgugagagccgccuuccuggagaaggagaacgcccugcugagacaggaggugguggccgugagacaggagcugagccacuacagagccgugcugagcagauaccaggcccagcacggcgcccuguaa

SEQ ID NO: 15949 - RNA, 1635 nt, Artificial Sequence
  DBR1__Homo_sapiens__NP_057300
augagaguggccguggccggcugcugccacggcgagcuggacaagaucuacgagacccuggcccuggccgagagaagaggccccggccccguggaccugcugcugugcugcggcgacuuccaggccgugagaaacgaggccgaccugagaugcauggccgugccccccaaguacagacacaugcagaccuucuacagauacuacagcggcgagaagaaggcccccgugcugacccuguucaucggcggcaaccacgaggccagcaaccaccugcaggagcugcccuacggcggcuggguggcccccaacaucuacuaccugggccuggccggcguggugaaguacagaggcgugagaaucggcggcaucagcggcaucuucaagagccacgacuacagaaagggccacuucgagugcccccccuacaacagcagcaccaucagaagcaucuaccacgugagaaacaucgagguguacaagcugaagcagcugaagcagcccaucgacaucuuccugagccacgacuggcccagaagcaucuaccacuacggcaacaagaagcagcugcugaagaccaagagcuucuucagacaggagguggagaacaacacccugggcagccccgccgccagcgagcugcuggagcaccugaagcccaccuacugguucagcgcccaccugcacgugaaguucgccgcccugaugcagcaccaggccaaggacaagggccagaccgccagagccaccaaguuccuggcccuggacaagugccugccccacagagacuuccugcagauccuggagaucgagcacgaccccagcgcccccgacuaccuggaguacgacaucgaguggcugaccauccugagagccaccgacgaccugaucaacgugaccggcagacuguggaacaugcccgagaacaacggccugcacgccagaugggacuacagcgccaccgaggagggcaugaaggaggugcuggagaagcugaaccacgaccugaaggugcccugcaacuucagcgugaccgccgccugcuacgaccccagcaagccccagacccagaugcagcugauccacagaaucaacccccagaccaccgaguucugcgcccagcugggcaucaucgacaucaacgugagacugcagaagagcaaggaggagcaccacgugugcggcgaguacgaggagcaggacgacguggagagcaacgacagcggcgaggaccagagcgaguacaacaccgacaccagcgcccugagcagcaucaaccccgacgagaucaugcuggacgaggaggaggacgaggacagcaucgugagcgcccacagcggcaugaacacccccagcguggagcccagcgaccaggccagcgaguucagcgccagcuucagcgacgugagaauccugcccggcagcaugaucgugagcagcgacgacaccguggacagcaccaucgacagagagggcaagcccggcggcaccguggagagcggcaacggcgaggaccugaccaaggugccccugaagagacugagcgacgagcacgagcccgagcagagaaagaagaucaagagaagaaaccaggccaucuacgccgccguggacgacgacgacgacgacgccgccuaa

SEQ ID NO: 15950 - RNA, 1032 nt, Artificial Sequence
  DBX1__Homo_sapiens__NP_001025036
augauguuccccggccugcuggccccccccgccggcuaccccagccugcugagacccacccccacccugacccugccccagagccugcagagcgccuucagcggccacagcagcuuccugguggaggaccugaucagaaucagcagaccccccgccuaccugcccagaagcgugcccaccgccagcaugagcccccccagacagggcgcccccaccgcccugaccgacaccggcgccagcgaccugggcagccccggccccggcagcagaagaggcggcagcccccccaccgccuucagccccgccagcgagaccaccuuccugaaguucggcgugaacgccauccugagcagcggccccagaaccgagaccagccccgcccugcugcagagcgugccccccaagaccuucgccuuccccuacuucgagggcagcuuccagcccuucaucagaagcagcuacuuccccgccagcagcagcguggugcccauccccggcaccuucagcuggccccuggccgccagaggcaagcccagaagaggcaugcugagaagagccguguucagcgacgugcagagaaaggcccuggagaagauguuccagaagcagaaguacaucagcaagcccgacagaaagaagcuggccgccaagcugggccugaaggacagccaggugaagaucugguuccagaacagaagaaugaaguggagaaacagcaaggagagagagcugcugagcagcggcggcugcagagagcagacccugcccaccaagcugaacccccaccccgaccugagcgacgugggccagaagggccccggcaacgaggaggaggaggagggccccggcagccccagccacagacuggccuaccacgccagcagcgacccccagcaccugagagaccccagacugcccggcccccugccccccagccccgcccacagcagcagccccggcaagcccagcgacuucagcgacagcgaggaggaggaggagggcgaggagcaggaggagaucaccgugagcuaa

SEQ ID NO: 15951 - RNA, 1362 nt, Artificial Sequence
  DCAF12__Homo_sapiens__NP_056212
auggccagaaagguggugagcagaaagagaaaggcccccgccagccccggcgccggcagcgacgcccagggcccccaguucggcugggaccacagccugcacaagagaaagagacugccccccgugaagagaagccugguguacuaccugaagaacagagaggugagacugcagaacgagaccagcuacagcagagugcugcacggcuacgccgcccagcagcugcccagccugcugaaggagagagaguuccaccugggcacccugaacaagguguucgccagccaguggcugaaccacagacagguggugugcggcaccaagugcaacacccuguucgugguggacgugcagaccagccagaucaccaagauccccauccugaaggacagagagcccggcggcgugacccagcagggcugcggcauccacgccaucgagcugaaccccagcagaacccugcuggccaccggcggcgacaaccccaacagccuggccaucuacagacugcccacccuggaccccgugugcgugggcgacgacggccacaaggacuggaucuucagcaucgccuggaucagcgacaccauggccgugagcggcagcagagacggcagcaugggccugugggaggugaccgacgacgugcugaccaagagcgacgccagacacaacgugagcagagugcccguguacgcccacaucacccacaaggcccugaaggacauccccaaggaggacaccaaccccgacaacugcaaggugagagcccuggccuucaacaacaagaacaaggagcugggcgccgugagccuggacggcuacuuccaccuguggaaggccgagaacacccugagcaagcugcugagcaccaagcugcccuacugcagagagaacgugugccuggccuacggcagcgaguggagcguguacgccgugggcagccaggcccacgugagcuuccuggaccccagacagcccagcuacaacgugaagagcgugugcagcagagagagaggcagcggcaucagaagcgugagcuucuacgagcacaucaucaccgugggcaccggccagggcagccugcuguucuacgacaucagagcccagagauuccuggaggagagacugagcgccugcuacggcagcaagcccagacuggccggcgagaaccugaagcugaccaccggcaagggcuggcugaaccacgacgagaccuggagaaacuacuucagcgacaucgacuucuuccccaacgccguguacacccacugcuacgacagcagcggcaccaagcuguucguggccggcggcccccugcccagcggccugcacggcaacuacgccggccuguggagcuaa

SEQ ID NO: 15952 - RNA, 1794 nt, Artificial Sequence
  DCAF13__Homo_sapiens__NP_056235
augcaguggcccccccccuggagaagaagcccccuggugagcgccacccccccccccggccccaccagaggccugcugugccccagaagagugagcgaggccggcgacagcagcaccgagggcgccagaaccggccacagacacuacgugacccccgccgagagcgccauggagggcagaagccagccccugcccagccugagacccgccagccccaccaacgcccccgcccacggcagaggcagcgacugcaccgccaaggagcccccccuggccaacgugugcagacagaacuacggcgccgcccaggaccccguggagcccgccggcagaagaagcgccagccacgugaccggcagcagccugggcaaggccgagguggccugcggcagaagauggagaugggccgagcugcuggccgacaccagcuggagccccgccggcagagccaccgagaugaaggugaagaugcugagcagaaaccccgacaacuacgugagagagaccaagcuggaccugcagagagugcccagaaacuacgaccccgcccugcaccccuucgaggugcccagagaguacaucagagcccugaacgccaccaagcuggagagaguguucgccaagcccuuccuggccagccuggacggccacagagacggcgugaacugccuggccaagcaccccgagaagcuggccaccgugcugagcggcgccugcgacggcgaggugagaaucuggaaccugacccagagaaacugcaucagaaccauccaggcccacgagggcuucgugagaggcaucugcaccagauucugcggcaccagcuucuucaccgugggcgacgacaagaccgugaagcaguggaagauggacggccccggcuacggcgacgaggaggagccccugcacaccauccugggcaagaccguguacaccggcaucgaccaccacuggaaggaggccguguucgccaccugcggccagcagguggacaucugggacgagcagagaaccaaccccaucugcagcaugaccuggggcuucgacagcaucagcagcgugaaguucaaccccaucgagaccuuccugcugggcagcugcgccagcgacagaaacaucgugcuguacgacaugagacaggccaccccccugaagaaggugauccuggacaugagaaccaacaccaucugcuggaaccccauggaggccuucaucuucaccgccgccaacgaggacuacaaccuguacaccuucgacaugagagcccuggacacccccgugauggugcacauggaccacgugagcgccgugcuggacguggacuacagccccaccggcaaggaguucgugagcgccagcuucgacaagagcaucagaaucuuccccguggacaagagcagaagcagagagguguaccacaccaagagaaugcagcacgugaucugcgugaaguggaccagcgacagcaaguacaucaugugcggcagcgacgagaugaacaucagacuguggaaggccaacgccagcgagaagcugggcgugcugaccagcagagagaaggccgccaaggacuacaaccagaagcugaaggagaaguuccagcacuacccccacaucaagagaaucgccagacacagacaccugcccaagagcaucuacagccagauccaggagcagagaaucaugaaggaggccagaagaagaaaggaggugaacagaaucaagcacagcaagcccggcagcgugccccuggugagcgagaagaagaagcacgugguggccguggugaaguaa

SEQ ID NO: 15953 - RNA, 1362 nt, Artificial Sequence
  DCAF17__Homo_sapiens__NP_001158293
augggccccaccagaaagcccaacgugugcagcagacugagcagaagagcccugggcugcuucagcagagacgccggcguggugcagagaaccaaccugggcauccugagagcccuggugugccaggagagcaccaaguucaagaacguguggaccacccacagcagaagccccaucgccuacgagagaggcagaaucuacuucgacaacuacagaagaugcgugagcagcguggccagcgagcccagaaagcuguacgagaugcccaagugcagcaagagcgagaagaucgaggacgcccugcugugggagugccccgugggcgacauccugcccaacagcagcgacuacaagagcagccugaucgcccugaccgcccacaacuggcugcugagaaucagcgccaccaccggcaagauccuggagaagaucuaccuggcccccuacugcaaguucagauaccugagcugggacaccccccaggaggugaucgccgugaagagcgcccagaacagaggcagcgccguggccagacaggccggcauccagcagcacgugcugcuguaccuggccguguucagagugcugcccuucagccuggugggcauccuggagaucaacaagaagaucuucggcaacgugaccgacgccacccugagccacggcauccugaucgugauguacagcagcggccuggugagacuguacagcuuccagaccaucgccgagcaguucaugcagcagaagcuggaccugggcugcgccugcagauggggcggcaccaccggcaccgugggcgaggcccccuucggcauccccugcaacaucaagaucaccgacaugcccccccugcuguucgaggugagcagccuggagaacgccuuccagaucggcggccaccccuggcacuacaucgugacccccaacaagaagaagcagaagggcguguuccacaucugcgcccugaaggacaacagccugaacgagaacgugcugaccgugaccgccagcggcagaguggugaagaagagcuucaaccugcuggacgacgaccccgagcaggagaccuucaagaucguggacuacgaggacgagcuggaccugcugagcgugguggccgugacccagaucgacgccgagggcaaggcccaccuggacuuccacugcaacgaguacggcacccugcugaagagcaucccccugguggagagcugggacgugaccuacagccacgagguguacuucgacagagaccuggugcugcacaucgagcagaagcccaacagaguguucagcugcuacguguaccagaugaucugcgacaccggcgaggaggaggagaccaucaacagaagcugcuaa

SEQ ID NO: 15954 - RNA, 1470 nt, Artificial Sequence
  DCAF4__Homo_sapiens__NP_001156980
augaacaagagcagauggcagagcagaagaagacacggcagaagaagccaccagcagaaccccugguucagacugagagacagcgaggacagaagcgacagcagagccgcccagcccgcccacgacagcggccacggcgacgacgagagccccagcaccagcagcggcaccgccggcaccagcagcgugcccgagcugcccggcuucuacuucgaccccgagaagaagagauacuucagacugcugcccggccacaacaacugcaacccccugaccaaggagagcaucagacagaaggagauggagagcaagagacugagacugcugcaggaggaggacagaagaaagaagaucgccagaaugggcuucaacgccagcagcaugcugagaaagagccagcugggcuuccugaacgugaccaacuacugccaccuggcccacgagcugagacugagcugcauggagagaaagaaggugcagaucagaagcauggaccccagcgcccuggccagcgacagauucaaccugauccuggccgacaccaacagcgacagacuguucaccgugaacgacgugaaggugggcggcagcaaguacggcaucaucaaccugcagagccugaagacccccacccugaagguguucaugcacgagaaccuguacuucaccaacagaaaggugaacagcgugugcugggccagccugaaccaccuggacagccacauccugcugugccugaugggccuggccgagacccccggcugcgccacccugcugcccgccagccuguucgugaacagccaccccgccggcaucgacagacccggcaugcugugcagcuucagaauccccggcgccuggagcugcgccuggagccugaacauccaggccaacaacugcuucagcaccggccugagcagaagagugcugcugaccaacguggugaccggccacagacagagcuucggcaccaacagcgacgugcuggccccccugcuguucaacggcugcagaagcggcgagaucuucgccaucgaccugagaugcggcaaccagggcaagggcuggaaggccaccagacuguuccacgacagcgccgugaccagcgugagaauccugcaggacgagcaguaccugauggccagcgacauggccggcaagaucaagcugugggaccugagaaccaccaagugcgugagacaguacgagggccacgugaacgaguacgccuaccugccccugcacgugcacgaggaggagggcauccugguggccgugggccaggacugcuacaccagaaucuggagccugcacgacgccagacugcugagaaccauccccagccccuaccccgccagcaaggccgacauccccagcguggccuucagcagcagacugggcggcagcagaggcgcccccggccugcugauggccgugggccaggaccuguacugcuacagcuacagcuaa

SEQ ID NO: 15955 - RNA, 2583 nt, Artificial Sequence
  DCAF5__Homo_sapiens__NP_001271136
auggagcaggccauccacagcagagugaagcccauccagcugaagggcgagcaccacagcaacaucuucugccuggccuucaacagcggcaacaccaagguguucagcggcggcaacgacgagcaggugauccugcacgacguggagagcagcgagacccuggacguguucgcccacgaggacgccguguacggccugagcgugagccccgugaacgacaacaucuucgccagcagcagcgacgacggcagagugcugaucugggacaucagagagagcccccacggcgagcccuucugccuggccaacuaccccagcgccuuccacagcgugauguucaaccccguggagcccagacugcuggccaccgccaacagcaaggagggcgugggccugugggacaucagaaagccccagagcagccugcugagauacggcggcaaccugagccugcagagcgccaugagcgugagauucaacagcaacggcacccagcugcuggcccugagaagaagacugccccccgugcuguacgacauccacagcagacugcccguguuccaguucgacaaccagggcuacuucaacagcugcaccaugaagagcugcugcuucgccggcgacagagaccaguacauccugagcggcagcgacgacuucaaccuguacauguggagaauccccgccgaccccgaggccggcggcaucggcagaguggugaacggcgccuucauggugcugaagggccacagaagcaucgugaaccaggugagauucaacccccacaccuacaugaucugcagcagcggcguggagaagaucaucaagaucuggagccccuacaagcagcccggcugcaccggcgaccuggacggcagaaucgaggacgacagcagaugccuguacacccacgaggaguacaucagccuggugcugaacagcggcagcggccugagccacgacuacgccaaccagagcgugcaggaggaccccagaaugauggccuucuucgacagccuggugagaagagagaucgagggcuggagcagcgacagcgacagcgaccugagcgagagcaccauccugcagcugcacgccggcgugagcgagagaagcggcuacaccgacagcgagagcagcgccagccugcccagaagccccccccccaccguggacgagagcgccgacaacgccuuccaccugggcccccugagagugaccaccaccaacaccguggccagcaccccccccacccccaccugcgaggacgccgccagcagacagcagagacugagcgcccugagaagauaccaggacaagagacugcuggcccugagcaacgagagcgacagcgaggagaacgugugcgagguggagcuggacaccgaccuguuccccagacccagaagccccagccccgaggacgagagcagcagcagcagcagcagcagcagcagcgaggacgaggaggagcugaacgagagaagagccagcaccuggcagagaaacgccaugagaagaagacagaagaccaccagagaggacaagcccagcgcccccaucaagcccaccaacaccuacaucggcgaggacaacuacgacuacccccagaucaagguggacgaccugagcagcagccccaccagcagccccgagagaagcaccagcacccuggagauccagcccagcagagccagccccaccagcgacaucgagagcguggagagaaagaucuacaaggccuacaaguggcugagauacagcuacaucagcuacagcaacaacaaggacggcgagaccagccuggugaccggcgaggccgacgagggcagagccggcaccagccacaaggacaaccccgcccccagcagcagcaaggaggccugccugaacaucgccauggcccagagaaaccaggaccugccccccgagggcugcagcaaggacaccuucaaggaggagacccccagaacccccagcaacggccccggccacgagcacagcagccacgccugggccgaggugcccgagggcaccagccaggacaccggcaacagcggcagcguggagcaccccuucgagaccaagaagcugaacggcaaggcccugagcagcagagccgaggagccccccagcccccccgugcccaaggccagcggcagcacccugaacagcggcagcggcaacugccccagaacccagagcgacgacagcgaggagagaagccuggagaccaucugcgccaaccacaacaacggcagacugcaccccagacccccccacccccacaacaacggccagaaccugggcgagcuggaggugguggccuacagcagccccggccacagcgacaccgacagagacaacagcagccugaccggcacccugcugcacaaggacugcugcggcagcgagauggccugcgagacccccaacgccggcaccagagaggaccccaccgacacccccgccaccgacagcagcagagccgugcacggccacagcggccugaagagacagagaaucgagcuggaggacaccgacagcgagaacagcagcagcgagaagaagcugaagaccuaa

SEQ ID NO: 15956 - RNA, 2583 nt, Artificial Sequence
  DCAF6__Homo_sapiens__NP_001017977
augagcagaggcggcagcuacccccaccugcugugggacgugagaaagagaagccugggccuggaggaccccagcagacugagaagcagauaccugggcagaagagaguucauccagagacugaagcuggaggccacccugaacgugcacgacggcugcgugaacaccaucugcuggaacgacaccggcgaguacauccugagcggcagcgacgacaccaagcuggugaucagcaaccccuacagcagaaaggugcugaccaccaucagaagcggccacagagccaacaucuucagcgccaaguuccugcccugcaccaacgacaagcagaucgugagcugcagcggcgacggcgugaucuucuacaccaacguggagcaggacgccgagaccaacagacagugccaguucaccugccacuacggcaccaccuacgagaucaugaccgugcccaacgaccccuacaccuuccugagcugcggcgaggacggcaccgugagaugguucgacaccagaaucaagaccagcugcaccaaggaggacugcaaggacgacauccugaucaacugcagaagagccgccaccagcguggccaucugcccccccauccccuacuaccuggccgugggcugcagcgacagcagcgugagaaucuacgacagaagaaugcugggcaccagagccaccggcaacuacgccggcagaggcaccaccggcaugguggccagauucauccccagccaccugaacaacaagagcugcagagugaccagccugugcuacagcgaggacggccaggagauccuggugagcuacagcagcgacuacaucuaccuguucgaccccaaggacgacaccgccagagagcugaagacccccagcgccgaggagagaagagaggagcugagacagccccccgugaagagacugagacugagaggcgacuggagcgacaccggccccagagccagacccgagagcgagagagagagagacggcgagcagagccccaacgugagccugaugcagagaaugagcgacaugcugagcagaugguucgaggaggccagcgagguggcccagagcaacagaggcagaggcagaagcagacccagaggcggcaccagccagagcgacaucagcacccugcccaccgugcccagcagccccgaccuggaggugagcgagaccgccauggagguggacacccccgccgagcaguuccugcagcccagcaccagcagcaccaugagcgcccaggcccacagcaccagcagccccaccgagagcccccacagcaccccccugcugagcagccccgacagcgagcagagacagagcguggaggccagcggccaccacacccaccaccagagcgacaacaacaacgagaagcugagccccaagcccggcaccggcgagcccgugcugagccugcacuacagcaccgagggcaccaccaccagcaccaucaagcugaacuucaccgacgaguggagcagcaucgccagcagcagcagaggcaucggcagccacugcaagagcgagggccaggaggagagcuucgugccccagagcagcgugcagccccccgagggcgacagcgagaccaaggcccccgaggagagcagcgaggacgugaccaaguaccaggagggcgugagcgccgagaaccccguggagaaccacaucaacaucacccagagcgacaaguucaccgccaagccccuggacagcaacagcggcgagagaaacgaccugaaccuggacagaagcugcggcgugcccgaggagagcgccagcagcgagaaggccaaggagcccgagaccagcgaccagaccagcaccgagagcgccaccaacgagaacaacaccaaccccgagccccaguuccagaccgaggccaccggccccagcgcccacgaggagaccagcaccagagacagcgcccugcaggacaccgacgacagcgacgacgaccccgugcugauccccggcgccagauacagagccggccccggcgacagaagaagcgccguggccagaauccaggaguucuucagaagaagaaaggagagaaaggagauggaggagcuggacacccugaacaucagaagaccccuggugaagaugguguacaagggccacagaaacagcagaaccaugaucaaggaggccaacuucuggggcgccaacuucgugaugagcggcagcgacugcggccacaucuucaucugggacagacacaccgccgagcaccugaugcugcuggaggccgacaaccacguggugaacugccugcagccccaccccuucgaccccauccuggccagcagcggcaucgacuacgacaucaagaucuggagcccccuggaggagagcagaaucuucaacagaaagcuggccgacgaggugaucaccagaaacgagcugaugcuggaggagaccagaaacaccaucaccgugcccgccagcuucaugcugagaaugcuggccagccugaaccacaucagagccgacagacuggagggcgacagaagcgagggcagcggccaggagaacgagaacgaggacgaggaguaa

SEQ ID NO: 15957 - RNA, 1029 nt, Artificial Sequence
  DCAF7__Homo_sapiens__NP_005819
augagccugcacggcaagagaaaggagaucuacaaguacgaggcccccuggaccguguacgccaugaacuggagcgugagacccgacaagagauucagacuggcccugggcagcuucguggaggaguacaacaacaaggugcagcuggugggccuggacgaggagagcagcgaguucaucugcagaaacaccuucgaccaccccuaccccaccaccaagcugauguggauccccgacaccaagggcguguaccccgaccugcuggccaccagcggcgacuaccugagaguguggagagugggcgagaccgagaccagacuggagugccugcugaacaacaacaagaacagcgacuucugcgccccccugaccagcuucgacuggaacgagguggaccccuaccugcugggcaccagcagcaucgacaccaccugcaccaucuggggccuggagaccggccaggugcugggcagagugaaccuggugagcggccacgugaagacccagcugaucgcccacgacaaggagguguacgacaucgccuucagcagagccggcggcggcagagacauguucgccagcgugggcgccgacggcagcgugagaauguucgaccugagacaccuggagcacagcaccaucaucuacgaggacccccagcaccacccccugcugagacugugcuggaacaagcaggaccccaacuaccuggccaccauggccauggacggcauggagguggugauccuggacgugagagugcccugcacccccguggccagacugaacaaccacagagccugcgugaacggcaucgccugggccccccacagcagcugccacaucugcaccgccgccgacgaccaccaggcccugaucugggacauccagcagaugcccagagccaucgaggaccccauccuggccuacaccgccgagggcgagaucaacaacgugcagugggccagcacccagcccgacuggaucgccaucugcuacaacaacugccuggagauccugagaguguaa

SEQ ID NO: 15958 - RNA, 1794 nt, Artificial Sequence
  DCAF8__Homo_sapiens__NP_056541
augagcagcaagggcagcagcaccgacggcagaaccgaccuggccaacggcagccugagcagcagccccgaggagaugagcggcgccgaggagggcagagagaccagcagcggcaucgagguggaggccagcgaccugagccugagccugaccggcgacgacggcggccccaacagaaccagcaccgagagcagaggcaccgacaccgagagcagcggcgaggacaaggacagcgacagcauggaggacaccggccacuacagcaucaacgacgagaacagagugcacgacagaagcgaggaggaggaggaggaggaggaggaggaggaggaggagcagcccagaagaagagugcagagaaagagagccaacagagaccaggacagcagcgacgacgagagagcccuggaggacugggugagcagcgagaccagcgcccugcccagacccagauggcaggcccugcccgcccugagagagagagagcugggcagcagcgccagauucguguacgaggccugcggcgccagaguguucgugcagagauucagacugcagcacggccuggagggccacaccggcugcgugaacacccugcacuucaaccagagaggcaccuggcuggccagcggcagcgacgaccugaaggugguggugugggacugggugagaagacagcccgugcuggacuucgagagcggccacaagagcaacguguuccaggccaaguuccugcccaacagcggcgacagcacccuggccaugugcgccagagacggccaggugagaguggccgagcugagcgccacccagugcugcaagaacaccaagagaguggcccagcacaagggcgccagccacaagcuggcccuggagcccgacagccccugcaccuuccugagcgccggcgaggacgccgugguguucaccaucgaccugagacaggacagacccgccagcaagcugguggugaccaaggagaaggagaagaaggugggccuguacaccaucuacgugaaccccgccaacacccaccaguucgccgugggcggcagagaccaguucgugagaaucuacgaccagagaaagaucgacgagaacgagaacaacggcgugcugaagaaguucugcccccaccaccuggugaacagcgagagcaaggccaacaucaccugccugguguacagccacgacggcaccgagcugcuggccagcuacaacgacgaggacaucuaccuguucaacagcagccacagcgacggcgcccaguacgugaagagauacaagggccacagaaacaacgccaccgugaagggcgugaacuucuacggccccaagagcgaguucguggugagcggcagcgacugcggccacaucuuccugugggagaagagcagcugccagaucauccaguucauggagggcgacaagggcggcguggugaacugccuggagccccacccccaccugcccgugcuggccaccagcggccuggaccacgacgugaagaucugggcccccaccgccgaggccagcaccgagcugaccggccugaaggacgugaucaagaagaacaagagagagagagacgaggacagccugcaccagaccgaccuguucgacagccacaugcugugguuccugaugcaccaccugagacagagaagacaccacagaagauggagagagcccggcgugggcgccaccgacgccgacagcgacgagagccccagcagcagcgacaccagcgacgaggaggagggccccgacagagugcagugcaugcccagcuaa

SEQ ID NO: 15959 - RNA, 735 nt, Artificial Sequence
  DCANP1__Homo_sapiens__NP_570900
augcacuacggcgccgccacccacauccagaacagcagaagccacggccuggagaccgugcccggccaccagagacuggagagaggcgccggcggcgagacccccgaguuccccggcugccacagccccgccccccccgagaacuucggcaacgagcugcugccccugagcgccccccugcagggccugagcgagggccuguacccccccggcagaaacaagacccugcccgccggcgugcugagagagggcgccgugcaguuccugcacagaggccugugcaacagcaaccugagcagcgaggccagcgccagacccagcggcacccaggacgagcugcacagcagcagaagaaagaccggccagaccagaagagagggcgccagaaagcaccuggugugcagcuucagacuguaccccuucaccgugcacaccgugagccccggcaacagccaccuggcccuguaccagguguucaaggccgugaagcugugccccagcgagaccagcuucuuccugagcagaaagagccugaagagcagcgaccccuggcacccccccagccugagccccaacagcuggaacagacaggccggcuucagagccuggagcagccaccugaucagccugagccugaccugcagcgacagccagagcagaagagugagcagcagccagcagcccccccugcacagccugagcagccacagaagagccgcccacgugcccgaguaa

SEQ ID NO: 15960 - RNA, 1620 nt, Artificial Sequence
  DCBLD1__Homo_sapiens__NP_775945
auggugcccggcgccagaggcggcggcgcccuggccagagccgccggcagaggccugcuggcccugcugcuggccgugagcgccccccugagacugcaggccgaggagcugggcgacggcugcggccaccuggugaccuaccaggacagcggcaccaugaccagcaagaacuaccccggcaccuaccccaaccacaccgugugcgagaagaccaucaccgugcccaagggcaagagacugauccugagacugggcgaccuggacaucgagagccagaccugcgccagcgacuaccugcuguucaccagcagcagcgaccaguacggccccuacugcggcagcaugaccgugcccaaggagcugcugcugaacaccagcgaggugaccgugagauucgagagcggcagccacaucagcggcagaggcuuccugcugaccuacgccagcagcgaccaccccgaccugaucaccugccuggagagagccagccacuaccugaagaccgaguacagcaaguucugccccgccggcugcagagacguggccggcgacaucagcggcaacaugguggacggcuacagagacaccagccugcugugcaaggccgccauccacgccggcaucaucgccgacgagcugggcggccagaucagcgugcugcagagaaagggcaucagcagauacgagggcauccuggccaacggcgugcugagcagagacggcagccugagcgacaagagauuccuguucaccagcaacggcugcagcagaagccugagcuucgagcccgacggccagaucagagccagcagcagcuggcagagcgugaacgagagcggcgaccaggugcacuggagccccggccaggccagacugcaggaccagggccccagcugggccagcggcgacagcagcaacaaccacaagcccagagaguggcuggagaucgaccugggcgagaagaagaagaucaccggcaucagaaccaccggcagcacccagagcaacuucaacuucuacgugaagagcuucgugaugaacuucaagaacaacaacagcaaguggaagaccuacaagggcaucgugaacaacgaggagaagguguuccagggcaacagcaacuucagagaccccgugcagaacaacuucaucccccccaucguggccagauacgugagaguggugccccagaccuggcaccagagaaucgcccugaagguggagcugaucggcugccagaucacccagggcaacgacagccugguguggagaaagaccagccagagcaccagcgugagcaccaagaaggaggacgagaccaucaccagacccauccccagcgaggagaccagcaccggcaucaacaucaccaccguggccaucccccuggugcugcugguggugcugguguucgccggcaugggcaucuucgccgccuucagaaagaagaagaagaagggcagccccuacggcagcgccgaggcccagaagaccgacugcuggaagcagaucaaguaccccuucgccagacaccagagcgccgaguucaccaucagcuacgacaacgagaaggagaugacccagaagcuggaccugaucaccagcgacauggccggcuaa

SEQ ID NO: 15961 - RNA, 2328 nt, Artificial Sequence
  DCBLD2__Homo_sapiens__NP_563615
auggccagcagagccguggugagagccagaagaugcccccagugcccccaggugagagccgccgccgccgcccccgccugggccgcccugccccugagcagaagccugccccccugcagcaacagcagcagcuucagcaugccccuguuccugcugcugcugcuggugcugcugcugcugcuggaggacgccggcgcccagcagggcgacggcugcggccacaccgugcugggccccgagagcggcacccugaccagcaucaacuacccccagaccuaccccaacagcaccgugugcgagugggagaucagagugaagaugggcgagagagugagaaucaaguucggcgacuucgacaucgaggacagcgacagcugccacuucaacuaccugagaaucuacaacggcaucggcgugagcagaaccgagaucggcaaguacugcggccugggccugcagaugaaccacagcaucgagagcaagggcaacgagaucacccugcuguucaugagcggcauccacgugagcggcagaggcuuccuggccagcuacagcgugaucgacaagcaggaccugaucaccugccuggacaccgccagcaacuuccuggagcccgaguucagcaaguacugccccgccggcugccugcugcccuucgccgagaucagcggcaccaucccccacggcuacagagacagcagcccccugugcauggccggcgugcacgccggcguggugagcaacacccugggcggccagaucagcguggugaucagcaagggcauccccuacuacgagagcagccuggccaacaacgugaccagcguggugggccaccugagcaccagccuguucaccuucaagaccagcggcugcuacggcacccugggcauggagagcggcgugaucgccgacccccagaucaccgccagcagcgugcuggaguggaccgaccacaccggccaggagaacagcuggaagcccaagaaggccagacugaagaagcccggcccccccugggccgccuucgccaccgacgaguaccaguggcugcagaucgaccugaacaaggagaagaagaucaccggcaucaucaccaccggcagcaccaugguggagcacaacuacuacgugagcgccuacagaauccuguacagcgacgacggccagaaguggaccguguacagagagcccggcguggagcaggacaagaucuuccagggcaacaaggacuaccaccaggacgugagaaacaacuuccugccccccaucaucgccagauucaucagagugaaccccacccaguggcagcagaagaucgccaugaagauggagcugcugggcugccaguucauccccaagggcagaccccccaagcugacccagccccccccccccagaaacagcaacgaccugaagaacaccaccgccccccccaagaucgccaagggcagagcccccaaguucacccagccccugcagcccagaagcagcaacgaguuccccgcccagaccgagcagaccaccgccagccccgacaucagaaacaccaccgugacccccaacgugaccaaggacguggcccuggccgccgugcuggugcccgugcuggugauggugcugaccacccugauccugauccuggugugcgccuggcacuggagaaacagaaagaagaagaccgagggcaccuacgaccugcccuacugggacagagccggcugguggaagggcaugaagcaguuccugcccgccaaggccguggaccacgaggagacccccgugagauacagcagcagcgaggugaaccaccugagccccagagaggugaccaccgugcugcaggccgacagcgccgaguacgcccagccccuggugggcggcaucgugggcacccugcaccagagaagcaccuucaagcccgaggagggcaaggaggccggcuacgccgaccuggaccccuacaacagccccggccaggagguguaccacgccuacgccgagccccugcccaucaccggccccgaguacgccacccccaucaucauggacaugagcggccaccccaccaccagcgugggccagcccagcaccagcaccuucaaggccaccggcaaccagccccccccccuggugggcaccuacaacacccugcugagcagaaccgacagcugcagcagcgcccaggcccaguacgacacccccaaggccggcaagcccggccugcccgcccccgacgagcugguguaccaggugccccagagcacccaggaggugagcggcgccggcagagacggcgagugcgacguguucaaggagauccuguaa

SEQ ID NO: 15962 - RNA, 4344 nt, Artificial Sequence
  DCC__Homo_sapiens__NP_005206
auggagaacagccugagaugcgugugggugcccaagcuggccuucgugcuguucggcgccagccuguucagcgcccaccugcaggugaccggcuuccagaucaaggccuucaccgcccugagauuccugagcgagcccagcgacgccgugaccaugagaggcggcaacgugcugcuggacugcagcgccgagagcgacagaggcgugcccgugaucaaguggaagaaggacggcauccaccuggcccugggcauggacgagagaaagcagcagcugagcaacggcagccugcugauccagaacauccugcacagcagacaccacaagcccgacgagggccuguaccagugcgaggccagccugggcgacagcggcagcaucaucagcagaaccgccaagguggccguggccggcccccugagauuccugagccagaccgagagcgugaccgccuucaugggcgacaccgugcugcugaagugcgaggugaucggcgagcccaugcccaccauccacuggcagaagaaccagcaggaccugacccccauccccggcgacagcagagugguggugcugcccagcggcgcccugcagaucagcagacugcagcccggcgacaucggcaucuacagaugcagcgccagaaaccccgccagcagcagaaccggcaacgaggccgaggugagaauccugagcgaccccggccugcacagacagcuguacuuccugcagagacccagcaacgugguggccaucgagggcaaggacgccgugcuggagugcugcgugagcggcuaccccccccccagcuucaccuggcugagaggcgaggaggugauccagcugagaagcaagaaguacagccugcugggcggcagcaaccugcugaucagcaacgugaccgacgacgacagcggcauguacaccugcguggugaccuacaagaacgagaacaucagcgccagcgccgagcugaccgugcuggugccccccugguuccugaaccaccccagcaaccuguacgccuacgagagcauggacaucgaguucgagugcaccgugagcggcaagcccgugcccaccgugaacuggaugaagaacggcgacguggugauccccagcgacuacuuccagaucgugggcggcagcaaccugagaauccugggcguggugaagagcgacgagggcuucuaccagugcguggccgagaacgaggccggcaacgcccagaccagcgcccagcugaucgugcccaagcccgccauccccagcagcagcgugcugcccagcgcccccagagacguggugcccgugcuggugagcagcagauucgugagacugagcuggagaccccccgccgaggccaagggcaacauccagaccuucaccguguucuucagcagagagggcgacaacagagagagagcccugaacaccacccagcccggcagccugcagcugaccgugggcaaccugaagcccgaggccauguacaccuucagagugguggccuacaacgaguggggccccggcgagagcagccagcccaucaagguggccacccagcccgagcugcaggugcccggccccguggagaaccugcaggccgugagcaccagccccaccagcauccugaucaccugggagccccccgccuacgccaacggccccgugcagggcuacagacuguucugcaccgaggugagcaccggcaaggagcagaacaucgagguggacggccugagcuacaagcuggagggccugaagaaguucaccgaguacagccugagauuccuggccuacaacagauacggccccggcgugagcaccgacgacaucaccguggugacccugagcgacgugcccagcgcccccccccagaacgugagccuggagguggugaacagcagaagcaucaaggugagcuggcugcccccccccagcggcacccagaacggcuucaucaccggcuacaagaucagacacagaaagaccaccagaagaggcgagauggagacccuggagcccaacaaccugugguaccuguucaccggccuggagaagggcagccaguacagcuuccaggugagcgccaugaccgugaacggcaccggcccccccagcaacugguacaccgccgagacccccgagaacgaccuggacgagagccaggugcccgaccagcccagcagccugcacgugagaccccagaccaacugcaucaucaugagcuggacccccccccugaaccccaacaucguggugagaggcuacaucaucggcuacggcgugggcagccccuacgccgagaccgugagaguggacagcaagcagagauacuacagcaucgagagacuggagagcagcagccacuacgugaucagccugaaggccuucaacaacgccggcgagggcgugccccuguacgagagcgccaccaccagaagcaucaccgaccccaccgaccccguggacuacuacccccugcuggacgacuuccccaccagcgugcccgaccugagcacccccaugcugccccccgugggcgugcaggccguggcccugacccacgacgccgugagagugagcugggccgacaacagcgugcccaagaaccagaagaccagcgaggugagacuguacaccgugagauggagaaccagcuucagcgccagcgccaaguacaagagcgaggacaccaccagccugagcuacaccgccaccggccugaagcccaacaccauguacgaguucagcgugauggugaccaagaacagaagaagcagcaccuggagcaugaccgcccacgccaccaccuacgaggccgcccccaccagcgcccccaaggaccugaccgugaucaccagagagggcaagcccagagccgugaucgugagcuggcagcccccccuggaggccaacggcaagaucaccgccuacauccuguucuacacccuggacaagaacauccccaucgacgacuggaucauggagaccaucagcggcgacagacugacccaccagaucauggaccugaaccuggacaccauguacuacuucagaauccaggccagaaacagcaagggcgugggcccccugagcgaccccauccuguucagaacccugaagguggagcaccccgacaagauggccaacgaccagggcagacacggcgacggcggcuacuggcccguggacaccaaccugaucgacagaagcacccugaacgagccccccaucggccagaugcaccccccccacggcagcgugaccccccagaagaacagcaaccugcuggugaucaucguggugaccgugggcgugaucaccgugcuggugguggugaucguggccgugaucugcaccagaagaagcagcgcccagcagagaaagaagagagccacccacagcgccggcaagagaaagggcagccagaaggaccugagaccccccgaccuguggauccaccacgaggagauggagaugaagaacaucgagaagcccagcggcaccgaccccgccggcagagacagccccauccagagcugccaggaccugacccccgugagccacagccagagcgagacccagcugggcagcaagagcaccagccacagcggccaggacaccgaggaggccggcagcagcaugagcacccuggagagaagccuggccgccagaagagcccccagagccaagcugaugauccccauggacgcccagagcaacaaccccgccguggugagcgccauccccgugcccacccuggagagcgcccaguaccccggcauccugcccagccccaccugcggcuacccccacccccaguucacccugagacccgugcccuuccccacccugagcguggacagaggcuucggcgccggcagaagccagagcgugagcgagggccccaccacccagcagccccccaugcugccccccagccagcccgagcacagcagcagcgaggaggcccccagcagaaccauccccaccgccugcgugagacccacccacccccugagaagcuucgccaacccccugcugcccccccccaugagcgccaucgagcccaaggugcccuacaccccccugcugagccagcccggccccacccugcccaagacccacgugaagaccgccagccugggccuggccggcaaggccagaagcccccugcugcccgugagcgugcccaccgcccccgaggugagcgaggagagccacaagcccaccgaggacagcgccaacguguacgagcaggacgaccugagcgagcagauggccagccuggagggccugaugaagcagcugaacgccaucaccggcagcgccuucuaa

SEQ ID NO: 15963 - RNA, 1095 nt, Artificial Sequence
  DCDC2C__Homo_sapiens__NP_001274373
augggcaccagaggccccagcgcccccguggacaccacccccgccaagaccaucgugguguacagaaacggcgaccccuucuacgugggcaagaaguucgugcugagcagaagaagagccgccaccuucgaggcccugcuggagcagcugaccgagcagguggacgugcccuucggcgugagaagacuguucacccccaccagaggccacagagugcugggccuggacgcccugcaggccggcggcaaguacguggccgccggcagagagagauucaaggagcuggacuacauccacaucgugcccagaaagcccgccaagaucagaaagcugaaggagaucaagcccguggugcacugcgacaucaacgugcccagcaaguggcagaccuaccacagaaucagcagacacaucaacguguucaccaacggcagacuguucaucccccccgccaagaucaucauccccaaguucagccugagcgacugggacaucgugcuggccaccaucggcgagaagguguucccccugggcggcgugagaaagcuguucaccaugaacggccaccugcugggcgacagcaaggaccugcaggacaaccacuucuacguggccgugggccuggagaccuucaaguacuuccccuacuggaagagccccagagugcccagcgaggugcagcagagauacgccaacguggagaagaacagccagagaaagaagaagguggacagcaagggcaaggagcccugcaaguacgacggcaucccccccaagacccaggacagcguguacuacgccaaggaggagaagaagaagacccuggccgagccccuggugcagagaggcgccgagggcgacguguacaaggcccccacccccagcaaggagacccagggcgcccuggacgugaaggaggagcacaacgugcagcuggaggugcccguggaccagagacaggccgagaucgugaaggaggacgaggagauccacgagaacacccccgacuucgagggcaacaaggacaaggaggacgccagacugugcgaggacguggagagaaagauggccagagaguggaagcccguggacuaa

SEQ ID NO: 15964 - RNA, 1431 nt, Artificial Sequence
  DCDC2__Homo_sapiens__NP_057440
augagcggcagcagcgccagaagcagccaccugagccagcccguggugaagagcgugcugguguacagaaacggcgaccccuucuacgccggcagaagaguggugauccacgagaagaaggugagcagcuucgagguguuccugaaggaggugaccggcggcgugcaggcccccuucggcgccgugagaaacaucuacacccccagaaccggccacagaaucagaaagcuggaccagauccagagcggcggcaacuacguggccggcggccaggaggccuucaagaagcugaacuaccuggacaucggcgagaucaagaagagacccauggagguggugaacaccgaggugaagcccgugauccacagcagaaucaacgugagcgccagauucagaaagccccugcaggagcccugcaccaucuuccugaucgccaacggcgaccugaucaaccccgccagcagacugcugauccccagaaagacccugaaccagugggaccacgugcugcagauggugaccgagaagaucacccugagaagcggcgccgugcacagacuguacacccuggagggcaagcugguggagagcggcgccgagcuggagaacggccaguucuacguggccgugggcagagacaaguucaagaagcugcccuacagcgagcugcuguucgacaagagcaccaugagaagacccuucggccagaaggccagcagccugccccccaucgugggcagcagaaagagcaagggcagcggcaacgacagacacagcaagagcaccgugggcagcagcgacaacagcagcccccagccccugaagagaaagggcaagaaggaggacgugaacagcgagaagcugaccaagcugaagcagaacgugaagcugaagaacagccaggagaccauccccaacagcgacgagggcaucuucaaggccggcgccgagagaagcgagaccagaggcgccgccgaggugcaggaggacgaggacacccagguggaggugcccguggaccagagacccgccgagaucguggacgaggaggaggacggcgagaaggccaacaaggacgccgagcagaaggaggacuucagcggcaugaacggcgaccuggaggaggagggcggcagagaggccaccgacgcccccgagcagguggaggagauccuggaccacagcgagcagcaggccagacccgccagagugaacggcggcaccgacgaggagaacggcgaggagcugcagcaggugaacaacgagcugcagcuggugcuggacaaggagagaaagagccagggcgccggcagcggccaggacgaggccgacguggacccccagagaccccccagacccgaggugaagaucaccagccccgaggagaacgagaacaaccagcagaacaaggacuacgccgccguggccuaa

SEQ ID NO: 15965 - RNA, 333 nt, Artificial Sequence
  DCD__Homo_sapiens__NP_444513
augagauucaugacccugcuguuccugaccgcccuggccggcgcccuggugugcgccuacgaccccgaggccgccagcgcccccggcagcggcaaccccugccacgaggccagcgccgcccagaaggagaacgccggcgaggaccccggccuggccagacaggcccccaagcccagaaagcagagaagcagccugcuggagaagggccuggacggcgccaagaaggccgugggcggccugggcaagcugggcaaggacgccguggaggaccuggagagcgugggcaagggcgccgugcacgacgugaaggacgugcuggacagcgugcuguaa

SEQ ID NO: 15966 - RNA, 9897 nt, Artificial Sequence
  DCHS1__Homo_sapiens__NP_003728
augcagaaggagcugggcaucgugcccagcugccccggcaugaagagccccagaccccaccugcugcugccccugcugcugcugcugcugcugcugcugggcgccggcgugcccggcgccuggggccaggccggcagccuggaccugcagaucgacgaggagcagcccgccggcacccugaucggcgacaucagcgccggccugcccgccggcaccgccgccccccugauguacuucaucagcgcccaggagggcagcggcgugggcaccgaccuggccaucgacgagcacagcggcguggugagaaccgccagagugcuggacagagagcagagagacagauacagauucaccgccgugacccccgacggcgccaccguggaggugaccgugagaguggccgacaucaacgaccacgcccccgccuucccccaggccagagccgcccugcaggugcccgagcacaccgccuucggcaccagauacccccuggagcccgccagagacgccgacgccggcagacugggcacccagggcuacgcccugagcggcgacggcgccggcgagaccuucagacuggagaccagacccggccccgacggcacccccgugcccgagcugguggugaccggcgagcuggacagagagaacagaagccacuacaugcugcagcuggaggccuacgacggcggcagcccccccagaagagcccaggcccugcuggacgugacccugcuggacaucaacgaccacgcccccgccuucaaccagagcagauaccacgccguggugagcgagagccuggcccccggcagccccgugcugcagguguucgccagcgacgccgacgccggcgugaacggcgccgugaccuacgagaucaacagaagacagagcgagggcgacggccccuucagcaucgacgcccacaccggccugcugcagcuggagagaccccuggacuucgagcagagaagagugcacgagcugguggugcaggccagagacggcggcgcccaccccgagcugggcagcgccuucgugaccgugcacgugagagacgccaacgacaaccagcccagcaugaccgugaucuuccugagcgccgacggcagcccccaggugagcgaggccgccccccccggccagcugguggccagaaucagcgugagcgaccccgacgacggcgacuucgcccacgugaacgugagccuggagggcggcgagggccacuucgcccugagcacccaggacagcgugaucuaccuggugugcguggccagaagacuggacagagaggagagagacgccuacaaccugagagugaccgccaccgacagcggcagccccccccugagagccgaggccgccuucgugcugcacgugaccgacgugaacgacaacgcccccgccuucgacagacagcuguacagacccgagccccugcccgagguggcccugcccggcagcuucguggugagagugaccgccagagaccccgaccagggcaccaacggccaggugaccuacagccuggcccccggcgcccacacccacugguucagcaucgaccccaccagcggcaucaucaccaccgccgccagccuggacuacgagcuggagccccagccccagcugaucgugguggccaccgacggcggccugcccccccuggccagcagcgccaccgugagcguggcccugcaggacgugaacgacaacgagccccaguuccagagaaccuucuacaacgccagccugcccgagggcacccagcccggcaccugcuuccugcaggugaccgccaccgacgccgacagcggccccuucggccugcugagcuacagccugggcgccggccugggcagcagcggcagcccccccuucagaaucgacgcccacagcggcgacgugugcaccaccagaacccuggacagagaccagggccccagcagcuucgacuucaccgugaccgccguggacggcggcggccugaagagcaugguguacgugaagguguuccugagcgacgagaacgacaaccccccccaguucuaccccagagaguacgccgccagcaucagcgcccagagcccccccggcaccgccgugcugagacugagagcccacgaccccgaccagggcagccacggcagacugagcuaccacauccuggccggcaacagccccccccuguucacccuggacgagcagagcggccugcugaccguggccuggccccuggccagaagagccaacagcguggugcagcuggagaucggcgccgaggacggcggcggccugcaggccgagcccagcgccagaguggacaucagcaucgugcccggcacccccaccccccccaucuucgagcagcugcaguacguguucagcgugcccgaggacguggcccccggcaccagcgugggcaucgugcaggcccacaacccccccggcagacuggcccccgugacccugagccugagcggcggcgaccccagaggccuguucagccuggacgccgugagcggccugcugcagacccugagaccccuggacagagagcugcugggccccgugcuggagcuggaggugagagccggcagcggcgugccccccgccuucgccguggccagagugagagugcugcuggacgacgugaacgacaacagccccgccuuccccgcccccgaggacaccgugcugcugccccccaacaccgcccccggcacccccaucuacacccugagagcccuggaccccgacagcggcgugaacagcagagugaccuucacccugcuggccggcggcggcggcgccuucaccguggaccccaccaccggccacgugagacugaugagaccccugggccccagcggcggccccgcccacgagcuggagcuggaggccagagacggcggcagcccccccagaaccagccacuucagacugagagugguggugcaggacgugggcaccagaggccuggcccccagauucaacagccccaccuacagaguggaccugcccagcggcaccaccgccggcacccaggugcugcaggugcaggcccaggcccccgacggcggccccaucaccuaccaccuggccgccgagggcgccagcagccccuucggccuggagccccagagcggcuggcugugggugagagccgcccuggacagagaggcccaggagcuguacauccugaaggugauggccgugagcggcagcaaggccgagcugggccagcagaccggcaccgccaccgugagagugagcauccugaaccagaacgagcacagccccagacugagcgaggaccccaccuuccuggccguggccgagaaccagccccccggcaccagcgugggcagaguguucgccaccgacagagacagcggccccaacggcagacugaccuacagccugcagcagcugagcgaggacagcaaggccuucagaauccacccccagaccggcgaggugaccacccugcagacccuggacagagagcagcagagcagcuaccagcugcuggugcaggugcaggacggcggcagcccccccagaagcaccaccggcaccgugcacguggccgugcuggaccugaacgacaacagccccaccuuccugcaggccagcggcgccgccggcggcggccugcccauccaggugcccgacagagugccccccggcacccuggugaccacccugcaggccaaggaccccgacgagggcgagaacggcaccauccuguacacccugaccggccccggcagcgagcuguucagccugcacccccacagcggcgagcugcugaccgccgccccccugaucagagccgagagaccccacuacgugcugacccugagcgcccacgaccagggcagcccccccagaagcgccagccugcagcugcuggugcaggugcugcccagcgccagacuggccgagcccccccccgaccuggccgagagagaccccgccgcccccgugcccguggugcugaccgugaccgccgccgagggccugagacccggcagccugcugggcagcguggccgcccccgagcccgccggcgugggcgcccugaccuacacccuggugggcggcgccgaccccgagggcaccuucgcccuggacgccgccagcggcagacuguaccuggccagaccccuggacuucgaggccggcccccccuggagagcccugaccgugagagccgagggccccggcggcgccggcgccagacugcugagagugcaggugcaggugcaggacgagaacgagcacgcccccgccuucgccagagacccccuggcccuggcccugcccgagaaccccgagcccggcgccgcccuguacaccuucagagccagcgacgccgacggccccggccccaacagcgacgugagauacagacugcugagacaggagccccccgugcccgcccugagacuggacgccagaaccggcgcccugagcgcccccagaggccuggacagagagaccacccccgcccugcugcugcugguggaggccaccgacagacccgccaacgccagcagaagaagagccgccagagugagcgccagaguguucgugaccgacgagaacgacaacgcccccguguucgccagccccagcagagugagacugcccgaggaccagccccccggccccgccgcccugcacgugguggccagagaccccgaccugggcgaggccgccagagugagcuacagacuggccagcggcggcgacggccacuucagacugcacagcagcaccggcgcccugagcguggugagaccccuggacagagagcagagagccgagcacgugcugaccgugguggccagcgaccacggcagcccccccagaagcgccacccaggugcugaccgugagcguggccgacgugaacgacgaggcccccaccuuccagcagcaggaguacagcgugcugcugagagagaacaacccccccggcaccagccugcugacccugagagccaccgaccccgacgugggcgccaacggccaggugaccuacggcggcgugagcagcgagagcuucagccuggaccccgacaccggcgugcugaccacccugagagcccuggacagagaggagcaggaggagaucaaccugaccguguacgcccaggacagaggcagccccccccagcugacccacgugaccgugagaguggccguggaggacgagaacgaccacgcccccaccuucggcagcgcccaccugagccuggaggugcccgagggccaggacccccagacccugaccaugcugagagccagcgaccccgacgugggcgccaacggccagcugcaguacagaauccuggacggcgaccccagcggcgccuucgugcuggaccuggccagcggcgaguucggcaccaugagaccccuggacagagagguggagcccgccuuccagcugagaaucgaggccagagacggcggccagcccgcccugagcgccacccugcugcugaccgugaccgugcuggacgccaacgaccacgcccccgccuuccccgugcccgccuacagcguggaggugcccgaggacgugcccgccggcacccugcugcugcagcugcaggcccacgaccccgacgccggcgccaacggccacgugaccuacuaccugggcgccggcaccgccggcgccuuccugcuggagcccagcagcggcgagcugagaaccgccgccgcccuggacagagagcagugccccagcuacaccuucagcgugagcgccguggacggcgccgccgccggcccccugagcaccaccgugagcgugaccaucaccgugagagacgugaacgaccacgcccccaccuuccccaccagcccccugagacugagacugcccagacccggccccagcuucagcacccccacccuggcccuggccacccugagagccgaggacagagacgccggcgccaacgccagcauccuguacagacuggccggcacccccccccccggcaccaccguggacagcuacaccggcgagaucagaguggccagaagccccguggcccugggccccagagacagagugcuguucaucguggccaccgaccugggcagacccgccagaagcgccaccggcgugaucaucgugggccugcagggcgaggccgagagaggccccagauuccccagagccagcagcgaggccaccaucagagagaacgccccccccggcacccccaucgugagccccagagccgugcacgccggcggcaccaacggccccaucaccuacagcauccugagcggcaacgagaagggcaccuucagcauccagcccagcaccggcgccaucaccgugagaagcgccgagggccuggacuucgaggugagccccagacugagacuggugcugcaggccgagagcggcggcgccuucgccuucaccgugcugacccugacccugcaggacgccaacgacaacgcccccagauuccugagaccccacuacguggccuuccugcccgagagcagaccccuggagggcccccugcugcagguggaggccgacgaccuggaccagggcagcggcggccagaucagcuacagccuggccgccagccagcccgccagaggccuguuccacguggaccccaccaccggcaccaucaccaccaccgccauccuggacagagagaucugggccgagaccagacuggugcugauggccaccgacagaggcagccccgcccuggugggcagcgccacccugaccgugauggugaucgacaccaacgacaacagacccaccaucccccagcccugggagcugagagugagcgaggacgcccugcugggcagcgagaucgcccaggugaccggcaacgacguggacagcggccccgugcugugguacgugcugagccccagcggcccccaggaccccuucagcgugggcagauacggcggcagagugagccugaccggcccccuggacuucgagcagugcgacagauaccagcugcagcugcuggcccacgacggcccccacgagggcagagccaaccugaccgugcugguggaggacgugaacgacaacgcccccgccuucagccagagccuguaccaggugaugcugcuggagcacaccccccccggcagcgccauccugagcgugagcgccaccgacagagacagcggcgccaacggccacaucagcuaccaccuggccagccccgccgacggcuucagcguggaccccaacaacggcacccuguucaccaucgugggcaccguggcccugggccacgacggcagcggcgccguggacguggugcuggaggccagagaccacggcgcccccggcagagccgccagagccaccgugcacgugcagcugcaggaccagaacgaccacgcccccagcuucacccugagccacuacagaguggccgugaccgaggaccugccccccggcagcacccugcugacccuggaggccaccgacgccgacggcagcagaagccacgccgccguggacuacagcaucaucagcggcaacuggggcagaguguuccagcuggagcccagacuggccgaggccggcgagagcgccggccccggccccagagcccugggcugccuggugcugcuggagccccuggacuucgagagccugacccaguacaaccugaccguggccgccgccgacagaggccagcccccccagagcagcguggugcccgugaccgugaccgugcuggacgugaacgacaacccccccguguucaccagagccagcuacagagugaccgugcccgaggacacccccgugggcgccgagcugcugcacguggaggccagcgacgccgaccccggcccccacggccuggugagauucaccgugagcagcggcgaccccagcggccuguucgagcuggacgagagcagcggcacccugagacuggcccacgcccuggacugcgagacccaggccagacaccagcugguggugcaggccgccgaccccgccggcgcccacuucgcccuggcccccgugaccaucgaggugcaggacgugaacgaccacggccccgccuucccccugaaccugcugagcaccagcguggccgagaaccagccccccggcacccuggugaccacccugcacgccaucgacggcgacgccggcgccuucggcagacugagauacagccugcuggaggccggccccggccccgagggcagagaggccuucgcccugaacagcagcaccggcgagcugagagccagagugcccuucgacuacgagcacaccgagagcuucagacugcuggugggcgccgccgacgccggcaaccugagcgccagcgugaccgugagcgugcuggugaccggcgaggacgaguacgaccccguguuccuggcccccgccuuccacuuccaggugcccgagggcgccagaagaggccacagccugggccacgugcaggccaccgacgaggacggcggcgccgacggccuggugcuguacagccuggccaccagcagccccuacuucggcaucaaccagaccaccggcgcccuguaccugagaguggacagcagagcccccggcagcggcaccgccaccagcggcggcggcggcagaaccagaagagaggcccccagagagcugagacuggaggugaucgccagaggcccccugcccggcagcagaagcgccaccgugcccgugaccguggacaucacccacaccgcccugggccuggcccccgaccugaaccugcugcuggugggcgccguggccgccagccugggcguggugguggugcuggcccuggccgcccuggugcugggccuggugagagccagaagcagaaaggccgaggccgcccccggccccaugagccaggccgccccccuggccagcgacagccugcagaagcugggcagagagccccccagccccccccccagcgagcaccuguaccaccagacccugcccagcuacggcggccccggcgccggcggccccuaccccagaggcggcagccuggaccccagccacagcagcggcagaggcagcgccgaggccgccgaggacgacgagaucagaaugaucaacgaguuccccagaguggccagcguggccagcagccuggccgccagaggccccgacagcggcauccagcaggacgccgacggccugagcgacaccagcugcgagccccccgcccccgacaccugguacaagggcagaaaggccggccugcugcugcccggcgccggcgccacccuguacagagaggagggcccccccgccaccgccaccgccuuccugggcggcugcggccugagccccgcccccaccggcgacuacggcuuccccgccgacggcaagcccugcguggccggcgcccugaccgccaucguggccggcgaggaggagcugagaggcagcuacaacugggacuaccugcugagcuggugcccccaguuccagccccuggccagcguguucaccgagaucgccagacugaaggacgaggccagacccugcccccccgcccccagaaucgacccccccccccugaucaccgccguggcccaccccggcgccaagagcgugccccccaagcccgccaacaccgccgccgccagagccaucuucccccccgccagccacagaagccccaucagccacgagggcagccugagcagcgccgccaugagccccagcuucagccccagccugagcccccuggccgccagaagccccguggugagccccuucggcguggcccagggccccagcgccagcgcccugagcgccgagagcggccuggagccccccgacgacaccgagcugcacaucuaa

SEQ ID NO: 15967 - RNA, 4110 nt, Artificial Sequence
  DCHS2__Homo_sapiens__NP_001136024
augagccccugcggcagaaagaugggcgagggcagacagcagagaagagcccccgugggcaagcugcugcugcugcccggcagaagagacaccccccacggcagaagcggcagcagcggcgccagaacccagagaagccugcuguggcugcuggugcacguguggcugugggccgccagcggcagcagcgcccagcuguucaaccugacccugagcguggacgagggccugccccccgacacccuggugggcgacaucagagccggccugcccgccgcccagcagcaggagggcagcggcuucuuccugagcgaggacagcgacgacagcccccugcuggacgacuuccacgugcaccccgacaccggcaucaucagaaccgccagaagacuggacagagagagaagagaccacuacagcuucguggccgccacccugcugggcgccguggugcagguggagaucagagugaacgacgugaacgaccacagccccagauucccccuggacagccugcagcuggacgugagcgagcugagcccccccggcaccgccuucagacugcccguggcccacgaccccgacgccggccuguucagcacccagggcuacacccuggugcagcccagcgaccugcccaaggaccccgccggccccuucuuccagcugagauacagaacccccggcccccugcccagcccccugcugcccggcagcagcagcccccuggagccccuggaccuggugcugcugagaagacuggacagagaggaggccgccgcccacagacugcagaucgaggccugggacggcggcagacccagaagaaccggccugcugagcguggagcugagagugcuggacgagaacgacaacccccccguguucgagcaggacgaguacagagccgccgugagagaggacgcccagcccggcgccgaggugugcagagugagagccaccgacagagaccugggccccaacggcuucgugagauacagcgugagagccagacaggugcccggcgccggcagcggcggcggcgcccugggcgacgccgccuacuucgccguggaggagcugagcggcguggugagaguguggagaccccuggacagagaggcccaggccuggcaccagcuggugguggaggccagagacggcggcgccgagcccgagguggccaccgugagagugagcaucgccgugcuggacgugaacgacaacagacccgccauccacgugcuguuccugaccgagggcggcguggccagagugagcgagggcgccagacccggcgacuacguggccagagugagcgugagcgacgccgacggcgacugggagaaggaggacgaggccaccggcgagcugggcgugggccugggcgacggcagcaucagccugagccuggagggcggcgagggcgacuucgcccugcugcccggcggcccccccggcguguucuuccugugcguggagggcccccuggacagagagagcagagaccuguacgagcugcugcugguggccaccgacgccggcagccccccccugagcaccgaggagacccugcugcugagaguggccgaccugaacgaccagcccccccuguucagccagcagcacuacaaggccagcgugagcgaggccgccgcccccggcaccguggugaugugggugagcgccagcgacgccgacgaggccggcagcgaccacgccuggcugagauacaccguggugcagcugagcgcccccugcaaccugggcagccugcagagcaagauggugcacaccgccgagugcggccccagcuucgccaucgacagcgagagcggcgccaucagcaccaucagaacccuggacagagaggugcaggaggccguggagcugaaggugguggcccaggaccugggcgagcccccccugagcgccaccugccuggugagcaucaccguggacgacgugaacgacaacgagcccaucuucuggagacagguguacaacgccaccaucgccgagcacgcccccgugggccacugcuuccugcaggugaccgccagcgacgccgacagcggccuguacggcuucaucgaguacagccuguacgacggcuuccugagcuacgaggccccccaggccuucagaaucgacccccacgacggccagaucugcgugagccaggacaucgacagagagagagaccccgccaccuacgaccugcugguggaggccaaggacggcggcggccugagcgcccaggccuucgugagaguggaccuggaggacgugaacgacaaccaccccguguucaaccccagcaccuacgugaccagcaucagcgacgagacccagcccggcaccgagaucaucaacgugcuggccaccgaccaggacagcggcaucuacggcaccguggccuacgagcugauccccggcaacgugagcagccuguucaccaucgacagcaccaccggcaucaucuaccugacccugccccugagccaccuggagagcaccacccugagccugauggugagcgcccaggacggcggcggccugaccgccgugaucaacgccgacgugaccauccacaucuuccagaccacccuggcccccgccgaguucgagagacccaaguacaccuuccugguguacgaggacgugcccgaggacagccccaucggcaccgugaaggccagagagccccugaacagcagcgagcccaucuucuacagaaucagcagcggcgaccugggcggcaaguucagcauccaccccagacugggcaccaucagaaccagaaagccccuggaccacgagacccagcccgugguggugcugaccgugcaggcccagcugggcagcgcccccgccugcagcagcaccgaggugaacaucaccgugauggacgugaacgacaaccaccccgccuuccugagaaccagcgacgagaucagaaucagccagaccaccccccccggcaccgcccuguaccuggccagagccgaggacagagacagcggcagaaacggccugaucagauacagcaucgccagcccccagcccggcguguucgccaucgacagagcccugggcgugcuguuccugaacggcagccugggcgccggcgagcagagagagcugacccugacccugagagccgaggaccagggcgugcacccccaggccgcccugcuggugcugaccguggugaucgagaagagagagcacagccccagcuggaccuucgagcaccugguguaccagguggaggugagcgagagccugagccccaugacccagaugcugcagacccaggcccacccccugggcccccagagagccgccagcccccugagauacagccuggagcccagcguggacagcgccauguucggcaucagacccuacaccggcuggaucuaccugagaagacaguucgacuacgagagcacccagaccuacaacuucagaguguucgccuggauccccgaggacggcuuccugcagaacgugagcaccaccgugaucgugagagugugggacgagaacgacaacagccccaccuuccugcacgacgugcuguuccugaagguggaggagagccccgugccccagggcgugaucggcaagaucaccgccaucgacauggacagcggcaagaacggccagcugcuguacuuccugcugagcgacggcaaguucuucaagaugaaccccaacaccggcgagcugaucaacuggguggcccuggacagagagcacagaggccaccacgagaugaccgugcuggugaccgacagaggcagcccccccagaaacgccaccauggccguguacgugagcgugaccgacaucaacgacaacagacccuucuucccccagugccugcccggcaaggagcugcacgugaaggugcuggagggccagcccgugaacaugcuggugaccaccguguucgccaaggaccccgacgagggcaacaacgccgaggugaccuacagcgugagcagcgccagacccaugccccugaagggcaagaccgccuucggcaagcagagcugcaagaagcagaccaacaagcagaccaacaagauccugaccuaa

SEQ ID NO: 15968 - RNA, 783 nt, Artificial Sequence
  DCK__Homo_sapiens__NP_000779
auggccaccccccccaagagaagcugccccagcuucagcgccagcagcgagggcaccagaaucaagaagaucagcaucgagggcaacaucgccgccggcaagagcaccuucgugaacauccugaagcagcugugcgaggacugggagguggugcccgagcccguggccagauggugcaacgugcagagcacccaggacgaguucgaggagcugaccaugagccagaagaacggcggcaacgugcugcagaugauguacgagaagcccgagagauggagcuucaccuuccagaccuacgccugccugagcagaaucagagcccagcuggccagccugaacggcaagcugaaggacgccgagaagcccgugcuguucuucgagagaagcguguacagcgacagauacaucuucgccagcaaccuguacgagagcgagugcaugaacgagaccgaguggaccaucuaccaggacuggcacgacuggaugaacaaccaguucggccagagccuggagcuggacggcaucaucuaccugcaggccacccccgagaccugccugcacagaaucuaccugagaggcagaaacgaggagcagggcaucccccuggaguaccuggagaagcugcacuacaagcacgagagcuggcugcugcacagaacccugaagaccaacuucgacuaccugcaggaggugcccauccugacccuggacgugaacgaggacuucaaggacaaguacgagagccugguggagaaggugaaggaguuccugagcacccuguaa

SEQ ID NO: 15969 - RNA, 1269 nt, Artificial Sequence
  DCLK1__Homo_sapiens__NP_001182344
augcuggagcugaucgaggugaacggcacccccggcagccagcugagcacccccagaagcggcaagagccccagccccagccccaccagccccggcagccugagaaagcagagaagcagccagcacggcggcagcagcaccagccuggccagcaccaaggugugcagcagcauggacgagaacgacggccccggcgaggaggugagcgaggagggcuuccagauccccgccaccaucaccgagagauacaaggugggcagaaccaucggcgacggcaacuucgccguggugaaggagugcguggagagaagcaccgccagagaguacgcccugaagaucaucaagaagagcaagugcagaggcaaggagcacaugauccagaacgaggugagcauccugagaagagugaagcaccccaacaucgugcugcugaucgaggagauggacgugcccaccgagcuguaccuggugauggagcuggugaagggcggcgaccuguucgacgccaucaccagcaccaacaaguacaccgagagagacgccagcggcaugcuguacaaccuggccagcgccaucaaguaccugcacagccugaacaucgugcacagagacaucaagcccgagaaccugcugguguacgagcaccaggacggcagcaagagccugaagcugggcgacuucggccuggccaccaucguggacggcccccuguacaccgugugcggcacccccaccuacguggcccccgagaucaucgccgagaccggcuacggccugaagguggacaucugggccgccggcgugaucaccuacauccugcugugcggcuucccccccuucagaggcagcggcgacgaccaggaggugcuguucgaccagauccugaugggccagguggacuuccccagccccuacugggacaacgugagcgacagcgccaaggagcugaucaccaugaugcugcugguggacguggaccagagauucagcgccgugcaggugcuggagcaccccugggugaacgacgacggccugcccgagaacgagcaccagcugagcguggccggcaagaucaagaagcacuucaacaccggccccaagcccaacagcaccgccgccggcgugagcgugaucgcccuggaccacggcuucaccaucaagagaagcggcagccuggacuacuaccagcagcccggcauguacuggaucagacccccccugcugaucagaagaggcagauucagcgacgaggacgccaccagaauguaa

SEQ ID NO: 15970 - RNA, 2301 nt, Artificial Sequence
  DCLK2__Homo_sapiens__NP_001035350
auggccagcaccagaagcaucgagcuggagcacuucgaggagagagacaagagacccagacccggcagcagaagaggcgcccccagcagcagcggcggcagcagcagcagcggccccaagggcaacggccugauccccagccccgcccacagcgcccacugcagcuucuacagaaccagaacccugcaggcccugagcagcgagaagaaggccaagaaggccagauucuacagaaacggcgacagauacuucaagggccugguguucgccaucagcagcgacagauucagaagcuucgacgcccugcugaucgagcugaccagaagccugagcgacaacgugaaccugccccagggcgugagaaccaucuacaccaucgacggcagcagaaaggugaccagccuggacgagcugcuggagggcgagagcuacgugugcgccagcaacgagcccuucagaaagguggacuacaccaagaacaucaaccccaacuggagcgugaacaucaagggcggcaccagcagagcccuggccgccgccagcagcgugaagagcgaggugaaggagagcaaggacuucaucaagcccaagcuggugaccgugaucagaagcggcgugaagcccagaaaggccgugagaauccugcugaacaagaagaccgcccacagcuucgagcaggugcugaccgacaucaccgaggccaucaagcuggacagcggcguggugaagagacugugcacccuggacggcaagcaggugaccugccugcaggacuucuucggcgacgacgacguguucaucgccugcggccccgagaaguucagauacgcccaggacgacuucgugcuggaccacagcgagugcagagugcugaagagcagcuacagcagaagcagcgccgugaaguacagcggcagcaagagccccggccccagcagaagaagcaagagccccgccagcgugaacggcacccccagcagccagcugagcacccccaagagcaccaagagcagcagcagcagccccaccagccccggcagcuucagaggccugaagcagaucagcgcccacggcagaagcagcagcaacgugaacggcggccccgagcuggacagaugcaucagccccgagggcgugaacggcaacagaugcagcgagagcagcacccugcuggagaaguacaagaucggcaaggugaucggcgacggcaacuucgccguggugaaggagugcaucgacagaagcaccggcaaggaguucgcccugaagaucaucgacaaggccaagugcugcggcaaggagcaccugaucgagaacgaggugagcauccugagaagagugaagcaccccaacaucaucaugcugguggaggagauggagaccgccaccgagcuguuccuggugauggagcuggugaagggcggcgaccuguucgacgccaucaccagcagcaccaaguacaccgagagagacggcagcgccaugguguacaaccuggccaacgcccugagauaccugcacggccugagcaucgugcacagagacaucaagcccgagaaccugcuggugugcgaguaccccgacggcaccaagagccugaagcugggcgacuucggccuggccaccgugguggagggcccccuguacaccgugugcggcacccccaccuacguggcccccgagaucaucgccgagaccggcuacggccugaagguggacaucugggccgccggcgugaucaccuacauccugcugugcggcuucccccccuucagaagcgagaacaaccugcaggaggaccuguucgaccagauccuggccggcaagcuggaguuccccgcccccuacugggacaacaucaccgacagcgccaaggagcugaucagccagaugcugcaggugaacguggaggccagaugcaccgccggccagauccugagccaccccugggugagcgacgacgccagccaggagaacaacaugcaggccgaggugaccggcaagcugaagcagcacuucaacaacgcccugcccaagcagaacagcaccaccaccggcgugagcgugaucaugaacaccgcccuggacaaggagggccagaucuucugcagcaagcacugccaggacagcggcagacccggcauggagcccaucagccccgugccccccagcguggaggagauccccgugcccggcgaggccgugcccgcccccaccccccccgagagccccaccccccaccccccccccgccgcccccggcggcgagagagccggcaccuggagaagacacagagacuaa

SEQ ID NO: 15971 - RNA, 1947 nt, Artificial Sequence
  DCLK3__Homo_sapiens__NP_208382
augggcaaggagccccugacccugaagagcauccagguggccguggaggagcuguaccccaacaaggccagagcccugacccuggcccagcacagcagagcccccagccccagacugagaagcagacuguucagcaaggcccugaagggcgaccacagaugcggcgagaccgagacccccaagagcugcagcgagguggccggcugcaaggccgccaugagacaccagggcaagauccccgaggagcugagccuggacgacagagccagaacccagaagaaguggggcagaggcaagugggagcccgagcccagcagcaagccccccagagaggccacccuggaggagagacacgccagaggcgagaagcaccugggcguggagaucgagaagaccagcggcgagaucaucagaugcgagaagugcaagagagagagagagcugcagcagagccuggagagagagagacugagccugggcaccagcgagcuggacaugggcaagggccccauguacgacguggagaagcuggugagaaccagaagcugcagaagaagccccgaggccaaccccgccagcggcgaggagggcuggaagggcgacagccacagaagcagccccagaaaccccacccaggagcugagaagacccagcaagagcauggacaagaaggaggacagaggccccgaggaccaggagagccacgcccagggcgccgccaaggccaagaaggaccugguggaggugcugcccgugaccgaggagggccugagagaggugaagaaggacaccagacccaugagcagaagcaagcacggcggcuggcugcugagagagcaccaggccggcuucgagaagcugagaagaaccagaggcgaggagaaggaggccgagaaggagaagaagcccugcaugagcggcggcagaagaaugacccugagagacgaccagcccgccaagcuggagaaggagcccaagaccagacccgaggagaacaagcccgagagacccagcggcagaaagcccagacccaugggcaucaucgccgccaacguggagaagcacuacgagaccggcagagugaucggcgacggcaacuucgccguggugaaggagugcagacacagagagaccagacaggccuacgccaugaagaucaucgacaagagcagacugaagggcaaggaggacaugguggacagcgagauccugaucauccagagccugagccaccccaacaucgugaagcugcacgagguguacgagaccgacauggagaucuaccugauccuggaguacgugcagggcggcgaccuguucgacgccaucaucgagagcgugaaguuccccgagcccgacgccgcccugaugaucauggaccugugcaaggcccuggugcacaugcacgacaagagcaucgugcacagagaccugaagcccgagaaccugcuggugcagagaaacgaggacaagagcaccacccugaagcuggccgacuucggccuggccaagcacguggugagacccaucuucaccgugugcggcacccccaccuacguggcccccgagauccugagcgagaagggcuacggccuggagguggacaugugggccgccggcgugauccuguacauccugcugugcggcuucccccccuucagaagccccgagagagaccaggacgagcuguucaacaucauccagcugggccacuucgaguuccugccccccuacugggacaacaucagcgacgccgccaaggaccuggugagcagacugcuggugguggaccccaagaagagauacaccgcccaccaggugcugcagcaccccuggaucgagaccgccggcaagaccaacaccgugaagagacagaagcaggugagccccagcagcgagggccacuucagaagccagcacaagagagugguggagcaggugagcuaa

SEQ ID NO: 15972 - RNA, 3123 nt, Artificial Sequence
  DCLRE1A__Homo_sapiens__NP_055696
augcuggaggacaucagcgaggaggacaucugggaguacaagagcaagagaaagcccaagagaguggaccccaacaacggcagcaagaacauccugaagagcguggagaaggccaccgacggcaaguaccagagcaagagaagcagaaacagaaagagagccgccgaggccaaggaggugaaggaccacgaggugccccugggcaacgccggcugccagaccagcguggccagcagccagaacagcagcugcggcgacggcauccagcagacccaggacaaggagaccacccccggcaagcugugcagaacccagaagagccagcacgugagccccaagaucagacccguguacgacggcuacugccccaacugccagaugcccuucagcagccugaucggccagacccccagauggcacguguucgagugccuggacagcccccccagaagcgagaccgagugccccgacggccugcugugcaccagcaccauccccuuccacuacaagagauacacccacuuccugcuggcccagagcagagccggcgaccaccccuucagcagccccagccccgccagcggcggcagcuucagcgagaccaagagcggcgugcugugcagccuggaggagagauggagcagcuaccagaaccagaccgacaacagcgugagcaacgacccccugcugaugacccaguacuucaagaagagccccagccugaccgaggccagcgagaagaucagcacccacauccagaccagccagcaggcccugcaguucaccgacuucguggagaacgacaagcuggugggcguggcccugagacuggccaacaacagcgagcacaucaaccugccccugcccgagaacgacuucagcgacugcgagaucagcuacagcccccugcagagcgacgaggacacccacgacaucgacgagaagcccgacgacagccaggagcagcuguucuucaccgagagcagcaaggacggcagccuggaggaggacgacgacagcugcggcuucuucaagaagagacacggcccccugcugaaggaccaggacgagagcugccccaaggugaacagcuuccugaccagagacaaguacgacgagggccuguacagauucaacagccugaacgaccugagccagcccaucagccagaacaacgagagcacccugcccuacgaccuggccugcaccggcggcgacuucgugcuguucccccccgcccuggccggcaagcuggccgccagcgugcaccaggccaccaaggccaagcccgacgagcccgaguuccacagcgcccagagcaacaagcagaagcaggugaucgaggagagcagcguguacaaccaggugagccugccccuggugaagagccugaugcugaagcccuucgagagccagguggagggcuaccugagcagccagcccacccagaacaccaucagaaagcugagcagcgagaaccugaacgccaagaacaacaccaacagcgccugcuucugcagaaaggcccuggagggcgugcccgugggcaaggccaccauccugaacaccgagaaccugagcagcacccccgcccccaaguaccugaagauccugcccagcggccugaaguacaacgccagacaccccagcaccaaggugaugaagcagauggacaucggcguguacuucggccugccccccaagagaaaggaggagaagcugcugggcgagagcgcccuggagggcaucaaccugaaccccgugcccagccccaaccagaagagaagcagccagugcaagagaaaggccgagaagagccugagcgaccuggaguucgacgccagcacccugcacgagagccagcugagcguggagcugagcagcgagagaagccagagacagaagaagagaugcagaaagagcaacagccugcaggagggcgccugccagaagagaagcgaccaccugaucaacaccgagagcgaggccgugaaccugagcaaggugaagguguucaccaagagcgcccacggcggccugcagagaggcaacaagaagauccccgagagcagcaacgugggcggcagcagaaagaagaccugccccuucuacaagaagauccccggcaccggcuucaccguggacgccuuccaguacggcgugguggagggcugcaccgccuacuuccugacccacuuccacagcgaccacuacgccggccugagcaagcacuucaccuuccccguguacugcagcgagaucaccggcaaccugcugaagaacaagcugcacgugcaggagcaguacauccacccccugccccuggacaccgagugcaucgugaacggcgugaagguggugcugcuggacgccaaccacugccccggcgccgugaugauccuguucuaccugcccaacggcaccgugauccugcacaccggcgacuucagagccgaccccagcauggagagaagccugcuggccgaccagaaggugcacaugcuguaccuggacaccaccuacugcagccccgaguacaccuuccccagccagcaggaggugaucagauucgccaucaacaccgccuucgaggccgugacccugaacccccacgcccugguggugugcggcaccuacagcaucggcaaggagaagguguuccuggccaucgccgacgugcugggcagcaaggugggcaugagccaggagaaguacaagacccugcagugccugaacauccccgagaucaacagccugaucaccaccgacaugugcagcagccuggugcaccugcugcccaugaugcagaucaacuucaagggccugcagagccaccugaagaagugcggcggcaaguacaaccagauccuggccuucagacccaccggcuggacccacagcaacaaguucaccagaaucgccgacgugaucccccagaccaagggcaacaucagcaucuacggcauccccuacagcgagcacagcagcuaccuggagaugaagagauucgugcaguggcugaagccccagaagaucauccccaccgugaacgugggcaccuggaagagcagaagcaccauggagaaguacuucagagaguggaagcuggaggccggcuacuaa

SEQ ID NO: 15973 - RNA, 2079 nt, Artificial Sequence
  DCLRE1C__Homo_sapiens__NP_001029027
augagcagcuucgagggccagauggccgaguaccccaccaucagcaucgacagauucgacagagagaaccugagagccagagccuacuuccugagccacugccacaaggaccacaugaagggccugagagcccccacccugaagagaagacuggagugcagccugaagguguaccuguacugcagccccgugaccaaggagcugcugcugaccagccccaaguacagauucuggaagaagagaaucaucagcaucgagaucgagacccccacccagaucagccugguggacgaggccagcggcgagaaggaggagaucguggugacccugcugcccgccggccacugccccggcagcgugauguuccuguuccagggcaacaacggcaccgugcuguacaccggcgacuucagacuggcccagggcgaggccgccagaauggagcugcugcacagcggcggcagagugaaggacauccagagcguguaccuggacaccaccuucugcgaccccagauucuaccagauccccagcagagaggagugccugagcggcgugcuggagcuggugagaagcuggaucaccagaagccccuaccacgugguguggcugaacugcaaggccgccuacggcuacgaguaccuguucaccaaccugagcgaggagcugggcgugcaggugcacgugaacaagcuggacauguucagaaacaugcccgagauccugcaccaccugaccaccgacagaaacacccagauccacgccugcagacaccccaaggccgaggaguacuuccaguggagcaagcugcccugcggcaucaccagcagaaacagaaucccccugcacaucaucagcaucaagcccagcaccaugugguucggcgagagaagcagaaagaccaacgugaucgugagaaccggcgagagcagcuacagagccugcuucagcuuccacagcagcuacagcgagaucaaggacuuccugagcuaccugugccccgugaacgccuaccccaacgugauccccgugggcaccaccauggacaaggugguggagauccugaagccccugugcagaagcagccagagcaccgagcccaaguacaagccccugggcaagcugaagagagccagaaccgugcacagagacagcgaggaggaggacgacuaccuguucgacgacccccugcccaucccccugagacacaaggugcccuaccccgagaccuuccaccccgagguguucagcaugaccgccgugagcgagaagcagcccgagaagcugagacagacccccggcugcugcagagccgagugcaugcagagcagcagauucaccaacuucguggacugcgaggagagcaacagcgagagcgaggaggaggugggcauccccgccagccugcagggcgaccugggcagcgugcugcaccugcagaaggccgacggcgacgugccccagugggagguguucuucaagagaaacgacgagaucaccgacgagagccuggagaacuuccccagcagcaccguggccggcggcagccagagccccaagcuguucagcgacagcgacggcgagagcacccacaucagcagccagaacagcagccagagcacccacaucaccgagcagggcagccagggcugggacagccagagcgacaccgugcugcugagcagccaggagagaaacagcggcgacaucaccagccuggacaaggccgacuacagacccaccaucaaggagaacauccccgccagccugauggagcagaacgugaucugccccaaggacaccuacagcgaccugaagagcagagacaaggacgugaccaucgugcccagcaccggcgagcccaccacccugagcagcgagacccacauccccgaggagaagagccugcugaaccugagcaccaacgccgacagccagagcagcagcgacuucgaggugcccagcacccccgaggccgagcugcccaagagagagcaccugcaguaccuguacgagaagcuggccaccggcgagagcaucgccgugaagaagagaaagugcagccugcuggacaccuaa

SEQ ID NO: 15974 - RNA, 1080 nt, Artificial Sequence
  DCN__Homo_sapiens__NP_598010
augaaggccaccaucauccugcugcugcuggcccaggugagcugggccggccccuuccagcagagaggccuguucgacuucaugcuggaggacgaggccagcggcaucggccccgaggugcccgacgacagagacuucgagcccagccugggccccgugugccccuucagaugccagugccaccugagaguggugcagugcagcgaccugggccuggacaaggugcccaaggaccugccccccgacaccacccugcuggaccugcagaacaacaagaucaccgagaucaaggacggcgacuucaagaaccugaagaaccugcacgcccugauccuggugaacaacaagaucagcaaggugagccccggcgccuucaccccccuggugaagcuggagagacuguaccugagcaagaaccagcugaaggagcugcccgagaagaugcccaagacccugcaggagcugagagcccacgagaacgagaucaccaaggugagaaaggugaccuucaacggccugaaccagaugaucgugaucgagcugggcaccaacccccugaagagcagcggcaucgagaacggcgccuuccagggcaugaagaagcugagcuacaucagaaucgccgacaccaacaucaccagcaucccccagggccugccccccagccugaccgagcugcaccuggacggcaacaagaucagcagaguggacgccgccagccugaagggccugaacaaccuggccaagcugggccugagcuucaacagcaucagcgccguggacaacggcagccuggccaacaccccccaccugagagagcugcaccuggacaacaacaagcugaccagagugcccggcggccuggccgagcacaaguacauccaggugguguaccugcacaacaacaacaucagcguggugggcagcagcgacuucugcccccccggccacaacaccaagaaggccagcuacagcggcgugagccuguucagcaaccccgugcaguacugggagauccagcccagcaccuucagaugcguguacgugagaagcgccauccagcugggcaacuacaaguaa

SEQ ID NO: 15975 - RNA, 1272 nt, Artificial Sequence
  DCP1A__Homo_sapiens__NP_001277136
auggccgacgugguggaggaggagaccagaagaagccagcaggccgccagagacaagcagagccccagccaggccaacggcugcagcgaccacagacccaucgacauccuggagaugcugagcagagccaaggacgaguacgagagaagcgcccccagcggccacaagcaccugaccguggaggagcuguucggcaccagccugcccaaggagcagcccgccguggugggccuggacagcgaggagauggagagacugcccggcgacgccagccagaaggagcccaacagcuuccugcccuuccccuucgagcagcugggcggcgccccccagagcgagacccugggcgugcccagcgccgcccaccacagcgugcagcccgagaucaccacccccgugcugaucacccccgccagcaucacccagagcaacgagaagcacgcccccaccuacaccaucccccugagccccgugcugagccccacccugcccgccgaggcccccaccgcccaggugccccccagccugcccagaaacagcaccaugaugcaggccgugaagaccacccccagacagagaagcccccugcugaaccagcccgugcccgagcugagccacgccagccugaucgccaaccagagccccuucagagccccccugaacgugaccaacaccgccggcaccagccugcccagcguggaccugcugcagaagcugagacugaccccccagcacgaccagauccagacccagccccugggcaagggcgccaugguggccagcuucagccccgccgccggccagcuggccacccccgagagcuucaucgagccccccagcaagaccgccgccgccagaguggccgccagcgccagccugagcaacauggugcuggccccccugcagagcaugcagcagaaccaggaccccgagguguucgugcagcccaaggugcugagcagcgccauccccguggccggcgccccccuggugaccgccaccaccaccgccgugagcagcgugcugcuggcccccagcguguuccagcagaccgugaccagaagcagcgaccuggagagaaaggccagcagccccagcccccugaccaucggcacccccgagagccagagaaagcccagcaucauccugagcaagagccagcugcaggacacccugauccaccugaucaagaacgacagcagcuuccugagcacccugcacgagguguaccugcaggugcugaccaagaacaaggacaaccacaaccuguaa

SEQ ID NO: 15976 - RNA, 1854 nt, Artificial Sequence
  DCP1B__Homo_sapiens__NP_689853
auggccgccguggccgccggcggccuggugggcaagggcagagacaucagccuggccgcccugcagagacacgaccccuacaucaacagaaucguggacguggccagccagguggcccuguacaccuucggccacagagccaacgagugggagaagaccgacguggagggcacccuguucguguacaccagaagcgccagccccaagcacggcuucaccaucaugaacagacugagcauggagaacagaaccgagcccaucaccaaggaccuggacuuccagcugcaggaccccuuccugcuguacagaaacgccagacugagcaucuacggcaucugguucuacgacaaggaggagugccagagaaucgccgagcugaugaagaaccugacccaguacgagcagcugaaggcccaccagggcaccggcgccggcaucagccccgugauccugaacagcggcgagggcaaggagguggacauccugagaaugcugaucaaggccaaggacgaguacaccaagugcaagaccugcagcgagcccaagaagaucaccagcagcagcgccaucuacgacaaccccaaccugaucaagcccauccccgugaagcccagcgagaaccagcagcagagaaucccccagcccaaccagacccuggaccccgagccccagcaccugagccugaccgcccuguucggcaagcaggacaaggccaccugccaggagaccguggagcccccccagacccugcaccagcagcagcagcagcagcagcagcagcaggagaagcugcccaucagacagggcguggugagaagccugagcuacgaggagcccagaagacacagcccccccaucgagaagcagcugugccccgccauccagaagcugauggugagaagcgccgaccugcacccccugagcgagcugcccgagaacagacccugcgagaacggcagcacccacagcgccggcgaguucuucaccggccccgugcagcccggcagcccccacaacaucggcaccagcagaggcgugcagaacgccagcagaacccagaaccuguucgagaagcugcagagcacccccggcgccgccaacaagugcgaccccagcacccccgcccccgccagcagcgccgcccugaacagaagcagagcccccaccagcgugacccccguggcccccggcaagggccuggcccagcccccccaggccuacuucaacggcagccugcccccccagaccgugggccaccaggcccacggcagagagcagagcacccugcccagacagacccugcccaucagcggcagccagaccggcagcagcggcgugaucagcccccaggagcugcugaagaagcugcagaucgugcagcaggagcagcagcugcacgccagcaacagacccgcccuggccgccaaguuccccgugcuggcccagagcagcggcaccggcaagccccuggagagcuggaucaacaagacccccaacaccgagcagcagaccccccuguuccaggugaucagcccccagagaauccccgccaccgccgcccccagccugcugaugagccccaugguguucgcccagcccaccagcgugccccccaaggagagagagagcggccugcugcccgugggcggccaggagccccccgccgccgccaccagccugcugcugcccauccagagccccgagcccagcgugaucaccagcagcccccugaccaagcugcagcugcaggaggcccugcuguaccugauccagaacgacgacaacuuccugaacaucaucuacgaggccuaccuguucagcaugacccaggccgccaugaagaagaccauguaa

SEQ ID NO: 15977 - RNA, 1014 nt, Artificial Sequence
  DCPS__Homo_sapiens__NP_054745
auggccgacgccgccccccagcugggcaagagaaagagagagcuggacguggaggaggcccacgccgccagcaccgaggagaaggaggccggcgugggcaacggcaccugcgcccccgugagacugcccuucagcggcuucagacugcagaaggugcugagagagagcgccagagacaagaucaucuuccugcacggcaaggugaacgaggccagcggcgacggcgacggcgaggacgccguggugauccuggagaagacccccuuccagguggagcagguggcccagcugcugaccggcagccccgagcugcagcugcaguucagcaacgacaucuacagcaccuaccaccuguucccccccagacagcugaacgacgugaagaccaccgugguguaccccgccaccgagaagcaccugcagaaguaccugagacaggaccugagacugaucagagagaccggcgacgacuacagaaacaucacccugccccaccuggagagccagagccugagcauccaguggguguacaacauccuggacaagaaggccgaggccgacagaaucguguucgagaaccccgaccccagcgacggcuucgugcugauccccgaccugaaguggaaccagcagcagcuggacgaccuguaccugaucgccaucugccacagaagaggcaucagaagccugagagaccugacccccgagcaccugccccugcugagaaacauccugcaccagggccaggaggccauccugcagagauacagaaugaagggcgaccaccugagaguguaccugcacuaccugcccagcuacuaccaccugcacgugcacuucaccgcccugggcuucgaggcccccggcagcggcguggagagagcccaccugcuggccgaggugaucgagaaccuggagugcgaccccagacacuaccagcagagaacccugaccuucgcccugagagccgacgacccccugcugaagcugcugcaggaggcccagcagagcuaa

SEQ ID NO: 15978 - RNA, 2046 nt, Artificial Sequence
  DCST1__Homo_sapiens__NP_001137159
auggacaucaagcaccaccagaacggcaccagaggccagagaagaaagcagccccacaccaccgugcagagacugcugaccuggggccugcccgugagcugcagcugguuccuguggagacagcccggcgaguuccccgugaccgcccugcugcugggcgccggcgccggcggccugcuggccaucggccugggcgccaugggcuggggcaccagcccccacaucagaugcgccagccugcugcuggugcccaagaugcugggcaaggagggcagacuguucgugcugggcuacgcccuggccgccaucuacgugggccccguggccaaccugagacacaaccugaacaacgugaucgccagccugggcugcaccguggagcugcagaucaacaacaccagagccgccuggagaaucagcaccgccccccugagagccauguucaaggaccugcugagcagcaaggagcugcugagagccgagaccagaaacaucagcgccaccuucgaggaccuggacgcccaggugaacagcgagaccggcuacacccccgaggacaccauggacagcggcgagaccgcccagggcagagaggccagacaggcccccgccagcagacugcaccugagcacccagaagauguacgagcugaagaccaagcugagaugcagcuacguggugaaccaggccauccugagcugcagaagaugguucgacagaaagcacgagcagugcaugaagcacaucugggugccccugcugacccaccugcugugccugcccaugaaguucaaguucuucugcggcaucgccaaggugauggagguguggugcagaaacagaauccccguggagggcaacuucggccagaccuacgacagccugaaccagagcaucagaggccuggacggcgaguucagcgccaacaucgacuucaaggaggagaagcaggccggcgugcugggccugaacaccagcugggagagagugagcaccgaggugagagacuacguguacagacaggaggccagacuggagugggcccugggccugcugcacgugcugcugagcugcaccuuccugcuggugcugcacgccagcuucagcuacauggacagcuacaaccacgacaucagauucgacaacaucuacaucagcaccuacuucugccagaucgacgacagaagaaagaagcugggcaagagaacccugcugccccugagaaaggccgaggagaagaccgugaucuuccccugcaagcccaccauccaggccagcgagaugagcaacguggugagagagcugcuggagacccugcccauccugcugcugcugguggugcugugcggccuggacugggcccuguacagcaucuucgacaccaucagacaccacagcuuccugcaguacagcuucagaagcagccacaagcuggaggugaaggugggcggcgacagcaugcuggccagacugcugagaaagaccaucggcgcccugaacaccagcagcgagaccgugauggagagcaacaacaugcccugccugccccagcccgugggccuggacgccagagccuacuggagagccgccgugcccaucggccugcuggugugccugugccugcugcaggccuucggcuacagacugagaagagugaucgccgccuucuacuuccccaagagagagaagaagagaauccuguuccuguacaacgaccugcugaagaagagagccgccuucaccaagcugagaagagccgccauccugagaagagagagacagcagaaggcccccagacacccccuggccgacauccugcacagaggcugcccccugcugagaagauggcugugcagaagaugcguggugugccaggcccccgagacccccgagagcuacgugugcagaacccuggacugcgaggccguguacugcuggagcugcugggacgacaugagacagagaugccccgugugcacccccagagaggagcugagcagcagcgccuucagcgacagcaacgacgacaccgccuacgccggcuaa

SEQ ID NO: 15979 - RNA, 2322 nt, Artificial Sequence
  DCST2__Homo_sapiens__NP_653223
augcccaaggugaugaaggacguggugcacccccugggcggcgaggagcccagcauggccagagccguggugagaagcgugggcggcuucacccugggccugagccuggccaccgccuacggccugcuggagcugcugguggagggccacagccccuggggcugccuggugggcacccugacccuggccgccuuccugagccugggcaugggcuucagcagacaggugagagccaccgugcugcugcugcugccccaggccuucagcagacagggcagaacccugcugcugguggccgccuucggccuggugcugcagggccccugcgccaacacccugagaaacuucaccagagccagcgaggccguggccugcggcgccgagcuggcccugaaccagaccgccgaggugcugcagagagccaagcagccccuggugagcgcccugaacaagaucaaggccaucgccagaaagaccaaggagguggccgacagagugagaaaguucuucagaagcaucauggacggcgugaagcacaucgccagagcccugagaaacguguggcaguggcugcugcacaucggcgacgugugcaacagcgagcugggcaaccccuaccugaagugcgccagaguguucgacgacgccaaggacagcugcaugauggugaucccccaggccuaccaccugugcuacgugcugaugcccuucaagcuggcccugugcggccuggccagccuggugcagguguucugcgugauccccaaguacauccagcccuuccugagacagaccaucggcacccccgugauccagcugcugaacagagugagacaggaguucgaguucaacaugaccgccacccaccacuucagcguggaccugaacgccagcagaagccugagccagguggccauggaccugcacgaggccgugagcaugaagcugcacagagugagagaggcccuggcccugaugggcuucaccaccccccugcugcuggugcugcuguaccugcaggcccuguucuacagauacugcuaccugaacugggaccacuacgacaacaucuacaucaccagcagauuccugagaauggaggccgugagaagcaccgccggccugcccaccgugcugccccugagcgcccacgaggccagaagauacaucccccccggcagcaucuuccugagccagugggagaaguucuucuacauccuggagaccuucaaccugaucagacaccugcugcuggugcuguuccugguguuccuggacuacgccguguucugggugcuggaccuggccagacaccagcugcagggcgagaucguggccagaagccccgugcuggugagccugaccguggagggcaccggcuacgccggcaacaucuacagagaccuggugagcgccuucgacgugcugcagcagggcaacaucagcauccugagcagaagaugccugcugagacccagcgagcccgacagcaccggcuacaucgugaucggcgugauguacggccugugcuucuucaucacccuguucggcagcuacgugagcagacugagaagagugaucugcgccagcuacuaccccagcagagagcaggagagaaucagcuaccuguacaacgugcugcugagcagaagaaccaaccugcuggccgcccugcacagaagcgugagaagaagagccgccgaccagggccacagaagcgccuuccuggugcuggccagcagaugccccugccugggccccuucgugagccacuucuggcugcaccaggccuacugccugggcugcggccagccccaggacgagggcgacauggagaacaccgugagcugcagcacccccggcugccagggccuguacugccugaccugcuucagacugcuggacaacaccugcagcgugugcgccagcccccugagcuaccagggcgaccuggaccuggagcuggacagcagcgacgaggagggcccccagcuguggcuggccgccgcccagagaaaggaccccgagcaggccuggcugcugcagcagcagcugcaggaggugcugggcagaagccugagcauggagagcaccagcgagagcagcgaccuggacgaggagaagggcccccagcagagaaagcacggccagcagccccugcccgaggcccaccagcccgugagcauccugaccagccccgagccccacagaccccccgagaccagcagcgccaccaagggcgcccccacccccgccagcgagcccagcgugccccugagcccccccagccugcccgaccccagccaccccccccccaaguaa

SEQ ID NO: 15980 - RNA, 1413 nt, Artificial Sequence
  DCSTAMP__Homo_sapiens__XP_005251132
augggcaucuggaccagcggcaccgacaucuuccugagccugugggagaucuacgugagccccagaagccccggcuggauggacuucauccagcaccugggcgugugcugccugguggcccugaucagcgugggccugcugagcguggccgccugcugguuccugcccagcaucaucgccgccgccgccagcuggaucaucaccugcgugcugcugugcugcagcaagcacgccagaugcuucauccugcugguguuccugagcugcggccugagagagggcagaaacgcccugaucgccgccggcaccggcaucgugauccugggccacguggagaacaucuuccacaacuucaagggccugcuggacggcaugaccugcaaccugagagccaagagcuucagcauccacuucccccugcugaagaaguacaucgaggccauccaguggaucuacggccuggccaccccccugagcguguucgacgaccuggugagcuggaaccagacccuggccgugagccuguucagccccagccacgugcuggaggcccagcugaacgacagcaagggcgaggugcugagcgugcuguaccagauggccaccaccaccgaggugcugagcagccugggccagaagcugcuggccuucgccggccugagccuggugcugcugggcaccggccuguucaugaagagauuccugggccccugcggcuggaaguacgagaacaucuacaucaccagacaguucgugcaguucgacgagagagagagacaccagcagagacccugcgugcugccccugaacaaggaggagagaagaaaguacgugaucauccccaccuucuggcccacccccaaggagagaaagaaccugggccuguucuuccugcccauccugauccaccugugcaucugggugcuguucgccgccguggacuaccugcuguacagacugaucuucagcgugagcaagcaguuccagagccugcccggcuucgaggugcaccugaagcugcacggcgagaagcagggcacccaggacaucauccacgacagcagcuucaacaucagcguguucgagcccaacugcauccccaagcccaaguuccugcugagcgagaccugggugccccugagcgugauccugcugauccuggugaugcugggccugcugagcagcauccugaugcagcugaagauccuggugagcgccagcuucuaccccagcguggagagaaagagaauccaguaccugcacgccaagcugcugaagaagagaagcaagcagccccugggcgaggugaagagaagacugagccuguaccugaccaagauccacuucuggcugcccgugcugaagaugaucagaaagaagcagauggacauggccagcgccgacaagagcuaa

SEQ ID NO: 15981 - RNA, 570 nt, Artificial Sequence
  DCTD__Homo_sapiens__NP_001012750
auggugggcggcggccagcccugcggccccaacaugagcgaggugagcugcaagaagagagacgacuaccuggaguggcccgaguacuucauggccguggccuuccugagcgcccagagaagcaaggaccccaacagccaggugggcgccugcaucgugaacagcgagaacaagaucgugggcaucggcuacaacggcaugcccaacggcugcagcgacgacgugcugcccuggagaagaaccgccgagaacaagcuggacaccaaguaccccuacgugugccacgccgagcugaacgccaucaugaacaagaacagcaccgacgugaagggcugcagcauguacguggcccuguuccccugcaacgagugcgccaagcugaucauccaggccggcaucaaggaggugaucuucaugagcgacaaguaccacgacagcgacgaggccaccgccgccagacugcuguucaacauggccggcgugaccuucagaaaguucauccccaagugcagcaagaucgugaucgacuucgacagcaucaacagcagacccagccagaagcugcaguaa

SEQ ID NO: 15982 - RNA, 1659 nt, Artificial Sequence
  DCT__Homo_sapiens__NP_001123361
augagcccccugugguggggcuuccugcugagcugccugggcugcaagauccugcccggcgcccagggccaguuccccagagugugcaugaccguggacagccuggugaacaaggagugcugccccagacugggcgccgagagcgccaacgugugcggcagccagcagggcagaggccagugcaccgaggugagagccgacaccagacccuggagcggccccuacauccugagaaaccaggacgacagagagcuguggcccagaaaguucuuccacagaaccugcaagugcaccggcaacuucgccggcuacaacugcggcgacugcaaguucggcuggaccggccccaacugcgagagaaagaagccccccgugaucagacagaacauccacagccugagcccccaggagagagagcaguuccugggcgcccuggaccuggccaagaagagagugcaccccgacuacgugaucaccacccagcacuggcugggccugcugggccccaacggcacccagccccaguucgccaacugcagcguguacgacuucuucguguggcugcacuacuacagcgugagagacacccugcugggccccggcagacccuacagagccaucgacuucagccaccagggccccgccuucgugaccuggcacagauaccaccugcugugccuggagagagaccugcagagacugaucggcaacgagagcuucgcccugcccuacuggaacuucgccaccggcagaaacgagugcgacgugugcaccgaccagcuguucggcgccgccagacccgacgaccccacccugaucagcagaaacagcagauucagcagcugggagaccgugugcgacagccuggacgacuacaaccaccuggugacccugugcaacggcaccuacgagggccugcugagaagaaaccagaugggcagaaacagcaugaagcugcccacccugaaggacaucagagacugccugagccugcagaaguucgacaacccccccuucuuccagaacagcaccuucagcuucagaaacgcccuggagggcuucgacaaggccgacggcacccuggacagccaggugaugagccugcacaaccuggugcacagcuuccugaacggcaccaacgcccugccccacagcgccgccaacgaccccaucuucguggugaucagcaacagacugcuguacaacgccaccaccaacauccuggagcacgugagaaaggagaaggccaccaaggagcugcccagccugcacgugcuggugcugcacagcuucaccgacgccaucuucgacgaguggaugaagagauucaacccccccgccgacgccuggccccaggagcuggcccccaucggccacaacagaauguacaacauggugcccuucuucccccccgugaccaacgaggagcuguuccugaccagcgaccagcugggcuacagcuacgccaucgaccugcccgugagcguggaggagacccccggcuggcccaccacccugcugguggugaugggcacccugguggcccuggugggccuguucgugcugcuggccuuccugcaguacagaagacugagaaagggcuacaccccccugauggagacccaccugagcagcaagagauacaccgaggaggccuaa

SEQ ID NO: 15983 - RNA, 3762 nt, Artificial Sequence
  DCTN1__Homo_sapiens__NP_001128512
auggcccagagcaagagacacguguacagcagaacccccagcggcagcagaaugagcgccgaggccagcgccagaccccugagagugggcagcagaguggaggugaucggcaagggccacagaggcaccguggccuacgugggcgccacccuguucgccaccggcaagugggugggcgugauccuggacgaggccaagggcaagaacgacggcaccgugcagggcagaaaguacuucaccugcgacgagggccacggcaucuucgugagacagagccagauccagguguucgaggacggcgccgacaccaccagccccgagacccccgacagcagcgccagcaaggugcugaagagagagggcaccgacaccaccgccaagaccagcaagcugcccaccagacccgccagcaccggcguggccggcgccagcagcagccugggccccagcggcagcgccagcgccggcgagcugagcagcagcgagcccagcacccccgcccagaccccccuggccgcccccaucauccccacccccgugcugaccagccccggcgccgugcccccccugcccagccccagcaaggaggaggagggccugagagcccaggugagagaccuggaggagaagcuggagacccugagacugaagagagccgaggacaaggccaagcugaaggagcuggagaagcacaagauccagcuggagcaggugcaggaguggaagagcaagaugcaggagcagcaggccgaccugcagagaagacugaaggaggccagaaaggaggccaaggaggcccuggaggccaaggagagauacauggaggagauggccgacaccgccgacgccaucgagauggccacccuggacaaggagauggccgaggagagagccgagagccugcagcaggagguggaggcccugaaggagagaguggacgagcugaccaccgaccuggagauccugaaggccgagaucgaggagaagggcagcgacggcgccgccagcagcuaccagcugaagcagcuggaggagcagaacgccagacugaaggacgcccuggugagaaugagagaccugagcagcagcgagaagcaggagcacgugaagcugcagaagcugauggagaagaagaaccaggagcuggagguggugagacagcagagagagagacugcaggaggagcugagccaggccgagagcaccaucgacgagcugaaggagcagguggacgccgcccugggcgccgaggagaugguggagaugcugaccgacagaaaccugaaccuggaggagaaggugagagagcugagagagaccgugggcgaccuggaggccaugaacgagaugaacgacgagcugcaggagaacgccagagagaccgagcuggagcugagagagcagcuggacauggccggcgccagagugagagaggcccagaagagaguggaggccgcccaggagaccguggccgacuaccagcagaccaucaagaaguacagacagcugaccgcccaccugcaggacgugaacagagagcugaccaaccagcaggaggccagcguggagagacagcagcagcccccccccgagaccuucgacuucaagaucaaguucgccgagaccaaggcccacgccaaggccaucgagauggagcugagacagauggagguggcccaggccaacagacacaugagccugcugaccgccuucaugcccgacagcuuccugagacccggcggcgaccacgacugcgugcuggugcugcugcugaugcccagacugaucugcaaggccgagcugaucagaaagcaggcccaggagaaguucgagcugagcgagaacugcagcgagagacccggccugagaggcgccgccggcgagcagcugagcuucgccgccggccugguguacagccugagccugcugcaggccacccugcacagauacgagcacgcccugagccagugcagcguggacguguacaagaaggugggcagccuguaccccgagaugagcgcccacgagagaagccuggacuuccugaucgagcugcugcacaaggaccagcuggacgagaccgugaacguggagccccugaccaaggccaucaaguacuaccagcaccuguacagcauccaccuggccgagcagcccgaggacugcaccaugcagcuggccgaccacaucaaguucacccagagcgcccuggacugcaugagcguggaggugggcagacugagagccuuccugcagggcggccaggaggccaccgacaucgcccugcugcugagagaccuggagaccagcugcagcgacaucagacaguucugcaagaagaucagaagaagaaugcccggcaccgacgcccccggcauccccgccgcccuggccuucggcccccaggugagcgacacccugcuggacugcagaaagcaccugaccugggugguggccgugcugcaggagguggccgccgccgccgcccagcugaucgccccccuggccgagaacgagggccugcugguggccgcccuggaggagcuggccuucaaggccagcgagcagaucuacggcacccccagcagcagccccuacgagugccugagacagagcugcaacauccugaucagcaccaugaacaagcuggccaccgccaugcaggagggcgaguacgacgccgagagaccccccagcaagcccccccccguggagcugagagccgccgcccugagagccgagaucaccgacgccgagggccugggccugaagcuggaggacagagagaccgugaucaaggagcugaagaagagccugaagaucaagggcgaggagcugagcgaggccaacgugagacugagccugcuggagaagaagcuggacagcgccgccaaggacgccgacgagagaaucgagaaggugcagaccagacuggaggagacccaggcccugcugagaaagaaggagaaggaguucgaggagaccauggacgcccugcaggccgacaucgaccagcuggaggccgagaaggccgagcugaagcagagacugaacagccagagcaagagaaccaucgagggccugagaggccccccccccagcggcaucgccacccuggugagcggcaucgccggcggcgccauccccggccaggcccccggcagcgugcccggccccggccuggugaaggacagcccccugcugcugcagcagaucagcgccaugagacugcacaucagccagcugcagcacgagaacagcauccugaagggcgcccagaugaaggccagccuggccagccugcccccccugcacguggccaagcugagccacgagggccccggcagcgagcugcccgccggcgcccuguacagaaagaccagccagcugcuggagacccugaaccagcugagcacccacacccacgugguggacaucaccagaaccagccccgccgccaagagccccagcgcccagcugauggagcagguggcccagcugaagagccugagcgacaccguggagaagcugaaggacgaggugcugaaggagaccgugagccagagacccggcgccaccgugcccaccgacuucgccaccuuccccagcagcgccuuccugagagccaaggaggagcagcaggacgacaccguguacaugggcaaggugaccuucagcugcgccgccggcuucggccagagacacagacuggugcugacccaggagcagcugcaccagcugcacagcagacugaucagcuaa

SEQ ID NO: 15984 - RNA, 1212 nt, Artificial Sequence
  DCTN2__Homo_sapiens__NP_001248341
auggccgaccccaaguacgccgaccugcccggcaucgccagaaacgagcccgacguguacgagaccagcgaccugcccgaggacgaccaggccgaguucgacgccgagcuggaggagcugaccagcaccagcguggagcacaucaucgugaaccccaacgccgccuacgacaaguucaaggacaagagagugggcaccaagggccuggacuucagcgacagaaucggcaagaccaagagaaccggcuacgagagcggcgaguacgagaugcugggcgagggccugggcgugaaggagaccccccagcagaaguaccagagacugcugcacgaggugcaggagcugaccaccgagguggagaagaucaagaccaccgugaaggagagcgccaccgaggagaagcugacccccgugcugcuggccaagcagcuggccgcccugaagcagcagcugguggccagccaccuggagaagcugcugggccccgacgccgccaucaaccugaccgaccccgacggcgcccuggccaagagacugcugcugcagcuggaggccaccaagaacagcaagggcggcagcggcggcaagaccaccggcaccccccccgacagcagccuggugaccuacgagcugcacagcagacccgagcaggacaaguucagccaggccgccaagguggccgagcuggagaagagacugaccgagcuggagaccgccgugagaugcgaccaggacgcccagaacccccugagcgccggccugcagggcgccugccugauggagaccguggagcugcugcaggccaaggugagcgcccuggaccuggccgugcuggaccagguggaggccagacugcagagcgugcugggcaaggugaacgagaucgccaagcacaaggccagcguggaggacgccgacacccagagcaaggugcaccagcuguacgagaccauccagagauggagccccaucgccagcacccugcccgagcuggugcagagacuggugaccaucaagcagcugcacgagcaggccaugcaguucggccagcugcugacccaccuggacaccacccagcagaugaucgccaacagccugaaggacaacaccacccugcugacccaggugcagaccaccaugagagagaaccuggccaccguggagggcaacuucgccagcaucgacgagagaaugaagaagcugggcaaguaa

SEQ ID NO: 15985 - RNA, 477 nt, Artificial Sequence
  DCTN3__Homo_sapiens__NP_001268354
auggccggccugaccgaccugcagagacugcaggccagaguggaggagcuggagagauggguguacggccccggcggcgccagaggcagcagaaagguggccgacggccuggugaaggugcagguggcccugggcaacaucagcagcaagagagagagagugaagauccuguacaagaagaucgaggaccugaucaaguaccuggaccccgaguacaucgacagaaucgccauccccgacgccagcaagcugcaguucauccuggccgccgugcccgagcacgccgccagacugcagagacuggcccagauccacauccagcagcaggaccagugcguggagaucaccgaggagagcaaggcccugcuggaggaguacaacaagaccaccaugcugcugagcaagcaguucgugcagugggacgagcugcugugccagcuggaggccgccacccaggugaagcccgccgaggaguaa

SEQ ID NO: 15986 - RNA, 1404 nt, Artificial Sequence
  DCTN4__Homo_sapiens__NP_001129115
auggccagccugcugcagagcgacagagugcuguaccuggugcagggcgagaagaaggugagagccccccugagccagcuguacuucugcagauacugcagcgagcugagaagccuggagugcgugagccacgagguggacagccacuacugccccagcugccuggagaacaugcccagcgccgaggccaagcugaagaagaacagaugcgccaacugcuucgacugccccggcugcaugcacacccugagcaccagagccaccagcaucagcacccagcugcccgacgaccccgccaagaccaccaugaagaaggccuacuaccuggccugcggcuucugcagauggaccagcagagacgugggcauggccgacaagagcguggccagcggcggcuggcaggagcccgagaacccccacacccagagaaugaacaagcugaucgaguacuaccagcagcuggcccagaaggagaagguggagagagacagaaagaagcuggccagaagaagaaacuacaugccccuggccuucagccagcacaccauccacgugguggacaaguacggccugggcaccagacugcagagacccagagccggcgccagcaucagcacccuggccggccugagccugaaggagggcgaggaccagaaggagaucaagaucgagcccgcccaggccguggacgagguggagccccugcccgaggacuacuacaccagacccgugaaccugaccgaggugaccacccugcagcagagacugcugcagcccgacuuccagcccgugugcgccagccagcuguaccccagacacaagcaccugcugaucaagagaagccugagaugcagaaagugcgagcacaaccugagcaagcccgaguucaaccccaccagcaucaaguucaagauccagcugguggccgugaacuacauccccgaggugagaaucaugagcauccccaaccugagauacaugaaggagagccaggugcugcugacccugaccaaccccguggagaaccugacccacgugacccuguucgagugcgaggagggcgaccccgacgacaucaacagcaccgccaaggugguggugccccccaaggagcuggugcuggccggcaaggacgccgccgccgaguacgacgagcuggccgagccccaggacuuccaggacgaccccgacaucaucgccuucagaaaggccaacaaggugggcaucuucaucaaggugaccccccagagagaggagggcgaggugaccgugugcuucaagaugaagcacgacuucaagaaccuggccgcccccaucagacccaucgaggagagcgaccagggcaccgaggugaucuggcugacccagcacguggagcugagccugggcccccugcugcccuaa

SEQ ID NO: 15987 - RNA, 255 nt, Artificial Sequence
  DCTN5__Homo_sapiens__NP_001185940
auggagcugggcgagcugcuguacaacaagagcgaguacaucgagaccgccagcggcaacaaggugagcagacagagcgugcugugcggcagccagaacaucgugcugaacggcaagaacuucgugaucagcguguuccugagccccuacaucagaugccacagcgccugcagagacagaaagagaagcgacgagagcgugagacugagcgugaacaacagagagugguggggccuggugaacuggagaauguaa

SEQ ID NO: 15988 - RNA, 573 nt, Artificial Sequence
  DCTN6__Homo_sapiens__NP_006562
auggccgagaagacccagaagagcgugaagaucgcccccggcgccguggugugcguggagagcgagaucagaggcgacgugaccaucggccccagaaccgugauccaccccaaggccagaaucaucgccgaggccggccccaucgugaucggcgagggcaaccugaucgaggagcaggcccugaucaucaacgccuaccccgacaacaucacccccgacaccgaggaccccgagcccaagcccaugaucaucggcaccaacaacguguucgaggugggcugcuacagccaggccaugaagaugggcgacaacaacgugaucgagagcaaggccuacgugggcagaaacgugauccugaccagcggcugcaucaucggcgccugcugcaaccugaacaccuucgaggugauccccgagaacaccgugaucuacggcgccgacugccugagaagagugcagaccgagagaccccagccccagacccugcagcuggacuuccugaugaagauccugcccaacuaccaccaccugaagaagaccaugaagggcagcagcacccccgugaagaacuaa

SEQ ID NO: 15989 - RNA, 780 nt, Artificial Sequence
  DCUN1D1__Homo_sapiens__NP_065691
augaacaagcugaagagcagccagaaggacaaggugagacaguucaugaucuucacccagagcagcgagaagaccgccgugagcugccugagccagaacgacuggaagcuggacguggccaccgacaacuucuuccagaaccccgagcuguacaucagagagagcgugaagggcagccuggacagaaagaagcuggagcagcuguacaacagauacaaggacccccaggacgagaacaagaucggcaucgacggcauccagcaguucugcgacgaccuggcccuggaccccgccagcaucagcgugcugaucaucgccuggaaguucagagccgccacccagugcgaguucagcaagcaggaguucauggacggcaugaccgagcugggcugcgacagcaucgagaagcugaaggcccagauccccaagauggagcaggagcugaaggagcccggcagauucaaggacuucuaccaguucaccuucaacuucgccaagaaccccggccagaagggccuggaccuggagauggccaucgccuacuggaaccuggugcugaacggcagauucaaguuccuggaccuguggaacaaguuccugcuggagcaccacaagagaagcauccccaaggacaccuggaaccugcugcuggacuucagcaccaugaucgccgacgacaugagcaacuacgacgaggagggcgccuggcccgugcugaucgacgacuucguggaguucgccagaccccagaucgccggcaccaagagcaccaccguguaa

SEQ ID NO: 15990 - RNA, 1326 nt, Artificial Sequence
  DCX__Homo_sapiens__NP_000546
augaagacccugccccugcacagccacugcaccgagaugcagagacugcugcccaagcuggagaugcugacccugggcagcagcuucugcagccugcagggcgaguucugccaggccauggacagcuucaccaccgugagccacgugggcaugugcgaggagaccgacgccagcuucaacguguucagccccaaguuccaguucgacagaagccacugccagagccugagauuccaccagaacauggagcuggacuucggccacuucgacgagagagacaagaccagcagaaacaugagaggcagcagaaugaacggccugcccagccccacccacagcgcccacugcagcuucuacagaaccagaacccugcaggcccugagcaacgagaagaaggccaagaaggugagauucuacagaaacggcgacagauacuucaagggcaucguguacgccgugagcagcgacagauucagaagcuucgacgcccugcuggccgaccugaccagaagccugagcgacaacaucaaccugccccagggcgugagauacaucuacaccaucgacggcagcagaaagaucggcagcauggacgagcuggaggagggcgagagcuacgugugcagcagcgacaacuucuucaagaagguggaguacaccaagaacgugaaccccaacuggagcgugaacgugaagaccagcgccaacaugaaggccccccagagccuggccagcagcaacagcgcccaggccagagagaacaaggacuucgugagacccaagcuggugaccaucaucagaagcggcgugaagcccagaaaggccgugagagugcugcugaacaagaagaccgcccacagcuucgagcaggugcugaccgacaucaccgaggccaucaagcuggagaccggcguggugaagaagcuguacacccuggacggcaagcaggugaccugccugcacgacuucuucggcgacgacgacguguucaucgccugcggccccgagaaguucagauacgcccaggacgacuucagccuggacgagaacgagugcagagugaugaagggcaaccccagcgccaccgccggccccaaggccagccccaccccccagaagaccagcgccaagagccccggccccaugagaagaagcaagagccccgccgacagcgccaacggcaccagcagcagccagcugagcacccccaagagcaagcagagccccaucagcacccccaccagccccggcagccugagaaagcacaaggaccuguaccugccccugagccuggacgacagcgacagccugggcgacagcauguaa

SEQ ID NO: 15991 - RNA, 735 nt, Artificial Sequence
  DCXR__Homo_sapiens__NP_057370
auggagcuguuccuggccggcagaagagugcuggugaccggcgccggcaagggcaucggcagaggcaccgugcaggcccugcacgccaccggcgccagagugguggccgugagcagaacccaggccgaccuggacagccuggugagagagugccccggcaucgagcccgugugcguggaccugggcgacugggaggccaccgagagagcccugggcagcgugggccccguggaccugcuggugaacaacgccgccguggcccugcugcagcccuuccuggaggugaccaaggaggccuucgacagaagcuucgaggugaaccugagagccgugauccaggugagccagaucguggccagaggccugaucgccagaggcgugcccggcgccaucgugaacgugagcagccagugcagccagagagccgugaccaaccacagcguguacugcagcaccaagggcgcccuggacaugcugaccaaggugauggcccuggagcugggcccccacaagaucagagugaacgccgugaaccccaccguggugaugaccagcaugggccaggccaccuggagcgacccccacaaggccaagaccaugcugaacagaaucccccugggcaaguucgccgagguggagcacguggugaacgccauccuguuccugcugagcgacagaagcggcaugaccaccggcagcacccugcccguggagggcggcuucugggccugcuaa

SEQ ID NO: 15992 - RNA, 558 nt, Artificial Sequence
  DDAH1__Homo_sapiens__XP_011539460
augguggacaugaugaaggaggcccuggagaagcugcagcugaacaucguggagaugaaggacgagaacgccacccuggacggcggcgacgugcuguucaccggcagagaguucuucgugggccugagcaagagaaccaaccagagaggcgccgagauccuggccgacaccuucaaggacuacgccgugagcaccgugcccguggccgacggccugcaccugaagagcuucugcagcauggccggccccaaccugaucgccaucggcagcagcgagagcgcccagaaggcccugaagaucaugcagcagaugagcgaccacagauacgacaagcugaccgugcccgacgacaucgccgccaacugcaucuaccugaacauccccaacaagggccacgugcugcugcacagaacccccgaggaguaccccgagagcgccaagguguacgagaagcugaaggaccacaugcugauccccgugagcaugagcgagcuggagaagguggacggccugcugaccugcugcagcgugcugaucaacaagaagguggacagcuaa

SEQ ID NO: 15993 - RNA, 858 nt, Artificial Sequence
  DDAH2__Homo_sapiens__NP_001289937
augggcacccccggcgagggccugggcagaugcagccacgcccugaucagaggcgugcccgagagccuggccagcggcgagggcgccggcgccggccugcccgcccuggaccuggccaaggcccagagagagcacggcgugcugggcggcaagcugagacagagacugggccugcagcugcuggagcugccccccgaggagagccugccccugggcccccugcugggcgacaccgccgugauccagggcgacaccgcccugaucaccagacccuggagccccgccagaagacccgagguggacggcgugagaaaggcccugcaggaccugggccugagaaucguggagaucggcgacgagaacgccacccuggacggcaccgacgugcuguucaccggcagagaguucuucgugggccugagcaaguggaccaaccacagaggcgccgagaucguggccgacaccuucagagacuucgccgugagcaccgugcccgugagcggccccagccaccugagaggccugugcggcaugggcggccccagaaccgugguggccggcagcagcgacgccgcccagaaggccgugagagccauggccgugcugaccgaccaccccuacgccagccugacccugcccgacgacgccgccgccgacugccuguuccugagacccggccugcccggcgugccccccuuccugcugcacagaggcggcggcgaccugcccaacagccaggaggcccugcagaagcugagcgacgugacccuggugcccgugagcugcagcgagcuggagaaggccggcgccggccugagcagccugugccuggugcugagcaccagaccccacagcuaa

SEQ ID NO: 15994 - RNA, 3423 nt, Artificial Sequence
  DDB1__Homo_sapiens__NP_001914
augagcuacaacuacguggugaccgcccagaagcccaccgccgugaacggcugcgugaccggccacuucaccagcgccgaggaccugaaccugcugaucgccaagaacaccagacuggagaucuacguggugaccgccgagggccugagacccgugaaggaggugggcauguacggcaagaucgccgugauggagcuguucagacccaagggcgagagcaaggaccugcuguucauccugaccgccaaguacaacgccugcauccuggaguacaagcagagcggcgagagcaucgacaucaucaccagagcccacggcaacgugcaggacagaaucggcagacccagcgagaccggcaucaucggcaucaucgaccccgagugcagaaugaucggccugagacuguacgacggccuguucaaggugaucccccuggacagagacaacaaggagcugaaggccuucaacaucagacuggaggagcugcacgugaucgacgugaaguuccuguacggcugccaggcccccaccaucugcuucguguaccaggacccccagggcagacacgugaagaccuacgaggugagccugagagagaaggaguucaacaagggccccuggaagcaggagaacguggaggccgaggccagcauggugaucgccgugcccgagcccuucggcggcgccaucaucaucggccaggagagcaucaccuaccacaacggcgacaaguaccuggccaucgccccccccaucaucaagcagagcaccaucgugugccacaacagaguggaccccaacggcagcagauaccugcugggcgacauggagggcagacuguucaugcugcugcuggagaaggaggagcagauggacggcaccgugacccugaaggaccugagaguggagcugcugggcgagaccagcaucgccgagugccugaccuaccuggacaacggcgugguguucgugggcagcagacugggcgacagccagcuggugaagcugaacguggacagcaacgagcagggcagcuacgugguggccauggagaccuucaccaaccugggccccaucguggacaugugcgugguggaccuggagagacagggccagggccagcuggugaccugcagcggcgccuucaaggagggcagccugagaaucaucagaaacggcaucggcauccacgagcacgccagcaucgaccugcccggcaucaagggccuguggccccugagaagcgaccccaacagagagaccgacgacacccuggugcugagcuucgugggccagaccagagugcugaugcugaacggcgaggagguggaggagaccgagcugaugggcuucguggacgaccagcagaccuucuucugcggcaacguggcccaccagcagcugauccagaucaccagcgccagcgugagacuggugagccaggagcccaaggcccuggugagcgaguggaaggagccccaggccaagaacaucagcguggccagcugcaacagcagccagguggugguggccgugggcagagcccuguacuaccugcagauccacccccaggagcugagacagaucagccacaccgagauggagcacgagguggccugccuggacaucaccccccugggcgacagcaacggccugagcccccugugcgccaucggccuguggaccgacaucagcgccagaauccugaagcugcccagcuucgagcugcugcacaaggagaugcugggcggcgagaucauccccagaagcauccugaugaccaccuucgagagcagccacuaccugcugugcgcccugggcgacggcgcccuguucuacuucggccugaacaucgagaccggccugcugagcgacagaaagaaggugacccugggcacccagcccaccgugcugagaaccuucagaagccugagcaccaccaacguguucgccugcagcgacagacccaccgugaucuacagcagcaaccacaagcugguguucagcaacgugaaccugaaggaggugaacuacaugugcccccugaacagcgacggcuaccccgacagccuggcccuggccaacaacagcacccugaccaucggcaccaucgacgagauccagaagcugcacaucagaaccgugccccuguacgagagccccagaaagaucugcuaccaggaggugagccagugcuucggcgugcugagcagcagaaucgaggugcaggacaccagcggcggcaccaccgcccugagacccagcgccagcacccaggcccugagcagcagcgugagcagcagcaagcuguucagcagcagcaccgccccccacgagaccagcuucggcgaggagguggaggugcacaaccugcugaucaucgaccagcacaccuucgaggugcugcacgcccaccaguuccugcagaacgaguacgcccugagccuggugagcugcaagcugggcaaggaccccaacaccuacuucaucgugggcaccgccaugguguaccccgaggaggccgagcccaagcagggcagaaucgugguguuccaguacagcgacggcaagcugcagaccguggccgagaaggaggugaagggcgccguguacagcaugguggaguucaacggcaagcugcuggccagcaucaacagcaccgugagacuguacgaguggaccaccgagaaggagcugagaaccgagugcaaccacuacaacaacaucauggcccuguaccugaagaccaagggcgacuucauccuggugggcgaccugaugagaagcgugcugcugcuggccuacaagcccauggagggcaacuucgaggagaucgccagagacuucaaccccaacuggaugagcgccguggagauccuggacgacgacaacuuccugggcgccgagaacgccuucaaccuguucgugugccagaaggacagcgccgccaccaccgacgaggagagacagcaccugcaggaggugggccuguuccaccugggcgaguucgugaacguguucugccacggcagccuggugaugcagaaccugggcgagaccagcacccccacccagggcagcgugcuguucggcaccgugaacggcaugaucggccuggugaccagccugagcgagagcugguacaaccugcugcuggacaugcagaacagacugaacaaggugaucaagagcgugggcaagaucgagcacagcuucuggagaagcuuccacaccgagagaaagaccgagcccgccaccggcuucaucgacggcgaccugaucgagagcuuccuggacaucagcagacccaagaugcaggaggugguggccaaccugcaguacgacgacggcagcggcaugaagagagaggccaccgccgacgaccugaucaaggugguggaggagcugaccagaauccacuaa

SEQ ID NO: 15995 - RNA, 1284 nt, Artificial Sequence
  DDB2__Homo_sapiens__NP_000098
auggcccccaagaagagacccgagacccagaagaccagcgagaucgugcugagacccagaaacaagagaagcagaagcccccuggagcuggagcccgaggccaagaagcugugcgccaagggcagcggccccagcagaagaugcgacagcgacugccugugggugggccuggccggcccccagauccugccccccugcagaagcaucgugagaacccugcaccagcacaagcugggcagagccagcuggcccagcgugcagcagggccugcagcagagcuuccugcacacccuggacagcuacagaauccugcagaaggccgcccccuucgacagaagagccaccagccuggccuggcaccccacccaccccagcaccguggccgugggcagcaagggcggcgacaucaugcuguggaacuucggcaucaaggacaagcccaccuucaucaagggcaucggcgccggcggcagcaucaccggccugaaguucaacccccugaacaccaaccaguucuacgccagcagcauggagggcaccaccagacugcaggacuucaagggcaacauccugagaguguucgccagcagcgacaccaucaacaucugguucugcagccuggacgugagcgccagcagcagaaugguggugaccggcgacaacgugggcaacgugauccugcugaacauggacggcaaggagcuguggaaccugagaaugcacaagaagaaggugacccacguggcccugaaccccugcugcgacugguuccuggccaccgccagcguggaccagaccgugaagaucugggaccugagacaggugagaggcaaggccagcuuccuguacagccugccccacagacaccccgugaacgccgccugcuucagccccgacggcgccagacugcugaccaccgaccagaagagcgagaucagaguguacagcgccagccagugggacugcccccugggccugaucccccacccccacagacacuuccagcaccugacccccaucaaggccgccuggcaccccagauacaaccugaucguggugggcagauaccccgaccccaacuucaagagcugcacccccuacgagcugagaaccaucgacguguucgacggcaacagcggcaagaugaugugccagcuguacgaccccgagagcagcggcaucagcagccugaacgaguucaaccccaugggcgacacccuggccagcgccaugggcuaccacauccugaucuggagccaggaggaggccagaaccagaaaguaa

SEQ ID NO: 15996 - RNA, 1443 nt, Artificial Sequence
  DDC__Homo_sapiens__NP_000781
augaacgccagcgaguucagaagaagaggcaaggagaugguggacuacguggccaacuacauggagggcaucgagggcagacagguguaccccgacguggagcccggcuaccugagaccccugauccccgccgccgccccccaggagcccgacaccuucgaggacaucaucaacgacguggagaagaucaucaugcccggcgugacccacuggcacagccccuacuucuucgccuacuuccccaccgccagcagcuaccccgccaugcuggccgacaugcugugcggcgccaucggcugcaucggcuucagcugggccgccagccccgccugcaccgagcuggagaccgugaugauggacuggcugggcaagaugcuggagcugcccaaggccuuccugaacgagaaggccggcgagggcggcggcgugauccagggcagcgccagcgaggccacccugguggcccugcuggccgccagaaccaaggugauccacagacugcaggccgccagccccgagcugacccaggccgccaucauggagaagcugguggccuacagcagcgaccaggcccacagcagcguggagagagccggccugaucggcggcgugaagcugaaggccauccccagcgacggcaacuucgccaugagagccagcgcccugcaggaggcccuggagagagacaaggccgccggccugauccccuucuucaugguggccacccugggcaccaccaccugcugcagcuucgacaaccugcuggaggugggccccaucugcaacaaggaggacaucuggcugcacguggacgccgccuacgccggcagcgccuucaucugccccgaguucagacaccugcugaacggcguggaguucgccgacagcuucaacuucaacccccacaaguggcugcuggugaacuucgacugcagcgccaugugggugaagaagagaaccgaccugaccggcgccuucagacuggaccccaccuaccugaagcacagccaccaggacagcggccugaucaccgacuacagacacuggcagaucccccugggcagaagauucagaagccugaagaugugguucguguucagaauguacggcgugaagggccugcaggccuacaucagaaagcacgugcagcugagccacgaguucgagagccuggugagacaggaccccagauucgagaucugcguggaggugauccugggccuggugugcuucagacugaagggcagcaacaaggugaacgaggcccugcugcagagaaucaacagcgccaagaagauccaccuggugcccugccaccugagagacaaguucgugcugagauucgccaucugcagcagaaccguggagagcgcccacgugcagagagccugggagcacaucaaggagcuggccgccgacgugcugagagccgagagagaguaa

SEQ ID NO: 15997 - RNA, 2640 nt, Artificial Sequence
  DDHD1__Homo_sapiens__NP_001153619
augaacuaccccggcagaggcagccccagaagccccgagcacaacggcagaggcggcggcggcggcgccugggagcugggcagcgacgccagacccgccuucggcggcggcgugugcugcuucgagcaccugcccggcggcgaccccgacgacggcgacgugccccuggcccugcugagaggcgagcccggccugcaccuggcccccggcaccgacgaccacaaccaccaccuggcccuggaccccugccugagcgacgagaacuacgacuucagcagcgccgagagcggcagcagccugagauacuacagcgagggcgagagcggcggcggcggcagcagccugagccugcaccccccccagcagcccccccuggugcccaccaacagcggcggcggcggcgccaccggcggcagccccggcgagagaaagagaaccagacugggcggccccgccgccagacacagauacgagguggugaccgagcugggccccgaggaggugagaugguucuacaaggaggacaagaagaccuggaagcccuucaucggcuacgacagccugagaaucgagcuggccuucagaacccugcugcagaccaccggcgccagaccccagggcggcgacagagacggcgaccacgugugcagccccaccggccccgccagcagcagcggcgaggacgacgacgaggacagagccugcggcuucugccagagcaccaccggccacgagcccgagaugguggagcuggugaacaucgagcccgugugcgugagaggcggccuguacgagguggacgugacccagggcgagugcuaccccguguacuggaaccaggccgacaagauccccgugaugagaggccagugguucaucgacggcaccuggcagccccuggaggaggaggagagcaaccugaucgagcaggagcaccugaacugcuucagaggccagcagaugcaggagaacuucgacaucgaggugagcaagagcaucgacggcaaggacggcagcggcaucaacuacagcgccgugcacagcuucaagcugagcagaaaccacguggacuggcacagcguggacgagguguaccuguacagcgacgccaccaccagcaagaucgccagaaccgugacccagaagcugggcuucagcaaggccagcagcagcggcaccagacugcacagaggcuacguggaggaggccacccuggaggacaagcccagccagaccacccacaucguguucguggugcacggcaucggccagaagauggaccagggcagaaucaucaagaacaccgccaugaugagagaggccgccagaaagaucgaggagagacacuucagcaaccacgccacccacguggaguuccugcccguggaguggagaagcaagcugacccuggacggcgacaccguggacagcaucacccccgacaaggugagaggccugagagacaugcugaacagcagcgccauggacaucauguacuacaccagcccccuguacagagacgagcuggugaagggccugcagcaggagcugaacagacuguacagccuguucugcagcagaaaccccgacuucgaggagaagggcggcaaggugagcaucgugagccacagccugggcugcgugaucaccuacgacaucaugaccggcuggaaccccgugagacuguacgagcagcugcugcagaaggaggaggagcugcccgacgagagauggaugagcuacgaggagagacaccugcuggacgagcuguacaucaccaagagaagacugaaggagaucgaggagagacugcacggccugaaggccagcagcaugacccagacccccgcccugaaguucaagguggagaacuucuucugcaugggcagcccccuggccguguuccuggcccugagaggcaucagacccggcaacaccggcagccaggaccacauccugcccagagagaucugcaacagacugcugaacaucuuccaccccaccgaccccguggccuacagacuggagccccugauccugaagcacuacagcaacaucagccccgugcagauccacugguacaacaccagcaacccccugcccuacgagcacaugaagcccagcuuccugaaccccgccaaggagcccaccagcgugagcgagaacgagggcaucagcaccauccccagccccgugaccagccccgugcugagcagaagacacuacggcgagagcaucaccaacaucggcaaggccagcauccugggcgccgccagcaucggcaagggccugggcggcaugcuguucagcagauucggcagaagcagcaccacccagagcagcgagaccagcaaggacagcauggaggacgagaagaagcccguggccagccccagcgccaccaccgugggcacccagacccugccccacagcagcagcggcuuccuggacagcgcccuggagcuggaccacagaaucgacuucgagcugagagagggccugguggagagcagauacuggagcgccgugaccagccacaccgccuacuggagcagccuggacguggcccuguuccugcugaccuucauguacaagcacgagcacgacgacgacgccaagcccaaccuggaccccaucuaa

SEQ ID NO: 15998 - RNA, 684 nt, Artificial Sequence
  DDHD2__Homo_sapiens__NP_001157706
augagcagcgugcagagccagcaggagcagcugagccagagcgaccccagccccagccccaacagcugcagcagcuucgagcugaucgacauggacgccggcagccuguacgagcccgugagcccccacugguucuacugcaagaucaucgacagcaaggagaccuggauccccuucaacagcgaggacagccagcagcuggaggaggccuacagcagcggcaagggcugcaacggcagaguggugcccaccgacggcggcagauacgacgugcaccugggcgagagaaugagauacgccguguacugggacgagcuggccagcgaggugagaagaugcaccugguucuacaagggcgacaaggacaacaaguacgugcccuacagcgagagcuucagccaggugcuggaggagaccuacaugcuggccgugacccuggacgaguggaagaagaagcuggagagccccaacagagagaucaucauccugcacaaccccaagcugauggugcacuaccagcccguggccggcagcgacgacuggggcagcacccccaccgagcagggcagacccagaaccgugaagagaggcguggagaacaucagcguggacauccacugcggcaacgugaacagacuguucuuccugaccuucggcugcaucugccugcugcugaagcuguaa

SEQ ID NO: 15999 - RNA, 1191 nt, Artificial Sequence
  DDI1__Homo_sapiens__NP_001001711
augcugaucaccguguacugcgugagaagagaccugagcgaggugaccuucagccugcaggugagccccgacuucgagcugagaaacuucaaggugcugugcgaggccgagagcagagugcccguggaggagauccagaucauccacauggagagacugcugaucgaggaccacugcagccugggcagcuacggccugaaggacggcgacaucguggugcugcugcagaaggacaacgugggccccagagcccccggcagagcccccaaccagcccagaguggacuucagcggcaucgccgugcccggcaccagcagcagcagaccccagcaccccggccagcagcagcagagaacccccgccgcccagagaagccagggccuggccagcggcgagaagguggccggccugcagggccugggcagccccgcccugaucagaagcaugcugcugagcaacccccacgaccugagccugcugaaggagagaaaccccccccuggccgaggcccugcugagcggcagccuggagaccuucagccaggugcugauggagcagcagagagagaaggcccugagagagcaggagagacugagacuguacaccgccgacccccuggacagagaggcccaggccaagaucgaggaggagaucagacagcagaacaucgaggagaacaugaacaucgccaucgaggaggcccccgagagcuucggccaggugaccaugcuguacaucaacugcaaggugaacggccacccccugaaggccuucguggacagcggcgcccagaugaccaucaugagccaggccugcgccgagagaugcaacaucaugagacugguggacagaagaugggccggcguggccaagggcgugggcacccagagaaucaucggcagagugcaccuggcccagauccagaucgagggcgacuuccugcagugcagcuucagcauccuggaggaccagcccauggacaugcugcugggccuggacaugcugagaagacaccagugcagcaucgaccugaagaagaacgugcuggugaucggcaccaccggcacccagaccuacuuccugcccgagggcgagcugccccugugcagcagaauggugagcggccaggacgagagcagcgacaaggagaucacccacagcgugauggacagcggcagaaaggagcacuaa

SEQ ID NO: 16000 - RNA, 2997 nt, Artificial Sequence
  DDIAS__Homo_sapiens__NP_659455
augaacagaagaagaaaguuccugcuggccagcgugcuggcccugcagaacagcagcuucaucuaccccagcugccagaagugcuucagcagaaucauccuggugagcaagagaagcaacugccccaagugcggcagcaccggcgagagcggcaacgccaacuacagauacaagcugagccugaagguggccgagagcaacaagcuguucgugaucaccguguucggcagcugccuggacaccuucuucggccugaccgccaccggccugcacagauacauccaggaccccaacaagauccccgagacccuggacaacgacaccacccagaaccugcugaccaaggccguggagaccugcuucgugggccagagcuucaucuucggcgugaccaacuucgagaaccagcccggccagggcagcgacgccagcaacuuccugcagcagugcagcgaccacaagagaaaggccaaggcccugguggccugccagaucgugcugcccgaccccggcaucgccggcuucaccgugaucgacuacuuccaccagcugcugcagaccuucaacuucagaaagcugcagugcgacagccaggcccccaacaaccaccugcuggcccuggaccacagcaacagcgaccugagcagcaucuacaccagcgacagcaccagcgacuucuucaagagcugcagcaaggacaccuucagcaaguucuggcagcccagccuggaguucaccugcaucgugagccagcugaccgacaacgacgacuucagcgccagcgagcagagcaaggccuucggcacccugcagcagaacagaaagagcaucagcaucgccgaggccaccggcagcagcagcugccacgaccccauccaggacagcuggagccuggugagcuacauggacaagaagagcaccgccgagaagcugggcaaggagcugggccugcaggccaaggagcugagcgccgugcacagcagccaccacgagaucggcgugaacgacagcaaccuguucagccuggagaugagagagccccuggagagcagcaacaccaagagcuuccacagcgccguggagaucaagaacagaagccagcacgagcugcccugcuuccagcaccacggcaucgacacccccaccagccugcagaagagaagcgccugcugcccccccagccugcugagacuggaggagaccgccagcagcagccaggacggcgacccccagaucugggacgaccugcccuucagcgagagccugaacaaguuccuggccgugcuggagagcgagaucgccgugacccaggccgacgugagcagcagaaagcaccacguggacaacgacaucgacaaguuccacgccgaccacagcagacugagcgugaccccccagagaaccaccggcgcccugcacaccccccccaucgcccugagaagcagccaggugaucgugaaggccaacugcagcaaggacgacuuccuguucaacugcaagggcaaccugagccccagcguggagaaggagagccagcccgacaacaagguggaggccgugagcgugaaccacaacggcagagacaugagcgaguacuuccugcccaaccccuaccugagcgcccugagcagcagcagcaaggaccuggagaccaucgugacccugaagaagaccaucagaaucagcccccacagagagagcgaccacagcagccugaacaacaaguaccugaacggcugcggcgagaucagcgugagcgagaugaacgagaagcugaccacccugugcuacagaaaguacaacgacgugagcgaccugugcaagcuggagaacaagcaguacugcagauggagcaagaaccaggacgacagcuucaccaucugcagaaagcugaccuacccccuggagacccugugcaacagccccaacagaagcaccaacacccugaaggagaugcccuggggccacaucaacaacaacgugacccagagcuacagcaucggcuacgagggcagcuacgacgccagcgccgaccuguucgacgacaucgccaaggagauggacaucgccaccgagaucaccaagaagagccaggacauccugcugaaguggggcaccagccuggccgagagccaccccagcgagagcgacuucagccugagaagccugagcgaggacuucauccagcccagccagaagcugagccugcagagccugagcgacagcagacacagcagaaccugcagccccaccccccacuuccagagcgacagcgaguacaacuucgagaacagccaggacuucgugcccugcagccagagcacccccaucagcggcuuccaccagaccagaauccacggcaucaacagagccuucaagaagcccguguucuacagcgaccuggacggcaacuacgagaagaucagaaucuuccccgagaacgacaagcagcaggccagccccagcugccccaagaacaucaagacccccagccagaagaucagaagccccaucgugagcggcgugagccagcccgacguguucaaccacuaccccuucgccgagugccacgagaccgacagcgacgagugggugccccccaccacccagaagaucuuccccagcgacaugcugggcuuccagggcaucggccugggcaagugccuggccgccuaccacuuccccgaccagcaggagcugcccagaaagaagcugaagcacaucagacagggcaccaacaagggccugaucaagaagaagcugaagaacaugcuggccgccguggugaccaagaagaagacccacaaguacaacugcaagagcagcggcuggaucagcaagugccccgacauccaggugcuggccgccccccagcugcaccccauccugggccccgacagcugcagcgaggugaagugcugccugcccuucagcgagaagggcccccccagcgugugcgagaccagaagcgccuggagccccgagcuguucagcuaa

SEQ ID NO: 16001 - RNA, 579 nt, Artificial Sequence
  DDIT3__Homo_sapiens__NP_001181983
auggagcuggugcccgccaccccccacuaccccgccgacgugcuguuccagaccgaccccaccgccgagauggccgccgagagccugcccuucagcuucggcacccugagcagcugggagcuggaggccugguacgaggaccugcaggaggugcugagcagcgacgagaacggcggcaccuacgugagcccccccggcaacgaggaggaggagagcaagaucuucaccacccuggaccccgccagccuggccuggcugaccgaggaggagcccgagcccgccgaggugaccagcaccagccagagcccccacagccccgacagcagccagagcagccuggcccaggaggaggaggaggaggaccagggcagaaccagaaagagaaagcagagcggccacagccccgccagagccggcaagcagagaaugaaggagaaggagcaggagaacgagagaaagguggcccagcuggccgaggagaacgagagacugaagcaggagaucgagagacugaccagagagguggaggccaccagaagagcccugaucgacagaauggugaaccugcaccaggccuaa

SEQ ID NO: 16002 - RNA, 699 nt, Artificial Sequence
  DDIT4__Homo_sapiens__NP_061931
augcccagccugugggacagauucagcagcagcagcaccagcagcagccccagcagccugcccagaacccccacccccgacagaccccccagaagcgccuggggcagcgccaccagagaggagggcuucgacagaagcaccagccuggagagcagcgacugcgagagccuggacagcagcaacagcggcuucggccccgaggaggacaccgccuaccuggacggcgugagccugcccgacuucgagcugcugagcgaccccgaggacgagcaccugugcgccaaccugaugcagcugcugcaggagagccuggcccaggccagacugggcagcagaagacccgccagacugcugaugcccagccagcuggugagccaggugggcaaggagcugcugagacuggccuacagcgagcccugcggccugagaggcgcccugcuggacgugugcguggagcagggcaagagcugccacagcgugggccagcuggcccuggaccccagccuggugcccaccuuccagcugacccuggugcugagacuggacagcagacuguggcccaagauccagggccuguucagcagcgccaacagccccuuccugcccggcuucagccagagccugacccugagcaccggcuucagagugaucaagaagaagcuguacagcagcgagcagcugcugaucgaggagugcuaa

SEQ ID NO: 16003 - RNA, 582 nt, Artificial Sequence
  DDIT4L__Homo_sapiens__NP_660287
augguggccaccggcagccugagcagcaagaaccccgccagcaucagcgagcugcuggacugcggcuaccaccccgagagccugcugagcgacuucgacuacugggacuacguggugcccgagcccaaccugaacgaggugaucuucgaggagagcaccugccagaaccuggugaagaugcuggagaacugccugagcaagagcaagcagaccaagcugggcugcagcaaggugcuggugcccgagaagcugacccagagaaucgcccaggacgugcugagacugagcagcaccgagcccugcggccugagaggcugcgugaugcacgugaaccuggagaucgagaacgugugcaagaagcuggacagaaucgugugcgacagcagcguggugcccaccuucgagcugacccugguguucaagcaggagaacugcagcuggaccagcuucagagacuucuucuucagcagaggcagauucagcagcggcuucagaagaacccugauccugagcagcggcuucagacuggugaagaagaagcuguacagccugaucggcaccaccgugaucgagggcagcuaa

SEQ ID NO: 16004 - RNA, 2136 nt, Artificial Sequence
  DDN__Homo_sapiens__NP_055901
augcuggacggcccccuguucagcgagggccccgacagccccagagagcugcaggacgaggagagcggcagcugccugugggugcagaagagcaagcugcuggugaucgaggugaagaccaucagcugccacuacagcagaagagcccccagcagacagcccauggacuuccaggccagccacugggccagaggcuuccagaacagaaccugcggccccagacccggcagcccccagcccccccccagaagacccugggccagcagagugcugcaggaggccaccaacuggagagccggcccccuggccgaggugagagccagagagcaggagaagagaaaggccgccagccaggagagagaggccaaggagaccgagagaaagagaagaaaggccggcggcgccagaagaagcccccccggcagacccagacccgagcccagaaacgcccccagaguggcccagcuggccggccugcccgccccccugagacccgagagacuggcccccgugggcagagcccccagacccagcgcccagccccagagcgaccccggcagcgccugggccggccccuggggcggcagaagacccggcccccccagcuacgaggcccaccugcugcugagaggcagcgccggcaccgcccccagaagaagaugggacagacccccccccuacguggccccccccagcuacgagggcccccacagaacccugggcaccaagagaggccccggcaacagccaggugcccaccagcagcgcccccgccgccacccccgccagaaccgacggcggcagaaccaagaagagacuggaccccagaaucuacagagacgugcugggcgccuggggccugagacagggccagggccugcugggcggcagccccggcugcggcgccgccagagccagacccgagcccggcaagggcgugguggagaagagccugggccuggccgccgccgaccugaacagcggcagcgacagccacccccaggccaaggccaccggcagcgccggcaccgagaucgcccccgccggcagcgccaccgccgcccccugcgccccccaccccgcccccagaagcagacaccaccugaagggcagcagagagggcaaggagggcgagcagaucugguuccccaagugcuggauccccagccccaagaagcagccccccagacacagccagacccugcccagacccugggcccccggcggcaccggcuggagagagagccugggccugggcgagggcgccggccccgagacccuggagggcuggaaggccaccagaagagcccacacccugcccagaagcagccagggccugagcagaggcgagggcguguucgugaucgacgccaccugcguggugaucagaagccaguacgugcccacccccagaacccagcaggugcagcugcugcccagcggcgugaccagaguggugggcgacagccccagccagagcaagcccggcaaggaggagggcgagggcgccaccguguuccccagccccugccagaagagacugagcagcagcagacugcugcaccagcccggcggcggcagaggcggcgaggccgagggcggcagacccggcgacagcacccuggaggagagaaccuucagaauccugggccugcccgcccccgaggugaaccugagagacgcccccacccagcccggcagccccgagcaccaggcccugggccccgccgccagcggcgcccagggcagagccgagggcagcgagguggccguggugcagagaagagccggcagaggcugggccagaacccccggccccuacgccggcgcccugagagaggccgugagcagaaucagaagacacaccgcccccgacagcgacaccgacgaggccgaggagcugagcgugcacagcggcagcagcgacggcagcgacaccgaggcccccggcgccagcuggagaaacgagagaacccugcccgaggugggcaacagcagccccgaggaggacggcaagaccgccgagcugagcgacagcgugggcgagauccuggacgugaucagccagaccgaggaggugcuguucggcgugagagacaucagaggcacccagcagggcaacagaaagagacaguaa

SEQ ID NO: 16005 - RNA, 1110 nt, Artificial Sequence
  DDO__Homo_sapiens__NP_003640
augagacccgccagacacugggagaccagauucggcgccagagacuucggcggcuuccaggacugcuucuucagagacagacugauggacaccgccagaaucgccguggugggcgccggcguggugggccugagcaccgccgugugcaucagcaagcuggugcccagaugcagcgugaccaucaucagcgacaaguucacccccgacaccaccagcgacguggccgccggcaugcugaucccccacaccuaccccgacacccccauccacacccagaagcagugguucagagagaccuucaaccaccuguucgccaucgccaacagcgccgaggccggcgacgccggcgugcaccuggugagcggcuggcagaucuuccagagcacccccaccgaggaggugcccuucugggccgacguggugcugggcuucagaaagaugaccgaggccgagcugaagaaguucccccaguacguguucggccaggccuucaccacccugaagugcgagugccccgccuaccugcccuggcuggagaagagaaucaagggcagcggcggcuggacccugaccagaagaaucgaggaccugugggagcugcaccccagcuucgacaucguggugaacugcagcggccugggcagcagacagcuggccggcgacagcaagaucuuccccgugagaggccaggugcugcaggugcaggcccccuggguggagcacuucaucagagacggcagcggccugaccuacaucuaccccggcaccagccacgugacccugggcggcaccagacagaagggcgacuggaaccugagccccgacgccgagaacagcagagagauccugagcagaugcugcgcccuggagcccagccugcacggcgccugcaacaucagagagaaggugggccugagacccuacagacccggcgugagacugcagaccgagcugcuggccagagacggccagagacugcccguggugcaccacuacggccacggcagcggcggcaucagcgugcacuggggcaccgcccuggaggccgccagacuggugagcgagugcgugcacgcccugagaacccccauccccaagagcaaccuguaa

SEQ ID NO: 16006 - RNA, 1527 nt, Artificial Sequence
  DDR1__Homo_sapiens__NP_001189450
augggccccgaggcccugagcagccugcugcugcugcugcugguggccagcggcgacgccgacaugaagggccacuucgaccccgccaagugcagauacgcccugggcaugcaggacagaaccauccccgacagcgacaucagcgccagcagcagcuggagcgacagcaccgccgccagacacagcagacuggagagcagcgacggcgacggcgccuggugccccgccggcagcguguuccccaaggaggaggaguaccugcagguggaccugcagagacugcaccugguggcccuggugggcacccagggcagacacgccggcggccugggcaaggaguucagcagaagcuacagacugagauacagcagagacggcagaagauggaugggcuggaaggacagauggggccaggaggugaucagcggcaacgaggaccccgagggcguggugcugaaggaccugggcccccccaugguggccagacuggugagauucuaccccagagccgacagagugaugagcgugugccugagaguggagcuguacggcugccuguggagagacggccugcugagcuacaccgcccccgugggccagaccauguaccugagcgaggccguguaccugaacgacagcaccuacgacggccacaccgugggcggccugcaguacggcggccugggccagcuggccgacggcguggugggccuggacgacuucagaaagagccaggagcugagaguguggcccggcuacgacuacgugggcuggagcaaccacagcuucagcagcggcuacguggagauggaguucgaguucgacagacugagagccuuccaggccaugcaggugcacugcaacaacaugcacacccugggcgccagacugcccggcggcguggagugcagauucagaagaggccccgccauggccugggagggcgagcccaugagacacaaccugggcggcaaccugggcgaccccagagccagagccgugagcgugccccugggcggcagaguggccagauuccugcagugcagauuccuguucgccggccccuggcugcuguucagcgagaucagcuucaucagcgacguggugaacaacagcagccccgcccugggcggcaccuucccccccgcccccugguggccccccggccccccccccaccaacuucagcagccuggagcuggagcccagaggccagcagcccguggccaaggccgagggcagccccaccgccauccugaucggcugccugguggccaucauccugcugcugcugcugaucaucgcccugaugcuguggagacugcacuggagaagacugcugagcaaggccgagagaagagugcuggaggaggagcugaccgugcaccugagcgugcccggcgacaccauccugaucaacaacagacccggccccagagagcccccccccuaccaggagcccagacccagaggcaaccccccccacagcgcccccugcgugcccaacggcagcggcgcccccguguaa

SEQ ID NO: 16007 - RNA, 2568 nt, Artificial Sequence
  DDR2__Homo_sapiens__XP_011507889
augauccugauccccagaaugcugcuggugcuguuccugcugcugcccauccugagcagcgccaaggcccaggugaaccccgccaucugcagauacccccugggcaugagcggcggccagauccccgacgaggacaucaccgccagcagccaguggagcgagagcaccgccgccaaguacggcagacuggacagcgaggagggcgacggcgccuggugccccgagauccccguggagcccgacgaccugaaggaguuccugcagaucgaccugcacacccugcacuucaucacccuggugggcacccagggcagacacgccggcggccacggcaucgaguucgcccccauguacaagaucaacuacagcagagacggcaccagauggaucagcuggagaaacagacacggcaagcaggugcuggacggcaacagcaaccccuacgacaucuuccugaaggaccuggagccccccaucguggccagauucgugagauucauccccgugaccgaccacagcaugaacgugugcaugagaguggagcuguacggcugcguguggcuggacggccuggugagcuacaacgcccccgccggccagcaguucgugcugcccggcggcagcaucaucuaccugaacgacagcguguacgacggcgccgugggcuacagcaugaccgagggccugggccagcugaccgacggcgugagcggccuggacgacuucacccagacccacgaguaccacguguggcccggcuacgacuacgugggcuggagaaacgagagcgccaccaacggcuacaucgagaucauguucgaguucgacagaaucagaaacuucaccaccaugaaggugcacugcaacaacauguucgccaagggcgugaagaucuucaaggaggugcagugcuacuucagaagcgaggccagcgagugggagcccaacgccaucagcuucccccuggugcuggacgacgugaaccccagcgccagauucgugaccgugccccugcaccacagaauggccagcgccaucaagugccaguaccacuucgccgacaccuggaugauguucagcgagaucaccuuccagagcgacgccgccauguacaacaacagcgaggcccugcccaccagccccauggcccccaccaccuacgaccccaugcugaagguggacgacagcaacaccagaauccugaucggcugccugguggccaucaucuucauccugcuggccaucaucgugaucauccuguggagacaguucuggcagaagaugcuggagaaggccagcagaagaaugcuggacgacgagaugaccgugagccugagccugcccagcgacagcagcauguucaacaacaacagaagcagcagccccagcgagcagggcagcaacagcaccuacgacagaaucuucccccugagacccgacuaccaggagcccagcagacugaucagaaagcugcccgaguucgcccccggcgaggaggagagcggcugcagcggcguggugaagcccgugcagcccagcggccccgagggcgugccccacuacgccgaggccgacaucgugaaccugcagggcgugaccggcggcaacaccuacagcgugcccgccgugaccauggaccugcugagcggcaaggacguggccguggaggaguuccccagaaagcugcugaccuucaaggagaagcugggcgagggccaguucggcgaggugcaccugugcgagguggagggcauggagaaguucaaggacaaggacuucgcccuggacgugagcgccaaccagcccgugcugguggccgugaagaugcugagagccgacgccaacaagaacgccagaaacgacuuccugaaggagaucaagaucaugagcagacugaaggaccccaacaucauccaccugcuggccgugugcaucaccgacgacccccugugcaugaucaccgaguacauggagaacggcgaccugaaccaguuccugagcagacacgagccccccaacagcagcagcagcgacgugagaaccgugagcuacaccaaccugaaguucauggccacccagaucgccagcggcaugaaguaccugagcagccugaacuucgugcacagagaccuggccaccagaaacugccuggugggcaagaacuacaccaucaagaucgccgacuucggcaugagcagaaaccuguacagcggcgacuacuacagaauccagggcagagccgugcugcccaucagauggaugagcugggagagcauccugcugggcaaguucaccaccgccagcgacgugugggccuucggcgugacccugugggagaccuucaccuucugccaggagcagcccuacagccagcugagcgacgagcaggugaucgagaacaccggcgaguucuucagagaccagggcagacagaccuaccugccccagcccgccaucugccccgacagcguguacaagcugaugcugagcugcuggagaagagacaccaagaacagacccagcuuccaggagauccaccugcugcugcugcagcagggcgacgaguaa

SEQ ID NO: 16008 - RNA, 945 nt, Artificial Sequence
  DDRGK1__Homo_sapiens__NP_076424
augguggcccccgugugguaccugguggccgccgcccugcuggugggcuucauccuguuccugaccagaagcagaggcagagccgccagcgccggccaggagccccugcacaacgaggagcuggccggcgccggcagaguggcccagcccggcccccuggagcccgaggagcccagagccggcggcagacccagaagaagaagagaccugggcagcagacugcaggcccagagaagagcccagagaguggccugggccgaggccgacgagaacgaggaggaggccgugauccuggcccaggaggaggagggcguggagaagcccgccgagacccaccugagcggcaagaucggcgccaagaagcugagaaagcuggaggagaagcaggccagaaaggcccagagagaggccgaggaggccgagagagaggagagaaagagacuggagagccagagagaggccgaguggaagaaggaggaggagagacugagacuggaggaggagcagaaggaggaggaggagagaaaggccagagaggagcaggcccagagagagcacgaggaguaccugaagcugaaggaggccuucgugguggaggaggagggcgugggcgagaccaugaccgaggagcagagccagagcuuccugaccgaguucaucaacuacaucaagcagagcaagguggugcugcuggaggaccuggccagccaggugggccugagaacccaggacaccaucaacagaauccaggaccugcuggccgagggcaccaucaccggcgugaucgacgacagaggcaaguucaucuacaucacccccgaggagcuggccgccguggccaacuucaucagacagagaggcagagugagcaucgccgagcuggcccaggccagcaacagccugaucgccuggggcagagagagccccgcccaggcccccgccuaa

SEQ ID NO: 16009 - RNA, 357 nt, Artificial Sequence
  DDT__Homo_sapiens__NP_001077861
augcccuuccuggagcuggacaccaaccugcccgccaacagagugcccgccggccuggagaagagacugugcgccgccgccgccagcauccugggcaagcccgccgacagagugaacgugaccgugagacccggccuggccauggcccugagcggcagcaccgagcccugcgcccagcugagcaucagcagcaucggcguggugggcaccgccgaggacaacagaagccacagcgcccacuucuucgaguuccugaccaaggagcuggcccugggccaggacagaauccugaucagauucuucccccuggagagcuggcagaucggcaagaucggcaccgugaugaccuuccuguaa

SEQ ID NO: 16010 - RNA, 405 nt, Artificial Sequence
  DDTL__Homo_sapiens__NP_001077862
augcccuuccuggagcuggacaccaaccugcccgccaacagagugcccgccggccuggagaagagacugugcgccgccgccgccagcauccugggcaagcccgccgacagagugaacgugaccgugagacccggccuggccauggcccugagcggcagcaccgagcccugcgcccagcugagcaucagcagcaucggcguggugggcaccgccgaggacaacagaagccacagcgcccacuucuucgaguuccugaccaaggagcuggcccugggccaggacagauuccccaccgugcugagcaccagccccgccgcccacggcggccccagaugccccggcgagaucaucgagggcaagaagagcugccugaacgaggaggcccuguucaucuacuucaucuaa

SEQ ID NO: 16011 - RNA, 2628 nt, Artificial Sequence
  DDX10__Homo_sapiens__NP_004389
augggcaagaccgccaacagccccggcagcggcgccagacccgaccccgugagaagcuucaacagauggaagaagaagcacagccacagacagaacaagaagaagcagcugagaaagcagcugaagaagcccgaguggcagguggagagagagagcaucagcagacugaugcagaacuacgagaagaucaacgugaacgagaucaccagauucagcgacuucccccugagcaagaagacccugaagggccugcaggaggcccaguacagacuggugaccgagauccagaagcagaccaucggccuggcccugcagggcaaggacgugcugggcgccgccaagaccggcagcggcaagacccuggccuuccuggugcccgugcuggaggcccuguacagacugcaguggaccagcaccgacggccugggcgugcugaucaucagccccaccagagagcuggccuaccagaccuucgaggugcugagaaaggugggcaagaaccacgacuucagcgccggccugaucaucggcggcaaggaccugaagcacgaggccgagagaaucaacaacaucaacauccuggugugcacccccggcagacugcugcagcacauggacgagaccgugagcuuccacgccaccgaccugcagaugcuggugcuggacgaggccgacagaauccuggacaugggcuucgccgacaccaugaacgccgugaucgagaaccugcccaagaagagacagacccugcuguucagcgccacccagaccaagagcgugaaggaccuggccagacugagccugaagaaccccgaguacgugugggugcacgagaaggccaaguacagcacccccgccacccuggagcagaacuacaucgugugcgagcugcagcagaagaucagcgugcuguacagcuuccugagaagccaccugaagaagaagagcaucguguucuucagcagcugcaaggaggugcaguaccuguacagaguguucugcagacugagacccggcgugagcauccuggcccugcacggcagacagcagcagaugagaagaauggagguguacaacgaguucgugagaaagagagccgccgugcuguucgccaccgacaucgccgccagaggccuggacuuccccgccgugaacugggugcugcaguucgacugccccgaggacgccaacaccuacauccacagagccggcagaaccgccagauacaaggaggacggcgaggcccugcugauccugcugcccagcgagaaggccauggugcagcagcugcugcagaagaaggugcccgugaaggagaucaagaucaaccccgagaagcugaucgacgugcagaagaagcuggagagcauccuggcccaggaccaggaccugaaggagagagcccagagaugcuucgugagcuacgugagaagcguguaccugaugaaggacaaggagguguucgacgugagcaagcugcccauccccgaguacgcccugagccugggccuggccguggcccccagagugagauuccugcagaagaugcagaagcagcccaccaaggagcuggugagaagccaggccgacaaggugaucgagcccagagcccccagccugaccaacgacgagguggaggaguucagagccuacuucaacgagaagaugagcauccugcagaagggcggcaagagacuggagggcaccgagcacagacaggacaacgacaccggcaacgaggagcaggaggaggaggaggacgacgaggaggagauggaggagaagcuggccaaggccaagggcagccaggcccccagccugcccaacaccagcgaggcccagaagaucaaggaggugcccacccaguuccuggacagagacgaggaggaggaggacgccgacuuccugaaggugaagagacacaacguguucggccuggaccugaaggacgagaagacccugcagaagaaggagcccagcaagagcagcaucaagaagaagaugaccaagguggccgaggccaagaaggugaugaagagaaacuucaaggugaacaagaagaucaccuucaccgacgagggcgagcuggugcagcaguggccccagaugcagaagagcgccaucaaggacgccgaggaggacgacgacaccggcggcaucaaccugcacaaggccaaggagagacugcaggaggaggacaaguucgacaaggaggaguacagaaagaagaucaaggccaagcacagagagaagagacugaaggagagagaggccagaagagaggccaacaagagacaggccaaggccaaggacgaggaggaggccuuccuggacuggagcgacgacgacgacgacgacgacgacggcuucgaccccagcacccugcccgaccccgacaaguacagaagcagcgaggacagcgacagcgaggacauggagaacaagaucagcgacaccaagaagaagcagggcaugaagaagagaagcaacagcgagguggaggacgugggccccaccagccacaacagaaagaaggccagaugggacacccuggagccccuggacaccggccugagccuggccgaggacgaggagcuggugcugcaccugcugagaagccagagcuaa

SEQ ID NO: 16012 - RNA, 2643 nt, Artificial Sequence
  DDX11__Homo_sapiens__NP_001244074
auggccgagcuguacagagugcuggaggccggcaagaucggcaucuucgagagccccaccggcaccggcaagagccugagccugaucugcggcgcccugagcuggcugagagacuucgagcagaagaagagagaggaggaggccagacugcuggagaccggcaccggcccccugcacgacgagaaggacgagagccugugccugagcagcagcugcgagggcgccgccggcacccccagacccgccggcgagcccgccugggugacccaguucgugcagaagaaggaggagagagaccugguggacagacugaaggccgagcaggccagaagaaagcagagagaggagagacugcagcagcugcagcacagagugcagcugaaguacgccgccaagagacugagacaggaggaggaggagagagagaaccugcugagacugagcagagagaugcuggagaccggccccgaggccgagagacuggagcagcuggagagcggcgaggaggagcuggugcuggccgaguacgagagcgacgaggagaagaagguggccagcagaguggacgaggacgaggacgaccuggaggaggagcacaucaccaagaucuacuacugcagcagaacccacagccagcuggcccaguucgugcacgaggugaagaagagccccuucggcaaggacgugagacuggugagccugggcagcagacagaaccugugcgugaacgaggacgugaagagccugggcagcgugcagcugaucaacgacagaugcguggacaugcagagaagcagacacgagaagaagaagggcgccgaggaggagaagcccaagagaagaagacaggagaagcaggccgccugccccuucuacaaccacgagcagaugggccugcugagagacgaggcccuggccgaggugaaggacauggagcagcugcuggcccugggcaaggaggccagagccugccccuacuacggcagcagacuggccauccccgccgcccagcugguggugcugcccuaccagaugcugcugcacgccgccaccagacaggccgccggcaucagacugcaggaccagguggugaucaucgacgaggcccacaaccugaucgacaccaucaccggcaugcacagcguggaggugagcggcagccagcugugccaggcccacagccagcugcugcaguacguggagagauacggcaagagacugaaggccaagaaccugauguaccugaagcagauccuguaccugcuggagaaguucguggccgugcugggcggcaacaucaagcagaaccccaacacccagagccugagccagaccggcaccgagcugaagaccaucaacgacuuccuguuccagagccagaucgacaacaucaaccuguucaaggugcagagauacugcgagaagagcaugaucagcagaaagcuguucggcuucaccgagagauacggcgccguguucagcagcagagagcagcccaagcuggccggcuuccagcaguuccugcagagccugcagcccagaaccaccgaggcccuggccgcccccgccgacgagagccaggccagcacccugagacccgccagcccccugaugcacauccagggcuuccuggccgcccugaccaccgccaaccaggacggcagagugauccugagcagacagggcagccugagccagagcacccugaaguuccugcugcugaaccccgccgugcacuucgcccagguggugaaggagugcagagccguggugaucgccggcggcaccaugcagcccgugagcgacuucagacagcagcugcuggccugcgccggcguggaggccgagagagugguggaguucagcugcggccacgugaucccccccgacaacauccugccccuggugaucugcagcggcaucagcaaccagccccuggaguucaccuuccagaagagagagcugccccagaugauggacgaggugggcagaauccugugcaaccugugcggcguggugcccggcggcguggugugcuucuuccccagcuacgaguaccugagacaggugcacgcccacugggagaagggcggccugcugggcagacuggccgccagaaagaagaucuuccaggagcccaagagcgcccaccagguggagcaggugcugcuggccuacagcagaugcauccaggccugcggccaggagagaggccaggugaccggcgcccugcugcugagcguggugggcggcaagaugagcgagggcaucaacuucagcgacaaccugggcagaugcguggugauggugggcaugcccuuccccaacaucagaagcgccgagcugcaggagaagauggccuaccuggaccagacccugcccagagcccccggccaggccccccccggcaaggcccugguggagaaccugugcaugaaggccgugaaccagagcaucggcagagccaucagacaccagaaggacuucgccagcguggugcugcuggaccagagauacgccagaccccccgugcuggccaagcugcccgccuggaucagagccagaguggaggugaaggccaccuucggccccgccaucgccgccgugcagaaguuccacagagagaagagcgccagcagcuaa

SEQ ID NO: 16013 - RNA, 2196 nt, Artificial Sequence
  DDX17__Homo_sapiens__NP_001091974
augcccaccggcuucguggcccccauccugugcgugcugcugcccagccccaccagagaggccgccaccguggccagcgccaccggcgacagcgccagcgagagagagagcgccgcccccgccgccgcccccaccgccgaggcccccccccccagcguggugaccagacccgagccccaggcccugcccagccccgccaucagagccccccugcccgaccuguaccccuucggcaccaugagaggcggcggcuucggcgacagagacagagacagagacagaggcggcuucggcgccagaggcggcggcggccugccccccaagaaguucggcaaccccggcgagagacugagaaagaagaagugggaccugagcgagcugcccaaguucgagaagaacuucuacguggagcaccccgagguggccagacugacccccuacgagguggacgagcugagaagaaagaaggagaucaccgugagaggcggcgacgugugccccaagcccguguucgccuuccaccacgccaacuucccccaguacgugauggacgugcugauggaccagcacuucaccgagcccacccccauccagugccagggcuucccccuggcccugagcggcagagacauggugggcaucgcccagaccggcagcggcaagacccuggccuaccugcugcccgccaucgugcacaucaaccaccagcccuaccuggagagaggcgacggccccaucugccuggugcuggcccccaccagagagcuggcccagcaggugcagcagguggccgacgacuacggcaagugcagcagacugaagagcaccugcaucuacggcggcgcccccaagggcccccagaucagagaccuggagagaggcguggagaucugcaucgccacccccggcagacugaucgacuuccuggagagcggcaagaccaaccugagaagaugcaccuaccuggugcuggacgaggccgacagaaugcuggacaugggcuucgagccccagaucagaaagaucguggaccagaucagacccgacagacagacccugauguggagcgccaccuggcccaaggaggugagacagcuggccgaggacuuccugagagacuacacccagaucaacgugggcaaccuggagcugagcgccaaccacaacauccugcagaucguggacgugugcauggagagcgagaaggaccacaagcugauccagcugauggaggagaucauggccgagaaggagaacaagaccaucaucuucguggagaccaagagaagaugcgacgaccugaccagaagaaugagaagagacggcuggcccgccaugugcauccacggcgacaagagccagcccgagagagacugggugcugaacgaguucagaagcggcaaggcccccauccugaucgccaccgacguggccagcagaggccuggacguggaggacgugaaguucgugaucaacuacgacuaccccaacagcagcgaggacuacgugcacagaaucggcagaaccgccagaagcaccaacaagggcaccgccuacaccuucuucacccccggcaaccugaagcaggccagagagcugaucaaggugcuggaggaggccaaccaggccaucaaccccaagcugaugcagcugguggaccacagaggcggcggcggcggcggcggcaagggcggcagaagcagauacagaaccaccagcagcgccaacaaccccaaccugauguaccaggacgagugcgacagaagacugagaggcgugaaggacggcggcagaagagacagcgccagcuacagagacagaagcgagaccgacagagccggcuacgccaacggcagcggcuacggcagccccaacagcgccuucggcgcccaggccggccaguacaccuacggccagggcaccuacggcgccgccgccuacggcaccagcagcuacaccgcccaggaguacggcgccggcaccuacggcgccagcagcaccaccagcaccggcagaagcagccagagcagcagccagcaguucagcggcaucggcagaagcggccagcagccccagccccugaugagccagcaguucgcccagccccccggcgccaccaacaugaucggcuacaugggccagaccgccuaccaguaccccccccccccccccccccccccccccagcagaaaguaa

SEQ ID NO: 16014 - RNA, 2013 nt, Artificial Sequence
  DDX18__Homo_sapiens__NP_006764
augagccaccugcccaugaagcugcugagaaagaagaucgagaagagaaaccugaagcugagacagagaaaccugaaguuccagggcgccagcaaccugacccugagcgagacccagaacggcgacgugagcgaggagaccaugggcagcagaaaggugaagaagagcaagcagaagcccaugaacgugggccugagcgagacccagaacggcggcaugagccaggaggccgugggcaacaucaaggugaccaagagcccccagaagagcaccgugcugaccaacggcgaggccgccaugcagagcagcaacagcgagagcaagaagaagaagaagaagaagagaaagauggugaacgacgccgagcccgacaccaagaaggccaagaccgagaacaagggcaagagcgaggaggagagcgccgagaccaccaaggagaccgagaacaacguggagaagcccgacaacgacgaggacgagagcgaggugcccagccugccccugggccugaccggcgccuucgaggacaccagcuucgccagccugugcaaccuggugaacgagaacacccugaaggccaucaaggagaugggcuucaccaacaugaccgagauccagcacaagagcaucagaccccugcuggagggcagagaccugcuggccgccgccaagaccggcagcggcaagacccuggccuuccugauccccgccguggagcugaucgugaagcugagauucaugcccagaaacggcaccggcgugcugauccugagccccaccagagagcuggccaugcagaccuucggcgugcugaaggagcugaugacccaccacgugcacaccuacggccugaucaugggcggcagcaacagaagcgccgaggcccagaagcugggcaacggcaucaacaucaucguggccacccccggcagacugcuggaccacaugcagaacacccccggcuucauguacaagaaccugcagugccuggugaucgacgaggccgacagaauccuggacgugggcuucgaggaggagcugaagcagaucaucaagcugcugcccaccagaagacagaccaugcuguucagcgccacccagaccagaaagguggaggaccuggccagaaucagccugaagaaggagccccuguacgugggcguggacgacgacaaggccaacgccaccguggacggccuggagcagggcuacguggugugccccagcgagaagagauuccugcugcuguucaccuuccugaagaagaacagaaagaagaagcugaugguguucuucagcagcugcaugagcgugaaguaccacuacgagcugcugaacuacaucgaccugcccgugcuggccauccacggcaagcagaagcagaacaagagaaccaccaccuucuuccaguucugcaacgccgacagcggcacccugcugugcaccgacguggccgccagaggccuggacauccccgagguggacuggaucgugcaguacgacccccccgacgaccccaaggaguacauccacagagugggcagaaccgccagaggccugaacggcagaggccacgcccugcugauccugagacccgaggagcugggcuuccugagauaccugaagcagagcaaggugccccugagcgaguucgacuucagcuggagcaagaucagcgacauccagagccagcuggagaagcugaucgagaagaacuacuuccugcacaagagcgcccaggaggccuacaagagcuacaucagagccuacgacagccacagccugaagcagaucuucaacgugaacaaccugaaccugccccagguggcccugagcuucggcuucaaggugccccccuucguggaccugaacgugaacagcaacgagggcaagcagaagaagagaggcggcggcggcggcuucggcuaccagaagaccaagaagguggagaagagcaagaucuucaagcacaucagcaagaagagcagcgacagcagacaguucagccacuaa

SEQ ID NO: 16015 - RNA, 1437 nt, Artificial Sequence
  DDX19A__Homo_sapiens__NP_060802
auggccaccgacagcugggcccuggccguggacgagcaggaggccgccgugaagagcaugaccaaccugcagaucaaggaggagaaggugaaggccgacaccaacggcaucaucaagaccagcaccaccgccgagaagaccgacgaggaggagaaggaggacagagccgcccagagccugcugaacaagcugaucagaagcaaccugguggacaacaccaaccagguggaggugcugcagagagaccccaacagcccccuguacagcgugaagagcuucgaggagcugagacugaagccccagcugcugcagggcguguacgccaugggcuucaacagacccagcaagauccaggagaacgcccugcccaugaugcuggccgagcccccccagaaccugaucgcccagagccagagcggcaccggcaagaccgccgccuucgugcuggccaugcugagcagaguggagcccagcgacagauacccccagugccugugccugagccccaccuacgagcuggcccugcagaccggcaaggugaucgagcagaugggcaaguucuaccccgagcugaagcuggccuacgccgugagaggcaacaagcuggagagaggccagaagaucagcgagcagaucgugaucggcacccccggcaccgugcuggacuggugcagcaagcugaaguucaucgaccccaagaagaucaagguguucgugcuggacgaggccgacgugaugaucgccacccagggccaccaggaccagagcaucagaauccagagaaugcugcccagaaacugccagaugcugcuguucagcgccaccuucgaggacagcguguggaaguucgcccagaagguggugcccgaccccaacgugaucaagcugaagagagaggaggagacccuggacaccaucaagcaguacuacgugcugugcagcagcagagacgagaaguuccaggcccugugcaaccuguacggcgccaucaccaucgcccaggccaugaucuucugccacaccagaaagaccgccagcuggcuggccgccgagcugagcaaggagggccaccagguggcccugcugagcggcgagaugaugguggagcagagagccgccgugaucgagagauucagagagggcaaggagaaggugcuggugaccaccaacgugugcgccagaggcaucgacguggagcaggugagcguggugaucaacuucgaccugcccguggacaaggacggcaaccccgacaacgagaccuaccugcacagaaucggcagaaccggcagauucggcaagagaggccuggccgugaacaugguggacagcaagcacagcaugaacauccugaacagaauccaggagcacuucaacaagaagaucgagagacuggacaccgacgaccuggacgagaucgagaagaucgccaacuaa

SEQ ID NO: 16016 - RNA, 2223 nt, Artificial Sequence
  DDX1__Homo_sapiens__NP_004930
auggccgccuucagcgagaugggcgugaugcccgagaucgcccaggccguggaggagauggacuggcugcugcccaccgacauccaggccgagagcaucccccugauccugggcggcggcgacgugcugauggccgccgagaccggcagcggcaagaccggcgccuucagcauccccgugauccagaucguguacgagacccugaaggaccagcaggagggcaagaagggcaagaccaccaucaagaccggcgccagcgugcugaacaaguggcagaugaaccccuacgacagaggcagcgccuucgccaucggcagcgacggccugugcugccagagcagagaggugaaggaguggcacggcugcagagccaccaagggccugaugaagggcaagcacuacuacgaggugagcugccacgaccagggccugugcagagugggcuggagcaccaugcaggccagccuggaccugggcaccgacaaguucggcuucggcuucggcggcaccggcaagaagagccacaacaagcaguucgacaacuacggcgaggaguucaccaugcacgacaccaucggcugcuaccuggacaucgacaagggccacgugaaguucagcaagaacggcaaggaccugggccuggccuucgagauccccccccacaugaagaaccaggcccuguuccccgccugcgugcugaagaacgccgagcugaaguucaacuucggcgaggaggaguucaaguucccccccaaggacggcuucguggcccugagcaaggcccccgacggcuacaucgugaagagccagcacagcggcaacgcccaggugacccagaccaaguuccugcccaacgcccccaaggcccugaucguggagcccagcagagagcuggccgagcagacccugaacaacaucaagcaguucaagaaguacaucgacaaccccaagcugagagagcugcugaucaucggcggcguggccgccagagaccagcugagcgugcuggagaacggcguggacaucguggugggcacccccggcagacuggacgaccuggugagcaccggcaagcugaaccugagccaggugagauuccuggugcuggacgaggccgacggccugcugagccagggcuacagcgacuucaucaacagaaugcacaaccagaucccccaggugaccagcgacggcaagagacugcaggugaucgugugcagcgccacccugcacagcuucgacgugaagaagcugagcgagaagaucaugcacuuccccaccuggguggaccugaagggcgaggacagcgugcccgacaccgugcaccacgugguggugcccgugaaccccaagaccgacagacugugggagagacugggcaagagccacaucagaaccgacgacgugcacgccaaggacaacaccagacccggcgccaacagccccgagauguggagcgaggccaucaagauccugaagggcgaguacgccgugagagccaucaaggagcacaagauggaccaggccaucaucuucugcagaaccaagaucgacugcgacaaccuggagcaguacuucauccagcagggcggcggccccgacaagaagggccaccaguucagcugcgugugccugcacggcgacagaaagccccacgagagaaagcagaaccuggagagauucaagaagggcgacgugagauuccugaucugcaccgacguggccgccagaggcaucgacauccacggcgugcccuacgugaucaacgugacccugcccgacgagaagcagaacuacgugcacagaaucggcagagugggcagagccgagagaaugggccuggccaucagccugguggccaccgagaaggagaaggugugguaccacgugugcagcagcagaggcaagggcugcuacaacaccagacugaaggaggacggcggcugcaccaucugguacaacgagaugcagcugcugagcgagaucgaggagcaccugaacugcaccaucagccagguggagcccgacaucaaggugcccguggacgaguucgacggcaaggugaccuacggccagaagagagccgccggcggcggcagcuacaagggccacguggacauccuggcccccaccgugcaggagcuggccgcccuggagaaggaggcccagaccagcuuccugcaccugggcuaccugcccaaccagcuguucagaaccuucuaa

SEQ ID NO: 16017 - RNA, 2352 nt, Artificial Sequence
  DDX21__Homo_sapiens__NP_004719
augcccggcaagcugagaagcgacgccggccuggagagcgacaccgccaugaagaagggcgagacccugagaaagcagaccgaggagaaggagaagaaggagaagcccaagagcgacaagaccgaggagaucgccgaggaggaggagaccguguuccccaaggccaagcaggugaagaagaaggccgagcccagcgagguggacaugaacagccccaagagcaagaaggccaagaagaaggaggagcccagccagaacgacaucagccccaagaccaagagccugagaaagaagaaggagcccaucgagaagaagguggugagcagcaagaccaagaaggugaccaagaacgaggagcccagcgaggaggagaucgacgcccccaagcccaagaagaugaagaaggagaaggagaugaacggcgagaccagagagaagagccccaagcugaagaacggcuucccccaccccgagcccgacugcaaccccagcgaggccgccagcgaggagagcaacagcgagaucgagcaggagauccccguggagcagaaggagggcgccuucagcaacuuccccaucagcgaggagaccaucaagcugcugaagggcagaggcgugaccuuccuguuccccauccaggccaagaccuuccaccacguguacagcggcaaggaccugaucgcccaggccagaaccggcaccggcaagaccuucagcuucgccaucccccugaucgagaagcugcacggcgagcugcaggacagaaagagaggcagagccccccaggugcuggugcuggcccccaccagagagcuggccaaccaggugagcaaggacuucagcgacaucaccaagaagcugagcguggccugcuucuacggcggcacccccuacggcggccaguucgagagaaugagaaacggcaucgacauccuggugggcacccccggcagaaucaaggaccacauccagaacggcaagcuggaccugaccaagcugaagcacguggugcuggacgagguggaccagaugcuggacaugggcuucgccgaccagguggaggagauccugagcguggccuacaagaaggacagcgaggacaacccccagacccugcuguucagcgccaccugcccccacuggguguucaacguggccaagaaguacaugaagagcaccuacgagcagguggaccugaucggcaagaagacccagaagaccgccaucaccguggagcaccuggccaucaagugccacuggacccagagagccgccgugaucggcgacgugaucagaguguacagcggccaccagggcagaaccaucaucuucugcgagaccaagaaggaggcccaggagcugagccagaacagcgccaucaagcaggacgcccagagccugcacggcgacaucccccagaagcagagagagaucacccugaagggcuucagaaacggcagcuucggcgugcugguggccaccaacguggccgccagaggccuggacauccccgagguggaccuggugauccagagcagcccccccaaggacguggagagcuacauccacagaagcggcagaaccggcagagccggcagaaccggcgugugcaucugcuucuaccagcacaaggaggaguaccagcuggugcagguggagcagaaggccggcaucaaguucaagagaaucggcgugcccagcgccaccgagaucaucaaggccagcagcaaggacgccaucagacugcuggacagcgugccccccaccgccaucagccacuucaagcagagcgccgagaagcugaucgaggagaagggcgccguggaggcccuggccgccgcccuggcccacaucagcggcgccaccagcguggaccagagaagccugaucaacagcaacgugggcuucgugaccaugauccugcagugcagcaucgagaugcccaacaucagcuacgccuggaaggagcugaaggagcagcugggcgaggagaucgacagcaaggugaagggcaugguguuccugaagggcaagcugggcgugugcuucgacgugcccaccgccagcgugaccgagauccaggagaaguggcacgacagcagaagauggcagcugagcguggccaccgagcagcccgagcuggagggccccagagagggcuacggcggcuucagaggccagagagagggcagcagaggcuucagaggccagagagacggcaacagaagauucagaggccagagagagggcagcagaggccccagaggccagagaagcggcggcggcaacaagagcaacagaagccagaacaagggccagaagagaagcuucagcaaggccuucggccaguaa

SEQ ID NO: 16018 - RNA, 1452 nt, Artificial Sequence
  DDX25__Homo_sapiens__NP_037396
auggccagccugcuguggggcggcgacgccggcgccgccgagagcgagagacugaacagccacuucagcaaccugagccagcccagaaagaaccuguggggcaucaagagcaccgccgugagaaacaucgacggcagcaucaacaacaucaacgaggacgacgaggaggacgugguggaccuggccgccaacagccugcugaacaagcugauccaccagagccugguggagagcagccacagaguggaggugcugcagaaggaccccagcagcccccuguacagcgugaagaccuucgaggagcugagacugaaggaggagcugcugaagggcaucuacgccaugggcuucaacagacccagcaagauccaggagauggcccugcccaugaugcuggcccaccccccccagaaccugaucgcccagagccagagcggcaccggcaagaccgccgccuucgugcuggccaugcugagcagagugaacgcccuggagcuguucccccagugccugugccuggcccccaccuacgagcuggcccugcagaccggcagagugguggagcagaugggcaaguucugcguggacgugcaggugauguacgccaucagaggcaacagaauccccagaggcaccgacaucaccaagcagaucaucaucggcacccccggcaccgugcuggacuggugcuucaagcugaagcugaucgaccugaccaagaucagaguguucgugcuggacgaggccgacgugaugaucgacacccagggcuucagcgaccacagcaucagaauccagagagcccugcccagcgagugccagaugcugcuguucagcgccaccuucgaggacagcguguggcacuucgccgagagaaucauccccgaccccaacgugaucaagcugagaaaggaggagcugacccugaacaacaucagacaguacuacgugcugugcgagcacagaaaggacaaguaccaggcccugugcaacaucuacggcagcaucaccaucggccaggccaucaucuucugccagaccagaagaaacgccaaguggcugaccguggagaugauccaggacggccaccaggugagccugcugagcggcgagcugaccguggagcagagagccagcaucauccagagauucagagacggcaaggagaaggugcugaucaccaccaacgugugcgccagaggcaucgacgugaagcaggugaccaucguggugaacuucgaccugcccgugaagcagggcgaggagcccgacuacgagaccuaccugcacagaaucggcagaaccggcagauucggcaagaagggccuggccuucaacaugaucgagguggacgagcugcccagccugaugaagauccaggaccacuucaacagcagcaucaagcagcugaacgccgaggacauggacgagaucgagaagaucgacuacuaa

SEQ ID NO: 16019 - RNA, 2391 nt, Artificial Sequence
  DDX27__Homo_sapiens__NP_060365
auggugcuggcccagagaagaagaggcggcugcgagaagcugagagccggcccccaggccgugcuggccagcggcagcggcuucugcgacaacaugcuggccgaccugggccugaucggcaccaucggcgaggacgacgaggugcccguggagcccgagagcgacagcggcgacgaggaggaggagggccccaucgugcugggcagaagacagaaggcccugggcaagaacagaagcgccgacuucaaccccgacuucguguucaccgagaaggagggcaccuacgacggcagcugggcccuggccgacgugaugagccagcugaagaagaagagagccgccaccacccuggacgagaagaucgagaaggugagaaagaagagaaagaccgaggacaaggaggccaagagcggcaagcuggagaaggagaaggaggccaaggagggcagcgagcccaaggagcaggaggaccugcaggagaacgacgaggagggcagcgaggacgaggccagcgagaccgacuacagcagcgccgacgagaacauccugaccaaggccgacacccugaaggugaaggacagaaagaagaagaagaagaagggccaggaggccggcggcuucuucgaggacgccagccaguacgacgagaaccugagcuuccaggacaugaaccugagcagaccccugcugaaggccaucaccgccaugggcuucaagcagcccacccccauccagaaggccugcauccccgugggccugcugggcaaggacaucugcgccugcgccgccaccggcaccggcaagaccgccgccuucgcccugcccgugcuggagagacugaucuacaagcccagacaggcccccgugaccagagugcuggugcuggugcccaccagagagcugggcauccaggugcacagcgugaccagacagcuggcccaguucugcaacaucaccaccugccuggccgugggcggccuggacgugaagagccaggaggccgcccugagagccgcccccgacauccugaucgccacccccggcagacugaucgaccaccugcacaacugccccagcuuccaccugagcagcaucgaggugcugauccuggacgaggccgacagaaugcuggacgaguacuucgaggagcagaugaaggagaucaucagaaugugcagccaccacagacagaccaugcuguucagcgccaccaugaccgacgaggugaaggaccuggccagcgugagccugaagaaccccgugagaaucuucgugaacagcaacaccgacguggcccccuuccugagacaggaguucaucagaaucagacccaacagagagggcgacagagaggccaucguggccgcccugcugaccagaaccuucaccgaccacgugaugcuguucacccagaccaagaagcaggcccacagaaugcacauccugcugggccugaugggccugcaggugggcgagcugcacggcaaccugagccagacccagagacuggaggcccugagaagauucaaggacgagcagaucgacauccugguggccaccgacguggccgccagaggccuggacaucgagggcgugaagaccgugaucaacuucaccaugcccaacaccaucaagcacuacgugcacagagugggcagaaccgccagagccggcagagccggcagaagcgugagccuggugggcgaggacgagagaaagaugcugaaggagaucgugaaggccgccaaggcccccgugaaggccagaauccugccccaggacgugauccugaaguucagagacaagaucgagaagauggagaaggacguguacgccgugcugcagcuggaggccgaggagaaggagaugcagcagagcgaggcccagaucaacaccgccaagagacugcuggagaagggcaaggaggccguggugcaggagcccgagagaagcugguuccagaccaaggaggagagaaagaaggagaagaucgccaaggcccugcaggaguucgaccuggcccugagaggcaagaagaagagaaagaaguucaugaaggacgccaagaagaagggcgagaugaccgccgaggagagaagccaguucgagauccugaaggcccagauguucgccgagagacuggccaagagaaacagaagagccaagagagccagagccaugcccgaggaggagcccgugagaggccccgccaagaagcagaagcagggcaagaagagcguguucgacgaggagcugaccaacaccagcaagaaggcccugaagcaguacagagccggccccagcuucgaggagagaaagcagcugggccugccccaccagagaagaggcggcaacuucaagagcaagagcagauacaagagaagaaaguaa

SEQ ID NO: 16020 - RNA, 1623 nt, Artificial Sequence
  DDX28__Homo_sapiens__NP_060850
auggcccugaccagacccgugagacuguucagccuggugaccagacugcugcuggcccccagaagaggccugaccgugagaagccccgacgagccccugcccguggugagaauccccguggcccugcagagacagcuggagcagagacagagcagaagaagaaaccugcccagacccgugcuggugagacccggcccccugcuggugagcgccagaagacccgagcugaaccagcccgccagacugacccugggcagaugggagagagccccccuggccagccagggcuggaagagcagaagagccagaagagaccacuucagcaucgagagagcccagcaggaggcccccgccgugagaaagcugagcagcaagggcagcuucgccgaccugggccuggagcccagagugcugcacgcccugcaggaggccgcccccgagguggugcagcccaccaccgugcagagcagcaccauccccagccugcugagaggcagacacguggugugcgccgccgagaccggcagcggcaagacccugagcuaccugcugccccugcugcagagacugcugggccagcccagccuggacagccugcccauccccgcccccagaggccuggugcuggugcccagcagagagcuggcccagcaggugagagccguggcccagccccugggcagaagccugggccugcuggugagagaccuggagggcggccacggcaugagaagaaucagacugcagcugagcagacagcccagcgccgacgugcugguggccacccccggcgcccuguggaaggcccugaagagcagacugaucagccuggagcagcugagcuuccuggugcuggacgaggccgacacccugcuggacgagagcuuccuggagcugguggacuacauccuggagaagagccacaucgccgagggccccgccgaccuggaggaccccuucaaccccaaggcccagcuggugcuggugggcgccaccuuccccgagggcgugggccagcugcugaacaagguggccagccccgacgccgugaccaccaucaccagcagcaagcugcacugcaucaugccccacgugaagcagaccuuccugagacugaagggcgccgacaagguggccgagcuggugcacauccugaagcacagagacagagccgagagaaccggccccagcggcaccgugcugguguucugcaacagcagcagcaccgugaacuggcugggcuacauccuggacgaccacaagauccagcaccugagacugcagggccagaugcccgcccugaugagagugggcaucuuccagagcuuccagaagagcagcagagacauccugcugugcaccgacaucgccagcagaggccuggacagcaccggcguggagcugguggugaacuacgacuucccccccacccugcaggacuacauccacagagccggcagagugggcagagugggcagcgaggugcccggcaccgugaucagcuucgugacccaccccugggacgugagccuggugcagaagaucgagcuggccgccagaagaagaagaagccugcccggccuggccagcagcgugaaggagccccugccccaggccaccuaa

SEQ ID NO: 16021 - RNA, 2556 nt, Artificial Sequence
  DDX31__Homo_sapiens__NP_073616
auggcccccgaccuggccagccagagacacagcgagagcuuccccagcgugaacagcagacccaacgugauccugcccggcagagagggcagaagagagggccugccccccggcggcggcaccagaggcagccuggugcccaccagacccgugccccccagccccgccccccugggcaccagccccuacagcuggagcagaagcggccccggcagaggcggcggcgccggcagcagcagagugcccagaggcgugcccggccccgccgugugcgcccccggcagccugcugcaccacgccagccccacccagaccauggccgccgccgacggcagccuguucgacaaccccagaaccuucagcagaagaccccccgcccaggccagcagacaggccaaggccaccaagagaaaguaccaggccagcagcgaggccccccccgccaagagaagaaacgagaccagcuuccugcccgccaagaagaccagcgugaaggagacccagagaaccuucaagggcaacgcccagaagauguucagccccaagaagcacagcgugagcaccagcgacagaaaccaggaggagagacagugcaucaagaccagcagccuguucaagaacaaccccgacauccccgagcugcacagacccguggugaagcaggugcaggagaagguguucaccagcgccgccuuccacgagcugggccugcacccccaccugaucagcaccaucaacaccgugcugaagaugagcagcaugaccagcgugcagaagcagagcauccccgugcugcuggagggcagagacgcccuggugagaagccagaccggcagcggcaagacccuggccuacugcauccccguggugcagagccugcaggccauggagagcaagauccagagaagcgacggccccuacgcccuggugcuggugcccaccagagagcuggcccugcagagcuucgacaccgugcagaagcugcugaagcccuucaccuggaucgugcccggcgugcugaugggcggcgagaagagaaagagcgagaaggccagacugagaaagggcaucaacauccugaucagcacccccggcagacugguggaccacaucaagagcaccaagaacauccacuucagcagacugagauggcugguguucgacgaggccgacagaauccuggaccugggcuucgagaaggacaucaccgugauccugaacgccgugaacgccgagugccagaagagacagaacgugcugcugagcgccacccugaccgagggcgugaccagacuggccgacaucagccugcacgaccccgugagcaucagcgugcuggacaagagccacgaccagcugaaccccaaggacaaggccgugcaggaggugugccccccccccgccggcgacaagcuggacagcuucgccauccccgagagccugaagcagcacgugaccguggugcccagcaagcugagacuggugugccuggccgccuucauccugcagaagugcaaguucgaggaggaccagaagauggugguguucuucagcagcugcgagcugguggaguuccacuacagccuguuccugcagacccugcugagcagcagcggcgcccccgccagcggccagcugcccagcgccagcaugagacugaaguuccugagacugcacggcggcauggagcaggaggagagaaccgccguguuccaggaguucagccacagcagaagaggcgugcugcugugcaccgacguggccgccagaggccuggaccugccccaggugaccuggaucgugcaguacaacgcccccagcagccccgccgaguacauccacagaaucggcagaaccgccagaaucggcugccacggcagcagccugcugauccuggcccccagcgaggccgaguacgugaacagccuggccagccacaagaucaacgugagcgagaucaagauggaggacauccugugcgugcugaccagagacgacugcuucaagggcaagagauggggcgcccagaagagccacgccgugggcccccaggagaucagagagagagccaccgugcugcagaccguguucgaggacuacgugcacagcagcgagagaagagugagcugggccaagaaggcccugcagagcuucauccaggccuacgccaccuaccccagagagcugaagcacaucuuccacgugagaagccugcaccugggccacguggccaagagcuucggccugagagacgcccccagaaaccugagcgcccugaccagaaagaagagaaaggcccacgugaagagacccgaccugcacaagaagacccagagcaagcacagccuggccgagauccugagaagcgaguacagcagcggcauggaggccgacaucgccaaggugaagaagcagaacgcccccggcgagcccggcggcagaccccugcagcacagccugcagcccacccccugcuucggcagaggcaagacccugaaguggagaaagacccagaagggcgugcagagagacagcaagaccagccagaagguguaa

SEQ ID NO: 16022 - RNA, 1284 nt, Artificial Sequence
  DDX39A__Homo_sapiens__NP_005795
auggccgagcaggacguggagaacgaccugcuggacuacgacgaggaggaggagccccaggccccccaggagagcacccccgccccccccaagaaggacaucaagggcagcuacgugagcauccacagcagcggcuucagagacuuccugcugaagcccgagcugcugagagccaucguggacugcggcuucgagcaccccagcgaggugcagcacgagugcaucccccaggccauccugggcauggacgugcugugccaggccaagagcggcaugggcaagaccgccguguucgugcuggccacccugcagcagaucgagcccgugaacggccaggugaccgugcuggugaugugccacaccagagagcuggccuuccagaucagcaaggaguacgagagauucagcaaguacaugcccagcgugaaggugagcguguucuucggcggccugagcaucaagaaggacgaggaggugcugaagaagaacugcccccacgugguggugggcacccccggcagaauccuggcccuggugagaaacagaagcuucagccugaagaacgugaagcacuucgugcuggacgagugcgacaagaugcuggagcagcuggacaugagaagagacgugcaggagaucuucagacugaccccccacgagaagcagugcaugauguucagcgccacccugagcaaggacaucagacccgugugcagaaaguucaugcaggaccccauggagguguucguggacgacgagaccaagcugacccugcacggccugcagcaguacuacgugaagcugaaggacagcgagaagaacagaaagcuguucgaccugcuggacgugcuggaguucaaccaggugaucaucuucgugaagagcgugcagagaugcauggcccuggcccagcugcugguggagcagaacuuccccgccaucgccauccacagaggcauggcccaggaggagagacugagcagauaccagcaguucaaggacuuccagagaagaauccugguggccaccaaccuguucggcagaggcauggacaucgagagagugaacaucguguucaacuacgacaugcccgaggacagcgacaccuaccugcacagaguggccagagccggcagauucggcaccaagggccuggccaucaccuucgugagcgacgagaacgacgccaagauccugaacgacgugcaggacagauucgaggugaacguggccgagcugcccgaggagaucgacaucagcaccuacaucgagcagagcagauaa

SEQ ID NO: 16023 - RNA, 1287 nt, Artificial Sequence
  DDX39B__Homo_sapiens__NP_542165
auggccgagaacgacguggacaacgagcugcuggacuacgaggacgacgagguggagaccgccgccggcggcgacggcgccgaggcccccgccaagaaggacgugaagggcagcuacgugagcauccacagcagcggcuucagagacuuccugcugaagcccgagcugcugagagccaucguggacugcggcuucgagcaccccagcgaggugcagcacgagugcaucccccaggccauccugggcauggacgugcugugccaggccaagagcggcaugggcaagaccgccguguucgugcuggccacccugcagcagcuggagcccgugaccggccaggugagcgugcuggugaugugccacaccagagagcuggccuuccagaucagcaaggaguacgagagauucagcaaguacaugcccaacgugaagguggccguguucuucggcggccugagcaucaagaaggacgaggaggugcugaagaagaacugcccccacaucguggugggcacccccggcagaauccuggcccuggccagaaacaagagccugaaccugaagcacaucaagcacuucauccuggacgagugcgacaagaugcuggagcagcuggacaugagaagagacgugcaggagaucuucagaaugaccccccacgagaagcaggugaugauguucagcgccacccugagcaaggagaucagacccgugugcagaaaguucaugcaggaccccauggagaucuucguggacgacgagaccaagcugacccugcacggccugcagcaguacuacgugaagcugaaggacaacgagaagaacagaaagcuguucgaccugcuggacgugcuggaguucaaccagguggugaucuucgugaagagcgugcagagaugcaucgcccuggcccagcugcugguggagcagaacuuccccgccaucgccauccacagaggcaugccccaggaggagagacugagcagauaccagcaguucaaggacuuccagagaagaauccugguggccaccaaccuguucggcagaggcauggacaucgagagagugaacaucgccuucaacuacgacaugcccgaggacagcgacaccuaccugcacagaguggccagagccggcagauucggcaccaagggccuggccaucaccuucgugagcgacgagaacgacgccaagauccugaacgacgugcaggacagauucgaggugaacaucagcgagcugcccgacgagaucgacaucagcagcuacaucgagcagaccagauaa

SEQ ID NO: 16024 - RNA, 1986 nt, Artificial Sequence
  DDX3X__Homo_sapiens__NP_001180345
augagccacguggccguggagaacgcccugggccuggaccagcaguucgccggccuggaccugaacagcagcgacaaccagagcggcggcagcaccgccagcaagggcagauacauccccccccaccugagaaacagagaggccaccaagggcuucuacgacaaggacagcagcggcuggagcagcagcaaggacaaggacgccuacagcagcuucggcagcagaagcgacagcagaggcaagagcagcuucuucagcgacagaggcagcggcagcagaggcagauucgacgacagaggcagaagcgacuacgacggcaucggcagcagaggcgacagaagcggcuucggcaaguucgagagaggcggcaacagcagauggugcgacaagagcgacgaggacgacuggagcaagccccugccccccagcgagagacuggagcaggagcuguucagcggcggcaacaccggcaucaacuucgagaaguacgacgacauccccguggaggccaccggcaacaacugccccccccacaucgagagcuucagcgacguggagaugggcgagaucaucaugggcaacaucgagcugaccagauacaccagacccacccccgugcagaagcacgccauccccaucaucaaggagaagagagaccugauggccugcgcccagaccggcagcggcaagaccgccgccuuccugcugcccauccugagccagaucuacagcgacggccccggcgaggcccugagagccaugaaggagaacggcagauacggcagaagaaagcaguaccccaucagccuggugcuggcccccaccagagagcuggccgugcagaucuacgaggaggccagaaaguucagcuacagaagcagagugagacccugcgugguguacggcggcgccgacaucggccagcagaucagagaccuggagagaggcugccaccugcugguggccacccccggcagacugguggacaugauggagagaggcaagaucggccuggacuucugcaaguaccuggugcuggacgaggccgacagaaugcuggacaugggcuucgagccccagaucagaagaaucguggagcaggacaccaugccccccaagggcgugagacacaccaugauguucagcgccaccuuccccaaggagauccagaugcuggccagagacuuccuggacgaguacaucuuccuggccgugggcagagugggcagcaccagcgagaacaucacccagaaggugguguggguggaggagagcgacaagagaagcuuccugcuggaccugcugaacgccaccggcaaggacagccugacccugguguucguggagaccaagaagggcgccgacagccuggaggacuuccuguaccacgagggcuacgccugcaccagcauccacggcgacagaagccagagagacagagaggaggcccugcaccaguucagaagcggcaagagccccauccugguggccaccgccguggccgccagaggccuggacaucagcaacgugaagcacgugaucaacuucgaccugcccagcgacaucgaggaguacgugcacagaaucggcagaaccggcagagugggcaaccugggccuggccaccagcuucuucaacgagagaaacaucaacaucaccaaggaccugcuggaccugcugguggaggccaagcaggaggugcccagcuggcuggagaacauggccuacgagcaccacuacaagggcagcagcagaggcagaagcaagagcagauucagcggcggcuucggcgccagagacuacagacagagcagcggcgccagcagcagcagcuucagcagcagcagagccagcagcagcagaagcggcggcggcggccacggcagcagcagaggcuucggcggcggcggcuacggcggcuucuacaacagcgacggcuacggcggcaacuacaacagccagggcguggacugguggggcaacuaa

SEQ ID NO: 16025 - RNA, 1974 nt, Artificial Sequence
  DDX3Y__Homo_sapiens__NP_001289481
auggagaucggcagacccagaaaggacaccuggaagcuggccaaccuggaccugaacagcgagaagcagagcggcggcgccagcaccgccagcaagggcagauacauccccccccaccugagaaacagagaggccagcaagggcuuccacgacaaggacagcagcggcuggagcugcagcaaggacaaggacgccuacagcagcuucggcagcagagacagcagaggcaagcccggcuacuucagcgagagaggcagcggcagcagaggcagauucgacgacagaggcagaagcgacuacgacggcaucggcaacagagagagacccggcuucggcagauucgagagaagcggccacagcagauggugcgacaagagcguggaggacgacuggagcaagccccugccccccagcgagagacuggagcaggagcuguucagcggcggcaacaccggcaucaacuucgagaaguacgacgacauccccguggaggccaccggcagcaacugccccccccacaucgagaacuucagcgacaucgacaugggcgagaucaucaugggcaacaucgagcugaccagauacaccagacccacccccgugcagaagcacgccauccccaucaucaagggcaagagagaccugauggccugcgcccagaccggcagcggcaagaccgccgccuuccugcugcccauccugagccagaucuacaccgacggccccggcgaggcccugaaggccgugaaggagaacggcagauacggcagaagaaagcaguaccccaucagccuggugcuggcccccaccagagagcuggccgugcagaucuacgaggaggccagaaaguucagcuacagaagcagagugagacccugcgugguguacggcggcgccgacaucggccagcagaucagagaccuggagagaggcugccaccugcugguggccacccccggcagacugguggacaugauggagagaggcaagaucggccuggacuucugcaaguaccuggugcuggacgaggccgacagaaugcuggacaugggcuucgagccccagaucagaagaaucguggagcaggacaccaugccccccaagggcgugagacacaccaugauguucagcgccaccuuccccaaggagauccagaugcuggccagagacuuccuggacgaguacaucuuccuggccgugggcagagugggcagcaccagcgagaacaucacccagaaggugguguggguggaggaccuggacaagagaagcuuccugcuggacauccugggcgccaccggcagcgacagccugacccugguguucguggagaccaagaagggcgccgacagccuggaggacuuccuguaccacgagggcuacgccugcaccagcauccacggcgacagaagccagagagacagagaggaggcccugcaccaguucagaagcggcaagagccccauccugguggccaccgccguggccgccagaggccuggacaucagcaacgugagacacgugaucaacuucgaccugcccagcgacaucgaggaguacgugcacagaaucggcagaaccggcagagugggcaaccugggccuggccaccagcuucuucaacgagaagaacaugaacaucaccaaggaccugcuggaccugcugguggaggccaagcaggaggugcccagcuggcuggagaacauggccuacgagcaccacuacaagggcggcagcagaggcagaagcaagagcaacagauucagcggcggcuucggcgccagagacuacagacagagcagcggcagcagcagcagcggcuucggcgccagcagaggcagcagcagcagaagcggcggcggcggcuacggcaacagcagaggcuucggcggcggcggcuacggcggcuucuacaacagcgacggcuacggcggcaacuacaacagccagggcguggacugguggggcaacuaa

SEQ ID NO: 16026 - RNA, 1869 nt, Artificial Sequence
  DDX41__Homo_sapiens__NP_057306
auggaggagagcgagcccgagagaaagagagccagaaccgacgaggugcccgccggcggcagcagaagcgaggccgaggacgaggacgacgaggacuacgugcccuacgugccccugagacagagaagacagcugcugcugcagaagcugcugcagagaagaagaaagggcgccgccgaggaggagcagcaggacagcggcagcgagcccagaggcgacgaggacgacaucccccugggcccccagagcaacgugagccugcuggaccagcaccagcaccugaaggagaaggccgaggccagaaaggagagcgccaaggagaagcagcugaaggaggaggagaagauccuggagagcguggccgagggcagagcccugaugagcgugaaggagauggccaagggcaucaccuacgacgaccccaucaagaccagcuggaccccccccagauacgugcugagcaugagcgaggagagacacgagagagugagaaagaaguaccacauccugguggagggcgacggcauccccccccccaucaagagcuucaaggagaugaaguuccccgccgccauccugagaggccugaagaagaagggcauccaccaccccacccccauccagauccagggcauccccaccauccugagcggcagagacaugaucggcaucgccuucaccggcagcggcaagacccugguguucacccugcccgugaucauguucugccuggagcaggagaagagacugcccuucagcaagagagagggccccuacggccugaucaucugccccagcagagagcuggccagacagacccacggcauccuggaguacuacugcagacugcugcaggaggacagcagcccccugcugagaugcgcccugugcaucggcggcaugagcgugaaggagcagauggagaccaucagacacggcgugcacaugaugguggccacccccggcagacugauggaccugcugcagaagaagauggugagccuggacaucugcagauaccuggcccuggacgaggccgacagaaugaucgacaugggcuucgagggcgacaucagaaccaucuucagcuacuucaagggccagagacagacccugcuguucagcgccaccaugcccaagaagauccagaacuucgccaagagcgcccuggugaagcccgugaccaucaacgugggcagagccggcgccgccagccuggacgugauccaggagguggaguacgugaaggaggaggccaagaugguguaccugcuggagugccugcagaagacccccccccccgugcugaucuucgccgagaagaaggccgacguggacgccauccacgaguaccugcugcugaagggcguggaggccguggccauccacggcggcaaggaccaggaggagagaaccaaggccaucgaggccuucagagagggcaagaaggacgugcugguggccaccgacguggccagcaagggccuggacuuccccgccauccagcacgugaucaacuacgacaugcccgaggagaucgagaacuacgugcacagaaucggcagaaccggcagaagcggcaacaccggcaucgccaccaccuucaucaacaaggccugcgacgagagcgugcugauggaccugaaggcccugcugcuggaggccaagcagaaggugccccccgugcugcaggugcugcacugcggcgacgagagcaugcuggacaucggcggcgagagaggcugcgccuucugcggcggccugggccacagaaucaccgacugccccaagcuggaggccaugcagaccaagcaggugagcaacaucggcagaaaggacuaccuggcccacagcagcauggacuucuaa

SEQ ID NO: 16027 - RNA, 2817 nt, Artificial Sequence
  DDX42__Homo_sapiens__NP_987095
augaacuggaacaagggcggccccggcaccaagagaggcuucggcuucggcggcuucgccaucagcgccggcaagaaggaggagcccaagcugccccagcagagccacagcgccuucggcgccaccagcagcagcagcggcuucggcaagagcgcccccccccagcugcccagcuucuacaagaucggcagcaagagagccaacuucgacgaggagaacgccuacuucgaggacgaggaggaggacagcagcaacguggaccugcccuacauccccgccgagaacagccccaccagacagcaguuccacagcaagcccguggacagcgacagcgacgacgacccccuggaggccuucauggccgagguggaggaccaggccgccagagacaugaagagacuggaggagaaggacaaggagagaaagaacgugaagggcaucagagacgacaucgaggaggaggacgaccaggaggccuacuucagauacauggccgagaaccccaccgccggcguggugcaggaggaggaggaggacaaccuggaguacgacagcgacggcaaccccaucgcccccaccaagaagaucaucgacccccugccccccaucgaccacagcgagaucgacuacccccccuucgagaagaacuucuacaacgagcacgaggagaucaccaaccugaccccccagcagcugaucgaccugagacacaagcugaaccugagagugagcggcgccgccccccccagacccggcagcagcuucgcccacuucggcuucgacgagcagcugaugcaccagaucagaaagagcgaguacacccagcccacccccauccagugccagggcgugcccguggcccugagcggcagagacaugaucggcaucgccaagaccggcagcggcaagaccgccgccuucaucuggcccaugcugauccacaucauggaccagaaggagcuggagcccggcgacggccccaucgccgugaucgugugccccaccagagagcugugccagcagauccacgccgagugcaagagauucggcaaggccuacaaccugagaagcguggccguguacggcggcggcagcaugugggagcaggccaaggcccugcaggagggcgccgagaucguggugugcacccccggcagacugaucgaccacgugaagaagaaggccaccaaccugcagagagugagcuaccugguguucgacgaggccgacagaauguucgacaugggcuucgaguaccaggugagaagcaucgccagccacgugagacccgacagacagacccugcuguucagcgccaccuucagaaagaagaucgagaagcuggccagagacauccugaucgaccccaucagaguggugcagggcgacaucggcgaggccaacgaggacgugacccagaucguggagauccugcacagcggccccagcaaguggaacuggcugaccagaagacugguggaguucaccagcagcggcagcgugcugcuguucgugaccaagaaggccaacgccgaggagcuggccaacaaccugaagcaggagggccacaaccugggccugcugcacggcgacauggaccagagcgagagaaacaaggugaucagcgacuucaagaagaaggacauccccgugcugguggccaccgacguggccgccagaggccuggacauccccagcaucaagaccgugaucaacuacgacguggccagagacaucgacacccacacccacagaaucggcagaaccggcagagccggcgagaagggcguggccuacacccugcugacccccaaggacagcaacuucgccggcgaccuggugagaaaccuggagggcgccaaccagcacgugagcaaggagcugcuggaccuggccaugcagaacgccugguucagaaagagcagauucaagggcggcaagggcaagaagcugaacaucggcggcggcggccugggcuacagagagagacccggccugggcagcgagaacauggacagaggcaacaacaacgugaugagcaacuacgaggccuacaagcccagcaccggcgccaugggcgacagacugaccgccaugaaggccgccuuccagagccaguacaagagccacuucguggccgccagccugagcaaccagaaggccggcagcagcgccgccggcgccagcggcuggaccagcgccggcagccugaacagcgugcccaccaacagcgcccagcagggccacaacagccccgacagccccgugaccagcgccgccaagggcauccccggcuucggcaacaccggcaacaucagcggcgcccccgugaccuaccccagcgccggcgcccagggcgugaacaacaccgccagcggcaacaacagcagagagggcaccggcggcagcaacggcaagagagagagauacaccgagaacagaggcagcagcagacacagccacggcgagaccggcaacagacacagcgacagccccagacacggcgacggcggcagacacggcgacggcuacagacaccccgagagcagcagcagacacaccgacggccacagacacggcgagaacagacacggcggcagcgccggcagacacggcgagaacagaggcgccaacgacggcagaaacggcgagagcagaaaggaggccuucaacagagagagcaagauggagcccaagauggagcccaagguggacagcagcaagauggacaagguggacagcaagaccgacaagaccgccgacggcuucgccgugcccgagccccccaagagaaagaagagcagaugggacagcuaa

SEQ ID NO: 16028 - RNA, 1947 nt, Artificial Sequence
  DDX43__Homo_sapiens__NP_061135
augagccaccacggcggcgcccccaaggccagcaccugggugguggccagcagaagaagcagcaccgugagcagagcccccgagagaagacccgccgaggagcugaacagaaccggccccgagggcuacagcgugggcagaggcggcagauggagaggcaccagcagaccccccgaggccguggccgccggccacgaggagcugccccugugcuucgcccugaagagccacuucgugggcgccgugaucggcagaggcggcagcaagaucaagaacauccagagcaccaccaacaccaccauccagaucauccaggagcagcccgagagccuggugaagaucuucggcagcaaggccaugcagaccaaggccaaggccgugaucgacaacuucgugaagaagcuggaggagaacuacaacagcgagugcggcaucgacaccgccuuccagcccagcgugggcaaggacggcagcaccgacaacaacgugguggccggcgacagaccccugaucgacugggaccagaucagagaggagggccugaaguggcagaagaccaagugggccgaccugccccccaucaagaagaacuucuacaaggagagcaccgccaccagcgccaugagcaagguggaggccgacagcuggagaaaggagaacuucaacaucaccugggacgaccugaaggacggcgagaagagacccauccccaaccccaccugcaccuucgacgacgccuuccagugcuaccccgaggugauggagaacaucaagaaggccggcuuccagaagcccacccccauccagagccaggccuggcccaucgugcugcagggcaucgaccugaucggcguggcccagaccggcaccggcaagacccugugcuaccugaugcccggcuucauccaccuggugcugcagcccagccugaagggccagagaaacagacccggcaugcuggugcugacccccaccagagagcuggcccugcagguggagggcgagugcugcaaguacagcuacaagggccugagaagcgugugcguguacggcggcggcaacagagacgagcagaucgaggagcugaagaagggcguggacaucaucaucgccacccccggcagacugaacgaccugcagaugagcaacuucgugaaccugaagaacaucaccuaccuggugcuggacgaggccgacaagaugcuggacaugggcuucgagccccagaucaugaagauccugcuggacgugagacccgacagacagaccgugaugaccagcgccaccuggccccacagcgugcacagacuggcccagagcuaccugaaggagcccaugaucguguacgugggcacccuggaccugguggccgugagcagcgugaagcagaacaucaucgugaccaccgaggaggagaaguggagccacaugcagaccuuccugcagagcaugagcagcaccgacaaggugaucguguucgugagcagaaaggccguggccgaccaccugagcagcgaccugauccugggcaacaucagcguggagagccugcacggcgacagagagcagagagacagagagaaggcccuggagaacuucaagaccggcaaggugagaauccugaucgccaccgaccuggccagcagaggccuggacgugcacgacgugacccacguguacaacuucgacuuccccagaaacaucgaggaguacgugcacagaaucggcagaaccggcagagccggcagaaccggcgugagcaucaccacccugaccagaaacgacuggagaguggccagcgagcugaucaacauccuggagagagccaaccagagcauccccgaggagcuggugagcauggccgagagauucaaggcccaccagcagaagagagagauggagagaaagauggagagaccccagggcagacccaagaaguuccacuaa

SEQ ID NO: 16029 - RNA, 3099 nt, Artificial Sequence
  DDX46__Homo_sapiens__NP_001287789
augggcagagagagcagacacuacagaaagagaagcgccagcagaggcagaagcggcagcagaagcagaagcagaagccccagcgacaagagaagcaagagaggcgacgacagaagaagcagaagcagagacagagacagaagaagagagagaagcagaagcagagacaagagaagaagcagaagcagagacagaaagagacugagaagaagcagaagcagagagagagacagaagcagagagagaagaagaagcagaagcagagacagaagaagaagcagaagcagaagcagaggcagaagaagcagaagcagcagccccggcaacaagagcaagaagaccgagaacagaagcagaagcaaggagaagaccgacggcggcgagagcagcaaggagaagaagaaggacaaggacgacaaggaggacgagaaggagaaggacgccggcaacuucgaccagaacaagcuggaggaggagaugagaaagagaaaggagagaguggagaaguggagagaggagcagagaaagaaggccauggagaacaucggcgagcugaagaaggagaucgaggagaugaagcagggcaagaaguggagccuggaggacgacgacgacgacgaggacgaccccgccgaggccgagaaggagggcaacgagauggagggcgaggagcuggacccccuggacgccuacauggaggaggugaaggaggaggugaagaaguucaacaugagaagcgugaagggcggcggcggcaacgagaagaagagcggccccaccgugaccaagguggugaccguggugaccaccaagaaggccgugguggacagcgacaagaagaagggcgagcugauggagaacgaccaggacgccauggaguacagcagcgaggaggaggagguggaccugcagaccgcccugaccggcuaccagaccaagcagagaaagcugcuggagcccguggaccacggcaagaucgaguacgagcccuucagaaagaacuucuacguggaggugcccgagcuggccaagaugagccaggaggaggugaacguguucagacuggagauggagggcaucaccgugaagggcaagggcugccccaagcccaucaagagcugggugcagugcggcaucagcaugaagauccugaacagccugaagaagcacggcuacgagaagcccacccccauccagacccaggccauccccgccaucaugagcggcagagaccugaucggcaucgccaagaccggcagcggcaagaccaucgccuuccugcugcccauguucagacacaucauggaccagagaagccuggaggagggcgagggccccaucgccgugaucaugacccccaccagagagcuggcccugcagaucaccaaggagugcaagaaguucagcaagacccugggccugagaguggugugcguguacggcggcaccggcaucagcgagcagaucgccgagcugaagagaggcgccgagaucaucgugugcacccccggcagaaugaucgacaugcuggccgccaacagcggcagagugaccaaccugagaagagugaccuacguggugcuggacgaggccgacagaauguucgacaugggcuucgagccccaggugaugagaaucguggacaacgugagacccgacagacagaccgugauguucagcgccaccuuccccagagccauggaggcccuggccagaagaauccugagcaagcccaucgaggugcaggugggcggcagaagcguggugugcagcgacguggagcagcaggugaucgugaucgaggaggagaagaaguuccugaagcugcuggagcugcugggccacuaccaggagagcggcagcgugaucaucuucguggacaagcaggagcacgccgacggccugcugaaggaccugaugagagccagcuaccccugcaugagccugcacggcggcaucgaccaguacgacagagacagcaucaucaacgacuucaagaacggcaccugcaagcugcugguggccaccagcguggccgccagaggccuggacgugaagcaccugauccugguggugaacuacagcugccccaaccacuacgaggacuacgugcacagagccggcagaaccggcagagccggcaacaagggcuacgccuacaccuucaucaccgaggaccaggccagauacgccggcgacaucaucaaggcccuggagcugagcggcaccgccgugccccccgaccuggagaagcuguggagcgacuucaaggaccagcagaaggccgagggcaagaucaucaagaagagcagcggcuucagcggcaagggcuucaaguucgacgagaccgagcaggcccuggccaacgagagaaagaagcugcagaaggccgcccugggccugcaggacagcgacgacgaggacgccgccguggacaucgacgagcagaucgagagcauguucaacagcaagaagagagugaaggacauggccgcccccggcaccagcagcgugcccgcccccaccgccggcaacgccgagaagcuggagaucgccaagagacuggcccugagaaucaacgcccagaagaaccugggcaucgagagccagguggacgugaugcagcaggccaccaacgccauccugagaggcggcaccauccuggcccccaccgugagcgccaagaccaucgccgagcagcuggccgagaagaucaacgccaagcugaacuacgugccccuggagaagcaggaggaggagagacaggacggcggccagaacgagagcuucaagagauacgaggaggagcuggagaucaacgacuucccccagaccgccagauggaaggugaccagcaaggaggcccugcagagaaucagcgaguacagcgaggccgccaucaccaucagaggcaccuacuucccccccggcaaggagcccaaggagggcgagagaaagaucuaccuggccaucgagagcgccaacgagcuggccgugcagaaggccaaggccgagaucaccagacugaucaaggaggagcugaucagacugcagaacagcuaccagcccaccaacaagggcagauacaaggugcuguaa

SEQ ID NO: 16030 - RNA, 2073 nt, Artificial Sequence
  DDX4__Homo_sapiens__NP_001136021
augggcgacgaggacugggaggccgagaucaacccccacaugagcagcuacgugcccaucuucgagaaggacagauacagcggcgagaacggcgacaacuucaacagaacccccgccagcagcagcgagauggacgacggccccagcagaagagaccacuucaugaagagcggcuucgccagcggcagaaacuucggcaacagagacgccggcgagugcaacaagagagacaacaccagcaccaugggcggcuucggcgugggcaagagcuucggcaacagaggcuucagcaacagcagauucgaggacggcgacagcagcggcuucuggagagagagcagcaacgacugcgaggacaaccccaccagaaacagaggcuucagcaagagaggcgacaacgaccuggaccccgacgagugcaugcagagaaccggcggccuguucggcagcagaagacccgugcugagcggcaccggcaacggcgacaccagccagagcagaagcggcagcggcagcgagagaggcggcuacaagggccugaacgaggaggugaucaccggcagcggcaagaacagcuggaagagcgaggccgagggcggcgagagcagcgacacccagggccccaaggugaccuacauccccccccccccccccgaggacgaggacagcaucuucgcccacuaccagaccggcaucaacuucgacaaguacgacaccauccugguggaggugagcggccacgacgccccccccgccauccugaccuucgaggaggccaaccugugccagacccugaacaacaacaucgccaaggccggcuacaccaagcugacccccgugcagaaguacagcauccccaucauccuggccggcagagaccugauggccugcgcccagaccggcagcggcaagaccgccgccuuccugcugcccauccuggcccacaugaugcacgacggcaucaccgccagcagauucaaggagcugcaggagcccgagugcaucaucguggcccccaccagagagcuggugaaccagaucuaccuggaggccagaaaguucagcuucggcaccugcgugagagccguggugaucuacggcggcacccagcugggccacagcaucagacagaucgugcagggcugcaacauccugugcgccacccccggcagacugauggacaucaucggcaaggagaagaucggccugaagcagaucaaguaccuggugcuggacgaggccgacagaaugcuggacaugggcuucggccccgagaugaagaagcugaucagcugccccggcaugcccagcaaggagcagagacagacccugauguucagcgccaccuuccccgaggagauccagagacuggccgccgaguuccugaagagcaacuaccuguucguggccgugggccaggugggcggcgccugcagagacgugcagcagaccgugcugcaggugggccaguucagcaagagagagaagcugguggagauccugagaaacaucggcgacgagagaaccaugguguucguggagaccaagaagaaggccgacuucaucgccaccuuccugugccaggagaagaucagcaccaccagcauccacggcgacagagagcagagagagagagagcaggcccugggcgacuucagauucggcaagugccccgugcugguggccaccagcguggccgccagaggccuggacaucgagaacgugcagcacgugaucaacuucgaccugcccagcaccaucgacgaguacgugcacagaaucggcagaaccggcagaugcggcaacaccggcagagccaucagcuucuucgaccuggagagcgacaaccaccuggcccagccccuggugaaggugcugaccgacgcccagcaggacgugcccgccuggcuggaggagaucgccuucagcaccuacauccccggcuucagcggcagcaccagaggcaacguguucgccagcguggacaccagaaagggcaagagcacccugaacaccgccggcuucagcagcagccaggcccccaaccccguggacgacgagagcugggacuaa

SEQ ID NO: 16031 - RNA, 2214 nt, Artificial Sequence
  DDX50__Homo_sapiens__NP_076950
augcccggcaagcugcuguggggcgacaucauggagcuggaggccccccuggaggagagcgagagccagaagaaggagagacagaagagcgacagaagaaagagcagacaccacuacgacagcgacgagaagagcgagaccagagagaacggcgugaccgacgaccuggacgcccccaaggccaagaagagcaagaugaaggagaagcugaacggcgacaccgaggagggcuucaacagacugagcgacgaguucagcaagagccacaagagcagaagaaaggaccugcccaacggcgacaucgacgaguacgagaagaagagcaagagagugagcagccuggacaccagcacccacaagagcagcgacaacaagcuggaggagacccugaccagagagcagaaggagggcgccuucagcaacuuccccaucagcgaggagaccaucaagcugcugaagggcagaggcgugaccuaccuguuccccauccaggugaagaccuucggccccguguacgagggcaaggaccugaucgcccaggccagaaccggcaccggcaagaccuucagcuucgccaucccccugaucgagagacugcagagaaaccaggagaccaucaagaagagcagaagccccaaggugcuggugcuggcccccaccagagagcuggccaaccagguggccaaggacuucaaggacaucaccagaaagcugagcguggccugcuucuacggcggcaccagcuaccagagccagaucaaccacaucagaaacggcaucgacauccuggugggcacccccggcagaaucaaggaccaccugcagagcggcagacuggaccugagcaagcugagacacguggugcuggacgagguggaccagaugcuggaccugggcuucgccgagcagguggaggacaucauccacgagagcuacaagaccgacagcgaggacaacccccagacccugcuguucagcgccaccugcccccaguggguguacaagguggccaagaaguacaugaagagcagauacgagcagguggaccuggugggcaagaugacccagaaggccgccaccaccguggagcaccuggccauccagugccacuggagccagagacccgccgugaucggcgacgugcugcagguguacagcggcagcgagggcagagccaucaucuucugcgagaccaagaagaacgugaccgagauggccaugaacccccacaucaagcagaacgcccagugccugcacggcgacaucgcccagagccagagagagaucacccugaagggcuucagagagggcagcuucaaggugcugguggccaccaacguggccgccagaggccuggacauccccgagguggaccuggugauccagagcagccccccccaggacguggagagcuacauccacagaagcggcagaaccggcagagccggcagaaccggcaucugcaucugcuucuaccagcccagagagagaggccagcugagauacguggagcagaaggccggcaucaccuucaagagagugggcgugcccagcaccauggaccuggugaagagcaagagcauggacgccaucagaagccuggccagcgugagcuacgccgccguggacuucuucagacccagcgcccagagacugaucgaggagaagggcgccguggacgcccuggccgccgcccuggcccacaucagcggcgccagcagcuucgagcccagaagccugaucaccagcgacaagggcuucgugaccaugacccuggagagccuggaggagauccaggacgugagcugcgccuggaaggagcugaacagaaagcugagcagcaacgccgugagccagaucaccagaaugugccugcugaagggcaacaugggcgugugcuucgacgugcccaccaccgagagcgagagacugcaggccgaguggcacgacagcgacuggauccugagcgugcccgccaagcugcccgagaucgaggaguacuacgacggcaacaccagcagcaacagcagacagagaagcggcuggagcagcggcagaagcggcagaagcggcagaagcggcggcagaagcggcggcagaagcggcagacagagcagacagggcagcagaagcggcagcagacaggacggcagaagaagaagcggcaacagaaacagaagcagaagcggcggccacaagagaagcuucgacuaa

SEQ ID NO: 16032 - RNA, 2001 nt, Artificial Sequence
  DDX51__Homo_sapiens__NP_778236
auggcccuguucuacguggccagauaccccggccccgacgccgccgccgccgccggccccgagggcgccgaggccggcgcccacggcagagccagagcccugcuggagagacugcagagcagagccagagagagacagcagcagagagagcccgcccagaccgaggccgccgccagcaccgagcccgccaccagaagaagaagaagacccagaagaagaagaagagugaacgacgccgagcccggcagccccgaggccccccagggcaagagaagaaaggccgacggcgaggacgccggcgccgagagcaacgaggaggcccccggcgagcccagcgccggcagcagcgaggaggcccccggcgagcccagcgccggcagcagcgaggaggcccccggcgagagaagcaccagcgccagcgccgaggccgcccccgacggccccgcccuggaggaggccgccggcccccuggugcccggccuggugcugggcggcuucggcaagagaaaggcccccaaggugcagcccuuccugcccagauggcuggccgagcccaacugcgugagaagaaacgugaccgaggaccuggugcccaucgaggacauccccgacgugcaccccgaccugcagaagcagcugagagcccacggcaucagcagcuacuuccccgugcaggccgccgugauccccgcccugcuggagagcgccgccugcggcuuccuggugggcagaggcggcuacagacccagcgaccugugcgugagcgcccccaccggcagcggcaagacccuggccuucgugauccccguggugcaggcccugcugagcagaguggugugccacaucagagcccugguggugcugcccaccaaggagcuggcccagcaggugagcaagguguucaacaucuacaccgacgccaccccccugagagugagccuggugaccggccagaagagccuggccaaggagcaggagagccuggugcagaagaccgccgacggcuacagaugccuggccgacaucgugguggccacccccggcagacugguggaccacaucgaccagacccccggcuucagccugcagcagcugagauuccugaucaucgacgaggccgacagaaugaucgacagcaugcaccagagcuggcugcccagagugguggccgccgccuuccagagcgaggaccccgccgaccccugcgcccugcugcagagaagacaggcccaggccgugaccgccgccagcaccugcugcccccagaugccccugcagaagcugcuguucagcgccacccugacccagaaccccgagaagcugcagcagcugggccugcaccagcccagacuguucagcaccggccuggcccacagaggccuggaggacaccgacggcgacggcgacagcggcaaguacgccuuccccgugggccugacccaccacuacgugcccugcagccugagcagcaagccccugguggugcugcaccuggugcuggagaugggcuucagcagagugcugugcuucaccaacagcagagagaacagccacagacuguuccugcuggugcaggccuucggcggcguggacguggccgaguucagcagcagauacggccccggccagagaagaaugauccugaagcaguucgagcagggcaagauccagcugcugaucagcaccgacgccaccgccagaggcaucgacgugcagggcguggagcugguggugaacuacgacgccccccaguaccugagaaccuacgugcacagagugggcagaaccgccagagccggcaagaccggccaggccuucacccugcugcugaaggugcaggagagaagauuccugagaaugcugaccgaggccggcgcccccgagcugcagagacacgagcugagcagcaagcugcugcagccccuggugcccagauacgaggaggcccugagccagcuggaggagagcgugaaggaggagagaaagcagagagccgccuaa

SEQ ID NO: 16033 - RNA, 1800 nt, Artificial Sequence
  DDX52__Homo_sapiens__NP_008941
auggacgugcacgaccuguucagaagacugggcgccggcgccaaguucgacaccagaagauucagcgccgacgccgccagauuccagaucggcaagagaaaguacgacuucgacagcagcgaggugcugcagggccuggacuucuucggcaacaagaagagcgugcccggcgugugcggcgccagccagacccaccagaagccccagaacggcgagaagaaggaggagagccugaccgagagaaagagagagcagagcaagaagaagagaaagaccaugaccagcgagaucgccagccaggaggagggcgccaccauccaguggaugagcagcguggaggccaagaucgaggacaagaaggugcagagagagagcaagcugaccagcggcaagcuggagaaccugagaaaggagaagaucaacuuccugagaaacaagcacaagauccacgugcagggcaccgaccugcccgaccccaucgccaccuuccagcagcuggaccaggaguacaagaucaacagcagacugcugcagaacauccuggacgccggcuuccagaugcccacccccauccagaugcaggccauccccgugaugcugcacggcagagagcugcuggccagcgcccccaccggcagcggcaagacccuggccuucagcauccccauccugaugcagcugaagcagcccgccaacaagggcuucagagcccugaucaucagccccaccagagagcuggccagccagauccacagagagcugaucaagaucagcgagggcaccggcuucagaauccacaugauccacaaggccgccguggccgccaagaaguucggccccaagagcagcaagaaguucgacauccuggugaccacccccaacagacugaucuaccugcugaagcaggacccccccggcaucgaccuggccagcguggaguggcuggugguggacgagagcgacaagcuguucgaggacggcaagaccggcuucagagaccagcuggccagcaucuuccuggccugcaccagccacaaggugagaagagccauguucagcgccaccuucgccuacgacguggagcaguggugcaagcugaaccuggacaacgugaucagcgugagcaucggcgccagaaacagcgccguggagaccguggagcaggagcugcuguucgugggcagcgagaccggcaagcugcuggccgugagagagcuggugaagaagggcuucaacccccccgugcugguguucgugcagagcaucgagagagccaaggagcuguuccacgagcugaucuacgagggcaucaacguggacgugauccacgccgagagaacccagcagcagagagacaacaccgugcacagcuucagagccggcaagaucugggugcugaucugcaccgcccugcuggccagaggcaucgacuucaagggcgugaaccuggugaucaacuacgacuuccccaccagcagcguggaguacauccacagaaucggcagaaccggcagagccggcaacaagggcaaggccaucaccuucuucaccgaggacgacaagccccugcugagaagcguggccaacgugauccagcaggccggcugccccgugcccgaguacaucaagggcuuccagaagcugcugagcaagcagaagaagaagaugaucaagaagccccuggagagagagagcaucagcaccacccccaagugcuuccuggagaaggccaaggacaagcagaagaaggugaccggccagaacagcaagaagaagguggcccuggaggacaagagcuaa

SEQ ID NO: 16034 - RNA, 1896 nt, Artificial Sequence
  DDX53__Homo_sapiens__NP_874358
augagccacugggcccccgaguggaagagagccgaggccaaccccagagaccugggcgccagcugggacgugagaggcagcagaggcagcggcuggagcggccccuucggccaccagggccccagagccgccggcagcagagagcccccccugugcuucaagaucaagaacaacauggugggcguggugaucggcuacagcggcagcaagaucaaggaccugcagcacagcaccaacaccaagauccagaucaucaacggcgagagcgaggccaaggugagaaucuucggcaacagagagaugaaggccaaggccaaggccgccaucgagacccugaucagaaagcaggagagcuacaacagcgagagcagcguggacaacgccgccagccagacccccaucggcagaaaccugggcagaaacgacaucgugggcgaggccgagccccugagcaacugggacagaaucagagccgccgugguggagugcgagaagagaaagugggccgaccugccccccgugaagaagaacuucuacaucgagagcaaggccaccagcugcaugagcgagaugcaggugaucaacuggagaaaggagaacuucaacaucaccugcgacgaccugaagagcggcgagaagagacugauccccaagcccaccugcagauucaaggacgccuuccagcaguaccccgaccugcugaagagcaucaucagagugggcaucgugaagcccacccccauccagagccaggccuggcccaucauccugcagggcaucgaccugaucgugguggcccagaccggcaccggcaagacccugagcuaccugaugcccggcuucauccaccuggacagccagcccaucagcagagagcagagaaacggccccggcaugcuggugcugacccccaccagagagcuggcccugcacguggaggccgagugcagcaaguacagcuacaagggccugaagagcaucugcaucuacggcggcagaaacagaaacggccagaucgaggacaucagcaagggcguggacaucaucaucgccacccccggcagacugaacgaccugcagaugaacaacagcgugaaccugagaagcaucaccuaccuggugaucgacgaggccgacaagaugcuggacauggaguucgagccccagaucagaaagauccugcuggacgugagacccgacagacagaccgugaugaccagcgccaccuggcccgacaccgugagacagcuggcccugagcuaccugaaggaccccaugaucguguacgugggcaaccugaaccugguggccgugaacaccgugaagcagaacaucaucgugaccaccgagaaggagaagagagcccugacccaggaguucguggagaacaugagccccaacgacaaggugaucauguucgugagccagaagcacaucgccgacgaccugagcagcgacuucaacauccagggcaucagcgccgagagccugcacggcaacagcgagcagagcgaccaggagagagccguggaggacuucaagagcggcaacaucaagauccugaucaccaccgacaucgugagcagaggccuggaccugaacgacgugacccacguguacaacuacgacuuccccagaaacaucgacguguacgugcacagagugggcuacaucggcagaaccggcaagaccggcaccagcgugacccugaucacccagagagacagcaagauggccggcgagcugaucaagauccuggacagagccaaccagagcgugcccgaggaccugguggugauggccgagcaguacaagcugaaccagcagaagagacacagagagaccagaagcagaaagcccggccagagaagaaaggaguucuacuuccugagcuaa

SEQ ID NO: 16035 - RNA, 2649 nt, Artificial Sequence
  DDX54__Homo_sapiens__NP_001104792
auggccgccgacaagggccccgccgccggccccagaagcagagccgccauggcccaguggagaaagaagaagggccugagaaagagaagaggcgccgccagccaggccagaggcagcgacagcgaggacggcgaguucgagauccaggccgaggacgacgccagagccagaaagcugggccccggcagaccccugcccaccuuccccaccagcgagugcaccagcgacguggagcccgacaccagagagauggugagagcccagaacaagaagaagaagaagagcggcggcuuccagagcaugggccugagcuaccccguguucaagggcaucaugaagaagggcuacaaggugcccacccccauccagagaaagaccauccccgugauccuggacggcaaggacgugguggccauggccagaaccggcagcggcaagaccgccugcuuccugcugcccauguucgagagacugaagacccacagcgcccagaccggcgccagagcccugauccugagccccaccagagagcuggcccugcagacccugaaguucaccaaggagcugggcaaguucaccggccugaagaccgcccugauccugggcggcgacagaauggaggaccaguucgccgcccugcacgagaaccccgacaucaucaucgccacccccggcagacuggugcacguggccguggagaugagccugaagcugcagagcguggaguacgugguguucgacgaggccgacagacuguucgagaugggcuucgccgagcagcugcaggagaucaucgccagacugcccggcggccaccagaccgugcuguucagcgccacccugcccaagcugcugguggaguucgccagagccggccugaccgagcccgugcugaucagacuggacguggacaccaagcugaacgagcagcugaagaccagcuucuuccuggugagagaggacaccaaggccgccgugcugcugcaccugcugcacaacguggugagaccccaggaccagaccgugguguucguggccaccaagcaccacgccgaguaccugaccgagcugcugaccacccagagagugagcugcgcccacaucuacagcgcccuggaccccaccgccagaaagaucaaccuggccaaguucacccugggcaagugcagcacccugaucgugaccgaccuggccgccagaggccuggacaucccccugcuggacaacgugaucaacuacagcuuccccgccaagggcaagcuguuccugcacagagugggcagaguggccagagccggcagaagcggcaccgccuacagccugguggcccccgacgagauccccuaccugcuggaccugcaccuguuccugggcagaagccugacccuggccagaccccugaaggagcccagcggcguggccggcguggacggcaugcugggcagagugccccagagcgugguggacgaggaggacagcggccugcagagcacccuggaggccagccuggagcugagaggccuggccagaguggccgacaacgcccagcagcaguacgugagaagcagacccgcccccagccccgagagcaucaagagagccaaggagauggaccuggugggccugggccugcacccccuguucagcagcagauucgaggaggaggagcugcagagacugagacugguggacagcaucaagaacuacagaagcagagccaccaucuucgagaucaacgccagcagcagagaccugugcagccaggugaugagagccaagagacagaaggacagaaaggccaucgccagauuccagcagggccagcagggcagacaggagcagcaggagggccccgugggccccgcccccagcagacccgcccugcaggagaagcagcccgagaaggaggaggaggaggaggccggcgagagcguggaggacaucuucagcgagguggugggcagaaagagacagagaagcggccccaacagaggcgccaagagaagaagagaggaggccagacagagagaccaggaguucuacauccccuacagacccaaggacuucgacagcgagagaggccugagcaucagcggcgagggcggcgccuucgagcagcaggccgccggcgccgugcuggaccugaugggcgacgaggcccagaaccugaccagaggcagacagcagcugaagugggacagaaagaagaagagauucgugggccagagcggccaggaggacaagaagaagaucaagaccgagagcggcagauacaucagcagcagcuacaagagagaccuguaccagaaguggaagcagaagcagaagaucgacgacagagacagcgacgaggagggcgccagcgacagaagaggccccgagagaagaggcggcaagagagacagaggccaggccggcgccagcagaccccacgcccccggcacccccgccggcagagugagacccgagcugaagaccaagcagcagauccugaagcagagaagaagagcccagaagcugcacuuccugcagagaggcggccugaagcagcugagcgccagaaacagaagaagagugcaggagcugcagcagggcgccuucggcagaggcgccagaagcaagaagggcaagaugagaaagagaauguaa

SEQ ID NO: 16036 - RNA, 1524 nt, Artificial Sequence
  DDX56__Homo_sapiens__NP_001244118
auggaggacagcgaggcccugggcuucgagcacaugggccuggaccccagacugcugcaggccgugaccgaccugggcuggagcagacccacccugauccaggagaaggccaucccccuggcccuggagggcaaggaccugcuggccagagccagaaccggcagcggcaagaccgccgccuacgccauccccaugcugcagcugcugcugcacagaaaggccaccggccccgugguggagcaggccgugagaggccuggugcuggugcccaccaaggagcuggccagacaggcccagagcaugauccagcagcuggccaccuacugcgccagagacgugagaguggccaacgugagcgccgccgaggacagcgugagccagagagccgugcugauggagaagcccgacgugguggugggcacccccagcagaauccugagccaccugcagcaggacagccugaagcugagagacagccuggagcugcuggugguggacgaggccgaccugcuguucagcuucggcuucgaggaggagcugaagagccugcugugccaccugcccagaaucuaccaggccuuccugaugagcgccaccuucaacgaggacgugcaggcccugaaggagcugauccugcacaaccccgugacccugaagcugcaggagagccagcugcccggccccgaccagcugcagcaguuccagguggugugcgagaccgaggaggacaaguuccugcugcuguacgcccugcugaagcugagccugaucagaggcaagagccugcuguucgugaacacccuggagagaagcuacagacugagacuguuccuggagcaguucagcauccccaccugcgugcugaacggcgagcugccccugagaagcagagccagcgaccccgaggccggcguggccagaggcaucgacuuccaccacgugagcgccgugcugaacuucgaccugccccccacccccgaggccuacauccacagagccggcagaaccgccagagccaacaaccccggcaucgugcugaccuucgugcugcccaccgagcaguuccaccugggcaagaucgaggagcugcugagcggcgagaacagaggccccauccugcugcccuaccaguucagaauggaggagaucgagggcuucagauacagaugcagagacgccaugagaagcgugaccaagcaggccaucagagaggccagacugaaggagaucaaggaggagcugcugcacagcgagaagcugaagaccuacuucgaggacaaccccagagaccugcagcugcugagacacgaccugccccugcaccccgccguggugaagccccaccugggccacgugcccgacuaccuggugccccccgcccugagaggccuggugagaccccacaagaagagaaagaagcugagcagcagcugcagaaaggccaagagagccaagagccagaacccccugagaagcuucaagcacaagggcaagaaguucagacccaccgccaagcccagcuaa

SEQ ID NO: 16037 - RNA, 2778 nt, Artificial Sequence
  DDX58__Homo_sapiens__NP_055129
augaccaccgagcagagaagaagccugcaggccuuccaggacuacaucagaaagacccuggaccccaccuacauccugagcuacauggcccccugguucagagaggaggaggugcaguacauccaggccgagaagaacaacaagggccccauggaggccgccacccuguuccugaaguuccugcuggagcugcaggaggagggcugguucagaggcuuccuggacgcccuggaccacgccggcuacagcggccuguacgaggccaucgagagcugggacuucaagaagaucgagaagcuggaggaguacagacugcugcugaagagacugcagcccgaguucaagaccagaaucauccccaccgacaucaucagcgaccugagcgagugccugaucaaccaggagugcgaggagauccugcagaucugcagcaccaagggcaugauggccggcgccgagaagcugguggagugccugcugagaagcgacaaggagaacuggcccaagacccugaagcuggcccuggagaaggagagaaacaaguucagcgagcuguggaucguggagaagggcaucaaggacguggagaccgaggaccuggaggacaagauggagaccagcgacauccagaucuucuaccaggaggaccccgagugccagaaccugagcgagaacagcugcccccccagcgaggugagcgacaccaaccuguacagccccuucaagcccagaaacuaccagcuggagcuggcccugcccgccaugaagggcaagaacaccaucaucugcgcccccaccggcugcggcaagaccuucgugagccugcugaucugcgagcaccaccugaagaaguucccccagggccagaagggcaaggugguguucuucgccaaccagauccccguguacgagcagcagaagagcguguucagcaaguacuucgagagacacggcuacagagugaccggcaucagcggcgccaccgccgagaacgugcccguggagcagaucguggagaacaacgacaucaucauccugaccccccagauccuggugaacaaccugaagaagggcaccauccccagccugagcaucuucacccugaugaucuucgacgagugccacaacaccagcaagcagcaccccuacaacaugaucauguucaacuaccuggaccagaagcugggcggcagcagcggcccccugccccaggugaucggccugaccgccagcgugggcgugggcgacgccaagaacaccgacgaggcccuggacuacaucugcaagcugugcgccagccuggacgccagcgugaucgccaccgugaagcacaaccuggaggagcuggagcaggugguguacaagccccagaaguucuucagaaagguggagagcagaaucagcgacaaguucaaguacaucaucgcccagcugaugagagacaccgagagccuggccaagagaaucugcaaggaccuggagaaccugagccagauccagaacagagaguucggcacccagaaguacgagcaguggaucgugaccgugcagaaggccugcaugguguuccagaugcccgacaaggacgaggagagcagaaucugcaaggcccuguuccuguacaccagccaccugagaaaguacaacgacgcccugaucaucagcgagcacgccagaaugaaggacgcccuggacuaccugaaggacuucuucagcaacgugagagccgccggcuucgacgagaucgagcaggaccugacccagagauucgaggagaagcugcaggagcuggagagcgugagcagagaccccagcaacgagaaccccaagcuggaggaccugugcuucauccugcaggaggaguaccaccugaaccccgagaccaucaccauccuguucgugaagaccagagcccugguggacgcccugaagaacuggaucgagggcaaccccaagcugagcuuccugaagcccggcauccugaccggcagaggcaagaccaaccagaacaccggcaugacccugcccgcccagaagugcauccuggacgccuucaaggccagcggcgaccacaacauccugaucgccaccagcguggccgacgagggcaucgacaucgcccagugcaaccuggugauccuguacgaguacgugggcaacgugaucaagaugauccagaccagaggcagaggcagagccagaggcagcaagugcuuccugcugaccagcaacgccggcgugaucgagaaggagcagaucaacauguacaaggagaagaugaugaacgacagcauccugagacugcagaccugggacgaggccguguucagagagaagauccugcacauccagacccacgagaaguucaucagagacagccaggagaagcccaagcccgugcccgacaaggagaacaagaagcugcugugcagaaagugcaaggcccuggccugcuacaccgccgacgugagagugaucgaggagugccacuacaccgugcugggcgacgccuucaaggagugcuucgugagcagaccccaccccaagcccaagcaguucagcagcuucgagaagagagccaagaucuucugcgccagacagaacugcagccacgacuggggcauccacgugaaguacaagaccuucgagauccccgugaucaagaucgagagcuucgugguggaggacaucgccaccggcgugcagacccuguacagcaaguggaaggacuuccacuucgagaagauccccuucgaccccgccgagaugagcaaguaa

SEQ ID NO: 16038 - RNA, 1860 nt, Artificial Sequence
  DDX59__Homo_sapiens__NP_001026895
auguucgugcccagaagccugaagaucaagagaaacgccaacgacgacggcaagagcugcguggccaagaucaucaagcccgaccccgaggaccugcagcuggacaagagcagagacgugcccguggacgccguggccaccgaggccgccaccaucgacagacacaucagcgagagcugccccuuccccagccccggcggccagcuggccgaggugcacagcgugagccccgagcagggcgccaaggacagccaccccagcgaggagcccgugaagagcuucagcaagacccagagaugggccgagcccggcgagcccaucugcguggugugcggcagauacggcgaguacaucugcgacaagaccgacgaggacgugugcagccuggagugcaaggccaagcaccugcugcaggugaaggagaaggaggagaagagcaagcugagcaacccccagaaggccgacagcgagcccgagagcccccugaacgccagcuacguguacaaggagcaccccuucauccugaaccugcaggaggaccagaucgagaaccugaagcagcagcugggcauccuggugcagggccaggaggugaccagacccaucaucgacuucgagcacugcagccugcccgaggugcugaaccacaaccugaagaagagcggcuacgaggugcccacccccauccagaugcagaugauccccgugggccugcugggcagagacauccuggccagcgccgacaccggcagcggcaagaccgccgccuuccugcugcccgugaucaugagagcccuguucgagagcaagacccccagcgcccugauccugacccccaccagagagcuggccauccagaucgagagacaggccaaggagcugaugagcggccugcccagaaugaagaccgugcugcuggugggcggccugccccugcccccccagcuguacagacugcagcagcacgugaaggugaucaucgccacccccggcagacugcuggacaucaucaagcagagcagcguggagcugugcggcgugaagaucguggugguggacgaggccgacaccaugcugaagaugggcuuccagcagcaggugcuggacauccuggagaacauccccaacgacugccagaccauccuggugagcgccaccauccccaccagcaucgagcagcuggccagccagcugcugcacaaccccgugagaaucaucaccggcgagaagaaccugcccugcgccaacgugagacagaucauccuguggguggaggaccccgccaagaagaagaagcuguucgagauccugaacgacaagaagcuguucaagccccccgugcugguguucguggacugcaagcugggcgccgaccugcugagcgaggccgugcagaagaucaccggccugaagagcaucagcauccacagcgagaagagccagaucgagagaaagaacauccugaagggccugcuggagggcgacuacgaggugguggugagcaccggcgugcugggcagaggccuggaccugaucagcgugagacugguggugaacuucgacaugcccagcagcauggacgaguacgugcaccagaucggcagagugggcagacugggccagaacggcaccgccaucaccuucaucaacaacaacagcaagagacuguucugggacaucgccaagagagugaagcccaccggcagcauccugcccccccagcugcugaacagccccuaccugcacgaccagaagagaaaggagcagcagaaggacaagcagacccagaacgaccuggugaccggcgccaaccugauggacaucaucagaaagcacgacaagagcaacagccagaaguaa

SEQ ID NO: 16039 - RNA, 1845 nt, Artificial Sequence
  DDX5__Homo_sapiens__NP_004387
augagcggcuacagcagcgacagagacagaggcagagacagaggcuucggcgcccccagauucggcggcagcagagccggcccccugagcggcaagaaguucggcaaccccggcgagaagcuggugaagaagaaguggaaccuggacgagcugcccaaguucgagaagaacuucuaccaggagcaccccgaccuggccagaagaaccgcccaggagguggagaccuacagaagaagcaaggagaucaccgugagaggccacaacugccccaagcccgugcugaacuucuacgaggccaacuuccccgccaacgugauggacgugaucgccagacagaacuucaccgagcccaccgccauccaggcccagggcuggcccguggcccugagcggccuggacauggugggcguggcccagaccggcagcggcaagacccugagcuaccugcugcccgccaucgugcacaucaaccaccagcccuuccuggagagaggcgacggccccaucugccuggugcuggcccccaccagagagcuggcccagcaggugcagcagguggccgccgaguacugcagagccugcagacugaagagcaccugcaucuacggcggcgcccccaagggcccccagaucagagaccuggagagaggcguggagaucugcaucgccacccccggcagacugaucgacuuccuggagugcggcaagaccaaccugagaagaaccaccuaccuggugcuggacgaggccgacagaaugcuggacaugggcuucgagccccagaucagaaagaucguggaccagaucagacccgacagacagacccugauguggagcgccaccuggcccaaggaggugagacagcuggccgaggacuuccugaaggacuacauccacaucaacaucggcgcccuggagcugagcgccaaccacaacauccugcagaucguggacgugugccacgacguggagaaggacgagaagcugaucagacugauggaggagaucaugagcgagaaggagaacaagaccaucguguucguggagaccaagagaagaugcgacgagcugaccagaaagaugagaagagacggcuggcccgccaugggcauccacggcgacaagagccagcaggagagagacugggugcugaacgaguucaagcacggcaaggcccccauccugaucgccaccgacguggccagcagaggccuggacguggaggacgugaaguucgugaucaacuacgacuaccccaacagcagcgaggacuacauccacagaaucggcagaaccgccagaagcaccaagaccggcaccgccuacaccuucuucacccccaacaacaucaagcaggugagcgaccugaucagcgugcugagagaggccaaccaggccaucaaccccaagcugcugcagcugguggaggacagaggcagcggcagaagcagaggcagaggcggcaugaaggacgacagaagagacagauacagcgccggcaagagaggcggcuucaacaccuucagagacagagagaacuacgacagaggcuacagcagccugcugaagagagacuucggcgccaagacccagaacggcguguacagcgccgccaacuacaccaacggcagcuucggcagcaacuucgugagcgccggcauccagaccagcuucagaaccggcaaccccaccggcaccuaccagaacggcuacgacagcacccagcaguacggcagcaacgugcccaacaugcacaacggcaugaaccagcaggccuacgccuaccccgccaccgccgccgcccccaugaucggcuaccccaugcccaccggcuacagccaguaa

SEQ ID NO: 16040 - RNA, 5139 nt, Artificial Sequence
  DDX60__Homo_sapiens__NP_060101
auggagagaaacgugcugaccaccuucagccaggagaugagccagcugauccugaacgagaugcccaaggccgaguacagcagccuguucaacgacuucguggagagcgaguucuuccugaucgacggcgacagccugcugaucaccugcaucugcgagaucagcuucaagcccggccagaaccugcacuucuucuaccugguggagagauaccugguggaccugaucagcaagggcggccaguucaccaucguguucuucaaggacgccgaguacgccuacuucaacuuccccgagcugcugagccugagaaccgcccugauccugcaccugcagaagaacaccaccaucgacgugagaaccaccuucagcagaugccugagcaaggaguggggcagcuuccuggaggagagcuaccccuacuuccugaucguggccgacgagggccugaacgaccugcagacccagcuguucaacuuccugaucauccacagcugggccagaaaggugaacguggugcugagcagcggccaggagagcgacgugcugugccuguacgccuaccugcugcccagcauguacagacaccagaucuucagcuggaagaacaagcagaacaucaaggacgccuacaccacccugcugaaccagcuggagagauucaagcugagcgcccuggccccccuguucggcagccugaaguggaacaacaucaccgaggaggcccacaagaccgugagccugcugacccagguguggcccgagggcagcgacaucagaagaguguucugcgugaccagcugcagccugagccugagaauguaccacagauuccugggcaacagagagcccagcagcggccaggagaccgagauccagcaggugaacagcaacugccugacccugcaggagauggaggaccugugcaagcugcacugccugaccgugguguuccugcugcaccugccccugagccagagagccugcgccagagugaucaccagccacugggccgaggacaugaagccccugcugcagaugaagaaguggugcgaguacuucauccugagaaacauccacaccuucgaguucuggaaccugaaccugauccaccugagcgaccugaacgacgagcugcugcugaagaacaucgccuucuacuacgagaacgagaacgugaagggccugcaccugaaccugggcgacaccaucaugaaggacuacgaguaccuguggaacaccgugagcaagcuggugagagacuucgaggugggccagcccuucccccugagaaccaccaaggugugcuuccuggagaagaagcccagccccaucaaggacagcagcaacgagauggugcccaaccugggcuucauccccaccagcagcuucgugguggacaaguucgccggcgacauccugaaggaccugcccuuccugaagagcgacgaccccaucgugaccagccuggugaagcagaaggaguucgacgagcuggugcacuggcacagccacaagccccugagcgacgacuacgacagaagcagaugccaguucgacgagaagagcagagaccccagagugcugagaagcgugcagaaguaccacguguuccagagauucuacggcaacagccuggagaccgugagcagcaagaucaucgugacccagaccaucaagagcaagaaggacuucagcggccccaagagcaagaaggcccacgagaccaaggccgagaucaucgccagagagaacaagaagagacuguucgccagagaggagcagaaggaggagcagaaguggaacgcccugagcuucagcaucgaggagcagcugaaggagaaccugcacagcggcaucaagagccuggaggacuuccugaagagcugcaagagcagcugcgugaagcugcagguggagauggugggccugaccgccugccugaaggccuggaaggagcacugcagaagcgaggagggcaagaccaccaaggaccugagcaucgccgugcaggugaugaagagaauccacagccugauggagaaguacagcgagcugcugcaggaggacgacagacagcugaucgccagaugccugaaguaccugggcuucgacgagcuggccagcagccugcaccccgcccaggacgccgagaacgacgugaaggugaagaagagaaacaaguacagcgugggcaucggccccgccagauuccagcugcaguacaugggccacuaccugaucagagacgagagaaaggaccccgaccccagagugcaggacuucauccccgacaccuggcagagagagcugcuggacgugguggacaagaacgagagcgccgugaucguggcccccaccagcagcggcaagaccuacgccagcuacuacugcauggagaaggugcugaaggagagcgacgacggcguggugguguacguggcccccaccaaggcccuggugaaccagguggccgccaccgugcagaacagauucaccaagaaccugcccagcggcgaggugcugugcggcguguucaccagagaguacagacacgacgcccugaacugccaggugcugaucaccgugcccgccugcuucgagauccugcugcuggccccccacagacagaacugggugaagaagaucagauacgugaucuucgacgaggugcacugccugggcggcgagaucggcgccgagaucugggagcaccugcuggugaugaucagaugccccuuccuggcccugagcgccaccaucagcaaccccgagcaccugaccgaguggcugcagagcgugaagugguacuggaagcaggaggacaagaucaucgagaacaacaccgccagcaagagacacgugggcagacaggccggcuuccccaaggacuaccugcaggugaagcagagcuacaaggugagacuggugcuguacggcgagagauacaacgaccuggagaagcacgugugcagcaucaagcacggcgacauccacuucgaccacuuccaccccugcgccgcccugaccaccgaccacaucgagagauacggcuucccccccgaccugacccugagccccagagagagcauccagcuguacgacgccauguuccagaucuggaagagcuggcccagagcccaggagcugugccccgagaacuucauccacuucaacaacaagcuggugaucaagaagauggacgccagaaaguacgaggagagccugaaggccgagcugaccagcuggaucaagaacggcaacguggagcaggccagaauggugcugcagaaccugagccccgaggccgaccugagccccgagaacaugaucaccauguucccccugcugguggagaagcugagaaagauggagaagcugcccgcccuguucuuccuguucaagcugggcgccguggagaacgccgccgagagcgugagcaccuuccugaagaagaagcaggagaccaagagaccccccaaggccgacaaggaggcccacgugauggccaacaagcugagaaaggugaagaagagcaucgagaagcagaagaucaucgacgagaagagccagaagaagaccagaaacguggaccagagccugauccacgaggccgagcacgacaaccuggugaagugccuggagaagaaccuggagaucccccaggacugcaccuacgccgaccagaaggccguggacaccgagacccugcagaagguguucggcagagugaaguucgagagaaagggcgaggagcugaaggcccuggccgagagaggcaucggcuaccaccacagcgccaugagcuucaaggagaagcagcugguggagauccuguucagaaagggcuaccugagaguggugaccgccaccggcacccuggcccugggcgugaacaugcccugcaagagcgugguguucgcccagaacagcguguaccuggacgcccugaacuacagacagaugagcggcagagccggcagaagaggccaggaccugaugggcgacguguacuucuucgacauccccuuccccaagaucggcaagcugaucaagagcaacgugcccgagcugagaggccacuucccccugagcaucacccuggugcugagacugaugcugcuggccagcaagggcgacgaccccgaggacgccaaggccaaggugcugagcgugcugaagcacagccugcugagcuucaagcagcccagagugauggacaugcugaagcuguacuuccuguucagccugcaguuccuggugaaggagggcuaccuggaccaggagggcaaccccaugggcuucgccggccuggugagccaccugcacuaccacgagcccagcaaccugguguucgugagcuuccuggugaacggccuguuccacgaccugugccagcccaccagaaagggcagcaagcacuucagccaggacgugauggagaagcuggugcuggugcuggcccaccuguucggcagaagauacuucccccccaaguuccaggacgcccacuucgaguucuaccagagcaagguguuccuggacgaccugcccgaggacuucagcgacgcccuggacgaguacaacaugaagaucauggaggacuucaccaccuuccugagaaucgugagcaagcuggccgacaugaaccaggaguaccagcugccccugagcaagaucaaguucaccggcaaggagugcgaggacagccagcuggugagccaccugaugagcugcaaggagggcagaguggccaucagccccuucgugugccugagcggcaacuucgacgacgaccugcugagacuggagacccccaaccacgugacccugggcaccaucggcgugaacagaagccaggcccccgugcugcugagccagaaguucgacaacagaggcagaaagaugagccugaacgccuacgcccuggacuucuacaagcacggcagccugaucggccuggugcaggacaacagaaugaacgagggcgacgccuacuaccugcugaaggacuucgcccugaccaucaagagcaucagcgugagccugagagagcugugcgagaacgaggacgacaacguggugcuggccuucgagcagcugagcaccaccuucugggagaagcugaacaagguguaa

SEQ ID NO: 16041 - RNA, 1452 nt, Artificial Sequence
  DDX6__Homo_sapiens__NP_004388
augagcaccgccagaaccgagaaccccgugaucaugggccugagcagccagaacggccagcugagaggccccgugaagcccaccggcggccccggcggcggcggcacccagacccagcagcagaugaaccagcugaagaacaccaacaccaucaacaacggcacccagcagcaggcccagagcaugaccaccaccaucaagcccggcgacgacuggaagaagacccugaagcugccccccaaggaccugagaaucaagaccagcgacgugaccagcaccaagggcaacgaguucgaggacuacugccugaagagagagcugcugaugggcaucuucgagaugggcugggagaagcccagccccauccaggaggagagcauccccaucgcccugagcggcagagacauccuggccagagccaagaacggcaccggcaagagcggcgccuaccugaucccccugcuggagagacuggaccugaagaaggacaacauccaggccauggugaucgugcccaccagagagcuggcccugcaggugagccagaucugcauccaggugagcaagcacaugggcggcgccaaggugauggccaccaccggcggcaccaaccugagagacgacaucaugagacuggacgacaccgugcacguggugaucgccacccccggcagaauccuggaccugaucaagaagggcguggccaagguggaccacgugcagaugaucgugcuggacgaggccgacaagcugcugagccaggacuucgugcagaucauggaggacaucauccugacccugcccaagaacagacagauccugcuguacagcgccaccuucccccugagcgugcagaaguucaugaacagccaccugcagaagcccuacgagaucaaccugauggaggagcugacccugaagggcgugacccaguacuacgccuacgugaccgagagacagaaggugcacugccugaacacccuguucagcagacugcagaucaaccagagcaucaucuucugcaacagcagccagagaguggagcugcuggccaagaagaucagccagcugggcuacagcugcuucuacauccacgccaagaugagacaggagcacagaaacagaguguuccacgacuucagaaacggccugugcagaaaccuggugugcaccgaccuguucaccagaggcaucgacauccaggccgugaacguggugaucaacuucgacuuccccaagcuggccgagaccuaccugcacagaaucggcagaagcggcagauucggccaccugggccuggccaucaaccugaucaccuacgacgacagauucaaccugaagagcaucgaggagcagcugggcaccgagaucaagcccauccccagcaacaucgacaagagccuguacguggccgaguaccacagcgagcccguggaggacgagaagcccuaa

SEQ ID NO: 16042 - RNA, 1473 nt, Artificial Sequence
  DEAF1__Homo_sapiens__NP_001280563
auggaggacagcgacagcgccgccaagcagcugggccuggccgaggccgccgccguggccgccgccgccgccguggccgccgccgccgccgccgccgccggcggcgaggccgaggagcccgugcugagcagagacgaggacagcgaggaggacgccgacagcgaggccgagagagagacccccagagugaccgccguggccgugauggccgccgagcccggccacauggacaugggcgccgaggcccugcccggccccgacgaggccgccgccgccgccgccuucgccgaggugaccaccgugaccguggccaacgugggcgccgccgccgacaacguguucaccaccagcguggccaacgccgccagcaucagcggccacgugcugagcggcagaaccgcccugcagaucggcgacagccugaacaccgagaaggccacccugaucguggugcacaccgacggcagcaucguggagaccaccggccugaagggccccgccgccccccugacccccggcccccagagcccccccaccccccuggcccccggccaggagaagggcggcaccaaguacaacugggaccccagcguguacgacagcgagcugcccgugagaugcagaaacaucagcggcacccuguacaagaacagacugggcagcggcugggaccugaagcccagcagaugccugcugcaccugugcugccugcugagaagacacgaccugaucaccgugacccccagcggccagaucaccaccagcggcgcccugaccuucgacagagccagcaccguggaggccaccgccgugaucagcgagagccccgcccagggcgacguguucgccggcgccaccgugcaggaggccagcgugcagccccccugcagagccagccaccccgagccccacuaccccggcuaccaggacagcugccagaucgcccccuuccccgaggccgcccugcccaccagccaccccaagaucgugcugaccagccugcccgcccuggccgugcccccccccacccccaccaaggccgccccccccgcccuggugaacggccuggagcugagcgagcccagaagcuggcuguaccuggaggagauggugaacagccugcugaacaccgcccagcagcugaagacccuguucgagcaggccaagcacgccagcaccuacagagaggccgccaccaaccaggccaagauccacgccgacgccgagagaaaggaggugauccacccccccagacugcccaaggugcugggccugcagcagagcugcgugaacugcggcagagaggccaugagcgagugcaccggcugccacaaggugaacuacugcagcaccuucugccagagaaaggacuggaaggaccaccagcacaucugcggccagagcgccgccgugaccgugcaggccgacgaggugcacguggccgagagcgugauggagaaggugaccguguaa

SEQ ID NO: 16043 - RNA, 213 nt, Artificial Sequence
  DEC1__Homo_sapiens__XP_011517055
augaccaugaacgugcuggaggccggcaaguggaagagcaucgugcccgcccccggcgagggccugcuggccgugcugcacaugaugguguucaccgacgcccugcacagagagagaagcgugaaguggcaggccggcgugugcuacaacggcggcaaggacuucgccgugagccuggccagacccaaggccgccgagggcaucgccgacuaa

SEQ ID NO: 16044 - RNA, 1008 nt, Artificial Sequence
  DECR1__Homo_sapiens__NP_001350
augaagcugcccgccagaguguucuucacccugggcagcagacugcccugcggccuggcccccagaagauucuucagcuacggcaccaagauccuguaccagaacaccgaggcccugcagagcaaguucuucagcccccugcagaaggccaugcugccccccaacagcuuccagggcaagguggccuucaucaccggcggcggcaccggccugggcaagggcaugaccacccugcugagcagccugggcgcccagugcgugaucgccagcagaaagauggacgugcugaaggccaccgccgagcagaucagcagccagaccggcaacaaggugcacgccauccagugcgacgugagagaccccgacauggugcagaacaccgugagcgagcugaucaagguggccggccaccccaacaucgugaucaacaacgccgccggcaacuucaucagccccaccgagagacugagccccaacgccuggaagaccaucaccgacaucgugcugaacggcaccgccuucgugacccuggagaucggcaagcagcugaucaaggcccagaagggcgccgccuuccugagcaucaccaccaucuacgccgagaccggcagcggcuucguggugcccagcgccagcgccaaggccggcguggaggccaugagcaagagccuggccgccgaguggggcaaguacggcaugagauucaacgugauccagcccggccccaucaagaccaagggcgccuucagcagacuggaccccaccggcaccuucgagaaggagaugaucggcagaauccccugcggcagacugggcaccguggaggagcuggccaaccuggccgccuuccugugcagcgacuacgccagcuggaucaacggcgccgugaucaaguucgacggcggcgaggaggugcugaucagcggcgaguucaacgaccugagaaaggugaccaaggagcagugggacaccaucgaggagcugaucagaaagaccaagggcagcuaa

SEQ ID NO: 16045 - RNA, 957 nt, Artificial Sequence
  DEDD__Homo_sapiens__NP_001034801
auggccggccugaagagaagagccagccagguguggcccgaggagcacggcgagcaggagcacggccuguacagccugcacagaauguucgacaucgugggcacccaccugacccacagagacgugagagugcugagcuuccuguucguggacgugaucgacgaccacgagagaggccugaucagaaacggcagagacuuccugcuggcccuggagagacagggcagaugcgacgagagcaacuucagacaggugcugcagcugcugagaaucaucaccagacacgaccugcugcccuacgugacccugaagagaagaagagccgugugccccgaccugguggacaaguaccuggaggagaccagcaucagauacgugacccccagagcccugagcgaccccgagcccagacccccccagcccagcaagaccgugcccccccacuaccccguggugugcugccccaccagcggcccccagaugugcagcaagagacccgccagaggcagagccacccugggcagccagagaaagagaagaaagagcgugacccccgaccccaaggagaagcagaccugcgacaucagacugagagugagagccgaguacugccagcacgagaccgcccugcagggcaacguguucagcaacaagcaggacccccuggagagacaguucgagagauucaaccaggccaacaccauccugaagagcagagaccugggcagcaucaucugcgacaucaaguucagcgagcugaccuaccuggacgccuucuggagagacuacaucaacggcagccugcuggaggcccugaagggcguguucaucaccgacagccugaagcaggccgugggccacgaggccaucaagcugcuggugaacguggacgaggaggacuacgagcugggcagacagaagcugcugagaaaccugaugcugcaggcccugcccuaa

SEQ ID NO: 16046 - RNA, 1896 nt, Artificial Sequence
  DEF6__Homo_sapiens__NP_071330
auggcccugagaaaggagcugcugaagagcaucugguacgccuucaccgcccuggacguggagaagagcggcaaggugagcaagagccagcugaaggugcugagccacaaccuguacaccgugcugcacaucccccacgaccccguggcccuggaggagcacuucagagacgacgacgacggccccgugagcagccagggcuacaugcccuaccugaacaaguacauccuggacaagguggaggagggcgccuucgugaaggagcacuucgacgagcugugcuggacccugaccgccaagaagaacuacagagccgacagcaacggcaacagcaugcugagcaaccaggacgccuucagacuguggugccuguucaacuuccugagcgaggacaaguacccccugaucauggugcccgacgagguggaguaccugcugaagaaggugcugagcagcaugagccuggaggugagccugggcgagcuggaggagcugcuggcccaggaggcccagguggcccagaccaccggcggccugagcguguggcaguuccuggagcuguucaacagcggcagaugccugagaggcgugggcagagacacccugagcauggccauccacgagguguaccaggagcugauccaggacgugcugaagcagggcuaccuguggaagagaggccaccugagaagaaacugggccgagagaugguuccagcugcagcccagcugccugugcuacuucggcagcgaggagugcaaggagaagagaggcaucaucccccuggacgcccacugcugcguggaggugcugcccgacagagacggcaagagaugcauguucugcgugaagaccgccaacagaaccuacgagaugagcgccagcgacaccagacagagacaggaguggaccgccgccauccagauggccaucagacugcaggccgagggcaagaccagccugcacaaggaccugaagcagaagagaagagagcagagagagcagagagagagaagaagagccgccaaggaggaggagcugcugagacugcagcagcugcaggaggagaaggagagaaagcugcaggagcuggagcugcugcaggaggcccagagacaggccgagagacugcugcaggaggaggaggagagaagaagaagccagcacagagagcugcagcaggcccuggagggccagcugagagaggccgagcaggccagagccagcaugcaggccgagauggagcugaaggaggaggaggccgccagacagagacagagaaucaaggagcuggaggagaugcagcagagacugcaggaggcccugcagcuggaggugaaggccagaagagacgaggagagcgugagaaucgcccagaccagacugcuggaggaggaggaggagaagcugaagcagcugaugcagcugaaggaggagcaggagagauacaucgagagagcccagcaggagaaggaggagcugcagcaggagauggcccagcagagcagaagccugcagcaggcccagcagcagcuggaggaggugagacagaacagacagagagccgacgaggacguggaggccgcccagagaaagcugagacaggccagcaccaacgugaagcacuggaacgugcagaugaacagacugaugcaccccaucgagcccggcgacaagagacccgugaccagcagcagcuucagcggcuuccagcccccccugcuggcccacagagacagcagccugaagagacugaccagauggggcagccagggcaacagaacccccagccccaacagcaacgagcagcagaagagccugaacggcggcgacgaggcccccgcccccgccagcaccccccaggaggacaagcuggaccccgcccccgagaacuaa

SEQ ID NO: 16047 - RNA, 285 nt, Artificial Sequence
  DEFA1B__Homo_sapiens__NP_001035965
augagaacccuggccauccuggccgccauccugcugguggcccugcaggcccaggccgagccccugcaggccagagccgacgagguggccgccgcccccgagcagaucgccgccgacauccccgaggugguggugagccuggccugggacgagagccuggcccccaagcaccccggcagcagaaagaacauggccugcuacugcagaauccccgccugcaucgccggcgagagaagauacggcaccugcaucuaccagggcagacugugggccuucugcugcuaa

SEQ ID NO: 16048 - RNA, 285 nt, Artificial Sequence
  DEFA3__Homo_sapiens__NP_005208
augagaacccuggccauccuggccgccauccugcugguggcccugcaggcccaggccgagccccugcaggccagagccgacgagguggccgccgcccccgagcagaucgccgccgacauccccgaggugguggugagccuggccugggacgagagccuggcccccaagcaccccggcagcagaaagaacauggacugcuacugcagaauccccgccugcaucgccggcgagagaagauacggcaccugcaucuaccagggcagacugugggccuucugcugcuaa

SEQ ID NO: 16049 - RNA, 294 nt, Artificial Sequence
  DEFA4__Homo_sapiens__NP_001916
augagaaucaucgcccugcuggccgccauccugcugguggcccugcaggugagagccggcccccugcaggccagaggcgacgaggcccccggccaggagcagagaggccccgaggaccaggacaucagcaucagcuucgccugggacaagagcagcgcccugcaggugagcggcagcaccagaggcauggugugcagcugcagacugguguucugcagaagaaccgagcugagagugggcaacugccugaucggcggcgugagcuucaccuacugcugcaccagaguggacuaa

SEQ ID NO: 16050 - RNA, 285 nt, Artificial Sequence
  DEFA5__Homo_sapiens__NP_066290
augagaaccaucgccauccuggccgccauccugcugguggcccugcaggcccaggccgagagccugcaggagagagccgacgaggccaccacccagaagcagagcggcgaggacaaccaggaccuggccaucagcuucgccggcaacggccugagcgcccugagaaccagcggcagccaggccagagccaccugcuacugcagaaccggcagaugcgccaccagagagagccugagcggcgugugcgagaucagcggcagacuguacagacugugcugcagauaa

SEQ ID NO: 16051 - RNA, 303 nt, Artificial Sequence
  DEFA6__Homo_sapiens__NP_001917
augagaacccugaccauccugaccgccgugcugcugguggcccugcaggccaaggccgagccccugcaggccgaggacgacccccugcaggccaaggccuacgaggccgacgcccaggagcagagaggcgccaacgaccaggacuucgccgugagcuucgccgaggacgccagcagcagccugagagcccugggcagcaccagagccuucaccugccacugcagaagaagcugcuacagcaccgaguacagcuacggcaccugcaccgugaugggcaucaaccacagauucugcugccuguaa

SEQ ID NO: 16052 - RNA, 204 nt, Artificial Sequence
  DEFB103B__Homo_sapiens__NP_061131
augagaauccacuaccugcuguucgcccugcuguuccuguuccuggugcccgugcccggccacggcggcaucaucaacacccugcagaaguacuacugcagagugagaggcggcagaugcgccgugcugagcugccugcccaaggaggagcagaucggcaagugcagcaccagaggcagaaagugcugcagaagaaagaaguaa

SEQ ID NO: 16053 - RNA, 219 nt, Artificial Sequence
  DEFB104B__Homo_sapiens__NP_001035792
augcagagacuggugcugcugcuggccaucagccugcugcuguaccaggaccugcccgugagaagcgaguucgagcuggacagaaucugcggcuacggcaccgccagaugcagaaagaagugcagaagccaggaguacagaaucggcagaugccccaacaccuacgccugcugccugagaaagugggacgagagccugcugaacagaaccaagcccuaa

SEQ ID NO: 16054 - RNA, 237 nt, Artificial Sequence
  DEFB105A__Homo_sapiens__NP_689463
auggcccugaucagaaagaccuucuacuuccuguucgccauguucuucauccuggugcagcugcccagcggcugccaggccggccuggacuucagccagcccuuccccagcggcgaguucgccgugugcgagagcugcaagcugggcagaggcaagugcagaaaggagugccuggagaacgagaagcccgacggcaacugcagacugaacuuccugugcugcagacagagaaucuaa

SEQ ID NO: 16055 - RNA, 198 nt, Artificial Sequence
  DEFB106A__Homo_sapiens__NP_689464
augagaaccuuccuguuccuguucgccgugcuguucuuccugacccccgccaagaacgccuucuucgacgagaagugcaacaagcugaagggcaccugcaagaacaacugcggcaagaacgaggagcugaucgcccugugccagaagagccugaagugcugcagaaccauccagcccugcggcagcaucaucgacuaa

SEQ ID NO: 16056 - RNA, 222 nt, Artificial Sequence
  DEFB108B__Homo_sapiens__NP_001002035
augagaaucgccgugcugcuguucgccaucuucuucuucaugagccaggugcugcccgccagaggcaaguucaaggagaucugcgagagacccaacggcagcugcagagacuucugccuggagaccgagauccacgugggcagaugccugaacagccagcccugcugccugccccugggccaccagcccagaaucgagagcaccacccccaagaaggacuaa

SEQ ID NO: 16057 - RNA, 342 nt, Artificial Sequence
  DEFB112__Homo_sapiens__NP_001032587
augaagcugcugaccaccaucugcagacugaagcuggagaagauguacagcaagaccaacaccagcagcaccaucuucgagaaggccagacacggcaccgagaagaucagcaccgccagaagcgagggccaccacaucaccuucagcagauggaagagcugcaccgccaucggcggcagaugcaagaaccagugcgacgacagcgaguucagaaucagcuacugcgccagacccaccacccacugcugcgugaccgagugcgaccccaccgaccccaacaacuggauccccaaggacagcgugggcacccaggagugguaccccaaggacagcagacacuaa

SEQ ID NO: 16058 - RNA, 471 nt, Artificial Sequence
  DEFB125__Homo_sapiens__NP_697020
augaacauccugaugcugaccuucaucaucugcggccugcugaccagagugaccaagggcagcuucgagccccagaagugcuggaagaacaacgugggccacugcagaagaagaugccuggacaccgagagauacauccugcugugcagaaacaagcugagcugcugcaucagcaucaucagccacgaguacaccagaagacccgccuuccccgugauccaccuggaggacaucacccuggacuacagcgacguggacagcuucaccggcagccccgugagcaugcugaacgaccugaucaccuucgacaccaccaaguucggcgagaccaugacccccgagaccaacacccccgagaccaccaugccccccagcgaggccaccacccccgagaccaccaugccccccagcgagaccgccaccagcgagaccaugcccccccccagccagaccgcccugacccacaacuaa

SEQ ID NO: 16059 - RNA, 336 nt, Artificial Sequence
  DEFB126__Homo_sapiens__NP_112193
augaagagccugcuguucacccuggccguguucaugcugcuggcccagcuggugagcggcaacugguacgugaagaagugccugaacgacgugggcaucugcaagaagaagugcaagcccgaggagaugcacgugaagaacggcugggccaugugcggcaagcagagagacugcugcgugcccgccgacagaagagccaacuaccccguguucugcgugcagaccaagaccaccagaaucagcaccgugaccgccaccaccgccaccaccacccugaugaugaccaccgccagcaugagcagcauggcccccacccccgugagccccaccggcuaa

SEQ ID NO: 16060 - RNA, 207 nt, Artificial Sequence
  DEFB1__Homo_sapiens__NP_005209
augagaaccagcuaccugcugcuguucacccugugccugcugcugagcgagauggccagcggcggcaacuuccugaccggccugggccacagaagcgaccacuacaacugcgugagcagcggcggccagugccuguacagcgccugccccaucuucaccaagauccagggcaccugcuacagaggcaaggccaagugcugcaaguaa

SEQ ID NO: 16061 - RNA, 195 nt, Artificial Sequence
  DEFB4A__Homo_sapiens__NP_004933
augagagugcuguaccugcuguucagcuuccuguucaucuuccugaugccccugcccggcguguucggcggcaucggcgaccccgugaccugccugaagagcggcgccaucugccaccccguguucugccccagaagauacaagcagaucggcaccugcggccugcccggcaccaagugcugcaagaagcccuaa

SEQ ID NO: 16062 - RNA, 972 nt, Artificial Sequence
  DEGS1__Homo_sapiens__NP_003667
augggcagcagagugagcagagaggacuucgaguggguguacaccgaccagccccacgccgacagaagaagagagauccuggccaaguaccccgagaucaagagccugaugaagcccgaccccaaccugaucuggaucaucaucaugauggugcugacccagcugggcgccuucuacaucgugaaggaccuggacuggaagugggugaucuucggcgccuacgccuucggcagcugcaucaaccacagcaugacccuggccauccacgagaucgcccacaacgccgccuucggcaacugcaaggccauguggaacagaugguucggcauguucgccaaccugcccaucggcauccccuacagcaucagcuucaagagauaccacauggaccaccacagauaccugggcgccgacggcguggacguggacauccccaccgacuucgagggcugguucuucugcaccgccuucagaaaguucaucugggugauccugcagccccuguucuacgccuucagaccccuguucaucaaccccaagcccaucaccuaccuggaggugaucaacaccguggcccaggugaccuucgacauccugaucuacuacuuccugggcaucaagagccugguguacaugcuggccgccagccugcugggccugggccugcaccccaucagcggccacuucaucgccgagcacuacauguuccugaagggccacgagaccuacagcuacuacggcccccugaaccugcugaccuucaacgugggcuaccacaacgagcaccacgacuuccccaacauccccggcaagagccugccccuggugagaaagaucgccgccgaguacuacgacaaccugccccacuacaacagcuggaucaaggugcuguacgacuucgugauggacgacaccaucagccccuacagcagaaugaagagacaccagaagggcgagauggugcuggaguaa

SEQ ID NO: 16063 - RNA, 972 nt, Artificial Sequence
  DEGS2__Homo_sapiens__NP_996801
augggcaacagcgccagcagaagcgacuucgaguggguguacaccgaccagccccacacccagagaagaaaggagauccuggccaaguaccccgccaucaaggcccugaugagacccgaccccagacugaagugggccgugcuggugcuggugcuggugcagaugcuggccugcuggcuggugagaggccuggccuggagauggcugcuguucugggccuacgccuucggcggcugcgugaaccacagccugacccuggccauccacgacaucagccacaacgccgccuucggcaccggcagagccgccagaaacagauggcuggccguguucgccaaccugcccgugggcgugcccuacgccgccagcuucaagaaguaccacguggaccaccacagauaccugggcggcgacggccuggacguggacgugcccaccagacuggagggcugguucuucugcacccccgccagaaagcugcuguggcuggugcugcagcccuucuucuacagccugagaccccugugcgugcaccccaaggccgugaccagaauggaggugcugaacacccuggugcagcuggccgccgaccuggccaucuucgcccuguggggccugaagcccgugguguaccugcuggccagcagcuuccugggccugggccugcaccccaucagcggccacuucguggccgagcacuacauguuccugaagggccacgagaccuacagcuacuacggcccccugaacuggaucaccuucaacgugggcuaccacguggagcaccacgacuuccccagcauccccggcuacaaccugccccuggugagaaagaucgcccccgaguacuacgaccaccugccccagcaccacagcugggugaaggugcugugggacuucguguucgaggacagccugggccccuacgccagagugaagagaguguacagacuggccaaggacggccuguaa

SEQ ID NO: 16064 - RNA, 1026 nt, Artificial Sequence
  DEK__Homo_sapiens__NP_001128181
augagcgccagcgcccccgccgccgagggcgagggcacccccacccagcccgccagcgagaaggagcccgagaugcccggccccagagaggagagcgaggaggaggaggacgaggacgacgaggaggaggaggaggaggagaagggcaagggccagaagcugugcgagaucgagagaauccacuucuuccugagcaagaagaagaccgacgagcugagaaaccugcacaagcugcuguacaacagacccggcaccgugagcagccugaagaagaacgugggccaguucagcggcuuccccuucgagaagggcagcgugcaguacaagaagaaggaggagaugcugaagaaguucagaaacgccaugcugaagagcaucugcgaggugcuggaccuggagagaagcggcgugaacagcgagcuggugaagagaauccugaacuuccugaugcaccccaagcccagcggcaagccccugcccaagagcaagaagaccugcagcaagggcagcaagaaggagagaaacagcagcggcauggccagaaaggccaagagaaccaagugccccgagauccugagcgacgagagcagcagcgacgaggacgagaagaagaacaaggaggagagcagcgacgacgaggacaaggagagcgaggaggagccccccaagaagaccgccaagagagagaagcccaagcagaaggccaccagcaagagcaagaagagcgugaagagcgccaacgugaagaaggccgacagcagcaccaccaagaagaaccagaacagcagcaagaaggagagcgagagcgaggacagcagcgacgacgagccccugaucaagaagcugaagaagccccccaccgacgaggagcugaaggagaccaucaagaagcugcuggccagcgccaaccuggaggaggugaccaugaagcagaucugcaagaagguguacgagaacuaccccaccuacgaccugaccgagagaaaggacuucaucaagaccaccgugaaggagcugaucagcuaa

SEQ ID NO: 16065 - RNA, 3030 nt, Artificial Sequence
  DENND1A__Homo_sapiens__NP_065997
augggcagcagaaucaagcagaaccccgagaccaccuucgagguguacguggagguggccuaccccagaaccggcggcacccugagcgaccccgaggugcagagacaguuccccgaggacuacagcgaccaggaggugcugcagacccugaccaaguucugcuuccccuucuacguggacagccugaccgugagccaggugggccagaacuucaccuucgugcugaccgacaucgacagcaagcagagauucggcuucugcagacugagcagcggcgccaagagcugcuucugcauccugagcuaccugcccugguucgagguguucuacaagcugcugaacauccuggccgacuacaccaccaagagacaggagaaccaguggaacgagcugcuggagacccugcacaagcugcccauccccgaccccggcgugagcgugcaccugagcgugcacagcuacuucaccgugcccgacaccagagagcugcccagcauccccgagaacagaaaccugaccgaguacuucguggccguggacgugaacaacaugcugcaccuguacgccagcaugcuguacgagagaagaauccugaucaucugcagcaagcugagcacccugaccgccugcauccacggcagcgccgccaugcuguaccccauguacuggcagcacguguacauccccgugcugcccccccaccugcuggacuacugcugcgcccccaugcccuaccugaucggcauccaccugagccugauggagaaggugagaaacauggcccuggacgacguggugauccugaacguggacaccaacacccuggagacccccuucgacgaccugcagagccugcccaacgacgugaucagcagccugaagaacagacugaagaaggugagcaccaccaccggcgacggcguggccagagccuuccugaaggcccaggccgccuucuucggcagcuacagaaacgcccugaagaucgagcccgaggagcccaucaccuucugcgaggaggccuucgugagccacuacagaagcggcgccaugagacaguuccugcagaacgccacccagcugcagcuguucaagcaguucaucgacggcagacuggaccugcugaacagcggcgagggcuucagcgacguguucgaggaggagaucaacaugggcgaguacgccggcagcgacaagcuguaccaccaguggcugagcaccgugagaaagggcagcggcgccauccugaacaccgugaagaccaaggccaaccccgccaugaagaccguguacaaguucgccaaggaccacgccaagaugggcaucaaggaggugaagaacagacugaagcagaaggacaucgccgagaacggcugcgcccccacccccgaggagcagcugcccaagaccgcccccagcccccugguggaggccaaggaccccaagcugagagaggacagaagacccaucaccgugcacuucggccaggugagaccccccagaccccacguggugaagagacccaagagcaacaucgccguggagggcagaagaaccagcgugcccagccccgagcagccccagcccuacagaacccugagagagagcgacagcgccgagggcgacgaggccgagagccccgagcagcaggugagaaagagcaccggccccgugcccgccccccccgacagagccgccagcaucgaccugcuggaggacguguucagcaaccuggacauggaggccgcccugcagccccugggccaggccaagagccuggaggaccugagagcccccaaggaccugagagagcagcccggcaccuucgacuaccagagacuggaccugggcggcagcgagagaagcagaggcgugaccguggcccugaagcugacccaccccuacaacaagcuguggagccugggccaggacgacauggccauccccagcaagccccccgccgccagccccgagaagcccagcgcccugcugggcaacagccuggcccugcccagaagaccccagaacagagacagcauccugaaccccagcgacaaggaggaggugcccacccccacccugggcagcaucaccauccccagaccccagggcagaaagacccccgagcugggcaucgugccccccccccccauccccagacccgccaagcugcaggccgccggcgccgcccugggcgacgugagcgagagacugcagaccgacagagacagaagagccgcccugagccccggccugcugcccggcguggugccccagggccccaccgagcugcugcagccccugagccccggccccggcgccgccggcaccagcagcgacgcccugcuggcccugcuggacccccugagcaccgccuggagcggcagcacccugcccagcagacccgccacccccaacguggccacccccuucaccccccaguucagcuucccccccgccggcacccccacccccuucccccagcccccccugaaccccuucgugcccagcaugcccgccgccccccccacccugccccuggugagcacccccgccggccccuucggcgccccccccgccagccugggccccgccuucgccagcggccugcugcugagcagcgccggcuucugcgccccccacagaagccagcccaaccugagcgcccugagcaugcccaaccuguucggccagaugcccaugggcacccacaccagcccccugcagccccugggcccccccgccguggcccccagcagaaucagaacccugccccuggccagaagcagcgccagagccgccgagaccaagcagggccuggcccugagacccggcgaccccccccugcugccccccagacccccccagggccuggagcccacccugcagcccagcgccccccagcaggccagagaccccuucgaggaccugcugcagaagaccaagcaggacgugagccccagccccgcccuggcccccgcccccgacagcguggagcagcugagaaagcagugggagaccuucgaguaa

SEQ ID NO: 16066 - RNA, 1191 nt, Artificial Sequence
  DENND1B__Homo_sapiens__NP_001287787
auggccgccgcccccagagaggagaagagauggccccagcccguguucagcaaccccguggugcuguggaaguuccccgaggacuucggcgaccaggagauccugcagagcgugcccaaguucugcuuccccuucgacguggagagagugagccagaaccaggugggccagcacuucaccuucgugcugaccgacaucgagagcaagcagagauucggcuucugcagacugaccagcggcggcaccaucugccugugcauccugagcuaccugcccugguucgagguguacuacaagcugcugaacacccuggccgacuaccuggccaaggagcuggagaacgaccugaacgagacccugagaagccuguacaaccaccccgugcccaaggccaacacccccgugaaccugagcgugcacagcuacuucaucgcccccgacgugaccggccugcccaccauccccgagagcagaaaccugaccgaguacuucguggccguggacgugaacaacaugcugcagcuguacgccagcaugcugcacgagagaagaaucgugaucaucagcagcaagcugagcacccugaccgccugcauccacggcagcgccgcccugcuguaccccauguacuggcagcacaucuacauccccgugcugcccccccaccugcuggacuacugcugcgcccccaugcccuaccugaucggcauccacagcagccugaucgagagagugaagaacaagagccuggaggacguggugaugcugaacguggacaccaacacccuggagagccccuucagcgaccugaacaaccugcccagcgacguggugagcgcccugaagaacaagcugaagaagcagagcaccgccaccggcgacggcguggccagagccuuccugagagcccaggccgcccuguucggcagcuacagagacgcccugagauacaagcccggcgagcccaucaccuucugcgaggagagcuucgugaagcacagaagcagcgugaugaagcaguuccuggagaccgccaucaaccugcagcuguucaagcaguucaucgacggcagacuggccaagcugaacgccggcagaggcuucagcgacguguucgaggaggagaucaccagcggcggcuucugcggcggcaaggacaagcugcaguacgacuaccccuucagccaguaa

SEQ ID NO: 16067 - RNA, 3030 nt, Artificial Sequence
  DENND2A__Homo_sapiens__NP_056504
auggacauguucagccuggacaugaucaucagcgaccccgccgccgaggccagcagagccggcaagaagcagcugagaggcgugcagaaccccugccccagcgccagagccagacccagacacaagagccugaacaucaaggacaagaucagcgagugggagggcaagaaggaggugcccacccccgcccccagcagaagagccgacggccaggaggacuaccugcccagcagcaccguggagagaagaagcagcgacggcgugagaacccaggugaccgaggccaagaacggcaugagacccggcaccgagagcaccgagaaggagagaaacaagggcgccgugaacgugggcggccaggaccccgagcccggccaggaccugagccagcccgagagagagguggaccccagcuggggcagaggcagagagcccagacugggcaagcugagauuccagaacgacccccugagcgugcugaagcaggugaagaagcuggagcaggcccugaaggacggcagcgccggccuggacccccagcugcccggcaccugcuacagcccccacugcccccccgacaaggccgaggccggcagcacccugcccgagaaccugggcggcggcagcggcagcgaggugagccagagagugcaccccagcgaccuggagggcagagagcccacccccgagcugguggaggacagaaagggcagcugcagaagacccugggacagaagccuggagaacguguacagaggcagcgagggcagccccaccaagcccuucaucaacccccugcccaagcccagaagaaccuucaagcacgccggcgagggcgacaaggacggcaagcccggcaucggcuucagaaaggagaagagaaaccugcccccccugcccagccugcccccccccccccugcccagcagccccccccccagcagcgugaacagaagacuguggaccggcagacagaagagcagcgccgaccacagaaagagcuacgaguucgaggaccugcugcagagcagcagcgagagcagcagaguggacugguacgcccagaccaagcugggccugaccagaacccugagcgaggagaacguguacgaggacauccuggacccccccaugaaggagaaccccuacgaggacaucgagcugcacggcagaugccugggcaagaagugcgugcugaacuuccccgccagccccaccagcagcauccccgacacccugaccaagcagagccugagcaagcccgccuucuucagacagaacagcgagagaagaaacuucaagcugcuggacaccagaaagcugagcagagacggcaccggcagccccagcaagaucagcccccccagcacccccagcagccccgacgacaucuucuucaaccugggcgacccccagaacggcagaaagaagagaaagauccccaagcuggugcugagaaucaacgccaucuacgaggugagaagaggcaagaagagagugaagagacugagccagagcauggagagcaacagcggcaaggugaccgacgagaacagcgagagcgacagcgacaccgaggagaagcugaaggcccacagccagagacuggugaacgugaagagcagacugaagcaggcccccagauaccccagccuggccagagagcugaucgaguaccaggagagacagcuguucgaguacuucgugguggugagccugcacaagaagcaggccggcgccgccuacgugcccgagcugacccagcaguucccccugaagcuggagagaagcuucaaguucaugagagaggccgaggaccagcugaaggccaucccccaguucugcuuccccgacgccaaggacugggugcccgugcagcaguucaccagcgagaccuucagcuucgugcugaccggcgaggacggcagcagaagauucggcuacugcagaagacugcugcccggcggcaagggcaagagacugcccgagguguacugcaucgugagcagacugggcugcuucagccuguucagcagaauccuggacgagguggagaagagaagaggcaucagccccgcccuggugcagccccugaugagaagcgugauggaggcccccuuccccgcccugggcaagaccauccuggugaagaacuuccugcccggcagcggcaccgaggugaucgagcugugcagaccccuggacagcagacuggagcacguggacuucgagagccuguucagcagccugagcgugagacaccuggugugcguguucgccagccugcugcuggagagaagagugaucuucaucgccgacaagcugagcauccugagcaagugcugccacgccaugguggcccugaucuaccccuucgccuggcagcacaccuacauccccgugcugccccccgccaugguggacaucgugugcagccccacccccuuccugaucggccugcugagcagcagccugccccugcugagagagcugccccuggaggaggugcuggugguggaccuggugaacagcagauuccugagacagauggacgacgaggacagcauccugcccagaaagcugcagguggcccuggagcacauccuggagcagagaaacgagcuggccugcgagcaggacgagggcccccuggacggcagacacggccccgagagcagcccccugaacgagguggugagcgaggccuucgugagauucuucguggagaucgugggccacuacagccuguuccugaccagcggcgagagagaggagagaacccugcagagagaggccuucagaaaggccgugagcagcaagagccugagacacuuccuggagguguucauggagacccagauguucagaggcuucauccaggagagagagcugagaagacaggacgccaagggccuguucgaggugagagcccaggaguaccuggagacccugcccagcggcgagcacagcggcgugaacaaguuccugaagggccugggcaacaagaugaaguuccugcacaagaaguaa

SEQ ID NO: 16068 - RNA, 5721 nt, Artificial Sequence
  DENND4A__Homo_sapiens__NP_001138295
augaucgaggacaagggccccagaguggccgacuacuucgugguggccggccugaccgacgugagcaagccccuggaggaggagauccacuucaacgacgccugccacaagguggccaagcccaaggagcccaucaccgacgugagcgugaucaucaagagccugggcgaggaggugccccaggacuacaucugcaucgacgugacccccaccggccugagcgccgaccugaacaacggcagccuggugggcccccagaucuaccugugcuacagaagaggcagagacaagcccccccugaccgaccugggcgugcuguacgacuggaaggagagacugaagcagggcugcgagaucauccagagcacccccuacggcagacccgccaacaucagcggcagcaccagcagccagagaaucuacaucaccuacagaagagccagcgagaacaugacccagaacacccuggccgugaccgacaucugcaucaucauccccagcaagggcgagagccccccccacaccuucugcaagguggacaagaaccugaacaacagcauguggggcagcgccguguaccugugcuacaagaagagcguggccaagaccaacaccgugagcuacaaggccggccugaucugcagauacccccaggaggacuacgagagcuucagccugcccgagagcgugccccuguucugccugcccaugggcgccaccaucgagugcuggcccagcaacagcaaguacccccugcccguguucagcaccuucgugcugaccggcgccagcgccgagaagguguacggcgccgccauccaguucuacgagcccuacagcgaggagaaccugaccgagaagcagagacugcugcugggccugaccagcgccgacggcaagagcgacagcagcaagaccauccacaccaacaagugcaucugccugcugagccacuggcccuucuucgacgccuucagaaaguuccugaccuuccuguacagauacagcaucagcggcccccacgugcugcccaucgagaagcacaucagccacuucaugcacaaggugcccuuccccagcccccagagacccagaauccuggugcagcugagcccccacgacaaccugauccugagccagcccgugagcagcccccugccccugagcggcggcaaguucagcacccugcugcagaaccugggccccgagaacgccgugacccugcugguguucgccgugaccgagcacaagauccugauccacagccugagacccagcgugcugaccagcgugaccgaggcccuggugagcaugaucuuccccuuccacuggcccugccccuacgugccccugugcccccuggcccuggccgacgugcugagcgcccccugccccuucaucgugggcaucgacagcagauacuucgaccuguacgaccccccccccgacgugagcugcguggacguggacaccaacaccaucagccagaucggcgacaagaagaacguggccuggaagauccugcccaagaagcccugcaagaaccugaugaacacccugaacaaccugcaccagcagcuggccaagcugcagcagagacccagagacgacggccugauggaccuggccaucaacgacuacgacuucaacagcggcaagagacugcacaugaucgaccuggagauccaggaggccuuccuguucuucauggccagcauccugaagggcuacagaagcuaccugagacccaucacccaggcccccagcgagaccgccaccgacgccgccagccuguucgcccugcaggccuuccugagaagcagagacagaagccaccagaaguucuacaacaugaugaccaagacccagauguucaucagauucaucgaggagugcagcuucgugagcgacaaggacgccagccuggccuucuucgacgacugcguggacaagguggacauggacaagagcggcgaggugagacugaucgagcuggacgagagcuucaagagcgagcacaccguguucgugaccccccccgagaucccccaccugcccaacggcgaggagcccccccugcaguacagcuacaacggcuuccccgugcugagaaacaaccuguucgagagacccgagggcuuccugcaggccaagaagaacaagcugcccagcaagagcagcagccccaacagcccccugcccauguucagaagaaccaagcaggagaucaagagcgcccacaagaucgccaagagauacagcagcaucccccagauguggagcagaugccugcugagacacugcuacggccugugguucaucugccugcccgccuacgugaaggugugccacagcaaggugagagcccugaagaccgccuacgacgugcugaagaagaugcagagcaagaagauggacccccccgacgaggugugcuacagaauccugaugcagcugugcggccaguacgaccagcccgugcuggccgugagagugcuguucgagaugcagaaggccggcaucgaccccaacgccaucaccuacggcuacuacaacaaggccgugcuggagagcaccuggcccagcagaagcagaagcggcuacuuccuguggaccaaggugagaaacguggugcugggcgugacccaguucaagagagcccugaagaagcacgcccaccugagccagaccacccugagcgacggcagcgaccuggacgccgugagccacggcagcauggacagcggccacggcacccacaccguggagcaggcccccuucaacaccggccugaucaagguguacgccaccgacgacagaagcagcaccggcggccagagcgaccugggcuacaacagccugagcaaggacgaggugagaagaggcgacaccagcaccgaggacauccaggaggagaaggacaagaagggcagcgacugcagcagccugagcgagagcgagagcaccaagggcagcgccgacugccugcccaagcugagcuaccagaacagcagcagcaucgugagacugaccggcaccagcaacaacagcgccggcaagaucagcggcgagagcauggagagcacccccgagcugcugcugaucagcagccuggaggacaccaacgagaccagaaacauccagagcagaugcuucagaaagagacacaagagcgacaacgagaccaaccugcagcagcaggugguguggggcaacagaaacagaaaccugagcggcggcgugcugaugggcuucaugcugaacagaaucaaccaggaggccacccccggcgacaucguggagaagcugggcgccgacgccaagauccugagcaacgugaucagcaagagcaccagacccaacacccuggacaucggcaagcccccccugagaagcaagagagacagccuggagaaggagagcagcgacgacgacacccccuucgacggcagcaacuaccuggccgacaagguggacagccccgugaucuucgaccuggaggaccuggacagcgagaccgacgugagcaaggccggcugcguggccacccagaaccccaagagaauccagagaaugaacagcagcuucagcgugaagcccuucgagaagaccgacguggccaccggcuucgacccccugagccugcugguggccgagaccgagcagcagcagaaggaggaggaggaggaggacgaggacgacagcaagagcaucagcacccccagcgccagaagagaccuggccgaggagaucgugauguacaugaacaacaugagcagcccccugaccagcagaacccccagcaucgaccugcagagagccugcgacgacaagcugaacaagaagagccccccccuggugaaggccugcagaagaagcagccugccccccaacagccccaagcccgugagacugaccaagagcaagagcuacaccaagagcgaggagaagcccagagacagacuguggagcagccccgccuucagccccaccugccccuucagagaggagagccaggacacccugacccacagcagccccagcuucaaccuggacacccugcuggugcccaagcuggacgugcugagaaacagcauguucaccgccggcaagggcguggccgagaaggccagcaagugguacagcagauucaccauguacaccaccagcagcaaggaccagagcagcgacagaaccagccugagcagcgugggcgcccaggacagcgagagcaccagccugaccgacgaggacgugugccacgagcuggagggccccaucagcagccaggagaccagcgccaccagcggcaccaagagaaucgaccugagcagaaucagccuggagagcagcgccagccuggagggcagccugagcaaguucgcccugcccggcaagagcgaggugaccagcagcuucaacgccagcaacaccaacaucuuccagaacuacgccauggaggugcugaucagcagcugcagcagaugcagaaccugcgacugccuggugcacgacgaggagaucauggccggcuggaccgccgacgacagcaaccugaacaccaccugccccuucugcggcaacaucuuccugcccuuccugaacaucgagaucagagaccugagaagacccggcagauacuuccugaagagcagccccagcaccgagaacaugcacuuccccagcagcaucagcagccagaccagacagagcugcaucagcaccagcgccagcggccuggacaccagcgcccugagcgugcagggcaacuucgaccugaacagcaagagcaagcugcaggagaacuucugcaccagaagcauccagauccccgccaacagaagcaagaccgccaugagcaagugccccaucuuccccauggccagaagcaucagcaccagcggcccccuggacaaggaggacaccggcagacagaagcugaucagcaccggcagccugcccgccacccugcagggcgccaccgacagccugggccuggaguggcaccugcccagccccgaccccgugaccgugcccuaccugagcccccuggugguguggaaggagcuggagagccugcuggagaacgagggcgaccacgccaucaccguggccgacuucguggaccaccaccccaucguguucuggaaccuggugugguacuucagaagacuggaccugcccagcaaccugcccggccugauccugagcagcgagcacugcaacaaguacagcaagauccccagacacugcaugagcgaggacagcaaguacgugcugauccagaugcugugggacaacaugaagcugcaccaggaccccggccagccccuguacauccuguggaacgcccacacccagaaguaccccauggugcaccugcugcagaagagcgacaacagcuucaaccaggagcugcugaagagcauggugaagagcaucaagaugaacgacguguacggccccaugagccagauccuggagacccugaacaagugcccccacuucaagagacagagaagccuguacagagagauccuguuccugagccugguggcccugggcagagagaacaucgacaucgacgccuucgacaaggaguacaagauggccuacgacagacugacccccagccaggugaagagcacccacaacugcgacagaccccccagcaccggcgugauggagugcagaaagaccuucggcgagcccuaccuguaa

SEQ ID NO: 16069 - RNA, 597 nt, Artificial Sequence
  DENR__Homo_sapiens__NP_003668
auggccgccgacaucagcgagagcagcggcgccgacugcaagggcgaccccagaaacagcgccaagcuggacgccgacuacccccugagagugcuguacugcggcgugugcagccugcccaccgaguacugcgaguacaugcccgacguggccaagugcagacaguggcuggagaagaacuuccccaacgaguucgccaagcugaccguggagaacagccccaagcaggaggccggcaucagcgagggccagggcaccgccggcgaggaggaggagaagaagaagcagaagagaggcggcagaggccagaucaagcagaagaagaagaccgugccccagaaggugaccaucgccaagauccccagagccaagaagaaguacgugaccagagugugcggccuggccaccuucgagaucgaccugaaggaggcccagagauucuucgcccagaaguucagcugcggcgccagcgugaccggcgaggacgagaucaucauccagggcgacuucaccgacgacaucaucgacgugauccaggagaaguggcccgagguggacgacgacagcaucgaggaccugggcgaggugaagaaguaa

SEQ ID NO: 16070 - RNA, 1404 nt, Artificial Sequence
  DEPDC1B__Homo_sapiens__NP_001138680
auggagcacagaaucgugggccccggccccuacagagccaccagacuguggaacgagaccguggagcuguucagagccaagaugccccugagaaagcacagaugcagauucaagagcuacgagcacugcuucaccgccgccgaggccguggacuggcugcacgagcugcugagaugcagccagaacuucggccccgaggugaccagaaagcagaccgugcagcugcugaagaaguuccugaagaaccacgugaucgaggacaucaagggcaaguggggcgaggaggacuucgaggacaacagacaccuguacagauucccccccagcagcccccugaagcccuaccccaagaagccccccaaccagaaggacgugaucaaguuccccgaguggaacgaccugccccccggcaccagccaggagaacauccccgugagacccguggugaugaacagcgagaugugguacaagagacacagcaucgccaucggcgaggugcccgccugcagacuggugcacagaagacagcugaccgaggccaacguggaggagaucuggaagagcaugacccugagcuaccugcagaagauccugggccuggacagccuggaggaggugcuggacgugaagcuggugaacagcaaguucaucauccacaacguguacagcgugagcaagcagggcguggugauccuggacgacaagagcaaggagcugccccacugggugcugagcgccaugaagugccuggccaacuggcccaacugcagcgaccugaagcagcccauguaccugggcuucgagaaggacguguucaagaccaucgccgacuacuacggccaccugaaggagccccugcugaccuuccaccuguucgacgccuucgugagcgugcugggccugcugcagaaggagaagguggccguggaggccuuccagaucugcugccugcugcugccccccgagaacagaagaaagcugcagcugcugaugagaaugauggccagaaucugccugaacaaggagaugcccccccugugcgacggcuucggcaccagaacccugauggugcagaccuucagcagaugcauccugugcagcaaggacgagguggaccuggacgagcugcuggccgccagacuggugaccuuccugauggacaacuaccaggagauccugaaggugccccuggcccugcagaccagcaucgaggagagaguggcccaccugagaagagugcaguuccagaagagcuaccccgagguguaccaggagagauuccccacccccgagagcgccgcccugcuguuccccgagaagcccaagcccaagccccagcugcugaugugggcccugaagaagcccuuccagcccuuccagagaaccagaagcuucagaauguaa

SEQ ID NO: 16071 - RNA, 1680 nt, Artificial Sequence
  DEPDC5__Homo_sapiens__NP_001007189
augagaaccaccaagguguacaagcuggugauccacaagaagggcuucggcggcagcgacgacgagcugguggugaaccccaagguguucccccacaucaagcugggcgacaucguggagaucgcccaccccaacgacgaguacagcccccugcugcugcaggugaagagccugaaggaggaccugcagaaggagaccaucagcguggaccagaccgugacccagguguucagacugagacccuaccaggacguguacgugaacgugguggaccccaaggacgugacccuggaccugguggagcugaccuucaaggaccaguacaucggcagaggcgacauguggagacugaagaagagccuggugagcaccugcgccuacaucacccagaagguggaguucgccggcaucagagcccaggccggcgagcugugggugaagaacgagaaggugaugugcggcuacaucagcgaggacaccagagugguguucagaagcaccagcgccaugguguacaucuucauccagaugagcugcgagaugugggacuucgacaucuacggcgaccuguacuucgagaaggccgugaacggcuuccuggccgaccuguucaccaaguggaaggagaagaacugcagccacgaggugaccguggugcuguucagcagaaccuucuacgacgccaagagcguggacgaguuccccgagaucaacagagccagcaucagacaggaccacaagggcagauucuacgaggacuucuacaaggugguggugcagaacgagagaagagaggaguggaccagccugcuggugaccaucaagaagcuguucauccaguaccccgugcuggugagacuggagcaggccgagggcuucccccagggcgacaacagcaccagcgcccagggcaacuaccuggaggccaucaaccugagcuucaacguguucgacaagcacuacaucaacagaaacuucgacagaaccggccagaugagcguggugaucacccccggcgugggcguguucgagguggacagacugcugaugauccugaccaagcagagaaugaucgacaacggcaucggcguggaccuggugugcaugggcgagcagccccugcacgccgugccccuguucaagcugcacaacagaagcgcccccagagacagcagacugggcgacgacuacaacaucccccacuggaucaaccacagcuucuacaccagcaagagccagcuguucugcaacagcuucacccccagaaucaagcuggccggcaagaagcccgccagcgagaaggccaagaacggcagagacaccagccugggcagccccaaggagagcgagaacgcccugcccauccagguggacuacgacgccuacgacgcccagguguucagacugcccggccccagcagagcccagugccugaccaccugcagaagcgugagagagagagagagccacagcagaaagagcgccagcagcugcgacgugagcagcagccccagccugcccagcagaacccugcccaccgaggaggugagaagccaggccagcgacgacagcagccugggcaagagcgccaacauccugaugaucccccacccccaccugcaccaguacgaggugagcagcagccugggcuacaccagcaccagagagcaccugggcuaa

SEQ ID NO: 16072 - RNA, 1230 nt, Artificial Sequence
  DEPTOR__Homo_sapiens__NP_073620
auggaggagggcggcagcaccggcagcgccggcagcgacagcagcaccagcggcagcggcggcgcccagcagagagagcuggagagaauggccgaggugcuggugaccggcgagcagcugagacugagacugcacgaggagaaggugaucaaggacagaagacaccaccugaagaccuaccccaacugcuucguggccaaggagcugaucgacuggcugaucgagcacaaggaggccagcgacagagagaccgccaucaagcugaugcagaagcuggccgacagaggcaucauccaccacgugugcgacgagcacaaggaguucaaggacgugaagcuguucuacagauucagaaaggacgacggcaccuucccccuggacaacgaggugaaggccuucaugagaggccagagacuguacgagaagcugaugagccccgagaacacccugcugcagcccagagaggaggagggcgugaaguacgagagaaccuucauggccagcgaguuccuggacuggcuggugcaggagggcgaggccaccaccagaaaggaggccgagcagcugugccacagacugauggagcacggcaucauccagcacgugagcaacaagcaccccuucguggacagcaaccugcuguaccaguucagaaugaacuucagaagaagaagaagacugauggagcugcugaacgagaagagccccagcagccaggagacccacgacagccccuucugccugagaaagcagagccacgacaacagaaagagcaccagcuucaugagcgugagccccagcaaggagaucaagaucgugagcgccgugagaagaagcagcaugagcagcugcggcagcagcggcuacuucagcagcagccccacccugagcagcagcccccccgugcugugcaaccccaagagcgugcugaagagacccgugaccagcgaggagcugcugacccccggcgcccccuacgccagaaagaccuucaccaucgugggcgacgccgugggcuggggcuucguggugagaggcagcaagcccugccacauccaggccguggaccccagcggccccgccgccgccgccggcaugaaggugugccaguucguggugagcgugaacggccugaacgugcugcacguggacuacagaaccgugagcaaccugauccugaccggccccagaaccaucgugauggaggugauggaggagcuggagugcuaa

SEQ ID NO: 16073 - RNA, 957 nt, Artificial Sequence
  DERA__Homo_sapiens__NP_057038
augagcgcccacaacagaggcaccgagcuggaccugagcuggaucagcaagauccaggugaaccaccccgccgugcugagaagagccgagcagauccaggccagaagaaccgugaagaaggaguggcaggccgccuggcugcugaaggccgugaccuucaucgaccugaccacccugagcggcgacgacaccagcagcaacauccagagacugugcuacaaggccaaguaccccaucagagaggaccugcugaaggcccugaacaugcacgacaagggcaucaccaccgccgccgugugcguguaccccgccagagugugcgacgccgugaaggcccugaaggccgccggcugcaacauccccguggccagcguggccgccggcuuccccgccggccagacccaccugaagaccagacuggaggagaucagacuggccguggaggacggcgccaccgagaucgacguggugaucaacagaagccuggugcugaccggccagugggaggcccuguacgacgagaucagacaguucagaaaggccugcggcgaggcccaccugaagaccauccuggccaccggcgagcugggcacccugaccaacguguacaaggccagcaugaucgccaugauggccggcagcgacuucaucaagaccagcaccggcaaggagaccgugaacgccaccuuccccguggccaucgugaugcugagagccaucagagacuucuucuggaagaccggcaacaagaucggcuucaagcccgccggcggcaucagaagcgccaaggacagccuggccuggcugagccuggugaaggaggagcugggcgacgaguggcugaagcccgagcuguucagaaucggcgccagcacccugcugagcgacaucgagagacagaucuaccaccacgugaccggcagauacgccgccuaccacgaccugcccaugagcuaa

SEQ ID NO: 16074 - RNA, 696 nt, Artificial Sequence
  DERL1__Homo_sapiens__NP_001128143
augagcgacaucggcgacugguucagaagcauccccgccaucaccagauacugguucgccgccaccguggccgugccccuggugggcaagcugggccugaucagccccgccuaccuguuccuguggcccgaggccuuccuguacagauuccagaucuggagacccaucaccgccaccuucuacuuccccgugggccccggcaccggcuuccuguaccuggugaaccuguacuuccuguaccaguacagcaccagacuggagaccggcgccuucgacggcagacccgccgacuaccuguucaugcugcuguucaacuggaucugcaucgugaucaccggccuggccauggacaugcagcugcugaugaucccccugaucaugagcgugcuguacgugugggcccagcugaacagagacaugaucgugagcuucugguucggcaccagauucaaggccugcuaccugcccugggugauccugggcuucaacuacaucaucggcggcagcuaccccauggaccugggcggcagaaacuuccugagcaccccccaguuccuguacagauggcugcccagcagaagaggcggcgugagcggcuucggcgugccccccgccagcaugagaagagccgccgaccagaacggcggcggcggcagacacaacuggggccagggcuucagacugggcgaccaguaa

SEQ ID NO: 16075 - RNA, 720 nt, Artificial Sequence
  DERL2__Homo_sapiens__NP_057125
auggccuaccagagccugagacuggaguaccugcagaucccccccgugagcagagccuacaccaccgccugcgugcugaccaccgccgccgugcagcuggagcugaucacccccuuccagcuguacuucaaccccgagcugaucuucaagcacuuccagaucuggagacugaucaccaacuuccuguucuucggccccgugggcuucaacuuccuguucaacaugaucuuccuguacagauacugcagaaugcuggaggagggcagcuucagaggcagaaccgccgacuucguguucauguuccuguucggcggcuuccugaugacccuguucggccuguucgugagccugguguuccugggccaggccuucaccaucaugcugguguacguguggagcagaagaaaccccuacgugagaaugaacuucuucggccugcugaacuuccaggcccccuuccugcccugggugcugaugggcuucagccugcugcugggcaacagcaucaucguggaccugcugggcaucgccgugggccacaucuacuucuuccuggaggacguguuccccaaccagcccggcggcaucagaauccugaagacccccagcauccugaaggccaucuucgacacccccgacgaggaccccaacuacaacccccugcccgaggagagacccggcggcuucgccuggggcgagggccagagacugggcggcuaa

SEQ ID NO: 16076 - RNA, 708 nt, Artificial Sequence
  DERL3__Homo_sapiens__NP_001002862
auggccuggcagggccuggccgccgaguuccugcaggugcccgccgugaccagagccuacaccgccgccugcgugcugaccaccgccgccgugcagcuggagcugcugagccccuuccagcuguacuucaacccccaccugguguucagaaaguuccagguguggagacuggugaccaacuuccuguucuucggcccccugggcuucagcuucuucuucaacaugcuguucguguucagauacugcagaaugcuggaggagggcagcuucagaggcagaaccgccgacuucguguucauguuccuguucggcggcgugcugaugacccugcugggccugcugggcagccuguucuuccugggccaggcccugauggccaugcugguguacguguggagcagaagaagccccagagugagagugaacuucuucggccugcugaccuuccaggcccccuuccugcccugggcccugaugggcuucagccugcugcugggcaacagcauccugguggaccugcugggcaucgccgugggccacaucuacuacuuccuggaggacguguuccccaaccagcccggcggcaagagacugcugcagacccccggcuuccugaagcugcugcuggacgcccccgccgaggaccccaacuaccugccccugcccgaggagcagcccggcccccaccugccccccccccagcaguaa

SEQ ID NO: 16077 - RNA, 1413 nt, Artificial Sequence
  DES__Homo_sapiens__NP_001918
augagccaggccuacagcagcagccagagagugagcagcuacagaagaaccuucggcggcgcccccggcuucccccugggcagcccccugagcagccccguguuccccagagccggcuucggcagcaagggcagcagcagcagcgugaccagcagaguguaccaggugagcagaaccagcggcggcgccggcggccugggcagccugagagccagcagacugggcaccaccagaacccccagcagcuacggcgccggcgagcugcuggacuucagccuggccgacgccgugaaccaggaguuccugaccaccagaaccaacgagaagguggagcugcaggagcugaacgacagauucgccaacuacaucgagaaggugagauuccuggagcagcagaacgccgcccuggccgccgaggugaacagacugaagggcagagagcccaccagaguggccgagcuguacgaggaggagcugagagagcugagaagacagguggaggugcugaccaaccagagagccagaguggacguggagagagacaaccugcuggacgaccugcagagacugaaggccaagcugcaggaggagauccagcugaaggaggaggccgagaacaaccuggccgccuucagagccgacguggacgccgccacccuggccagaaucgaccuggagagaagaaucgagagccugaacgaggagaucgccuuccugaagaaggugcacgaggaggagaucagagagcugcaggcccagcugcaggagcagcaggugcagguggagauggacaugagcaagcccgaccugaccgccgcccugagagacaucagagcccaguacgagaccaucgccgccaagaacaucagcgaggccgaggagugguacaagagcaaggugagcgaccugacccaggccgccaacaagaacaacgacgcccugagacaggccaagcaggagaugauggaguacagacaccagauccagagcuacaccugcgagaucgacgcccugaagggcaccaacgacagccugaugagacagaugagagagcuggaggacagauucgccagcgaggccagcggcuaccaggacaacaucgccagacuggaggaggagaucagacaccugaaggacgagauggccagacaccugagagaguaccaggaccugcugaacgugaagauggcccuggacguggagaucgccaccuacagaaagcugcuggagggcgaggagagcagaaucaaccugcccauccagaccuacagcgcccugaacuucagagagaccagccccgagcagagaggcagcgaggugcacaccaagaagaccgugaugaucaagaccaucgagaccagagacggcgagguggugagcgaggccacccagcagcagcacgaggugcuguaa

SEQ ID NO: 16078 - RNA, 486 nt, Artificial Sequence
  DESI2__Homo_sapiens__NP_001284675
augggcgccaaccagcugguggugcugaacguguacgacauguacuggaugaacgaguacaccagcagcaucggcaucggcguguuccacagcggcaucgagguguacggcagagccguggugcugggcagcaccgacuuccuggaggacgacaucgagaagaucguggaggagcugggcaaggaguacaagggcaacgccuaccaccugaugcacaagaacugcaaccacuucagcagcgcccugagcgagauccugugcggcaaggagauccccagauggaucaacagacuggccuacuucagcagcugcauccccuuccugcagagcugccugcccaaggaguggcugacccccgccgcccugcagagcagcgugagccaggagcugcaggacgagcuggaggaggccgaggacgccgccgccagcgccagcguggccagcaccgccgccggcagcagacccggcagacacaccaagcuguaa

SEQ ID NO: 16079 - RNA, 288 nt, Artificial Sequence
  DEXI__Homo_sapiens__NP_054734
augcugggcgccagaguggccgcccaccuggacgcccugggcccccuggugcccuacgugccccccccccugcugcccagcauguucuacgugggccuguucuucgugaacgugcugauccuguacuacgccuuccugauggaguacaucgugcugaacgugggccugguguuccugcccgaggacauggaccaggcccugguggaccugggcgugcugagcgaccccggcagcggccuguacgacgccgacagcgagcuggacguguucgacgccuaccuggaguaa

SEQ ID NO: 16080 - RNA, 885 nt, Artificial Sequence
  DFFB__Homo_sapiens__XP_011539165
augcugcagaagcccaagagcgugaagcugagagcccugagaagccccagaaaguucggcguggccggcagaagcugccaggaggugcugagaaagggcugccugagauuccagcugcccgagagaggcagcagacugugccuguacgaggacggcaccgagcugaccgaggacuacuuccccagcgugcccgacaacgccgagcuggugcugcugacccugggccaggccuggcagggcugcgaguggcagggccuguggagaaugugccugcugcuggacagacaccugcuguucgugccccugguggccgacgugagcgacaucagaagauuccugagcgccuuccacgagccccaggugggccugauccaggccgcccagcagcugcugugcgacgagcaggccccccagagacagagacugcuggccgaccugcugcacaacgugagccagaacaucgccgccgagaccagagccgaggacccccccugguucgagggccuggagagcagauuccagagcaagagcggcuaccugagauacagcugcgagagcagaaucagaagcuaccugagagaggugagcagcuaccccagcaccgugggcgccgaggcccaggaggaguuccugagagugcugggcagcaugugccagagacugagaagcaugcaguacaacggcagcuacuucgacagaggcgccaagggcggcagcagacugugcacccccgagggcugguucagcugccagggccccuucgacauggacagcugccugagcagacacagcaucaaccccuacagcaacagagagagcagaauccuguucagcaccuggaaccuggaccacaucgacggcgugcugcugugcggccccggcuaa

SEQ ID NO: 16081 - RNA, 1491 nt, Artificial Sequence
  DFNA5__Homo_sapiens__NP_001120925
auguucgccaaggccaccagaaacuuccugagagagguggacgccgacggcgaccugaucgccgugagcaaccugaacgacagcgacaagcugcagcugcugagccuggugaccaagaagaagagauucuggugcuggcagagacccaaguaccaguuccugagccugacccugggcgacgugcugaucgaggaccaguuccccagccccguggugguggagagcgacuucgugaaguacgagggcaaguucgccaaccacgugagcggcacccuggagaccgcccugggcaaggugaagcugaaccugggcggcagcagcagaguggagagccagagcagcuucggcacccugagaaagcaggagguggaccugcagcagcugaucagagacagcgccgagagaaccaucaaccugagaaaccccgugcugcagcaggugcuggagggcagaaacgaggugcugugcgugcugacccagaagaucaccaccaugcagaagugcgugaucagcgagcacaugcagguggaggagaagugcggcggcaucgugggcauccagaccaagaccgugcaggugagcgccaccgaggacggcaacgugaccaaggacagcaacguggugcuggagauccccgccgccaccaccaucgccuacggcgugaucgagcuguacgugaagcuggacggccaguucgaguucugccugcugagaggcaagcagggcggcuucgagaacaagaagagaaucgacagcguguaccuggacccccugguguucagagaguucgccuucaucgacaugcccgacgccgcccacggcaucagcagccaggacggcccccugagcgugcugaagcaggccacccugcugcuggagagaaacuuccaccccuucgccgagcugcccgagccccagcagaccgcccugagcgacaucuuccaggccgugcuguucgacgacgagcugcugauggugcuggagcccgugugcgacgaccuggugagcggccugagccccaccguggccgugcugggcgagcugaagcccagacagcagcaggaccugguggccuuccugcagcuggugggcugcagccugcagggcggcugccccggccccgaggacgccggcagcaagcagcuguucaugaccgccuacuuccuggugagcgcccuggccgagaugcccgacagcgccgccgcccugcugggcaccugcugcaagcugcagaucauccccacccugugccaccugcugagagcccugagcgacgacggcgugagcgaccuggaggaccccacccugaccccccugaaggacaccgagagauucggcaucgugcagagacuguucgccagcgccgacaucagccuggagagacugaagagcagcgugaaggccgugauccugaaggacagcaagguguucccccugcugcugugcaucacccugaacggccugugcgcccugggcagagagcacagcuaa

SEQ ID NO: 16082 - RNA, 2724 nt, Artificial Sequence
  DFNB31__Homo_sapiens__NP_056219
augaacgccccccuggacggccugagcgugagcagcagcagcaccggcagccugggcagcgccgccggcgccggcggcggcggcggcgccggccugagacugcugagcgccaacgugagacagcugcaccaggcccugaccgcccugcugagcgaggccgagagagagcaguucacccacugccugaacgccuaccacgccagaagaaacguguucgaccuggugagaacccugagagugcugcuggacagccccgugaagagaagacugcugcccaugcugagacuggugauccccagaagcgaccagcugcuguucgaccaguacaccgccgagggccuguaccugcccgccaccacccccuacagacagcccgccuggggcggccccgacagcgccggccccggcgaggugagacuggugagccugagaagagccaaggcccacgagggccugggcuucagcaucagaggcggcagcgagcacggcgugggcaucuacgugagccugguggagcccggcagccuggccgagaaggagggccugagagugggcgaccagauccugagagugaacgacaagagccuggccagagugacccacgccgaggccgugaaggcccugaagggcagcaagaagcuggugcugagcguguacagcgccggcagaauccccggcggcuacgugaccaaccacaucuacaccuggguggacccccagggcagaagcaucagcccccccagcggccugccccagccccacggcggcgcccugagacagcaggagggcgacagaagaagcacccugcaccugcugcagggcggcgacgagaagaaggugaaccuggugcugggcgacggcagaagccugggccugaccaucagaggcggcgccgaguacggccugggcaucuacaucaccggcguggaccccggcagcgaggccgagggcagcggccugaaggugggcgaccagauccuggaggugaacggcagaagcuuccugaacauccugcacgacgaggccgugagacugcugaagagcagcagacaccugauccugaccgugaaggacgugggcagacugccccacgccagaaccaccguggacgagaccaaguggaucgccagcagcagaaucagagagaccauggccaacagcgccggcuuccugggcgaccugaccaccgagggcaucaacaagcccggcuucuacaagggccccgccggcagccaggugacccugagcagccugggcaaccagaccagagugcugcuggaggagcaggccagacaccugcugaacgagcaggagcacgccaccauggccuacuaccuggacgaguacagaggcggcagcgugagcguggaggcccuggugauggcccuguucaagcugcugaacacccacgccaaguucagccugcugagcgaggugagaggcaccaucagcccccaggaccuggagagauucgaccaccuggugcugagaagagagaucgagagcaugaaggccagacagccccccggccccggcgccggcgacaccuacagcauggugagcuacagcgacaccggcagcagcaccggcagccacggcaccagcaccaccgugagcagcgccagaaacacccuggaccuggaggagaccggcgaggccgugcagggcaacaucaacgcccugcccgacgugagcguggacgacgugagaagcaccagccagggccugagcagcuucaagccccugcccagaccccccccccuggcccagggcaacgaccugccccugggccagcccagaaagcugggcagagaggaccugcagccccccagcagcaugcccagcugcagcggcaccguguucagcgccccccagaacagaagcccccccgccggcaccgcccccacccccggcaccagcagcgcccaggaccugcccagcagccccaucuacgccagcgugagccccgccaaccccagcagcaagagaccccuggacgcccaccuggcccuggugaaccagcaccccaucggccccuuccccagagugcagagccccccccaccugaagagccccagcgccgaggccaccguggccggcggcugccugcugccccccagccccagcggccaccccgaccagaccggcaccaaccagcacuucgugaugguggaggugcacagacccgacagcgagcccgacgugaacgaggugagagcccugccccagaccagaaccgccagcacccugagccagcugagcgacagcggccagacccugagcgaggacagcggcguggacgccggcgaggccgaggccagcgcccccggcagaggcagacagagcgugagcaccaagagcagaagcagcaaggagcugcccagaaacgagagacccaccgacggcgccaacaagccccccggccugcuggagcccaccagcacccuggugagagugaagaagagcgccgccacccugggcaucgccaucgagggcggcgccaacaccagacagccccugcccagaaucgugaccauccagagaggcggcagcgcccacaacugcggccagcugaaggugggccacgugauccuggaggugaacggccugacccugagaggcaaggagcacagagaggccgccagaaucaucgccgaggccuucaagaccaaggacagagacuacaucgacuuccuggugaccgaguucaacgugaugcuguaa

SEQ ID NO: 16083 - RNA, 1059 nt, Artificial Sequence
  DFNB59__Homo_sapiens__NP_001036167
auguucgccgccgccaccaagagcuucgugaagcaggugggcgacggcggcagacuggugcccgugcccagccugagcgaggccgacaaguaccagccccugagccugguggugaagaagaagagaugcuuccuguuccccagauacaaguucaccagcacccccuucacccugaaggacauccugcugggcgacagagagaucagcgccggcaucagcagcuaccagcugcugaacuacgaggacgagagcgacgugagccuguacggcagaagaggcaaccacaucgugaacgacgugggcaucaacguggccggcagcgacagcaucgccgugaaggccagcuucggcaucgugaccaagcacgagguggaggugagcacccugcugaaggagaucaccaccagaaagaucaacuucgaccacagccugaucagacagagcagaagcagcagaaaggccgugcugugcguggugauggagagcaucagaaccaccagacagugcagccugagcgugcacgccggcaucagaggcgaggccaugagauuccacuucauggacgagcagaaccccaagggcagagacaaggccaucguguuccccgcccacaccaccaucgccuucagcguguucgagcuguucaucuaccuggacggcgccuucgaccugugcgugaccagcgugagcaagggcggcuucgagagagaggagaccgccaccuucgcccugcuguacagacugagaaacauccuguucgagagaaacagaagagugauggacgugaucagcagaagccagcuguaccuggacgaccuguucagcgacuacuacgacaagccccugagcaugaccgacaucagccugaaggagggcacccacaucagagugaaccugcugaaccacaacauccccaagggccccugcauccugugcggcaugggcaacuucaagagagagaccguguacggcugcuuccagugcagcguggacggccagaaguacgugagacugcacgccgugcccugcuucgacaucuggcacaagagaaugaaguaa

SEQ ID NO: 16084 - RNA, 1467 nt, Artificial Sequence
  DGAT1__Homo_sapiens__NP_036211
augggcgacagaggcagcagcagaagaagaagaaccggcagcagacccagcagccacggcggcggcggccccgccgccgccgaggaggaggugagagacgccgccgccggccccgacgugggcgccgccggcgacgcccccgcccccgcccccaacaaggacggcgacgccggcgugggcagcggccacugggagcugagaugccacagacugcaggacagccuguucagcagcgacagcggcuucagcaacuacagaggcauccugaacuggugcguggugaugcugauccugagcaacgccagacuguuccuggagaaccugaucaaguacggcauccugguggaccccauccagguggugagccuguuccugaaggaccccuacagcuggcccgcccccugccuggugaucgccgccaacguguucgccguggccgccuuccagguggagaagagacuggccgugggcgcccugaccgagcaggccggccugcugcugcacguggccaaccuggccaccauccugugcuuccccgccgccguggugcugcugguggagagcaucacccccgugggcagccugcuggcccugauggcccacaccauccuguuccugaagcuguucagcuacagagacgugaacagcuggugcagaagagccagagccaaggccgccagcgccggcaagaaggccagcagcgccgccgccccccacaccgugagcuaccccgacaaccugaccuacagagaccuguacuacuuccuguucgcccccacccugugcuacgagcugaacuuccccagaagccccagaaucagaaagagauuccugcugagaagaauccuggagaugcuguucuucacccagcugcaggugggccugauccagcaguggauggugcccaccauccagaacagcaugaagcccuucaaggacauggacuacagcagaaucaucgagagacugcugaagcuggccgugcccaaccaccugaucuggcugaucuucuucuacuggcuguuccacagcugccugaacgccguggccgagcugaugcaguucggcgacagagaguucuacagagacugguggaacagcgagagcgugaccuacuucuggcagaacuggaacauccccgugcacaaguggugcaucagacacuucuacaagcccaugcugagaagaggcagcagcaaguggauggccagaaccggcguguuccuggccagcgccuucuuccacgaguaccuggugagcgugccccugagaauguucagacugugggccuucaccggcaugauggcccagaucccccuggccugguucgugggcagauucuuccagggcaacuacggcaacgccgccguguggcugagccugaucaucggccagcccaucgccgugcugauguacgugcacgacuacuacgugcugaacuacgaggcccccgccgccgaggccuaa

SEQ ID NO: 16085 - RNA, 1038 nt, Artificial Sequence
  DGAT2__Homo_sapiens__NP_001240820
augaagacccugaucgccgccuacagcggcgugcugagaggcgagagacaggccgaggccgacagaagccagagaagccacggcggccccgcccugagcagagagggcagcggcagauggggcguggccugcagcgccauccugauguacaucuucugcaccgacugcuggcugaucgccgugcuguacuucaccuggcugguguucgacuggaacacccccaagaagggcggcagaagaagccagugggugagaaacugggccguguggagauacuucagagacuacuuccccauccagcuggugaagacccacaaccugcugaccaccagaaacuacaucuucggcuaccacccccacggcaucaugggccugggcgccuucugcaacuucagcaccgaggccaccgaggugagcaagaaguuccccggcaucagacccuaccuggccacccuggccggcaacuucagaaugcccgugcugagagaguaccugaugagcggcggcaucugccccgugagcagagacaccaucgacuaccugcugagcaagaacggcagcggcaacgccaucaucaucguggugggcggcgccgccgagagccugagcagcaugcccggcaagaacgccgugacccugagaaacagaaagggcuucgugaagcuggcccugagacacggcgccgaccuggugcccaucuacagcuucggcgagaacgagguguacaagcaggugaucuucgaggagggcagcuggggcagaugggugcagaagaaguuccagaaguacaucggcuucgcccccugcaucuuccacggcagaggccuguucagcagcgacaccuggggccuggugcccuacagcaagcccaucaccaccguggugggcgagcccaucaccauccccaagcuggagcaccccacccagcaggacaucgaccuguaccacaccauguacauggaggcccuggugaagcuguucgacaagcacaagaccaaguucggccugcccgagaccgaggugcuggaggugaacuaa

SEQ ID NO: 16086 - RNA, 1530 nt, Artificial Sequence
  DGCR2__Homo_sapiens__NP_001167004
auggugcccaaggccgacagcggcgccuuccugcugcuguuccugcuggugcugaccgugaccgagccccugagacccgaggugaccggcgaggugagaccccaccacggcaaggaggccguggaccccagacagggcagagccagaggcggcgaccccagccacuuccacgccgugaacguggcccagcccgugagauucagcagcuuccugggcaagugccccaccggcuggcaccacuacgagggcaccgccagcugcuacagaguguaccugagcggcgagaacuacugggacgccgcccagaccugccagagacugaacggcagccuggccaccuucagcaccgaccaggagcugagauucgugcuggcccaggagugggaccagcccgagagaagcuucggcuggaaggaccagagaaagcugugggugggcuaccaguacgugaucaccggcagaaacagaagccuggagggcagaugggagguggccuucaagggcagcagcgagguguuccugccccccgaccccaucuucgccagcgccaugagcgagaacgacaacguguucugcgcccagcugcagugcuuccacuuccccacccugagacaccacgaccugcacagcuggcacgccgagagcugcuacgagaagagcagcuuccugugcaagagaagccagaccugcguggacaucaaggacaacgugguggacgagggcuucuacuucacccccaagggcgacgaccccugccugagcugcaccugccacggcggcgagcccgagaugugcguggccgcccugugcgagagaccccagggcugccagcaguacagaaaggaccccaaggagugcugcaaguucaugugccuggaccccgacggcaacagccuguucgacagcauggccagcggcaugagacugguggugagcugcaucagcagcuuccugauccugagccugcugcuguucauggugcacagacugagacagagaagaagagagagaaucgagagccugaucggcgccaaccugcaccacuucaaccugggcagaagaauccccggcuucgacuacggccccgacggcuucggcaccggccugaccccccugcaccugagcgacgacggcgagggcggcaccuuccacuuccacgacccccccccccccuacaccgccuacaaguaccccgacaucggccagcccgacgacccccccccccccuacgaggccagcauccaccccgacagcguguucuacgaccccgccgacgacgacgccuucgagcccguggaggugagccugcccgcccccggcgacggcggcagcgagggcgcccugcugagaagacuggagcagccccugcccaccgccggcgccagccuggccgaccuggaggacagcgccgacagcagcagcgcccugcuggugccccccgaccccgcccagagcggcagcacccccgccgccgaggcccugcccggcggcggcagacacagcagaagcagccugaacaccgugguguaa

SEQ ID NO: 16087 - RNA, 663 nt, Artificial Sequence
  DGCR6L__Homo_sapiens__NP_150282
auggagagauacgccgccgcccuggaggagguggccgacggcgccagacagcaggagagacacuaccagcugcugagcgcccugcagagccuggugaaggagcugcccagcagcuuccagcagagacugagcuacaccacccugagcgaccuggcccuggcccugcuggacggcaccguguucgagaucgugcagggccugcuggagauccagcaccugaccgagaagagccuguacaaccagagacugagacugcagaacgagcacagagugcugagacaggcccugagacagaagcaccaggaggcccagcaggccugcagaccccacaaccugcccguggugcaggccgcccagcagagagagcuggaggccguggagcacagaaucagagaggagcagagagccauggaccagaagaucauccuggagcuggacagaaagguggccgaccagcagagcacccuggagaaggccggcguggccggcuucuacgugaccaccaacccccaggagcugaugcugcagaugaaccugcuggagcugaucagaaagcugcagcagagaggcugcagagccggcaacgccgcccugggccugggcggccccuggcagagccccgccgcccagugcgaccagaagggcagccccgugccccccuaa

SEQ ID NO: 16088 - RNA, 2223 nt, Artificial Sequence
  DGCR8__Homo_sapiens__NP_001177255
auggagaccgacgagagccccagcccccugcccugcggccccgccggcgaggccgugauggagagcagagccagacccuuccaggcccugcccagagagcagagccccccccccccccugcagaccagcagcggcgccgaggugauggacgugggcagcggcggcgacggccagagcgagcugcccgccgaggaccccuucaacuucuacggcgccagccugcugagcaagggcagcuucagcaagggcagacugcugaucgaccccaacugcagcggccacagccccagaaccgccagacacgcccccgccgugagaaaguucagccccgaccugaagcugcugaaggacgugaagaucagcgugagcuucaccgagagcugcagaagcaaggacagaaaggugcuguacaccggcgccgagagagacgugagagccgagugcggccugcugcugagccccgugagcggcgacgugcacgccugccccuucggcggcagcgugggcgacggcgugggcaucggcggcgagagcgccgacaagaaggacgaggagaacgagcuggaccaggagaagagaguggaguacgccgugcuggacgagcuggaggacuucaccgacaaccuggagcuggacgaggagggcgccggcggcuucaccgccaaggccaucgugcagagagacagaguggacgaggaggcccugaacuuccccuacgaggacgacuucgacaacgacguggacgcccugcuggaggagggccugugcgcccccaagaagagaagaaccgaggagaaguacggcggcgacagcgaccaccccagcgacggcgagaccagcgugcagcccaugaugaccaagaucaagaccgugcugaagagcagaggcagaccccccaccgagccccugcccgacggcuggaucaugaccuuccacaacagcggcgugcccguguaccugcacagagagagcagaguggugaccuggagcagacccuacuuccugggcaccggcagcaucagaaagcacgaccccccccugagcagcauccccugccugcacuacaagaagaugaaggacaacgaggagagagagcagagcagcgaccugacccccagcggcgacgugagccccgugaagccccugagcagaagcgccgagcuggaguucccccuggacgagcccgacagcaugggcgccgaccccggcccccccgacgagaaggacccccugggcgccgaggccgcccccggcgcccugggccaggugaaggccaagguggaggugugcaaggacgagagcguggaccuggaggaguucagaagcuaccuggagaagagauucgacuucgagcaggugaccgugaagaaguucagaaccugggccgagagaagacaguucaacagagagaugaagagaaagcaggccgagagcgagagacccauccugcccgccaaccagaagcugaucacccugagcgugcaggacgcccccaccaagaaggaguucgugaucaaccccaacggcaagagcgaggugugcauccugcacgaguacaugcagagagugcugaaggugagacccguguacaacuucuucgagugcgccagagccacccuggagauccugauccccgacuucgugaagcagaccagcgaggagaagcccaaggacagcgaggagcuggaguacuucaaccacaucagcaucgaggacagcagaguguacgagcugaccagcaaggccggccugcugagccccuaccagauccugcacgagugccugaagagaaaccacggcaugggcgacaccagcaucaaguucgagguggugcccggcaagaaccagaagagcgaguacgugauggccugcggcaagcacaccgugagaggcuggugcaagaacaagagagugggcaagcagcuggccagccagaagauccugcagcugcugcacccccacgugaagaacuggggcagccugcugagaauguacggcagagagagcagcaagauggugaagcaggagaccagcgacaagagcgugaucgagcugcagcaguacgccaagaagaacaagcccaaccugcacauccugagcaagcugcaggaggagaugaagagacuggccgaggagagagaggagaccagaaagaagcccaagaugagcaucguggccagcgcccagcccggcggcgagccccugugcaccguggacguguaa

SEQ ID NO: 16089 - RNA, 2208 nt, Artificial Sequence
  DGKA__Homo_sapiens__NP_958853
auggccaaggagagaggccugaucagccccagcgacuucgcccagcugcagaaguacauggaguacagcaccaagaaggugagcgacgugcugaagcuguucgaggacggcgagauggccaaguacgugcagggcgacgccaucggcuacgagggcuuccagcaguuccugaagaucuaccuggagguggacaacgugcccagacaccugagccuggcccuguuccagagcuucgagaccggccacugccugaacgagaccaacgugaccaaggacguggugugccugaacgacgugagcugcuacuucagccugcuggagggcggcagacccgaggacaagcuggaguucaccuucaagcuguacgacaccgacagaaacggcauccuggacagcagcgagguggacaagaucauccugcagaugaugagaguggccgaguaccuggacugggacgugagcgagcugagacccauccugcaggagaugaugaaggagaucgacuacgacggcagcggcagcgugagccaggccgagugggugagagccggcgccaccaccgugccccugcuggugcugcugggccuggagaugacccugaaggacgacggccagcacauguggagacccaagagauuccccagacccguguacugcaaccugugcgagagcagcaucggccugggcaagcagggccugagcugcaaccugugcaaguacaccgugcacgaccagugcgccaugaaggcccugcccugcgaggugagcaccuacgccaagagcagaaaggacaucggcgugcagagccacgugugggugagaggcggcugcgagagcggcagaugcgacagaugccagaagaagaucagaaucuaccacagccugaccggccugcacugcguguggugccaccuggagauccacgacgacugccugcaggccgugggccacgagugcgacugcggccugcugagagaccacauccugccccccagcagcaucuaccccagcgugcuggccagcggccccgacagaaagaacagcaagaccagccagaagaccauggacgaccugaaccugagcaccagcgaggcccugagaaucgaccccgugcccaacacccacccccugcugguguucgugaaccccaagagcggcggcaagcagggccagagagugcuguggaaguuccaguacauccugaaccccagacagguguucaaccugcugaaggacggccccgagaucggccugagacuguucaaggacgugcccgacagcagaauccuggugugcggcggcgacggcaccgugggcuggauccuggagaccaucgacaaggccaaccugcccgugcugccccccguggccgugcugccccugggcaccggcaacgaccuggccagaugccugagauggggcggcggcuacgagggccagaaccuggccaagauccugaaggaccuggagaugagcaagguggugcacauggacagauggagcguggaggugaucccccagcagaccgaggagaagagcgaccccgugcccuuccagaucaucaacaacuacuucagcaucggcguggacgccagcaucgcccacagauuccacaucaugagagagaaguaccccgagaaguucaacagcagaaugaagaacaagcugugguacuucgaguucgccaccagcgagagcaucuucagcaccugcaagaagcuggaggagagccugaccguggagaucugcggcaagccccuggaccugagcaaccugagccuggagggcaucgccgugcugaacauccccagcaugcacggcggcagcaaccuguggggcgacaccagaagaccccacggcgacaucuacggcaucaaccaggcccugggcgccaccgccaaggugaucaccgaccccgacauccugaagaccugcgugcccgaccugagcgacaagagacuggagguggugggccuggagggcgccaucgagaugggccagaucuacaccaagcugaagaacgccggcagaagacuggccaagugcagcgagaucaccuuccacaccaccaagacccugcccaugcagaucgacggcgagcccuggaugcagacccccugcaccaucaagaucacccacaagaaccagaugcccaugcugaugggccccccccccagaagcaccaacuucuucggcuuccugagcuaa

SEQ ID NO: 16090 - RNA, 2415 nt, Artificial Sequence
  DGKB__Homo_sapiens__NP_004071
augaccaaccaggagaagugggcccaccugagccccagcgaguucagccagcugcagaaguacgccgaguacagcaccaagaagcugaaggacgugcuggaggaguuccacggcaacggcgugcuggccaaguacaaccccgagggcaagcaggacauccugaaccagaccaucgacuucgagggcuucaagcuguucaugaagaccuuccuggaggccgagcugcccgacgacuucaccgcccaccuguucaugagcuucagcaacaaguucccccacagcagccccauggugaagagcaagcccgcccugcugagcggcggccugagaaugaacaagggcgccaucaccccccccagaaccaccagccccgccaacaccugcagccccgaggugauccaccugaaggacaucgugugcuaccugagccugcuggagagaggcagacccgaggacaagcuggaguucauguucagacuguacgacaccgacggcaacggcuuccuggacagcagcgagcuggagaacaucaucagccagaugaugcacguggccgaguaccuggagugggacgugaccgagcugaaccccauccugcacgagaugauggaggagaucgacuacgaccacgacggcaccgugagccuggaggaguggauccagggcggcaugaccaccaucccccugcuggugcugcugggccuggagaacaacgugaaggacgacggccagcacguguggagacugaagcacuucaacaagcccgccuacugcaaccugugccugaacaugcugaucggcgugggcaagcagggccugugcugcagcuucugcaaguacaccgugcacgagagaugcguggccagagccccccccagcugcaucaagaccuacgugaagagcaagagaaacaccgacgugaugcaccacuacuggguggagggcaacugccccaccaagugcgacaagugccacaagaccgugaagugcuaccagggccugaccggccugcacugcguguggugccagaucacccugcacaacaagugcgccagccaccugaagcccgagugcgacugcggcccccugaaggaccacauccugccccccaccaccaucugccccguggugcugcagacccugcccaccagcggcgugagcgugcccgaggagagacagagcaccgugaagaaggagaagagcggcagccagcagcccaacaaggugaucgacaagaacaagaugcagagagccaacagcgugaccguggacggccagggccugcaggugacccccgugcccggcacccacccccugcugguguucgugaaccccaagagcggcggcaagcagggcgagagaaucuacagaaaguuccaguaccugcugaaccccagacagguguacagccugagcggcaacggccccaugcccggccugaacuucuucagagacgugcccgacuucagagugcuggccugcggcggcgacggcaccgugggcugggugcuggacugcaucgagaaggccaacgugggcaagcacccccccguggccauccugccccugggcaccggcaacgaccuggccagaugccugagauggggcggcggcuacgagggcgagaaccugaugaagauccugaaggacaucgagaacagcaccgagaucaugcuggacagauggaaguucgaggugauccccaacgacaaggacgagaagggcgaccccgugcccuacagcaucaucaacaacuacuucagcaucggcguggacgccagcaucgcccacagauuccacaucaugagagagaagcaccccgagaaguucaacagcagaaugaagaacaaguucugguacuucgaguucggcaccagcgagaccuucagcgccaccugcaagaagcugcacgagagcguggagaucgagugcgacggcgugcagaucgaccugaucaacaucagccuggagggcaucgccauccugaacauccccagcaugcacggcggcagcaaccuguggggcgagagcaagaagagaagaagccacagaagaaucgagaagaagggcagcgacaagagaaccaccgugaccgacgccaaggagcugaaguucgccagccaggaccugagcgaccagcugcuggagguggugggccuggagggcgccauggagaugggccagaucuacaccggccugaagagcgccggcagaagacuggcccagugcagcugcguggugaucagaaccagcaagagccugcccaugcagaucgacggcgagcccuggaugcagacccccugcaccaucaagaucacccacaagaaccaggcccccaugcugaugggccccccccccaagaccggccuguucugcagccuggugaagagaaccagaaacagaagcaaggaguaa

SEQ ID NO: 16091 - RNA, 3513 nt, Artificial Sequence
  DGKD__Homo_sapiens__NP_003639
augaacauguuccuguacuuccagaccaucaucaaggagggcaugcugaccaagcagaacaacagcuuccagagaagcaagagaagauacuucaagcugagaggcagaacccuguacuacgccaagaccgccaagagcaucaucuucgacgagguggaccugaccgacgccagcguggccgagagcagcaccaagaacgugaacaacagcuucaccgugaucacccccugcagaaagcugauccugugcgccgacaacagaaaggagauggaggacuggaucgccgcccugaagaccgugcagaacagagagcacuucgagcccacccaguacagcauggaccacuucagcggcaugcacaacugguacgccugcagccacgccagacccaccuacugcaacgugugcagagaggcccugagcggcgugaccagccacggccugagcugcgaggugugcaaguucaaggcccacaagagaugcgccgugagagccaccaacaacugcaaguggaccacccuggccagcaucggcaaggacaucaucgaggacgccgacggcaucgccaugccccaccaguggcuggagggcaaccugcccgugagcgccaagugcaccgugugcgacaagaccugcggcagcgugcugagacugcaggacuggagaugccuguggugcaaggccauggugcacaccagcugcaaggagagccugcugaccaagugcccccugggccugugcaaggugagcgugaucccccccaccgcccugaacagcaucgacagcgacggcuucuggaaggccagcugcccccccagcugcaccagcccccugcugguguucgugaacagcaagagcggcgacaaccagggcgugaaguuccugagaagauucaagcagcugcugaaccccgcccagguguucgaccugaugaacggcggcccccaccugggccugagacuguuccagaaguucgacaccuucagaauccuggugugcggcggcgacggcagcgugggcugggugcugagcgagaucgacagccugaaccugcacaagcagugccagcugggcgugcugccccugggcaccggcaacgaccuggccagagugcugggcuggggcagcgccugcgacgacgacacccagcugccccagauccuggagaagcuggagagagccagcaccaagaugcuggacagauggagcgugauggccuacgaggccaagcugcccagacaggccagcagcagcaccgugaccgaggacuucagcgaggacagcgaggugcagcagauccuguucuacgaggacagcguggccgcccaccugagcaagauccugaccagcgaccagcacagcguggugaucagcagcgccaaggugcugugcgagaccgugaaggacuucguggccagagugggcaaggccuacgagaagaccaccgagagcagcgaggagagcgaggugauggccaagaagugcagcgugcugaaggagaagcuggacagccugcugaagacccuggacgacgagagccaggccagcagcagccugcccaaccccccccccaccaucgccgaggaggccgaggacggcgacggcagcggcagcaucugcggcagcaccggcgacagacugguggccagcgccugccccgccagaccccagaucuucagacccagagagcagcugaugcugagagccaacagccugaagaaggccaucagacagaucaucgagcacaccgagaaggccguggacgagcagaacgcccagacccaggagcaggagggcuucgugcugggccugagcgagagcgaggagaagauggaccacagagugugccccccccugagccacagcgagagcuucggcgugcccaagggcagaagccagagaaaggugagcaagagccccugcgagaagcugaucagcaagggcagccugagccugggcagcagcgccagccugcccccccagcccggcagcagagacggccugcccgcccugaacaccaagauccuguaccccaacgugagagccggcaugagcggcagccugcccggcggcagcgugaucagcagacugcugaucaacgccgaccccuucaacagcgagcccgagacccuggaguacuacaccgagaagugcgugaugaacaacuacuucggcaucggccuggacgccaagaucagccuggacuucaacaacaagagagacgagcaccccgagaagugcagaagcagaaccaagaacaugaugugguacggcgugcugggcaccaaggagcugcugcacagaaccuacaagaaccuggagcagaaggugcugcuggagugcgacggcagacccaucccccugcccagccugcagggcaucgccgugcugaacauccccagcuacgccggcggcaccaacuucuggggcggcaccaaggaggacgacaccuucgccgcccccagcuucgacgacaagauccuggaggugguggccguguucggcagcaugcagauggccgugagcagagugaucagacugcagcaccacagaaucgcccagugcagaaccgugaagaucagcauccugggcgacgagggcgugcccgugcagguggacggcgaggccugggugcagccccccggcuacaucagaaucgugcacaagaacagagcccagacccugaccagagacagagccuucgagagcacccugaagagcugggaggacaagcagaagugcgagcugcccagaccccccagcugcagccugcaccccgagaugcugagcgaggaggaggccacccagauggaccaguucggccaggccgccggcgugcugauccacagcaucagagagaucgcccagagccacagagacauggagcaggagcuggcccacgccgugaacgccagcagcaagagcauggacagaguguacggcaagcccagaaccaccgagggccugaacugcagcuucgugcuggagauggugaacaacuucagagcccugagaagcgagaccgagcugcugcugagcggcaagauggcccugcagcuggaccccccccagaaggagcagcugggcagcgcccuggccgagauggacagacagcugagaagacuggccgacacccccuggcugugccagagcgccgagcccggcgacgaggagagcgugaugcuggaccuggccaagagaagcagaagcggcaaguucagacuggugaccaaguucaagaaggagaagaacaacaagaacaaggaggcccacagcagccugggcgcccccgugcaccuguggggcaccgaggagguggccgccuggcuggagcaccugagccugugcgaguacaaggacaucuucaccagacacgacaucagaggcagcgagcugcugcaccuggagagaagagaccugaaggaccugggcgugaccaaggugggccacaugaagagaauccugugcggcaucaaggagcugagcagaagcgcccccgccguggaggccuaa

SEQ ID NO: 16092 - RNA, 1704 nt, Artificial Sequence
  DGKE__Homo_sapiens__NP_003638
auggaggccgagagaagacccgcccccggcagccccagcgagggccuguucgccgacggccaccugauccuguggacccugugcagcgugcugcugcccguguucaucaccuucuggugcagccugcagagaagcagaagacagcugcacagaagagacaucuucagaaagagcaagcacggcuggagagacaccgaccuguucagccagcccaccuacugcugcgugugcgcccagcacauccugcagggcgccuucugcgacugcugcggccugagaguggacgagggcugccugagaaaggccgacaagagauuccagugcaaggagaucaugcugaagaacgacaccaaggugcuggacgccaugccccaccacuggaucagaggcaacgugccccugugcagcuacugcauggugugcaagcagcagugcggcugccagcccaagcugugcgacuacagaugcaucuggugccagaagaccgugcacgacgagugcaugaagaacagccugaagaacgagaagugcgacuucggcgaguucaagaaccugaucaucccccccagcuaccugaccagcaucaaccagaugagaaaggacaagaagaccgacuacgaggugcuggccagcaagcugggcaagcaguggaccccccugaucauccuggccaacagcagaagcggcaccaacaugggcgagggccugcugggcgaguucagaauccugcugaaccccgugcagguguucgacgugaccaagaccccccccaucaaggcccugcagcugugcacccugcugcccuacuacagcgccagagugcuggugugcggcggcgacggcaccgugggcugggugcuggacgccguggacgacaugaagaucaagggccaggagaaguacaucccccagguggccgugcugccccugggcaccggcaacgaccugagcaacacccugggcuggggcaccggcuacgccggcgagauccccguggcccaggugcugagaaacgugauggaggccgacggcaucaagcuggacagauggaaggugcaggugaccaacaagggcuacuacaaccugagaaagcccaaggaguucaccaugaacaacuacuucagcgugggccccgacgcccugauggcccugaacuuccacgcccacagagagaaggcccccagccuguucagcagcagaauccugaacaaggccguguaccuguucuacggcaccaaggacugccuggugcaggagugcaaggaccugaacaagaagguggagcuggagcuggacggcgagagaguggcccugcccagccuggagggcaucaucgugcugaacaucggcuacuggggcggcggcugcagacugugggagggcaugggcgacgagaccuacccccuggccagacacgacgacggccugcuggagguggugggcguguacggcagcuuccacugcgcccagauccaggugaagcuggccaaccccuucagaaucggccaggcccacaccgugagacugauccugaagugcagcaugaugcccaugcagguggacggcgagcccugggcccagggccccugcaccgugaccaucacccacaagacccacgccaugaugcuguacuucagcggcgagcagaccgacgacgacaucagcagcaccagcgaccaggaggacaucaaggccaccgaguaa

SEQ ID NO: 16093 - RNA, 2301 nt, Artificial Sequence
  DGKG__Homo_sapiens__NP_001074213
augggcgaggagagaugggugagccugacccccgaggaguucgaccagcugcagaaguacagcgaguacagcagcaagaagaucaaggacgcccugaccgaguucaacgagggcggcagccugaagcaguacgacccccacgagcccaucagcuacgacguguucaagcuguucaugagagccuaccuggagguggaccugccccagccccugagcacccaccuguuccuggccuucagccagaagcccagacacgagaccagcgaccaccccaccgagggcgccagcaacagcgaggccaacagcgccgacaccaacauccagaacgccgacaacgccaccaaggccgacgaggccugcgcccccgacaccgagagcaacauggccgagaagcaggcccccgccgaggaccagguggccgccaccccccuggagccccccgugcccagaagcagcagcagcgagagccccgugguguaccugaaggacguggugugcuaccugagccugcuggagaccggcagaccccaggacaagcuggaguucauguucagacuguacgacagcgacgagaacggccugcuggaccaggccgagauggacugcaucgugaaccagaugcugcacaucgcccaguaccuggagugggaccccaccgagcugagacccauccugaaggagaugcugcagggcauggacuacgacagagacggcuucgugagccugcaggagugggugcacggcggcaugaccaccaucccccugcuggugcugcugggcauggacgacagcggcagcaagggcgacggcagacacgccuggaccaugaagcacuucaagaagcccaccuacugcaacuucugccacaucaugcugaugggcgugagaaagcagggccugugcugcaccuacugcaaguacaccgugcacgagagaugcgugagcagaaacauccccggcugcgugaagaccuacagcaaggccaagagaagcggcgaggugaugcagcacgccuggguggagggcaacagcagcgugaagugcgacagaugccacaagagcaucaagugcuaccagagcgugaccgccagacacugcguguggugcagaaugaccuuccacagaaagugcgagcugagcacccugugcgacggcggcgagcugagagaccacauccugcugcccaccagcaucugccccaucaccagagacagacccggcgagaagagcgacggcugcgugagcgccaagggcgagcuggugaugcaguacaagaucauccccacccccggcacccacccccugcuggugcuggugaaccccaagagcggcggcagacagggcgagagacugaacuucuucagagacacccccgacuucagagugcuggccugcggcggcgacggcaccgugggcuggauccuggacugcaucgacaaggccaacuucgccaagcacccccccguggccgugcugccccugggcaccggcaacgaccuggccagaugccugagauggggcggcggcuacgagggcggcagccugaccaagauccugaaggacaucgagcagagcccccuggugaugcuggacagauggcaccuggaggugauccccagagaggagguggagaacggcgaccaggugcccuacagcaucaugaacaacuacuucagcaucggcguggacgccagcaucgcccacagauuccacgugaugagagagaagcaccccgagaaguucaacagcagaaugaagaacaagcugugguacuucgaguucggcaccagcgagaccuucgccgccaccugcaagaagcugcacgaccacaucgagcuggagugcgacggcgugggcguggaccugagcaacaucuuccuggagggcaucgccauccugaacauccccagcauguacggcggcaccaaccuguggggcgagaacaagaagaacagagccgugaucagagagagcagaaagggcgugaccgaccccaaggagcugaaguucugcgugcaggaccugagcgaccagcugcuggagguggugggccuggagggcgccauggagaugggccagaucuacaccggccugaagagcgccggcagaagacuggcccagugcgccagcgugaccaucagaaccaacaagcugcugcccaugcagguggacggcgagcccuggaugcagcccugcugcaccaucaagaucacccacaagaaccaggcccccaugaugaugggccccccccagaagagcagcuucuucagccugagaagaaagagcagaagcaaggacuaa

SEQ ID NO: 16094 - RNA, 3495 nt, Artificial Sequence
  DGKH__Homo_sapiens__NP_001191433
auggccggcgccggcggccagcaccacccccccggcgccgccggcggcgccgccgccggcgccggcgccgccgugaccagcgccgccgccagcgccggccccggcgaggacagcagcgacagcgaggccgagcaggagggcccccagaagcugaucagaaaggugagcaccagcggccagaucagaaccaagaccagcaucaaggagggccagcugcugaagcagaccagcagcuuccagagauggaagaagagauacuucaagcugagaggcagaacccuguacuacgccaaggacagcaagagccugaucuucgacgagguggaccugagcgacgccagcguggccgaggccagcaccaagaacgccaacaacagcuucaccaucaucacccccuucagaagacugaugcugugcgccgagaacagaaaggagauggaggacuggaucagcagccugaagagcgugcagaccagagagcccuacgagguggcccaguucaacguggagcacuucagcggcaugcacaacugguacgccugcagccacgccagacccaccuucugcaacgugugcagagagagccugagcggcgugaccagccacggccugagcugcgaggugugcaaguucaaggcccacaagagaugcgccgugagagccaccaacaacugcaaguggaccacccuggccagcaucggcaaggacaucaucgaggacgaggacggcguggccaugccccaccaguggcuggagggcaaccugcccgugagcgccaagugcgccgugugcgacaagaccugcggcagcgugcugagacugcaggacuggaagugccuguggugcaagaccauggugcacaccgccugcaaggaccuguaccaccccaucugcccccugggccagugcaaggugagcaucaucccccccaucgcccugaacagcaccgacagcgacggcuucugcagagccaccuucagcuucugcgugagcccccugcugguguucgugaacagcaagagcggcgacaaccagggcgugaaguuccugagaagauucaagcagcugcugaaccccgcccagguguucgaccugaugaacggcggcccccaccugggccugagacuguuccagaaguucgacaacuucagaauccuggugugcggcggcgacggcagcgugggcugggugcugagcgagaucgacaagcugaaccugaacaagcagugccagcugggcgugcugccccugggcaccggcaacgaccuggccagagugcugggcuggggcggcagcuacgacgacgacacccagcugccccagauccuggagaagcuggagagagccagcaccaagaugcuggacagauggagcaucaugaccuacgagcugaagcugccccccaaggccagccugcugcccggcccccccgaggccagcgaggaguucuacaugaccaucuacgaggacagcguggccacccaccugaccaagauccugaacagcgacgagcacgccguggugaucagcagcgccaagacccugugcgagaccgugaaggacuucguggccaagguggagaagaccuacgacaagacccuggagaacgccgugguggccgacgccguggccagcaagugcagcgugcugaacgagaagcuggagcagcugcugcaggcccugcacaccgacagccaggccgcccccgugcugcccggccugagcccccugaucguggaggaggacgccguggagagcagcagcgaggagagccugggcgagagcaaggagcagcugggcgacgacgugaccaagcccagcagccagaaggccgugaagcccagagagaucaugcugagagccaacagccugaagaaggccgugagacaggugaucgaggaggccggcaaggugauggacgaccccaccgugcaccccugcgagcccgccaaccagagcagcgacuacgacagcaccgagaccgacgagagcaaggaggaggccaaggacgacggcgccaaggagagcaucaccgugaagaccgcccccagaagccccgacgccagagccagcuacggccacagccagaccgacagcgugcccggccccgccguggccgccagcaaggagaaccugcccgugcugaacaccagaaucaucugccccggccugagagccggccuggccgccagcaucgccggcagcagcaucaucaacaagaugcugcuggccaacaucgaccccuucggcgccacccccuucaucgaccccgaccuggacagcguggacggcuacagcgagaagugcgugaugaacaacuacuucggcaucggccuggacgccaagaucagccuggaguucaacaacaagagagaggagcaccccgagaagugcagaagcagaaccaagaaccugaugugguacggcgugcugggcaccagagagcugcugcagagaagcuacaagaaccuggagcagagagugcagcuggagugcgacggccaguacaucccccugcccagccugcagggcaucgccgugcugaacauccccagcuacgccggcggcaccaacuucuggggcggcaccaaggaggacgacaucuucgccgcccccagcuucgacgacaagauccuggaggugguggccaucuucgacagcaugcagauggccgugagcagagugaucaagcugcagcaccacagaaucgcccagugcagaaccgugaagaucaccaucuucggcgacgagggcgugcccgugcagguggacggcgaggccugggugcagccccccggcaucaucaagaucgugcacaagaacagagcccagaugcugaccagagacagagccuucgagagcacccugaagagcugggaggacaagcagaagugcgacagcggcaagcccgugcugagaacccaccuguacauccaccacgccaucgaccuggccaccgaggaggugagccagaugcagcugugcagccaggccgccgaggagcugaucaccagaaucugcgacgccgccaccauccacugccugcuggagcaggagcuggcccacgccgugaacgccugcagccacgcccugaacaaggccaaccccagaugccccgagagccugaccagagacaccgccaccgagaucgccaucaacgugaaggcccuguacaacgagaccgagagccugcuggugggcagagugccccugcagcuggagagcccccacgaggagagagugagcaacgcccugcacagcguggagguggagcugcagaagcugaccgagauccccuggcuguacuacauccugcaccccaacgaggacgaggagccccccauggacugcaccaagagaaacaacagaagcaccguguucagaaucgugcccaaguucaagaaggagaaggugcagaagcagaagaccagcagccagcccggcagcggcgacaccgagagcggcagcugcgaggccaacagccccggcaacuaa

SEQ ID NO: 16095 - RNA, 3198 nt, Artificial Sequence
  DGKI__Homo_sapiens__NP_004708
auggacgccgccggcagaggcugccaccugcugccccugcccgccgccagaggccccgccagagcccccgccgccgccgccgccgccgccgccagcccccccggccccugcagcggcgccgccugcgcccccagcgccgccgccggcgccggcgccaugaaccccagcagcagcgccggcgaggagaagggcgccaccggcggcagcagcagcagcggcagcggcgccggcagcugcugccugggcgccgagggcggcgccgaccccagaggcgccggcagcgccgccgccgccggcgccgccgcccuggacgagcccgccgccgccggccagaaggagaaggacgaggcccuggaggagaagcugagaaaccugaccuucagaaagcaggugagcuacagaaaggccaucagcagagccggccugcagcaccuggcccccgcccacccccugagccugcccguggccaacggccccgccaaggagcccagagccacccuggacuggagcgagaacgccgugaacggcgagcaccuguggcuggagaccaacgugagcggcgaccugugcuaccugggcgaggagaacugccaggugagauucgccaagagcgcccugagaagaaagugcgccgugugcaagaucguggugcacaccgccugcaucgagcagcuggagaagaucaacuucagaugcaagcccaccuucagagagggcggcagcagaagccccagagagaacuucgugagacaccacugggugcacagaagaagacaggagggcaagugcaagcagugcggcaagggcuuccagcagaaguucagcuuccacagcaaggagaucguggccaucagcugcagcuggugcaagcaggccuuccacaacaaggugaccugcuucaugcugcaccacaucgaggagcccugcagccugggcgcccacgccgccgugaucgugccccccaccuggaucaucaaggugaagaagccccagaacagccugaaggccagcaacagaaagaagaagagaaccagcuucaagagaaaggccagcaagagaggcauggagcaggagaacaagggcagacccuucgugaucaagcccaucagcagcccccugaugaagccccugcugguguucgugaaccccaagagcggcggcaaccagggcaccaaggugcugcagauguucaugugguaccugaaccccagacagguguucgaccugagccaggagggccccaaggacgcccuggagcuguacagaaaggugcccaaccugagaauccuggccugcggcggcgacggcaccgugggcuggauccugagcauccuggacgagcugcagcugagcccccagccccccgugggcgugcugccccugggcaccggcaacgaccuggccagaacccugaacuggggcggcggcuacaccgacgagcccgugagcaagauccugugccagguggaggacggcaccguggugcagcuggacagauggaaccugcacguggagagaaaccccgaccugccccccgaggagcuggaggacggcgugugcaagcugccccugaacguguucaacaacuacuucagccugggcuucgacgcccacgugacccuggaguuccacgagagcagagaggccaaccccgagaaguucaacagcagauucagaaacaagauguucuacgccggcgccgccuucagcgacuuccugcagagaagcagcagagaccugagcaagcacgugaagguggugugcgacggcaccgaccugacccccaagauccaggagcugaaguuccagugcaucguguuccugaacauccccagauacugcgccggcaccaugcccuggggcaaccccggcgaccaccacgacuucgagccccagagacacgacgacggcuacaucgaggugaucggcuucaccauggccagccuggccgcccugcaggugggcggccacggcgagagacugcaccagugcagagaggugaugcugcugaccuacaagagcauccccaugcagguggacggcgagcccugcagacuggcccccgccaugaucagaaucagccugagaaaccaggccaacauggugcagaagagcaagagaagaaccagcaugccccugcugaacgacccccagagcgugcccgacagacugagaaucagagugaacaagaucagccugcaggacuacgagggcuuccacuacgacaaggagaagcugagagaggccagcaucagcgacuggcugagaaccaucgccggcgagcuggugcagagcuucggcgccaucccccugggcauccugguggugagaggcgacugcgaccuggagaccugcagaauguacaucgacagacugcaggaggaccugcagagcgugagcagcggcagccagagagugcacuaccaggaccacgagaccagcuuccccagagcccugagcgcccagagacugagccccagauggugcuuccuggacgacagaagccaggagcaccugcacuucgugauggagaucagccaggacgagaucuucauccuggaccccgacaugguggugagccagcccgccggcaccccccccggcaugcccgaccuggugguggagcaggccagcggcaucagcgacugguggaaccccgcccugagaaagagaaugcugagcgacagcggccugggcaugaucgcccccuacuacgaggacagcgaccugaaggaccugagccacagcagagugcugcagagccccgugagcagcgaggaccacgccauccugcaggccgugaucgccggcgaccugaugaagcugaucgagagcuacaagaacggcggcagccugcugauccagggccccgaccacugcagccugcugcacuacgccgccaagaccggcaacggcgagaucgugaaguacauccuggaccacggccccagcgagcugcuggacauggccgacagcgagaccggcgagaccgcccugcacaaggccgccugccagagaaacagagccgugugccagcugcugguggacgccggcgccagccugagaaagaccgacagcaagggcaagaccccccaggagagagcccagcaggccggcgaccccgaccuggccgccuaccuggagagcagacagaacuacaaggugaucggccacgaggaccuggagaccgccguguaa

SEQ ID NO: 16096 - RNA, 3816 nt, Artificial Sequence
  DGKK__Homo_sapiens__NP_001013764
auggacagaggcgccgccgccgcccagggcaccgcccccccccaggacggcgagcagcccgccgagagccccgagccccccccccccuggcccccccccccccccccccccgcccccccccccgcccccccccugcugagcgaggccagccccgagcccauccccgagcccugccccgagcuggcccccggccccugccccgaggccaccagcgagagcgccaccgagcuguacaccgagcccacccccgagcccgccaccgagcccgccagcgagcccgcccccgagcccgccaccgagcccgcccccgagcccgccaccgagcccgcccccgagcccgcccccgagcccgccaccgagagcgcccccgagcccacccccgagcccgcccuggagagcgugcccgagcccgcccccgagcugacccccgagguggcccccgagcuggcccccgagcccacccccgagcccgugaccgagcuggcccccgaguucugccccgaggccgcccccgaguucagacccagccccgcccccugccugcugcagugccccguggacaccagagagagaggccugaagaccagccccagccccagccccagccccagccccagaacccccaugagcuggagcagaaucaagaagauccugaaggagggccccaugcugaagaacugcaacagcuucaagagauggaagcugagauacuuccuggugcagggccagaagcuguacuucgcccaccaccccgccuucgcccacuucgagaccaucgaccugagccaggccaccguggccgagagcagcugcagaaaccugugccacagcuucugcgugaucaccccccagagaaagaucacccuggccgcccccaacagaaaggacauggaggaguggaucaacaucaucaagaccauccagcagggcgagaucuacaagauccccgccgccgagaacaaccccuuccuggugggcaugcacugcugguacagcagcuacagccacagaacccagcacugcaacgugugcagagagagcauccccgcccugagcagagacgccaucaucugcgaggugugcaaggugaagagccacagacugugcgcccugagagccagcaaggacugcaaguggaacacccugagcaucaccgacgaccugcugcugcccgccgacgaggugaacaugccccaccaguggguggagggcaacaugcccgugagcagccagugcgccgugugccacgagagcugcggcagcuaccagagacugcaggacuucagaugccuguggugcaacagcaccgugcacgacgacugcagaagaagauucagcaaggagugcugcuucagaagccacagaagcagcgugaucccccccaccgcccugagcgaccccaagggcgacggccagcugguggugagcagcgacuucuggaaccuggacuggagcagcgccugcagcugcccccugcugaucuucaucaacagcaagagcggcgaccaccagggcaucguguuccugagaaaguucaagcaguaccugaaccccagccagguguucgaccugcugaagggcggccccgaggccggccugagcauguucaagaacuucgccagauucagaauccuggugugcggcggcgacggcagcgugagcugggugcugagccugaucgacgccuucggccugcacgagaagugccagcuggccgugaucccccugggcaccggcaacgaccuggccagagugcugggcuggggcgccuucuggaacaagagcaagagcccccuggacauccugaacagaguggagcaggccagcgugagaauccuggacagauggagcgugaugaucagagagacccccagacagaccccccugcugaagggccagguggagauggacgugcccagauucgaggccgccgccauccagcaccuggagagcgccgccaccgagcugaacaagauccugaaggccaaguaccccaccgagaugaucaucgccaccagauuccugugcagcgccguggaggacuucgugguggacaucgugaaggccuggggccagaucaagcagaacaacaccgccaucgugagcgugauccugaagagcgaccugauguacgacagacugagcgugcugaucgacgugcuggccgaggaggccgccgccaccagcgccgagaagagcgccaccgaguacgccgacagcagcaaggccgacagaaagcccuucaucccccagaucgaccacaucgccaagugcaagcuggagcuggccaccaaggcccagagccugcagaagagccugaagcugaucaucuuccagguggagcaggcccuggacgaggagagcagacagaccaucagcgugaagaacuucagcagcaccuucuuccuggaggacgaccccgaggacaucaaccagaccagccccagaagaagaagcagaagaggcacccugagcagcaucagcagccugaagagcgaggaccuggacaaccugaaccuggaccaccugcacuucacccccgagagcaucagauucaaggagaagugcgugaugaacaacuacuucggcaucggccuggacgccaagaucagccuggacuucaacaccagaagagacgagcaccccggccaguacaacagcagacugaagaacaagaugugguacggccugcugggcaccaaggagcugcugcagagaagcuacagaaagcuggaggagagagugcaccuggagugcgacggcgagaccaucagccugcccaaccugcagggcaucguggugcugaacaucaccagcuacgccggcggcaucaacuucuggggcagcaacaccgccaccaccgaguacgaggcccccgccaucgacgacggcaagcuggaggugguggccaucuucggcagcgugcagauggccaugagcagaaucaucaaccugcaccaccacagaaucgcccagugccacgaggugaugaucaccaucgacggcgaggagggcauccccgugcagguggacggcgaggccuggauccagagacccggccugaucaagaucagauacaagaacgccgcccagaugcugaccagagacagagacuucgagaacagcaugaagaugugggaguacaagcacaccgagauccaggccgccccccagccccagcuggacuuccaggacagccaggagagccugagcgacgaggaguacgcccagaugcagcaccuggccagacuggccgagaaccugaucagcaagcugaacgaccugagcaagauccaccagcacgugagcgugcugaugggcagcgugaacgccagcgccaacauccugaacgacaucuucuacggccaggacagcggcaacgagaugggcgccgccagcugcauccccaucgagacccugagcagaaacgacgccguggacgugaccuucagccugaagggccuguacgacgacaccaccgccuuccuggacgagaagcugcugagaagcgccgaggacgagaccgcccugcagagcgcccuggacgccaugaacaaggaguucaagaagcugagcgagaucgacuggaugaaccccaucuucgugcccgaggagaagagcagcgacaccgacagcagaagccugagacugaagaucaaguuccccaagcugggcaagaagaagguggaggaggagagaaagcccaagagcggccagagcgugcagagcuucaucggcaaccuguggcacagaagacacagagaggacgaggccgagggcgacgacccccugacccccagcagaagccagcuguaa

SEQ ID NO: 16097 - RNA, 2829 nt, Artificial Sequence
  DGKQ__Homo_sapiens__NP_001338
auggccgccgccgccgagcccggcgccagagccuggcugggcggcggcagccccagacccggcagccccgccugcagccccgugcugggcagcggcggcagagccagacccggccccggccccggccccggccccgagagagccggcgugagagcccccggccccgccgccgcccccggccacagcuucagaaaggugacccugaccaagcccaccuucugccaccugugcagcgacuucaucuggggccuggccggcuuccugugcgacgugugcaacuucaugagccacgagaagugccugaagcacgugagaauccccugcaccagcguggcccccagccuggugagagugcccguggcccacugcuucggccccagaggccugcacaagagaaaguucugcgccgugugcagaaaggugcuggaggcccccgcccugcacugcgaggugugcgagcugcaccugcaccccgacugcgugcccuucgccugcagcgacugcagacagugccaccaggacggccaccaggaccacgacacccaccaccaccacuggagagagggcaaccugcccagcggcgccagaugcgaggugugcagaaagaccugcggcagcagcgacgugcuggccggcgugagaugcgaguggugcggcgugcaggcccacagccugugcagcgccgcccuggcccccgagugcggcuucggcagacugagaagccuggugcugccccccgccugcgugagacugcugcccggcggcuucagcaagacccagagcuucagaaucguggaggccgccgagcccggcgagggcggcgacggcgccgacggcagcgccgccgugggccccggcagagagacccaggccacccccgagagcggcaagcagacccugaagaucuucgacggcgacgacgccgugagaagaagccaguucagacuggugaccgugagcagacuggccggcgccgaggaggugcuggaggccgcccugagagcccaccacauccccgaggaccccggccaccuggagcugugcagacugccccccagcagccaggccugcgacgccugggccggcggcaaggccggcagcgccgugaucagcgaggagggcagaagccccggcagcggcgaggccacccccgaggccugggugaucagagcccugcccagagcccaggaggugcugaagaucuaccccggcuggcugaaggugggcguggccuacgugagcgugagagugacccccaagagcaccgccagaagcguggugcuggaggugcugccccugcugggcagacaggccgagagccccgagagcuuccagcugguggagguggccaugggcugcagacacgugcagagaaccaugcugauggacgagcagccccugcuggacagacugcaggacaucagacagaugagcgugagacaggugagccagaccagauucuacguggccgagagcagagacguggccccccacgugagccuguucgugggcggccugccccccggccugagccccgaggaguacagcagccugcugcacgaggccggcgccaccaaggccaccguggugagcgugagccacaucuacagcagccagggcgccguggugcuggacguggccugcuucgccgaggccgagagacuguacaugcugcugaaggacauggccgugagaggcagacugcugaccgcccuggugcugcccgaccugcugcacgccaagcugccccccgacagcugcccccugcugguguucgugaaccccaagagcggcggccugaagggcagagaccugcugugcagcuucagaaagcugcugaacccccaccagguguucgaccugaccaacggcggcccccugcccggccugcaccuguucagccaggugcccugcuucagagugcuggugugcggcggcgacggcaccgugggcugggugcugggcgcccuggaggagaccagauacagacuggccugccccgagcccagcguggccauccugccccugggcaccggcaacgaccugggcagagugcugagauggggcgccggcuacagcggcgaggaccccuucagcgugcugcugagcguggacgaggccgacgccgugcugauggacagauggaccauccugcuggacgcccacgaggccggcagcgccgagaacgacaccgccgacgccgagccccccaagaucgugcagaugagcaacuacugcggcaucggcaucgacgccgagcugagccuggacuuccaccaggccagagaggaggagcccggcaaguucaccagcagacugcacaacaagggcguguacgugagagugggccugcagaagaucagccacagcagaagccugcacaagcagaucagacugcagguggagagacaggagguggagcugcccagcaucgagggccugaucuucaucaacauccccagcuggggcagcggcgccgaccuguggggcagcgacagcgacaccagauucgagaagcccagaauggacgacggccugcuggagguggugggcgugaccggcguggugcacaugggccaggugcagggcggccugagaagcggcaucagaaucgcccagggcagcuacuucagagugacccugcugaaggccacccccgugcagguggacggcgagcccugggugcaggcccccggccacaugaucaucagcgccgccggccccaaggugcacaugcugagaaaggccaagcagaagcccagaagagccggcaccaccagagacgccagagccgacgccgcccccgcccccgagagcgaccccagauaa

SEQ ID NO: 16098 - RNA, 3354 nt, Artificial Sequence
  DGKZ__Homo_sapiens__NP_001099010
auggagaccuucuucagaagacacuucagaggcaaggugcccggccccggcgagggccagcagagacccagcagcgugggccugcccaccggcaaggccagaagaagaagccccgccggccaggccagcagcagccuggcccagagaagaagaagcagcgcccagcugcagggcugccugcugagcugcggcgugagagcccagggcagcagcagaagaagaagcagcaccgugccccccagcugcaaccccagauucaucguggacaaggugcugaccccccagcccaccaccgugggcgcccagcugcugggcgccccccugcugcugaccggccuggugggcaugaacgaggaggagggcgugcaggaggacgugguggccgaggccagcagcgccauccagcccggcaccaagacccccggcccccccccccccagaggcgcccagccccugcugccccugcccagauaccugagaagagccagcagccaccugcugcccgccgacgccguguacgaccacgcccuguggggccugcacggcuacuacagaagacugagccagagaagacccagcggccagcaccccggccccggcggcagaagagccagcggcaccaccgccggcaccaugcugcccaccagagugagaccccugagcagaagaagacagguggcccugagaagaaaggccgccggcccccaggccuggagcgcccugcuggccaaggccaucaccaagagcggccugcagcaccuggccccccccccccccacccccggcgcccccugcagcgagagcgagagacagaucagaagcaccguggacuggagcgagagcgccaccuacggcgagcacaucugguucgagaccaacgugagcggcgacuucugcuacgugggcgagcaguacugcguggccagaaugcugaagagcgugagcagaagaaagugcgccgccugcaagaucguggugcacacccccugcaucgagcagcuggagaagaucaacuucagaugcaagcccagcuucagagagagcggcagcagaaacgugagagagcccaccuucgugagacaccacugggugcacagaagaagacaggacggcaagugcagacacugcggcaagggcuuccagcagaaguucaccuuccacagcaaggagaucguggccaucagcugcagcuggugcaagcaggccuaccacagcaaggugagcugcuucaugcugcagcagaucgaggagcccugcagccugggcgugcacgccgccguggugaucccccccaccuggauccugagagccagaagaccccagaacacccugaaggccagcaagaagaagaagagagccagcuucaagagaaagagcagcaagaagggccccgaggagggcagauggagacccuucaucaucagacccacccccagcccccugaugaagccccugcugguguucgugaaccccaagagcggcggcaaccagggcgccaagaucauccagagcuuccugugguaccugaaccccagacagguguucgaccugagccagggcggccccaaggaggcccuggagauguacagaaaggugcacaaccugagaauccuggccugcggcggcgacggcaccgugggcuggauccugagcacccuggaccagcugagacugaagccccccccccccguggccauccugccccugggcaccggcaacgaccuggccagaacccugaacuggggcggcggcuacaccgacgagcccgugagcaagauccugagccacguggaggagggcaacguggugcagcuggacagaugggaccugcacgccgagcccaaccccgaggccggccccgaggacagagacgagggcgccaccgacagacugccccuggacguguucaacaacuacuucagccugggcuucgacgcccacgugacccuggaguuccacgagagcagagaggccaaccccgagaaguucaacagcagauucagaaacaagauguucuacgccggcaccgccuucagcgacuuccugaugggcagcagcaaggaccuggccaagcacaucagaguggugugcgacggcauggaccugacccccaagauccaggaccugaagccccagugcgugguguuccugaacauccccagauacugcgccggcaccaugcccuggggccaccccggcgagcaccacgacuucgagccccagagacacgacgacggcuaccuggaggugaucggcuucaccaugaccagccuggccgcccugcaggugggcggccacggcgagagacugacccagugcagagagguggugcugaccaccagcaaggccauccccgugcagguggacggcgagcccugcaagcuggccgccagcagaaucagaaucgcccugagaaaccaggccaccauggugcagaaggccaagagaagaagcgccgccccccugcacagcgaccagcagcccgugcccgagcagcugagaauccaggugagcagagugagcaugcacgacuacgaggcccugcacuacgacaaggagcagcugaaggaggccagcgugccccugggcaccgugguggugcccggcgacagcgaccuggagcugugcagagcccacaucgagagacugcagcaggagcccgacggcgccggcgccaagagccccaccugccagaagcugagccccaaguggugcuuccuggacgccaccaccgccagcagauucuacagaaucgacagagcccaggagcaccugaacuacgugaccgagaucgcccaggacgagaucuacauccuggaccccgagcugcugggcgccagcgccagacccgaccugcccacccccaccagcccccugcccaccagccccugcagccccacccccagaagccugcagggcgacgccgcccccccccagggcgaggagcugaucgaggccgccaagagaaacgacuucugcaagcugcaggagcugcacagagccggcggcgaccugaugcacagagacgagcagagcagaacccugcugcaccacgccgugagcaccggcagcaaggacguggugagauaccugcuggaccacgccccccccgagauccuggacgccguggaggagaacggcgagaccugccugcaccaggccgccgcccugggccagagaaccaucugccacuacaucguggaggccggcgccagccugaugaagaccgaccagcagggcgacacccccagacagagagccgagaaggcccaggacaccgagcuggccgccuaccuggagaacagacagcacuaccagaugauccagagagaggaccaggagaccgccguguaa

SEQ ID NO: 16099 - RNA, 834 nt, Artificial Sequence
  DGUOK__Homo_sapiens__NP_550438
auggccgccggcagacuguuccugagcagacugagagcccccuucagcagcauggccaagagcccccuggagggcgugagcagcagcagaggccugcacgccggcagaggccccagaagacugagcaucgagggcaacaucgccgugggcaagagcaccuucgugaagcugcugaccaagaccuaccccgaguggcacguggccaccgagcccguggccaccuggcagaacauccaggccgccggcacccagaaggccugcaccgcccagagccugggcaaccugcuggacaugauguacagagagcccgccagauggagcuacaccuuccagaccuucagcuuccugagcagacugaaggugcagcuggagcccuuccccgagaagcugcugcaggccagaaagcccgugcagaucuucgagagaagcguguacagcgacagauacaucuucgccaagaaccuguucgagaacggcagccugagcgacaucgaguggcacaucuaccaggacuggcacagcuuccugcugugggaguucgccagcagaaucacccugcacggcuucaucuaccugcaggccagcccccaggugugccugaagagacuguaccagagagccagagaggaggagaagggcaucgagcuggccuaccuggagcagcugcacggccagcacgaggccuggcugauccacaagaccaccaagcugcacuucgaggcccugaugaacauccccgugcuggugcuggacgugaacgacgacuucagcgaggaggugaccaagcaggaggaccugaugagagaggugaacaccuucgugaagaaccuguaa

SEQ ID NO: 16100 - RNA, 1428 nt, Artificial Sequence
  DHCR7__Homo_sapiens__NP_001157289
auggccgccaagagccagcccaacauccccaaggccaagagccuggacggcgugaccaacgacagaaccgccagccagggccaguggggcagagccugggagguggacugguucagccuggccagcgugaucuuccugcugcuguucgcccccuucaucguguacuacuucaucauggccugcgaccaguacagcugcgcccugaccggccccgugguggacaucgugaccggccacgccagacugagcgacaucugggccaagaccccccccaucaccagaaaggccgcccagcuguacacccugugggugaccuuccaggugcugcuguacaccagccugcccgacuucugccacaaguuccugcccggcuacgugggcggcauccaggagggcgccgugacccccgccggcguggugaacaaguaccagaucaacggccugcaggccuggcugcugacccaccugcugugguucgccaacgcccaccugcugagcugguucagccccaccaucaucuucgacaacuggaucccccugcuguggugcgccaacauccugggcuacgccgugagcaccuucgccauggugaagggcuacuucuuccccaccagcgccagagacugcaaguucaccggcaacuucuucuacaacuacaugaugggcaucgaguucaaccccagaaucggcaagugguucgacuucaagcuguucuucaacggcagacccggcaucguggccuggacccugaucaaccugagcuucgccgccaagcagagagagcugcacagccacgugaccaacgccauggugcuggugaacgugcugcaggccaucuacgugaucgacuucuucuggaacgagaccugguaccugaagaccaucgacaucugccacgaccacuucggcugguaccugggcuggggcgacugcguguggcugcccuaccuguacacccugcagggccuguaccugguguaccaccccgugcagcugagcaccccccacgccgugggcgugcugcugcugggccuggugggcuacuacaucuucagaguggccaaccaccagaaggaccuguucagaagaaccgacggcagaugccugaucuggggcagaaagcccaaggugaucgagugcagcuacaccagcgccgacggccagagacaccacagcaagcugcuggugagcggcuucuggggcguggccagacacuucaacuacgugggcgaccugaugggcagccuggccuacugccuggccugcggcggcggccaccugcugcccuacuucuacaucaucuacauggccauccugcugacccacagaugccugagagacgagcacagaugcgccagcaaguacggcagagacugggagagauacaccgccgccgugcccuacagacugcugcccggcaucuucuaa

SEQ ID NO: 16101 - RNA, 1005 nt, Artificial Sequence
  DHDH__Homo_sapiens__NP_055290
auggcccugagauggggcaucgugagcgugggccugaucagcagcgacuucaccgccgugcugcagacccugcccagaagcgagcaccaggugguggccguggccgccagagaccugagcagagccaaggaguucgcccagaagcacgacauccccaaggccuacggcagcuacgaggagcuggccaaggaccccagcguggagguggccuacaucggcacccagcacccccagcacaaggccgccgugaugcugugccuggccgccggcaaggccgugcugugcgagaagcccaccggcgugaacgccgccgaggugagagagaugguggccgaggccagaagcagagcccuguuccugauggaggccaucuggaccagauucuuccccgccagcgaggcccugagaagcgugcuggcccagggcacccugggcgaccugagaguggccagagccgaguucggcaagaaccugauccacgugcccagagccguggacagagcccaggccggcggcgcccugcuggacaucggcaucuacugcgugcaguucaccagcaugguguucggcggccagaagcccgagaagaucagcguggugggcagaagacacgagaccggcguggacgacaccgugaccgugcugcugcaguaccccggcgaggugcacggcagcuucaccugcagcaucaccgugcagcugagcaacaccgccagcgugagcggcaccaagggcauggugcagcugcugaaccccugcuggugccccaccgagcugguggugaagggcgagcacaaggaguucccccugccccccgugcccaaggacugcaacuucgacaacggcgccggcaugagcuacgaggccaagcacgugugggagugccugagaaagggcaugaaggagagccccgugaucccccugagcgagagcgagcugcuggccgacauccuggaggaggugagaaaggccaucggcgugaccuucccccaggacaagagauaa

SEQ ID NO: 16102 - RNA, 564 nt, Artificial Sequence
  DHFR__Homo_sapiens__NP_000782
auggugggcagccugaacugcaucguggccgugagccagaacaugggcaucggcaagaacggcgaccugcccuggcccccccugagaaacgaguucagauacuuccagagaaugaccaccaccagcagcguggagggcaagcagaaccuggugaucaugggcaagaagaccugguucagcauccccgagaagaacagaccccugaagggcagaaucaaccuggugcugagcagagagcugaaggagcccccccagggcgcccacuuccugagcagaagccuggacgacgcccugaagcugaccgagcagcccgagcuggccaacaagguggacaugguguggaucgugggcggcagcagcguguacaaggaggccaugaaccaccccggccaccugaagcuguucgugaccagaaucaugcaggacuucgagagcgacaccuucuuccccgagaucgaccuggagaaguacaagcugcugcccgaguaccccggcgugcugagcgacgugcaggaggagaagggcaucaaguacaaguucgagguguacgagaagaacgacuaa

SEQ ID NO: 16103 - RNA, 564 nt, Artificial Sequence
  DHFRL1__Homo_sapiens__NP_001182572
auguuccugcugcugaacugcaucguggccgugagccagaacaugggcaucggcaagaacggcgaccugcccagacccccccugagaaacgaguucagauacuuccagagaaugaccaccaccagcagcguggagggcaagcagaaccuggugaucaugggcagaaagaccugguucagcauccccgagaagaacagaccccugaaggacagaaucaaccuggugcugagcagagagcugaaggagcccccccagggcgcccacuuccuggccagaagccuggacgacgcccugaagcugaccgagagacccgagcuggccaacaagguggacaugaucuggaucgugggcggcagcagcguguacaaggaggccaugaaccaccugggccaccugaagcuguucgugaccagaaucaugcaggacuucgagagcgacaccuucuucagcgagaucgaccuggagaaguacaagcugcugcccgaguaccccggcgugcugagcgacgugcaggagggcaagcacaucaaguacaaguucgaggugugcgagaaggacgacuaa

SEQ ID NO: 16104 - RNA, 1191 nt, Artificial Sequence
  DHH__Homo_sapiens__NP_066382
auggcccugcugaccaaccugcugccccugugcugccuggcccugcuggcccugcccgcccagagcugcggccccggcagaggccccgugggcagaagaagauacgccagaaagcagcuggugccccugcuguacaagcaguucgugcccggcgugcccgagagaacccugggcgccagcggccccgccgagggcagaguggccagaggcagcgagagauucagagaccuggugcccaacuacaaccccgacaucaucuucaaggacgaggagaacagcggcgccgacagacugaugaccgagagaugcaaggagagagugaacgcccuggccaucgccgugaugaacauguggcccggcgugagacugagagugaccgagggcugggacgaggacggccaccacgcccaggacagccugcacuacgagggcagagcccuggacaucaccaccagcgacagagacagaaacaaguacggccugcuggccagacuggccguggaggccggcuucgacuggguguacuacgagagcagaaaccacgugcacgugagcgugaaggccgacaacagccuggccgugagagccggcggcugcuuccccggcaacgccaccgugagacuguggagcggcgagagaaagggccugagagagcugcacagaggcgacugggugcuggccgccgacgccagcggcagaguggugcccacccccgugcugcuguuccuggacagagaccugcagagaagagccagcuucguggccguggagaccgaguggccccccagaaagcugcugcugacccccuggcaccugguguucgccgccagaggccccgcccccgcccccggcgacuucgcccccguguucgccagaagacugagagccggcgacagcgugcuggcccccggcggcgacgcccugagacccgccagaguggccagaguggccagagaggaggccgugggcguguucgccccccugaccgcccacggcacccugcuggugaacgacgugcuggccagcugcuacgccgugcuggagagccaccagugggcccacagagccuucgccccccugagacugcugcacgcccugggcgcccugcugcccggcggcgccgugcagcccaccggcaugcacugguacagcagacugcuguacagacuggccgaggagcugcugggcuaa

SEQ ID NO: 16105 - RNA, 1188 nt, Artificial Sequence
  DHODH__Homo_sapiens__NP_001352
auggccuggagacaccugaagaagagagcccaggacgccgugaucauccugggcggcggcggccugcuguucgccagcuaccugauggccaccggcgacgagagauucuacgccgagcaccugaugcccacccugcagggccugcuggaccccgagagcgcccacagacuggccgugagauucaccagccugggccugcugcccagagccagauuccaggacagcgacaugcuggaggugagagugcugggccacaaguucagaaaccccgugggcaucgccgccggcuucgacaagcacggcgaggccguggacggccuguacaagaugggcuucggcuucguggagaucggcagcgugacccccaagccccaggagggcaaccccagacccagaguguucagacugcccgaggaccaggccgugaucaacagauacggcuucaacagccacggccugagcgugguggagcacagacugagagccagacagcagaagcaggccaagcugaccgaggacggccugccccugggcgugaaccugggcaagaacaagaccagcguggacgccgccgaggacuacgccgagggcgugagagugcugggcccccuggccgacuaccugguggugaacgugagcagccccaacaccgccggccugagaagccugcagggcaaggccgagcugagaagacugcugaccaaggugcugcaggagagagacggccugagaagagugcacagacccgccgugcuggugaagaucgcccccgaccugaccagccaggacaaggaggacaucgccagcguggugaaggagcugggcaucgacggccugaucgugaccaacaccaccgugagcagacccgccggccugcagggcgcccugagaagcgagaccggcggccugagcggcaagccccugagagaccugagcacccagaccaucagagagauguacgcccugacccagggcagagugcccaucaucggcgugggcggcgugagcagcggccaggacgcccuggagaagaucagagccggcgccagccuggugcagcuguacaccgcccugaccuucuggggcccccccguggugggcaaggugaagagagagcuggaggcccugcugaaggagcagggcuucggcggcgugaccgacgccaucggcgccgaccacagaagauaa

SEQ ID NO: 16106 - RNA, 984 nt, Artificial Sequence
  DHPS__Homo_sapiens__NP_001193903
augcccaucauccccgccuucugggaggccgaggccggcggcagcagagaggaggaguucgagaccagccuggccaacaugaucgagaagaagcuggagccccugagccaggacgaggaccagcacgccgaccugacccagagcagaagaccccugaccagcugcaccaucuuccugggcuacaccagcaaccugaucagcagcggcaucagagagaccaucagauaccuggugcagcacaacaugguggacgugcuggugaccaccgccggcggcguggaggaggaccugaucaagugccuggcccccaccuaccugggcgaguucagccugagaggcaaggagcugagagagaacggcaucaacagaaucggcaaccugcuggugcccaacgagaacuacugcaaguucgaggacuggcugaugcccauccuggaccagauggugauggagcagaacaccgagggcgugaaguggacccccagcaagaugaucgccagacugggcaaggagaucaacaaccccgagagcguguacuacugggcccagaagaaccacauccccguguucagccccgcccugaccgacggcagccugggcgacaugaucuucuuccacagcuacaagaaccccggccuggugcuggacaucguggaggaccugagacugaucaacacccaggccaucuucgccaagugcaccggcaugaucauccugggcggcggcguggugaagcaccacaucgccaacgccaaccugaugagaaacggcgccgacuacgccguguacaucaacaccgcccaggaguucgacggcagcgacagcggcgccagacccgacgaggccgugagcuggggcaagaucagaguggacgcccagcccgugaagguguacgccgacgccagccugguguucccccugcugguggccgagaccuucgcccagaagauggacgccuucaugcacgagaagaacgaggacuaa

SEQ ID NO: 16107 - RNA, 783 nt, Artificial Sequence
  DHRS11__Homo_sapiens__NP_077284
auggccagacccggcauggagagauggagagacagacuggcccuggugaccggcgccagcggcggcaucggcgccgccguggccagagcccuggugcagcagggccugaagguggugggcugcgccagaaccgugggcaacaucgaggagcuggccgccgagugcaagagcgccggcuaccccggcacccugauccccuacagaugcgaccugagcaacgaggaggacauccugagcauguucagcgccaucagaagccagcacagcggcguggacaucugcaucaacaacgccggccuggccagacccgacacccugcugagcggcagcaccagcggcuggaaggacauguucaacgugaacgugcuggcccugagcaucugcaccagagaggccuaccagagcaugaaggagagaaacguggacgacggccacaucaucaacaucaacagcaugagcggccacagagugcugccccugagcgugacccacuucuacagcgccaccaaguacgccgugaccgcccugaccgagggccugagacaggagcugagagaggcccagacccacaucagagccaccugcaucagccccggcgugguggagacccaguucgccuucaagcugcacgacaaggaccccgagaaggccgccgccaccuacgagcagaugaagugccugaagcccgaggacguggccgaggccgugaucuacgugcugagcacccccgcccacauccagaucggcgacauccagaugagacccaccgagcaggugaccuaa

SEQ ID NO: 16108 - RNA, 843 nt, Artificial Sequence
  DHRS2__Homo_sapiens__NP_005785
augcugagcgccguggccagaggcuaccagggcugguuccaccccugcgccagacugagcgugagaaugagcagcaccggcaucgacagaaagggcgugcuggccaacagaguggccguggugaccggcagcaccagcggcaucggcuucgccaucgccagaagacuggccagagacggcgcccacguggugaucagcagcagaaagcagcagaacguggacagagccauggccaagcugcagggcgagggccugagcguggccggcaucgugugccacgugggcaaggccgaggacagagagcagcugguggccaaggcccuggagcacugcggcggcguggacuuccuggugugcagcgccggcgugaacccccuggugggcagcacccugggcaccagcgagcagaucugggacaagauccugagcgugaacgugaagagccccgcccugcugcugagccagcugcugcccuacauggagaacagaagaggcgccgugauccuggugagcagcaucgccgccuacaaccccgugguggcccugggcguguacaacgugagcaagaccgcccugcugggccugaccagaacccuggcccuggagcuggcccccaaggacaucagagugaacugcguggugcccggcaucaucaagaccgacuucagcaagguguuccacggcaacgagagccuguggaagaacuucaaggagcaccaccagcugcagagaaucggcgagagcgaggacugcgccggcaucgugagcuuccugugcagccccgacgccagcuacgugaacggcgagaacaucgccguggccggcuacagcaccagacuguaa

SEQ ID NO: 16109 - RNA, 567 nt, Artificial Sequence
  DHRS4__Homo_sapiens__NP_001269916
augcacaaggccggccugcugggccugugcgccagagccuggaacagcgugagaauggccagcagcggcaugaccagaagagacccccuggccaacaagguggcccuggugaccgccagcaccgacggcaucggcuucgccaucgccagaagacuggcccaggacggcgcccacgugguggugagcagcagaaagcagcagaacguggaccaggccguggccacccugcagggcgagggccugagcgugaccggcaccgugugccacgugggcaaggccgaggacagagagagacugguggccaccgccgugaagcugcacggcggcaucgacauccuggugagcaacgccgccgugaaccccuucuucggcagcaucauggacgugaccgaggaggugugggacaagagaagacugagcggcgacagaguguuccacagcagccugcagagcaucagcagccuggacggccagggcaagagaggcaagcacgagagaaaccccgccgacaagaaggugagaagagccagaggccugugcuggcacagaguguuccccgugcuguaa

SEQ ID NO: 16110 - RNA, 936 nt, Artificial Sequence
  DHRS7C__Homo_sapiens__NP_001099041
augggcgugauggccaugcugaugcugccccugcugcugcugggcaucagcggccugcuguucaucuaccaggaggugagcagacuguggagcaagagcgccgugcagaacaaggugguggugaucaccgacgccaucagcggccugggcaaggagugcgccagaguguuccacaccggcggcgccagacuggugcugugcggcaagaacugggagagacuggagaaccuguacgacgcccugaucagcguggccgaccccagcaagaccuucacccccaagcuggugcugcuggaccugagcgacaucagcugcgugcccgacguggccaaggaggugcuggacugcuacggcugcguggacauccugaucaacaacgccagcgugaaggugaagggccccgcccacaagaucagccuggagcuggacaagaagaucauggacgccaacuacuucggccccaucacccugaccaaggcccugcugcccaacaugaucagcagaagaaccggccagaucgugcuggugaacaacauccagggcaaguucggcauccccuucagaaccaccuacgccgccagcaagcacgccgcccugggcuucuucgacugccugagagccgagguggaggaguacgacguggugaucagcaccgugagccccaccuucaucagaagcuaccacguguaccccgagcagggcaacugggaggccagcaucuggaaguucuucuucagaaagcugaccuacggcgugcaccccguggagguggccgaggaggugaugagaaccgugagaagaaagaagcaggagguguucauggccaaccccauccccaaggccgccguguacgugagaaccuucuuccccgaguucuucuucgccgugguggccugcggcgugaaggagaagcugaacgugcccgaggagggcuaa

SEQ ID NO: 16111 - RNA, 1140 nt, Artificial Sequence
  DHRS9__Homo_sapiens__NP_001276692
augcccgagggcagaagccacugcgccugcagcaucaccagccugacccugcuggugagccugaccagagugacccuggacauccugcagaagcuggaccccccccagcccgcccacuggagacaccaccugcuggugcuguacaagaagggcguguaccugagccacaccggcggcaagaugcuguucugggugcugggccugcugauccugugcggcuuccuguggaccagaaagggcaagcugaagaucgaggacaucaccgacaaguacaucuucaucaccggcugcgacagcggcuucggcaaccuggccgccagaaccuucgacaagaagggcuuccacgugaucgccgccugccugaccgagagcggcagcaccgcccugaaggccgagaccagcgagagacugagaaccgugcugcuggacgugaccgaccccgagaacgugaagagaaccgcccagugggugaagaaccaggugggcgagaagggccuguggggccugaucaacaacgccggcgugcccggcgugcuggcccccaccgacuggcugacccuggaggacuacagagagcccaucgaggugaaccuguucggccugaucagcgugacccugaacaugcugccccuggugaagaaggcccagggcagagugaucaacgugagcagcgugggcggcagacuggccaucgugggcggcggcuacacccccagcaaguacgccguggagggcuucaacgacagccugagaagagacaugaaggccuucggcgugcacgugagcugcaucgagcccggccuguucaagaccaaccuggccgaccccgugaaggugaucgagaagaagcuggccaucugggagcagcugagccccgacaucaagcagcaguacggcgagggcuacaucgagaagagccuggacaagcugaagggcaacaagagcuacgugaacauggaccugagccccgugguggagugcauggaccacgcccugaccagccuguuccccaagacccacuacgccgccggcaaggacgccaagaucuucuggaucccccugagccacaugcccgccgcccugcaggacuuccugcugcugaagcagaaggccgagcuggccaaccccaaggccguguaa

SEQ ID NO: 16112 - RNA, 2760 nt, Artificial Sequence
  DHTKD1__Homo_sapiens__NP_061176
auggccagcgccaccgccgccgccgccagaagaggccugggcagagcccugccccugcuguggagaggcuaccagaccgagagaggcguguacggcuacagacccagaaagcccgagagcagagagccccagggcgcccuggagagaccccccguggaccacggccuggccagacuggugaccguguacugcgagcacggccacaaggccgccaagaucaacccccuguucaccggccaggcccugcuggagaacgugcccgagauccaggcccuggugcagacccugcagggccccuuccacaccgccggccugcugaacaugggcaaggaggaggccagccuggaggaggugcugguguaccugaaccagaucuacugcggccagaucagcaucgagaccagccagcugcagagccaggacgagaaggacugguucgccaagagauucgaggagcugcagaaggagaccuucaccaccgaggagagaaagcaccugagcaagcugaugcuggagagccaggaguucgaccacuuccuggccaccaaguucagcaccgugaagagauacggcggcgagggcgccgagagcaugaugggcuucuuccacgagcugcugaagaugagcgccuacagcggcaucaccgacgugaucaucggcaugccccacagaggcagacugaaccugcugaccggccugcugcaguucccccccgagcugauguucagaaagaugagaggccugagcgaguuccccgagaacuucagcgccaccggcgacgugcugagccaccugaccagcagcguggaccuguacuucggcgcccaccacccccugcacgugaccaugcugcccaaccccagccaccuggaggccgugaaccccguggccgugggcaagaccagaggcagacagcagagcagacaggacggcgacuacagccccgacaacagcgcccagcccggcgacagagugaucugccugcaggugcacggcgacgccagcuucugcggccagggcaucgugcccgagaccuucacccugagcaaccugccccacuucagaaucggcggcagcgugcaccugaucgugaacaaccagcugggcuacaccacccccgccgagagaggcagaagcagccuguacugcagcgacaucggcaagcuggugggcugcgccaucauccacgugaacggcgacagccccgaggagguggugagagccaccagacuggccuucgaguaccagagacaguucagaaaggacgugaucaucgaccugcugugcuacagacaguggggccacaacgagcuggacgagcccuucuacaccaaccccaucauguacaagaucaucagagccagaaagagcauccccgacaccuacgccgagcaccugaucgccggcggccugaugacccaggaggaggugagcgagaucaagagcagcuacuacgccaagcugaacgaccaccugaacaacauggcccacuacagaccccccgcccugaaccugcaggcccacuggcagggccuggcccagcccgaggcccagaucaccaccuggagcaccggcgugccccuggaccugcugagauucgugggcaugaagagcguggaggugcccagagagcugcagaugcacagccaccugcugaagacccacgugcagagcagaauggagaagaugauggacggcaucaagcuggacugggccaccgccgaggcccuggcccugggcagccugcuggcccagggcuucaacgugagacugagcggccaggacgugggcagaggcaccuucagccagagacacgccaucguggugugccaggagaccgacgacaccuacaucccccugaaccacauggaccccaaccagaagggcuuccuggaggugagcaacagcccccugagcgaggaggccgugcugggcuucgaguacggcaugagcaucgagagccccaagcugcugccccugugggaggcccaguucggcgacuucuucaacggcgcccagaucaucuucgacaccuucaucagcggcggcgaggccaaguggcugcugcagagcggcaucgugauccugcugccccacggcuacgacggcgccggccccgaccacagcagcugcagaaucgagagauuccugcagaugugcgacagcgccgaggagggcguggacggcgacaccgugaacauguucguggugcaccccaccacccccgcccaguacuuccaccugcugagaagacagauggugagaaacuucagaaagccccugaucguggccagccccaagaugcugcugagacugcccgccgccgugagcacccugcaggagauggcccccggcaccaccuucaaccccgugaucggcgacagcagcguggaccccaagaaggugaagacccugguguucugcagcggcaagcacuucuacagccuggugaagcagagagagagccugggcgccaagaagcacgacuucgccaucaucagaguggaggagcugugccccuucccccuggacagccugcagcaggagaugagcaaguacaagcacgugaaggaccacaucuggagccaggaggagccccagaacaugggccccuggagcuucgugagccccagauucgagaagcagcuggccugcaagcugagacuggugggcagacccccccugcccgugcccgccgugggcaucggcaccgugcaccugcaccagcacgaggacauccuggccaagaccuucgccuaa

SEQ ID NO: 16113 - RNA, 2388 nt, Artificial Sequence
  DHX15__Homo_sapiens__NP_001349
augagcaagagacacagacuggaccugggcgaggacuaccccagcggcaagaagagagccggcaccgacggcaaggacagagacagagacagagacagagaggacagaagcaaggacagagacagagagagagacagaggcgacagagagagagagagagagaaggagaaggagaaggagcugagagccagcaccaacgccaugcugaucagcgccggccugcccccccugaaggccagccacagcgcccacagcacccacagcgcccacagcacccacagcacccacagcgcccacagcacccacgccggccacgccggccacaccagccugccccagugcaucaaccccuucaccaaccugccccacacccccagauacuacgacauccugaagaagagacugcagcugcccgugugggaguacaaggacagauucaccgacauccuggugagacaccagagcuucgugcuggugggcgagaccggcagcggcaagaccacccagaucccccaguggugcguggaguacaugagaagccugcccggccccaagagaggcguggccugcacccagcccagaagaguggccgccaugagcguggcccagagaguggccgacgagauggacgugaugcugggccaggaggugggcuacagcaucagauucgaggacugcagcagcgccaagaccauccugaaguacaugaccgacggcaugcugcugagagaggccaugaacgacccccugcuggagagauacggcgugaucauccuggacgaggcccacgagagaacccuggccaccgacauccugaugggcgugcugaaggagguggugagacagagaagcgaccugaaggugaucgugaugagcgccacccuggacgccggcaaguuccagaucuacuucgacaacugcccccugcugaccauccccggcagaacccaccccguggagaucuucuacacccccgagcccgagagagacuaccuggaggccgccaucagaaccgugauccagauccacaugugcgaggaggaggagggcgaccugcugcuguuccugaccggccaggaggagaucgacgaggccugcaagagaaucaagagagagguggacgaccugggccccgaggugggcgacaucaagaucaucccccuguacagcacccugcccccccagcagcagcagagaaucuucgagccccccccccccaagaagcagaacggcgccaucggcagaaaggugguggugagcaccaacaucgccgagaccagccugaccaucgacggcgugguguucgugaucgaccccggcuucgccaagcagaagguguacaaccccagaaucagaguggagagccugcuggugaccgccaucagcaaggccagcgcccagcagagagccggcagagccggcagaaccagacccggcaagugcuucagacuguacaccgagaaggccuacaagaccgagaugcaggacaacaccuaccccgagauccugagaagcaaccugggcagcguggugcugcagcugaagaagcugggcaucgacgaccuggugcacuucgacuucauggacccccccgcccccgagacccugaugagagcccuggagcugcugaacuaccuggccgcccugaacgacgacggcgaccugaccgagcugggcagcaugauggccgaguucccccuggacccccagcuggccaagauggugaucgccagcugcgacuacaacugcagcaacgaggugcugagcaucaccgccaugcugagcgugccccagugcuucgugagacccaccgaggccaagaaggccgccgacgaggccaagaugagauucgcccacaucgacggcgaccaccugacccugcugaacguguaccacgccuucaagcagaaccacgagagcgugcaguggugcuacgacaacuucaucaacuacagaagccugaugagcgccgacaacgugagacagcagcugagcagaaucauggacagauucaaccugcccagaagaagcaccgacuucaccagcagagacuacuacaucaacaucagaaaggcccuggugaccggcuacuucaugcagguggcccaccuggagagaaccggccacuaccugaccgugaaggacaaccagguggugcagcugcaccccagcaccgugcuggaccacaagcccgagugggugcuguacaacgaguucgugcugaccaccaagaacuacaucagaaccugcaccgacaucaagcccgaguggcuggugaagaucgccccccaguacuacgacaugagcaacuucccccagugcgaggccaagagacagcuggacagaaucaucgccaagcugcagagcaaggaguacagccaguacuaa

SEQ ID NO: 16114 - RNA, 2946 nt, Artificial Sequence
  DHX16__Homo_sapiens__NP_001157711
augagcgaggaccccagaggccccaaggugcccagaaaggccgugguggagaagcccgccagagccgccgagagagaggccagagcccugcuggagaagaacagaagcuacagacugcuggaggacagcgaggagagcagcgaggagaccgugagcagagccggcagcagccugcagaagaagagaaagaagagaaagcaccugagaaagaagagagaggaggaggaggaggaggaggccagcgagaagggcaagaagaagaccggcggcagcaagcagcagaccgagaagcccgagagcgaggacgagugggagagaaccgagagagagagacugcaggaccuggaggagagagacgccuucgccgagagagugagacagagagacaaggacagaaccagaaacgugcuggagagaagcgacaagaaggccuacgaggaggcccagaagagacugaagauggccgaggaggacagaaaggccauggugcccgagcugagaaagaagagcagaagagaguaccuggccaagagagagagagagaagcuggaggaccuggaggccgagcuggccgacgaggaguuccuguucggcgacguggagcugagcagacacgagagacaggagcugaaguacaagagaagagugagagaccuggccagagaguacagagccgccggcgagcaggagaagcuggaggccaccaacagauaccacaugcccaaggagaccagaggccagcccgccagagccguggaccugguggaggaggagagcggcgcccccggcgaggagcagagaagaugggaggaggccagacugggcgccgccagccugaaguucggcgccagagacgccgccagccaggagcccaaguaccagcuggugcuggaggaggaggagaccaucgaguucgugagagccacccagcugcagggcgacgaggagcccagcgccccccccaccagcacccaggcccagcagaaggagagcauccaggccgugagaagaagccugcccguguuccccuucagagaggagcugcuggccgccaucgccaaccaccaggugcugaucaucgagggcgagaccggcagcggcaagaccacccagaucccccaguaccuguucgaggagggcuacaccaacaagggcaugaagaucgccugcacccagcccagaagaguggccgccaugagcguggccgccagaguggccagagagaugggcgugaagcugggcaacgaggugggcuacagcaucagauucgaggacugcaccagcgagagaaccgugcugagauacaugaccgacggcaugcugcugagagaguuccugagcgagcccgaccuggccagcuacagcguggugaugguggacgaggcccacgagagaacccugcacaccgacauccuguucggccugaucaaggacguggccagauucagacccgagcugaaggugcugguggccagcgccaccauggacaccgccagauucagcaccuucuucgacgacgcccccguguucagaauccccggcagaagauuccccguggacaucuucuacaccaaggcccccgaggccgacuaccuggaggccugcguggugagcgugcugcagauccacgugacccagccccccggcgacauccugguguuccugaccggccaggaggagaucgaggccgccugcgagaugcugcaggacagaugcagaagacugggcagcaagaucagagagcugcuggugcugcccaucuacgccaaccugcccagcgacaugcaggccagaaucuuccagcccaccccccccggcgccagaaagguggugguggccaccaacaucgccgagaccagccugaccaucgagggcaucaucuacgugcuggaccccggcuucugcaagcagaagagcuacaaccccagaaccggcauggagagccugaccgugacccccugcagcaaggccagcgccaaccagagagccggcagagccggcagaguggccgccggcaagugcuucagacuguacaccgccugggccuaccagcacgagcuggaggagaccaccgugcccgagauccagagaaccagccugggcaacguggugcugcugcugaagagccugggcauccacgaccugaugcacuucgacuuccuggaccccccccccuacgagacccugcugcuggcccuggagcagcuguacgcccugggcgcccugaaccaccugggcgagcugaccaccagcggcagaaagauggccgagcugcccguggaccccaugcugagcaagaugauccuggccagcgagaaguacagcugcagcgaggagauccugaccguggccgccaugcugagcgugaacaacagcaucuucuacagacccaaggacaagguggugcacgccgacaacgccagagugaacuucuuccugcccggcggcgaccaccuggugcugcugaacguguacacccagugggccgagagcggcuacagcagccaguggugcuacgagaacuucgugcaguucagaagcaugagaagagccagagacgugagagagcagcuggagggccugcuggagagaguggaggugggccugagcagcugccagggcgacuacaucagagugagaaaggccaucaccgccggcuacuucuaccacaccgccagacugaccagaagcggcuacagaaccgugaagcagcagcagaccguguucauccaccccaacagcagccuguucgagcagcagcccagauggcugcuguaccacgagcuggugcugaccaccaaggaguucaugagacaggugcuggagaucgagagcagcuggcugcuggagguggccccccacuacuacaaggccaaggagcuggaggacccccacgccaagaagaugcccaagaagaucggcaagaccagagaggagcugggcuaa

SEQ ID NO: 16115 - RNA, 2232 nt, Artificial Sequence
  DHX32__Homo_sapiens__NP_060650
auggaggaggagggccuggagugccccaacagcagcagcgagaagagauacuuccccgagagccuggacagcagcgacggcgacgaggaggaggugcuggccugcgaggaccuggagcugaaccccuucgacggccugcccuacagcagcagauacuacaagcugcugaaggagagagaggaccugcccaucuggaaggagaaguacagcuucauggagaaccugcugcagaaccagaucgugaucgugagcggcgacgccaagugcggcaagagcgcccaggugccccaguggugcgccgaguacugccugagcauccacuaccagcacggcggcgugaucugcacccaggugcacaagcagaccguggugcagcuggcccugagaguggccgacgagauggacgugaacaucggccacgaggugggcuacgugauccccuucgagaacugcugcaccaacgagaccauccugagauacugcaccgacgacaugcugcagagagagaugaugagcaaccccuuccugggcagcuacggcgugaucauccuggacgacauccacgagagaagcaucgccaccgacgugcugcugggccugcugaaggacgugcugcuggccagacccgagcugaagcugaucaucaacagcagcccccaccugaucagcaagcugaacagcuacuacggcaacgugcccgugaucgaggugaagaacaagcaccccguggaggugguguaccugagcgaggcccagaaggacagcuucgagagcauccugagacugaucuucgagauccaccacagcggcgagaagggcgacaucgugguguuccuggccugcgagcaggacaucgagaaggugugcgagaccguguaccagggcagcaaccugaaccccgaccugggcgagcuggugguggugccccuguaccccaaggagaagugcagccuguucaagccccuggacgagaccgagaagagaugccagguguaccagagaagaguggugcugaccaccagcagcggcgaguuccugaucuggagcaacagcgugagauucgugaucgacgugggcguggagagaagaaagguguacaaccccagaaucagagccaacagccuggugaugcagcccaucagccagagccaggccgagaucagaaagcagauccugggcagcagcagcagcggcaaguucuucugccuguacaccgaggaguucgccagcaaggacaugaccccccugaagcccgccgagaugcaggaggccaaccugaccagcauggugcuguucaugaagagaaucgacaucgccggccugggccacugcgacuucaugaacagacccgcccccgagagccugaugcaggcccuggaggaccuggacuaccuggccgcccuggacaacgacggcaaccugagcgaguucggcaucaucaugagcgaguucccccuggacccccagcugagcaagagcauccuggccagcugcgaguucgacugcguggacgaggugcugaccaucgccgccauggugaccgcccccaacugcuucagccacgugccccacggcgccgaggaggccgcccugaccugcuggaagaccuuccugcaccccgagggcgaccacuucacccugaucagcaucuacaaggccuaccaggacaccacccugaacagcagcagcgaguacugcguggagaaguggugcagagacuacuuccugaacugcagcgcccugagaauggccgacgugaucagagccgagcugcuggagaucaucaagagaaucgagcugcccuacgccgagcccgccuucggcagcaaggagaacacccugaacaucaagaaggcccugcugagcggcuacuucaugcagaucgccagagacguggacggcagcggcaacuaccugaugcugacccacaagcagguggcccagcugcacccccugagcggcuacagcaucaccaagaagaugcccgagugggugcuguuccacaaguucagcaucagcgagaacaacuacaucagaaucaccagcgagaucagccccgagcuguucaugcagcuggugccccaguacuacuucagcaaccugccccccagcgagagcaaggacauccugcagcaggugguggaccaccugagccccgugagcaccaugaacaaggagcagcagaugugcgagaccugccccgagaccgagcagagaugcacccugcaguaa

SEQ ID NO: 16116 - RNA, 3432 nt, Artificial Sequence
  DHX34__Homo_sapiens__NP_055496
augcccccccccagaaccagagagggcagagacagaagagaccaccacagagcccccagcgaggaggaggcccuggagaagugggacuggaacugccccgagaccagaagacugcuggaggacgccuucuucagagaggaggacuacaucagacagggcagcgaggagugccagaaguucuggaccuucuucgagagacugcagagauuccagaaccugaagaccagcagaaaggaggagaaggaccccggccagcccaagcacagcauccccgcccuggccgaccugcccagaaccuacgaccccagauacagaaucaaccugagcgugcugggccccgccaccagaggcagccagggccugggcagacaccugcccgccgagagaguggccgaguucagaagagcccugcugcacuaccuggacuucggccagaagcaggccuucggcagacuggccaagcugcagagagagagagccgcccugcccaucgcccaguacggcaacagaauccugcagacccugaaggagcaccaggugguggugguggccggcgacaccggcugcggcaagagcacccaggugccccaguaccugcuggccgccggcuucagccacguggccugcacccagcccagaagaaucgccugcaucagccuggccaagagagugggcuucgagagccugagccaguacggcagccaggugggcuaccagaucagauucgagagcaccagaagcgccgccaccaagaucguguuccugaccgugggccugcugcugagacagauccagagagagcccagccugccccaguacgaggugcugaucguggacgaggugcacgagagacaccugcacaacgacuuccugcugggcgugcugcagagacugcugcccaccagacccgaccugaaggugauccugaugagcgccaccaucaacaucagccuguucagcagcuacuucagcaacgcccccguggugcaggugcccggcagacuguuccccaucaccgugguguaccagccccaggaggccgagcccaccaccagcaagagcgagaagcuggaccccagacccuuccugagagugcuggagagcaucgaccacaaguacccccccgaggagagaggcgaccugcugguguuccugagcggcauggccgagaucagcgccgugcuggaggccgcccagaccuacgccagccacacccagagauggguggugcugccccugcacagcgcccugagcguggccgaccaggacaagguguucgacguggccccccccggcgugagaaagugcauccugagcaccaacaucgccgagaccagcgugaccaucgacggcaucagauucgugguggacagcggcaaggugaaggagaugagcuacgacccccaggccaagcugcagagacugcaggaguucuggaucagccaggccagcgccgagcagagaaagggcagagccggcagaaccggccccggcgugugcuucagacuguacgccgagagcgacuacgacgccuucgcccccuaccccgugcccgagaucagaagaguggcccuggacagccuggugcugcagaugaagagcaugagcgugggcgaccccagaaccuuccccuucaucgagccccccccccccgccagccuggagaccgccauccuguaccugagagaccagggcgcccuggacagcagcgaggcccugacccccaucggcagccugcuggcccagcugcccguggacguggugaucggcaagaugcugauccugggcagcauguucagccugguggagcccgugcugaccaucgccgccgcccugagcgugcagagccccuucaccagaagcgcccagagcagccccgagugcgccgccgccagaagaccccuggagagcgaccagggcgaccccuucacccuguucaacguguucaacgccugggugcaggugaagagcgagagaagcagaaacagcagaaaguggugcagaagaagaggcaucgaggagcacagacuguacgagauggccaaccugagaagacaguucaaggagcugcuggaggaccacggccugcuggccggcgcccaggccgcccaggugggcgacagcuacagcagacugcagcagagaagagagagaagagcccugcaccagcugaagagacagcacgaggagggcgccggcagaagaagaaaggugcugagacugcaggaggagcaggacggcggcagcagcgacgaggacagagccggccccgccccccccggcgccagcgacggcguggacauccaggacgugaaguucaagcugagacacgaccuggcccagcugcaggccgccgccagcagcgcccaggaccugagcagagagcagcuggcccugcugaagcuggugcugggcagaggccuguacccccagcuggccgugcccgacgccuucaacagcagcagaaaggacagcgaccagaucuuccacacccaggccaagcagggcgccgugcugcaccccaccugcguguucgccggcagccccgaggugcugcacgcccaggagcuggaggccagcaacugcgacggcagcagagacgacaaggacaagaugagcagcaagcaccagcugcugagcuucgugagccugcuggagaccaacaagcccuaccuggugaacugcgugagaauccccgcccugcagagccugcugcuguucagcagaagccuggacaccaacggcgacugcagcagacugguggccgacggcuggcuggagcugcagcuggccgacagcgagagcgccaucagacugcuggccgccagccugagacugagagccagaugggagagcgcccuggacagacagcuggcccaccaggcccagcagcagcuggaggaggaggaggaggacacccccgugagccccaaggagguggccacccugagcaaggagcugcugcaguucaccgccagcaagauccccuacagccugagaagacugaccggccuggaggugcagaacauguacgugggcccccagaccauccccgccaccccccaccugcccggccuguucggcagcagcacccugagcccccaccccaccaagggcggcuacgccgugaccgacuuccugaccuacaacugccugaccaacgacaccgaccuguacagcgacugccugagaaccuucuggaccugcccccacugcggccugcacgccccccugaccccccuggagagaaucgcccacgagaacaccugcccccaggccccccaggacggcccccccggcgccgaggaggccgcccuggagacccugcagaagaccagcgugcugcagagacccuaccacugcgaggccugcggcaaggacuuccuguucacccccaccgaggugcugagacacagaaagcagcacguguaa

SEQ ID NO: 16117 - RNA, 2985 nt, Artificial Sequence
  DHX36__Homo_sapiens__NP_001107869
augagcuacgacuaccaccagaacuggggcagagacggcggccccagaagcagcggcggcggcuacggcggcggccccgccggcggccacggcggcaacagaggcagcggcggcggcggcggcggcggcggcggcggcagaggcggcagaggcagacaccccggccaccugaagggcagagagaucggcaugugguacgccaagaagcagggccagaagaacaaggaggccgagagacaggagagagccguggugcacauggacgagagaagagaggagcagaucgugcagcugcugaacagcgugcaggccaagaacgacaaggagagcgaggcccagaucagcugguucgcccccgaggaccacggcuacggcaccgaggugagcaccaagaacacccccugcagcgagaacaagcuggacauccaggagaagaagcugaucaaccaggagaagaagauguucagaaucagaaacagaagcuacaucgacagagacagcgaguaccugcugcaggagaacgagcccgacggcacccuggaccagaagcugcuggaggaccugcagaagaagaagaacgaccugagauacaucgagaugcagcacuucagagagaagcugcccagcuacggcaugcagaaggagcuggugaaccugaucgacaaccaccaggugaccgugaucagcggcgagaccggcugcggcaagaccacccaggugacccaguucauccuggacaacuacaucgagagaggcaagggcagcgccugcagaaucgugugcacccagcccagaagaaucagcgccaucagcguggccgagagaguggccgccgagagagccgagagcugcggcagcggcaacagcaccggcuaccagaucagacugcagagcagacugcccagaaagcagggcagcauccuguacugcaccaccggcaucauccugcaguggcugcagagcgaccccuaccugagcagcgugagccacaucgugcuggacgagauccacgagagaaaccugcagagcgacgugcugaugaccguggugaaggaccugcugaacuucagaagcgaccugaaggugauccugaugagcgccacccugaacgccgagaaguucagcgaguacuucggcaacugccccaugauccacauccccggcuucaccuuccccgugguggaguaccugcuggaggacgugaucgagaagaucagauacgugcccgagcagaaggagcacagaagccaguucaagagaggcuucaugcagggccacgugaacagacaggagaaggaggagaaggaggccaucuacaaggagagauggcccgacuacgugagagagcugagaagaagauacagcgccagcaccguggacgugaucgagaugauggaggacgacaagguggaccugaaccugaucguggcccugaucagauacaucgugcuggaggaggaggacggcgccauccugguguuccugcccggcugggacaacaucagcacccugcacgaccugcugaugagccaggugauguucaagagcgugaaccagacccagguguucaagagaaccccccccggcgugagaaagaucgugaucgccaccaacaucgccgagaccagcaucaccaucgacgacgugguguacgugaucgacggcggcaagaucaaggagacccacuucgacacccagaacaacaucagcaccaugagcgccgagugggugagcaaggccaacgccaagcagagaaagggcagagccggcagagugcagcccggccacugcuaccaccuguacaacggccugagagccagccugcuggacgacuaccagcugcccgagauccugagaaccccccuggaggagcugugccugcagaucaagauccugagacugggcggcaucgccuacuuccugagcagacugauggacccccccagcaacgaggccgugcugcugagcaucagacaccugauggagcugaacgcccuggacaagcaggaggagcugaccccccugggcgugcaccuggccagacugcccguggagccccacaucggcaagaugauccuguucggcgcccuguucugcugccuggaccccgugcugaccaucgccgccagccugagcuucaaggaccccuucgugaucccccugggcaaggagaagaucgccgacgccagaagaaaggagcuggccaaggacaccagaagcgaccaccugaccguggugaacgccuucgagggcugggaggaggccagaagaagaggcuucagauacgagaaggacuacugcugggaguacuuccugagcagcaacacccugcagaugcugcacaacaugaagggccaguucgccgagcaccugcugggcgccggcuucgugagcagcagaaaccccaaggaccccgagagcaacaucaacagcgacaacgagaagaucaucaaggccgugaucugcgccggccuguaccccaagguggccaagaucagacugaaccugggcaagaagagaaagauggugaagguguacaccaagaccgacggccugguggccgugcaccccaagagcgugaacguggagcagaccgacuuccacuacaacuggcugaucuaccaccugaagaugagaaccagcagcaucuaccuguacgacugcaccgaggugagccccuacugccugcuguucuucggcggcgacaucagcauccagaaggacaacgaccaggagaccaucgccguggacgaguggaucguguuccagagccccgccagaaucgcccaccuggugaaggagcugagaaaggagcuggacauccugcugcaggagaagaucgagagcccccaccccguggacuggaacgacaccaagagcagagacugcgccgugcugagcgccaucaucgaccugaucaagacccaggagaaggccacccccagaaacuucccccccagauuccaggacggcuacuacagcuaa

SEQ ID NO: 16118 - RNA, 3684 nt, Artificial Sequence
  DHX38__Homo_sapiens__NP_054722
augggcgacaccagcgaggacgccagcauccacagacuggagggcaccgaccuggacugccaggugggcggccugaucugcaagagcaagagcgccgccagcgagcagcacguguucaaggcccccgcccccagacccagccugcugggccuggaccugcuggccagccugaagagaagagagagagaggagaaggacgacggcgaggacaagaagaagagcaaggugagcagcuacaaggacugggaggagagcaaggacgaccagaaggacgccgaggaggagggcggcgaccaggccggccagaacaucagaaaggacagacacuacagaagcgccagaguggagacccccagccaccccggcggcgugagcgaggaguucugggagagaagcagacagagagagagagagagaagagagcacggcguguacgccagcagcaaggaggagaaggacuggaagaaggagaagagcagagacagagacuacgacagaaagagagacagagacgagagagacagaagcagacacagcagcagaagcgagagagacggcggcagcgagagaagcagcagaagaaacgagcccgagagccccagacacagacccaaggacgccgccacccccagcagaagcaccugggaggaggaggacagcggcuacggcagcagcagaagaagccagugggagagccccagccccacccccagcuacagagacagcgagagaagccacagacugagcaccagagacagagacagaagcgugagaggcaaguacagcgacgacaccccccugcccacccccagcuacaaguacaacgagugggccgacgacagaagacaccugggcagcacccccagacugagcagaggcagaggcagaagagaggagggcgaggagggcaucagcuucgacaccgaggaggagagacagcagugggaggacgaccagagacaggccgacagagacugguacaugauggacgagggcuacgacgaguuccacaacccccuggccuacagcagcgaggacuacgugagaagaagagagcagcaccugcacaagcagaagcagaagagaaucagcgcccagagaagacagaucaacgaggacaacgagagaugggagaccaacagaaugcugaccagcggcguggugcacagacuggagguggacgaggacuucgaggaggacaacgccgccaaggugcaccugauggugcacaaccuggugccccccuuccuggacggcagaaucguguucaccaagcagcccgagcccgugauccccgugaaggacgccaccagcgaccuggccaucaucgccagaaagggcagccagaccgugagaaagcacagagagcagaaggagagaaagaaggcccagcacaagcacugggagcuggccggcaccaagcugggcgacaucaugggcgugaagaaggaggaggagcccgacaaggccgugaccgaggacggcaagguggacuacagaaccgagcagaaguucgccgaccacaugaagagaaagagcgaggccagcagcgaguucgccaagaagaagagcauccuggagcagagacaguaccugcccaucuucgccgugcagcaggagcugcugaccaucaucagagacaacagcaucgugaucguggugggcgagaccggcagcggcaagaccacccagcugacccaguaccugcacgaggacggcuacaccgacuacggcaugaucggcugcacccagcccagaagaguggccgccaugagcguggccaagagagugagcgaggagaugggcggcaaccugggcgaggaggugggcuacgccaucagauucgaggacugcaccagcgagaacacccugaucaaguacaugaccgacggcauccugcugagagagagccugagagaggccgaccuggaccacuacagcgccaucaucauggacgaggcccacgagagaagccugaacaccgacgugcuguucggccugcugagagaggugguggccagaagaagcgaccugaagcugaucgugaccagcgccaccauggacgccgagaaguucgccgccuucuucggcaacgugcccaucuuccacauccccggcagaaccuuccccguggacauccuguucagcaagaccccccaggaggacuacguggaggccgccgugaagcagagccugcaggugcaccugagcggcgcccccggcgacauccugaucuucaugcccggccaggaggacaucgaggugaccagcgaccagaucguggagcaccuggaggagcuggagaacgcccccgcccuggccgugcugcccaucuacagccagcugcccagcgaccugcaggccaagaucuuccagaaggcccccgacggcgugagaaagugcaucguggccaccaacaucgccgagaccagccugaccguggacggcaucauguucgugaucgacagcggcuacugcaagcugaagguguucaaccccagaaucggcauggacgcccugcagaucuaccccaucagccaggccaacgccaaccagagaagcggcagagccggcagaaccggccccggccagugcuucagacuguacacccagagcgccuacaagaacgagcugcugaccaccaccgugcccgagauccagagaaccaaccuggccaacguggugcugcugcugaagagccugggcgugcaggaccugcugcaguuccacuucauggaccccccccccgaggacaacaugcugaacagcauguaccagcuguggauccugggcgcccuggacaacaccggcggccugaccagcaccggcagacugaugguggaguucccccuggaccccgcccugagcaagaugcugaucgugagcugcgacaugggcugcagcagcgagauccugcugaucgugagcaugcugagcgugcccgccaucuucuacagacccaagggcagagaggaggagagcgaccagaucagagagaaguucgccgugcccgagagcgaccaccugaccuaccugaacguguaccugcaguggaagaacaacaacuacagcaccaucuggugcaacgaccacuucauccacgccaaggccaugagaaaggugagagaggugagagcccagcugaaggacaucauggugcagcagagaaugagccuggccagcugcggcaccgacugggacaucgugagaaagugcaucugcgccgccuacuuccaccaggccgccaagcugaagggcaucggcgaguacgugaacaucagaaccggcaugcccugccaccugcaccccaccagcagccuguucggcaugggcuacacccccgacuacaucguguaccacgagcuggugaugaccaccaaggaguacaugcagugcgugaccgccguggacggcgaguggcuggccgagcugggccccauguucuacagcgugaagcaggccggcaagagcagacaggagaacagaagaagagccaaggaggaggccagcgccauggaggaggagauggcccuggccgaggagcagcugagagccagaagacaggagcaggagaagagaagcccccugggcagcgugagaagcaccaagaucuacacccccggcagaaaggagcagggcgagcccaugacccccagaagaacccccgccagauucggccuguaa

SEQ ID NO: 16119 - RNA, 2109 nt, Artificial Sequence
  DHX40__Homo_sapiens__NP_001159773
augagcagauuccccgccguggccggcagagcccccagaagacaggaggagggcgagagaagcagagaccugcaggaggagagacugagcgccgugugcaucgccgacagagaggagaagggcugcaccagccaggagggcggcaccacccccaccuuccccauccagaagcagagaaagaagaucauccaggccgagaccgccaucaaguacaugaccgacggcugccugcugaagcacauccugggcgaccccaaccugaccaaguucagcgugaucauccuggacgaggcccacgagagaacccugaccaccgacauccuguucggccugcugaagaagcuguuccaggagaagagccccaacagaaaggagcaccugaaggugguggugaugagcgccaccauggagcuggccaagcugagcgccuucuucggcaacugccccaucuucgacauccccggcagacuguaccccgugagagagaaguucugcaaccugaucggccccagagacagagagaacaccgccuacauccaggccaucgugaaggugaccauggacauccaccugaacgagauggccggcgacauccugguguuccugaccggccaguucgagaucgagaagagcugcgagcugcuguuccagauggccgagagcguggacuacgacuacgacgugcaggacaccacccuggacggccugcugauccugcccugcuacggcagcaugaccaccgaccagcagagaagaaucuuccugccccccccccccggcaucagaaagugcgugaucagcaccaacaucagcgccaccagccugaccaucgacggcaucagauacgugguggacggcggcuucgugaagcagcugaaccacaaccccagacugggccuggacauccuggagguggugcccaucagcaagagcgaggcccugcagagaagcggcagagccggcagaaccagcagcggcaagugcuucagaaucuacagcaaggacuucuggaaccagugcaugcccgaccacgugauccccgagaucaagagaaccagccugaccagcguggugcugacccugaagugccuggccauccacgacgugaucagauuccccuaccuggacccccccaacgagagacugauccuggaggcccugaagcagcuguaccagugcgacgccaucgacagaagcggccacgugaccagacugggccugagcaugguggaguucccccugcccccccaccugaccugcgccgugaucaaggccgccagccuggacugcgaggaccugcugcugcccaucgccgccaugcugagcguggagaacguguucaucagacccguggaccccgaguaccagaaggaggccgagcagagacacagagagcuggccgccaaggccggcggcuucaacgacuucgccacccuggccgugaucuucgagcagugcaagagcagcggcgcccccgccagcuggugccagaagcacuggauccacuggagaugccuguucagcgccuucagaguggaggcccagcugagagagcugaucagaaagcugaagcagcagagcgacuuccccaaggagaccuucgagggccccaagcacgaggugcugagaagaugccugugcgccggcuacuucaagaacguggccagaagaagcgugggcagaaccuucugcaccauggacggcagaggcagccccgugcacauccaccccagcagcgcccugcacgagcaggagaccaagcuggaguggaucaucuuccacgaggugcuggugaccaccaagguguacgccagaaucgugugccccaucagauacgagugggugagagaccugcugcccaagcugcacgaguucaacgcccacgaccugagcagcguggccagaagagaggugagagaggacgccagaagaagauggaccaacaaggagaacgugaagcagcugaaggacggcaucagcaaggacgugcugaagaagaugcagagaagaaacgacgacaagagcaucagcgacgccagagccagauuccuggagagaaagcagcagagaacccaggaccacagcgacaccagaaaggagaccggcuaa

SEQ ID NO: 16120 - RNA, 2037 nt, Artificial Sequence
  DHX58__Homo_sapiens__NP_077024
auggagcugagaagcuaccagugggaggugaucaugcccgcccuggagggcaagaacaucaucaucuggcugcccaccggcgccggcaagaccagagccgccgccuacguggccaagagacaccuggagaccguggacggcgccaaggugguggugcuggugaacagagugcaccuggugacccagcacggcgaggaguucagaagaaugcuggacggcagauggaccgugaccacccugagcggcgacaugggccccagagccggcuucggccaccuggccagaugccacgaccugcugaucugcaccgccgagcugcugcagauggcccugaccagccccgaggaggaggagcacguggagcugaccguguucagccugaucgugguggacgagugccaccacacccacaaggacaccguguacaacgugaucaugagccaguaccuggagcugaagcugcagagagcccagccccugccccaggugcugggccugaccgccagccccggcaccggcggcgccagcaagcuggacggcgccaucaaccacgugcugcagcugugcgccaaccuggacaccuggugcaucaugagcccccagaacugcugcccccagcugcaggagcacagccagcagcccugcaagcaguacaaccugugccacagaagaagccaggaccccuucggcgaccugcugaagaagcugauggaccagauccacgaccaccuggagaugcccgagcugagcagaaaguucggcacccagauguacgagcagcagguggugaagcugagcgaggccgccgcccuggccggccugcaggagcagagaguguacgcccugcaccugagaagauacaacgacgcccugcugauccacgacaccgugagagccguggacgcccuggccgcccugcaggacuucuaccacagagagcacgugaccaagacccagauccugugcgccgagagaagacugcuggcccuguucgacgacagaaagaacgagcuggcccaccuggccacccacggccccgagaaccccaagcuggagaugcuggagaagauccugcagagacaguucagcagcagcaacagccccagaggcaucaucuucaccagaaccagacagagcgcccacagccugcugcuguggcugcagcagcagcagggccugcagaccguggacaucagagcccagcugcugaucggcgccggcaacagcagccagagcacccacaugacccagagagaccagcaggaggugauccagaaguuccaggacggcacccugaaccugcugguggccaccagcguggccgaggagggccuggacaucccccacugcaacgugguggugagauacggccugcugaccaacgagaucagcauggugcaggccagaggcagagccagagccgaccagagcguguacgccuucguggccaccgagggcagcagagagcugaagagagagcugaucaacgaggcccuggagacccugauggagcaggccguggccgccgugcagaagauggaccaggccgaguaccaggccaagaucagagaccugcagcaggccgcccugaccaagagagccgcccaggccgcccagagagagaaccagagacagcaguuccccguggagcacgugcagcugcugugcaucaacugcaugguggccgugggccacggcagcgaccugagaaagguggagggcacccaccacgugaacgugaaccccaacuucagcaacuacuacaacgugagcagagaccccguggugaucaacaagguguucaaggacuggaagcccggcggcgugaucagcugcagaaacugcggcgagguguggggccugcagaugaucuacaagagcgugaagcugcccgugcugaaggugagaagcaugcugcuggagaccccccagggcagaauccaggccaagaaguggagcagagugcccuucagcgugcccgacuucgacuuccugcagcacugcgccgagaaccugagcgaccugagccuggacuaa

SEQ ID NO: 16121 - RNA, 3546 nt, Artificial Sequence
  DHX8__Homo_sapiens__NP_001289552
auggccguggccguggccauggccggcgcccugaucggcagcgagcccggccccgccgaggagcuggccaagcuggaguaccugagccuggugagcaaggugugcaccgagcuggacaaccaccugggcaucaacgacaaggaccuggccgaguucgugaucagccuggccgagaagaacaccaccuucgacaccuucaaggccagccuggugaagaacggcgccgaguucaccgacagccugaucagcaaccugcugagacugauccagaccaugagaccccccgccaagcccagcaccagcaaggaccccguggugaagcccaagaccgagaaggagaagcugaaggagcuguuccccgugcugugccagcccgacaaccccagcgugagaaccaugcuggacgaggacgacgugaagguggccguggacgugcugaaggagcuggaggcccugaugcccagcgccgccggccaggagaagcagagagacgccgagcacagagacagaaccaagaagaagaagagaagcagaagcagagacagaaacagagacagagacagagacagagagagaaacagagacagagaccacaagagaagacacagaagcagaagcagaagcagaagcagaaccagagagagaaacaaggugaagagcagauacagaagcagaagcagaagccagagcccccccaaggacagaaaggacagagacaaguacggcgagagaaaccuggacagauggagagacaagcacguggacagacccccccccgaggagcccaccaucggcgacaucuacaacggcaaggugaccagcaucaugcaguucggcugcuucgugcagcuggagggccugagaaagagaugggagggccuggugcacaucagcgagcugagaagagagggcagaguggccaacguggccgacguggugagcaagggccagagagugaaggugaaggugcugagcuucaccggcaccaagaccagccugagcaugaaggacguggaccaggagaccggcgaggaccugaaccccaacagaagaagaaaccuggugggcgagaccaacgaggagaccagcaugagaaaccccgacagacccacccaccugagccuggugagcgcccccgagguggaggacgacagccuggagagaaagagacugaccagaaucagcgaccccgagaagugggagaucaagcagaugaucgccgccaacgugcugagcaaggaggaguuccccgacuucgacgaggagaccggcauccugcccaagguggacgacgaggaggacgaggaccuggagaucgagcugguggaggaggagccccccuuccugagaggccacaccaagcagagcauggacaugagccccaucaagaucgugaagaaccccgacggcagccugagccaggccgccaugaugcagagcgcccuggccaaggagagaagagagcugaagcaggcccagagagaggccgagauggacagcauccccaugggccugaacaagcacuggguggacccccugcccgacgccgagggcagacagaucgccgccaacaugagaggcaucggcaugaugcccaacgacauccccgaguggaagaagcacgccuucggcggcaacaaggccagcuacggcaagaagacccagaugagcauccuggagcagagagagagccugcccaucuacaagcugaaggagcagcuggugcaggccgugcacgacaaccagauccugaucgugaucggcgagaccggcagcggcaagaccacccagaucacccaguaccuggccgaggccggcuacaccagcagaggcaagaucggcugcacccagcccagaagaguggccgccaugagcguggccaagagagugagcgaggaguucggcugcugccugggccaggaggugggcuacaccaucagauucgaggacugcaccagccccgagaccgugaucaaguacaugaccgacggcaugcugcugagagagugccugaucgaccccgaccugacccaguacgccaucaucaugcuggacgaggcccacgagagaaccauccacaccgacgugcuguucggccugcugaagaagaccgugcagaagagacaggacaugaagcugaucgugaccagcgccacccuggacgccgugaaguucagccaguacuucuacgaggcccccaucuucaccauccccggcagaaccuaccccguggagauccuguacaccaaggagcccgagaccgacuaccuggacgccagccugaucaccgugaugcagauccaccugaccgagccccccggcgacauccugguguuccugaccggccaggaggagaucgacaccgccugcgagauccuguacgagagaaugaagagccugggccccgacgugcccgagcugaucauccugcccguguacagcgcccugcccagcgagaugcagaccagaaucuucgaccccgccccccccggcagcagaaagguggugaucgccaccaacaucgccgagaccagccugaccaucgacggcaucuacuacgugguggaccccggcuucgugaagcagaagguguacaacagcaagaccggcaucgaccagcugguggugacccccaucagccaggcccaggccaagcagagagccggcagagccggcagaaccggccccggcaagugcuacagacuguacaccgagagagccuacagagacgagaugcugaccaccaacgugcccgagauccagagaaccaaccuggccagcaccgugcugagccugaaggccaugggcaucaacgaccugcugagcuucgacuucauggacgccccccccauggagacccugaucaccgccauggagcagcuguacacccugggcgcccuggacgacgagggccugcugaccagacugggcagaagaauggccgaguucccccuggagcccaugcugugcaagaugcugaucaugagcgugcaccugggcugcagcgaggagaugcugaccaucgugagcaugcugagcgugcagaacguguucuacagacccaaggacaagcaggcccuggccgaccagaagaaggccaaguuccaccagaccgagggcgaccaccugacccugcuggccguguacaacagcuggaagaacaacaaguucagcaaccccuggugcuacgagaacuucauccaggccagaagccugagaagagcccaggacaucagaaagcagaugcugggcaucauggacagacacaagcuggacguggugagcugcggcaagagcaccgugagagugcagaaggccaucugcagcggcuucuucagaaacgccgccaagaaggacccccaggagggcuacagaacccugaucgaccagcaggugguguacauccaccccagcagcgcccuguucaacagacagcccgagugccccaagcacuuccugcccgugguggccguggccgugagccuggagcagugccugagcaaguucgaggaccugaacaaggagcugggccuggugaccugcuaa

SEQ ID NO: 16122 - RNA, 3813 nt, Artificial Sequence
  DHX9__Homo_sapiens__NP_001348
augggcgacgugaagaacuuccuguacgccuggugcggcaagagaaagaugacccccagcuacgagaucagagccgugggcaacaagaacagacagaaguucaugugcgaggugcagguggagggcuacaacuacaccggcaugggcaacagcaccaacaagaaggacgcccagagcaacgccgccagagacuucgugaacuaccuggugagaaucaacgagaucaagagcgaggaggugcccgccuucggcguggccagcccccccccccugaccgacacccccgacaccaccgccaacgccgagggcgaccugcccaccaccaugggcggcccccugcccccccaccuggcccugaaggccgagaacaacagcgaggugggcgccagcggcuacggcgugcccggccccaccugggacagaggcgccaaccugaaggacuacuacagcagaaaggaggagcaggaggugcaggccacccuggagagcgaggagguggaccugaacgccggccugcacggcaacuggacccuggagaacgccaaggccagacugaaccaguacuuccagaaggagaagauccagggcgaguacaaguacacccaggugggccccgaccacaacagaagcuucaucgccgagaugaccaucuacaucaagcagcugggcagaagaaucuucgccagagagcacggcagcaacaagaagcuggccgcccagagcugcgcccugagccuggugagacagcuguaccaccugggcgugguggaggccuacagcggccugaccaagaagaaggagggcgagaccguggagcccuacaaggugaaccugagccaggaccuggagcaccagcugcagaacaucauccaggagcugaaccuggagauccugcccccccccgaggaccccagcgugcccguggcccugaacaucggcaagcuggcccaguucgagcccagccagagacagaaccaggugggcguggugcccuggagccccccccagagcaacuggaaccccuggaccagcagcaacaucgacgagggcccccuggccuucgccacccccgagcagaucagcauggaccugaagaacgagcugauguaccagcuggagcaggaccacgaccugcaggccauccugcaggagagagagcugcugcccgugaagaaguucgagagcgagauccuggaggccaucagccagaacagcguggugaucaucagaggcgccaccggcugcggcaagaccacccaggugccccaguucauccuggacgacuucauccagaacgacagagccgccgagugcaacaucguggugacccagcccagaagaaucagcgccgugagcguggccgagagaguggccuucgagagaggcgaggagcccggcaagagcugcggcuacagcgugagauucgagagcauccugcccagaccccacgccagcaucauguucugcaccgugggcgugcugcugagaaagcuggaggccggcaucagaggcaucagccacgugaucguggacgagauccacgagagagacaucaacaccgacuuccugcugguggugcugagagacguggugcaggccuaccccgaggugagaaucgugcugaugagcgccaccaucgacaccagcauguucugcgaguacuucuucaacugccccaucaucgagguguacggcagaaccuaccccgugcaggaguacuuccuggaggacugcauccagaugacccacuucgugcccccccccaaggacaagaagaagaaggacaaggacgacgacggcggcgaggacgacgacgccaacugcaaccugaucugcggcgacgaguacggccccgagaccagacugagcaugagccagcugaacgagaaggagacccccuucgagcugaucgaggcccugcugaaguacaucgagacccugaacgugcccggcgccgugcugguguuccugcccggcuggaaccugaucuacaccaugcagaagcaccuggagaugaacccccacuucggcagccacagauaccagauccugccccugcacagccagauccccagagaggagcagagaaagguguucgaccccgugcccgugggcgugaccaaggugauccugagcaccaacaucgccgagaccagcaucaccaucaacgacgugguguacgugaucgacagcugcaagcagaaggugaagcuguucaccgcccacaacaacaugaccaacuacgccaccgugugggccagcaagaccaaccuggagcagagaaagggcagagccggcagagugagacccggcuucugcuuccaccugugcagcagagccagauucgagagacuggagacccacaugacccccgagauguucagaaccccccugcacgagaucgcccugagcaucaagcugcugagacugggcggcaucggccaguuccuggccaaggccaucgagccccccccccuggacgccgugaucgaggccgagcacacccugagagagcuggacgcccuggacgccaacgacgagcugaccccccugggcagaauccuggccaagcugcccaucgagcccagauucggcaagaugaugaucaugggcugcaucuucuacgugggcgacgccaucugcaccaucgccgccgccaccugcuuccccgagcccuucaucaacgagggcaagagacugggcuacauccacagaaacuucgccggcaacagauucagcgaccacguggcccugcugagcguguuccaggccugggacgacgccagaaugggcggcgaggaggccgagaucagauucugcgagcacaagagacugaacauggccacccugagaaugaccugggaggccaaggugcagcugaaggagauccugaucaacagcggcuuccccgaggacugccugcugacccagguguucaccaacaccggccccgacaacaaccuggacguggugaucagccugcuggccuucggcguguaccccaacgugugcuaccacaaggagaagagaaagauccugaccaccgagggcagaaacgcccugauccacaagagcagcgugaacugccccuucagcagccaggacaugaaguaccccagccccuucuucguguucggcgagaagaucagaaccagagccaucagcgccaagggcaugacccuggugaccccccugcagcugcugcuguucgccagcaagaaggugcagagcgacggccagaucgugcugguggacgacuggaucaagcugcagaucagccacgaggccgccgccugcaucaccggccugagagccgccauggaggcccuggugguggaggugaccaagcagcccgccaucaucagccagcuggaccccgugaacgagagaaugcugaacaugaucagacagaucagcagacccagcgccgccggcaucaaccugaugaucggcagcaccagauacggcgacggccccagaccccccaagauggccagauacgacaacggcagcggcuacagaagaggcggcagcagcuacagcggcggcggcuacggcggcggcuacagcagcggcggcuacggcagcggcggcuacggcggcagcgccaacagcuucagagccggcuacggcgccggcgugggcggcggcuacagaggcgugagcagaggcggcuucagaggcaacagcggcggcgacuacagaggccccagcggcggcuacagaggcagcggcggcuuccagagaggcggcggcagaggcgccuacggcaccggcuacuucggccagggcagaggcggcggcggcuacuaa

SEQ ID NO: 16123 - RNA, 561 nt, Artificial Sequence
  DIABLO__Homo_sapiens__NP_001265233
augaagagcgacuucuacuuccagaagagcgagccccacagccugagcagcgaggcccugaugagaagagccgugagccuggugaccgacagcaccagcaccuuccugagccagaccaccuacgcccugaucgaggccaucaccgaguacaccaaggccguguacacccugaccagccuguacagacaguacaccagccugcugggcaagaugaacagcgaggaggaggacgagguguggcaggugaucaucggcgccagagccgagaugaccagcaagcaccaggaguaccugaagcuggagaccaccuggaugaccgccgugggccugagcgagauggccgccgaggccgccuaccagaccggcgccgaccaggccagcaucaccgccagaaaccacauccagcuggugaagcugcagguggaggaggugcaccagcugagcagaaaggccgagaccaagcuggccgaggcccagaucgaggagcugagacagaagacccaggaggagggcgaggagagagccgagagcgagcaggaggccuaccugagagaggacuaa

SEQ ID NO: 16124 - RNA, 3792 nt, Artificial Sequence
  DIAPH1__Homo_sapiens__NP_001073280
auggagccccccggcggcagccugggccccggcagaggcaccagagacaagaagaagggcagaagccccgacgagcugcccagcgccggcggcgacggcggcaagagcaagaaguuccuggagagauucaccagcaugagaaucaagaaggagaaggagaagcccaacagcgcccacagaaacagcagcgccagcuacggcgacgaccccaccgcccagagccugcaggacgugagcgacgagcaggugcuggugcuguucgagcagaugcugcuggacaugaaccugaacgaggagaagcagcagccccugagagagaaggacaucaucaucaagagagagauggugagccaguaccuguacaccagcaaggccggcaugagccagaaggagagcagcaagagcgccaugauguacauccaggagcugagaagcggccugagagacaugccccugcugagcugccuggagagccugagagugagccugaacaacaaccccgugagcugggugcagaccuucggcgccgagggccuggccagccugcuggacauccugaagagacugcacgacgagaaggaggagaccgccggcagcuacgacagcagaaacaagcacgagaucaucagaugccugaaggccuucaugaacaacaaguucggcaucaagaccaugcuggagaccgaggagggcauccugcugcuggugagagccauggaccccgccgugcccaacaugaugaucgacgccgccaagcugcugagcgcccugugcauccugccccagcccgaggacaugaacgagagagugcuggaggccaugaccgagagagccgagauggacgagguggagagauuccagccccugcuggacggccugaagagcggcaccaccaucgcccugaaggugggcugccugcagcugaucaacgcccugaucacccccgccgaggagcuggacuucagagugcacaucagaagcgagcugaugagacugggccugcaccaggugcugcaggaccugagagagaucgagaacgaggacaugagagugcagcugaacguguucgacgagcagggcgaggaggacagcuacgaccugaagggcagacuggacgacaucagaauggagauggacgacuucaacgagguguuccagauccugcugaacaccgugaaggacagcaaggccgagccccacuuccugagcauccugcagcaccugcugcuggugagaaacgacuacgaggccagaccccaguacuacaagcugaucgaggagugcaucagccagaucgugcugcacaagaacggcgccgaccccgacuucaagugcagacaccugcagaucgagaucgagggccugaucgaccagaugaucgacaagaccaagguggagaagagcgaggccaaggccgccgagcuggagaagaagcuggacagcgagcugaccgccagacacgagcugcagguggagaugaagaagauggagagcgacuucgagcagaagcugcaggaccugcagggcgagaaggacgcccugcacagcgagaagcagcagaucgccaccgagaagcaggaccuggaggccgaggugagccagcugaccggcgagguggccaagcugaccaaggagcuggaggacgccaagaaggagauggccagccugagcgccgccgccaucaccgugccccccagcgugcccagcagagcccccgugccccccgcccccccccugcccggcgacagcggcaccaucaucccccccccccccgcccccggcgacagcaccaccccccccccccccccccccccccccccccccccccccccccugcccggcggcgugugcaucagcagcccccccagccugcccggcggcaccgccaucagccccccccccccccugagcggcgacgccaccaucccccccccccccccccugcccgagggcgugggcauccccagccccagcagccugcccggcggcaccgccaucccccccccccccccccugcccggcagcgccagaauccccccccccccccccccccugcccggcagcgccggcauccccccccccccccccccccugcccggcgaggccggcaugcccccccccccccccccccugcccggcggccccggcauccccccccccccccccuuccccggcggccccggcauccccccccccccccccggcaugggcaugcccccccccccccccuucggcuucggcgugcccgccgcccccgugcugcccuucggccugacccccaagaagcuguacaagcccgaggugcagcugagaagacccaacuggagcaagcugguggccgaggaccugagccaggacugcuucuggaccaaggugaaggaggacagauucgagaacaacgagcuguucgccaagcugacccugaccuucagcgcccagaccaagaccagcaaggccaagaaggaccaggagggcggcgaggagaagaagagcgugcagaagaagaaggugaaggagcugaaggugcuggacagcaagaccgcccagaaccugagcaucuuccugggcagcuucagaaugcccuaccaggagaucaagaacgugauccuggaggugaacgaggccgugcugaccgagagcaugauccagaaccugaucaagcagaugcccgagcccgagcagcugaagaugcugagcgagcugaaggacgaguacgacgaccuggccgagagcgagcaguucggcguggugaugggcaccgugcccagacugagacccagacugaacgccauccuguucaagcugcaguucagcgagcagguggagaacaucaagcccgagaucgugagcgugaccgccgccugcgaggagcugagaaagagcgagagcuucagcaaccugcuggagaucacccugcuggugggcaacuacaugaacgccggcagcagaaacgccggcgccuucggcuucaacaucagcuuccugugcaagcugagagacaccaagagcaccgaccagaagaugacccugcugcacuuccuggccgagcugugcgagaacgacuaccccgacgugcugaaguuccccgacgagcuggcccacguggagaaggccagcagagugagcgccgagaaccugcagaagaaccuggaccagaugaagaagcagaucagcgacguggagagagacgugcagaacuuccccgccgccaccgacgagaaggacaaguucguggagaagaugaccagcuucgugaaggacgcccaggagcaguacaacaagcugagaaugaugcacagcaacauggagacccuguacaaggagcugggcgaguacuuccuguucgaccccaagaagcugagcguggaggaguucuucauggaccugcacaacuucagaaacauguuccugcaggccgugaaggagaaccagaagagaagagagaccgaggagaagaugagaagagccaagcuggccaaggagaaggccgagaaggagagacuggagaagcagcagaagagagagcagcugaucgacaugaacgccgagggcgacgagaccggcgugauggacagccugcuggaggcccugcagagcggcgccgccuucagaagaaagagaggccccagacaggccaacagaaaggccggcugcgccgugaccagccugcuggccagcgagcugaccaaggacgacgccauggccgccgugcccgccaaggugagcaagaacagcgagaccuuccccaccauccuggaggaggccaaggagcuggugggcagagccagcuaa

SEQ ID NO: 16125 - RNA, 3306 nt, Artificial Sequence
  DIAPH2__Homo_sapiens__NP_006720
auggagcagcccggcgccgccgccagcggcgccggcggcggcagcgaggagcccggcggcggcagaagcaacaagagaagcgccggcaacagagccgccaacgaggaggagaccaagaacaagcccaagcugaacauccagaucaagacccuggccgacgacgugagagacagaaucaccagcuucagaaagagcaccgugaagaaggagaagccccugauccagcaccccaucgacagccagguggccaugagcgaguuccccgccgcccagccccuguacgacgagagaagccugaaccugagcgagaaggaggugcuggaccuguucgagaagaugauggaggacaugaaccugaacgaggagaagaaggccccccugagaaacaaggacuucaccaccaagagagagaugguggugcaguacaucagcgccaccgccaagagcggcggccugaagaacagcaagcacgagugcacccugagcagccaggaguacgugcacgagcugagaagcggcaucagcgacgagaagcugcugaacugccuggagagccugagagugagccugaccagcaaccccgugagcugggugaacaacuucggccacgagggccugggccugcugcuggacgagcuggagaagcugcuggacaagaagcagcaggagaacaucgacaagaagaaccaguacaagcugauccagugccugaaggccuucaugaacaacaaguucggccugcagagaauccugggcgacgagagaagccugcugcugcuggccagagccaucgaccccaagcagcccaacaugaugaccgagaucgugaagauccugagcgccaucugcaucgugggcgaggagaacauccuggacaagcugcugggcgccaucaccaccgccgccgagagaaacaacagagagagauucagccccaucguggagggccuggagaaccaggaggcccugcagcugcagguggccugcaugcaguucaucaacgcccuggugaccagccccuacgagcuggacuucagaauccaccugagaaacgaguuccugagaagcggccugaagaccaugcugcccgaccugaaggagaaggagaacgacgagcuggacauccagcugaagguguucgacgagaacaaggaggacgaccugaccgagcugagccacagacugaacgacaucagagccgagauggacgacaugaacgagguguaccaccugcuguacaacaugcugaaggacaccgccgccgagaacuacuuccugagcauccugcagcacuuccugcugaucagaaacgacuacuacaucagaccccaguacuacaagaucaucgaggagugcgugagccagaucgugcugcacugcagcggcauggaccccgacuucaaguacagacagagacuggacaucgaccugacccaccugaucgacagcugcgugaacaaggccaagguggaggagagcgagcagaaggccgccgaguucagcaagaaguucgacgaggaguucaccgccagacaggaggcccaggccgagcugcagaagagagacgagaagaucaaggagcuggaggccgagauccagcagcugagaacccaggcccaggugcugagcagcagcagcggcauccccggcccccccgccgcccccccccugcccggcgugggcccccccccccccccccccgcccccccccugcccggcggcgccccccugcccccccccccccccccccugcccggcaugaugggcaucccccccccccccccccccccccugcuguucggcggccccccccccccccccccccugggcggcgugccccccccccccggcaucagccugaaccugcccuacggcaugaagcagaagaagauguacaagcccgaggugagcaugaagagaaucaacuggagcaagaucgagcccaccgagcugagcgagaacugcuucuggcugagagugaaggaggacaaguucgagaaccccgaccuguucgccaagcuggcccugaacuucgccacccagaucaaggugcagaagaacgccgaggcccuggaggagaagaagaccggccccaccaagaagaaggugaaggagcugagaauccuggaccccaagaccgcccagaaccugagcaucuuccugggcagcuacagaaugcccuacgaggacaucagaaacgugauccuggaggugaacgaggacaugcugagcgaggcccugauccagaaccuggugaagcaccugcccgagcagaagauccugaacgagcuggccgagcugaagaacgaguacgacgaccugugcgagcccgagcaguucggcguggugaugagcagcgugaagaugcugcagcccagacugagcagcauccuguucaagcugaccuucgaggagcacaucaacaacaucaagcccagcaucaucgccgugacccuggccugcgaggagcugaagaagagcgagagcuucaacagacugcuggagcuggugcugcuggugggcaacuacaugaacagcggcagcagaaacgcccagagccugggcuucaagaucaacuuccugugcaagaucagagacaccaagagcgccgaccagaagaccacccugcugcacuucaucgccgacaucugcgaggagaaguacagagacauccugaaguuccccgaggagcuggagcacguggagagcgccagcaaggugagcgcccagauccugaagagcaaccuggccagcauggagcagcagaucgugcaccuggagagagacaucaagaaguucccccaggccgagaaccagcacgacaaguucguggagaagaugaccagcuucaccaagaccgccagagagcaguacgagaagcugagcaccaugcacaacaacaugaugaagcuguacgagaaccugggcgaguacuucaucuucgacagcaagaccgugagcaucgaggaguucuucggcgaccugaacaacuucagaacccuguuccuggaggccgugagagagaacaacaagagaagagagauggaggagaagaccagaagagccaagcuggccaaggagaaggccgagcaggagaagcuggagagacagaagaagaagaagcagcugaucgacaucaacaaggagggcgacgagaccggcgugauggacaaccugcuggaggcccugcagagcggcgccgccuucagagacagaagaaagagaauccccagaaaccccgacaacagaagagugccccuggagagaagcagaagcagacacaacggcgccaucagcagcaaguaa

SEQ ID NO: 16126 - RNA, 3582 nt, Artificial Sequence
  DIAPH3__Homo_sapiens__NP_001035982
auggagagacaccagcccagacugcaccaccccgcccagggcagcgccgccggcacccccuaccccagcagcgccagccugagaggcugcagagagagcaagaugcccagaagaaagggcccccagcacccccccccccccagcggccccgaggagcccggcgagaagagacccaaguuccaccugaacaucagaacccugaccgacgacaugcuggacaaguucgccagcaucagaauccccggcagcaagaaggagagacccccccugcccaaccugaagaccgccuucgccagcagcgacugcagcgccgccccccuggagaugauggagaacuuccccaagccccugagcgagaacgagcugcuggagcuguucgagaagaugauggaggacaugaaccugaacgaggacaagaaggccccccugagagagaaggacuucagcaucaagaaggagauggugaugcaguacaucaacaccgccagcaagaccggcagccugaagagaagcagacagaucagcccccaggaguucauccacgagcugaagaugggcagcgccgacgagagacuggugaccugccuggagagccugagagugagccugaccagcaaccccgugagcuggguggagagcuucggccacgagggccugggccugcugcuggacauccuggagaagcugaucagcggcaagauccaggagaagguggugaagaagaaccagcacaaggugauccagugccugaaggcccugaugaacacccaguacggccuggagagaaucaugagcgaggagagaagccugagccugcuggccaaggccguggaccccagacaccccaacaugaugaccgacguggugaagcugcugagcgccgugugcaucgugggcgaggagagcauccuggaggaggugcuggaggcccugaccagcgccggcgaggagaagaagaucgacagauucuucugcaucguggagggccugagacacaacagcgugcagcugcagguggccugcaugcagcugaucaacgcccuggugaccagccccgacgaccuggacuucagacugcacaucagaaacgaguucaugagaugcggccugaaggagauccugcccaaccugaagugcaucaagaacgacggccuggacauccagcugaagguguucgacgagcacaaggaggaggaccuguucgagcugagccacagacuggaggacaucagagccgagcuggacgaggccuacgacguguacaacaugguguggagcaccgugaaggagaccagagccgagggcuacuucaucagcauccugcagcaccugcugcugaucagaaacgacuacuucaucagacagcaguacuucaagcugaucgacgagugcgugagccagaucgugcugcacagagacggcauggaccccgacuucaccuacagaaagagacuggaccuggaccugacccaguucguggacaucugcaucgaccaggccaagcuggaggaguucgaggagaaggccagcgagcuguacaagaaguucgagaaggaguucaccgaccaccaggagacccaggccgagcugcagaagaaggaggccaagaucaacgagcugcaggccgagcugcaggccuucaagagccaguucggcgcccugcccgccgacugcaacaucccccugccccccagcaaggagggcggcaccggccacagcgcccugccccccccccccccccugcccagcggcggcggcgugccccccccccccccccccccccccccccccccccugcccggcaugagaaugcccuucagcggccccgugccccccccccccccccugggcuuccugggcggccagaacagccccccccugcccauccugcccuucggccugaagcccaagaaggaguucaagcccgagaucagcaugagaagacugaacuggcugaagaucagaccccacgagaugaccgagaacugcuucuggaucaaggugaacgagaacaaguacgagaacguggaccugcugugcaagcuggagaacaccuucugcugccagcagaaggagagaagagaggaggaggacaucgaggagaagaagagcaucaagaagaagaucaaggagcugaaguuccuggacagcaagaucgcccagaaccugagcaucuuccugagcagcuucagagugcccuacgaggagaucagaaugaugauccuggagguggacgagaccagacuggccgagagcaugauccagaaccugaucaagcaccugcccgaccaggagcagcugaacagccugagccaguucaagagcgaguacagcaaccugugcgagcccgagcaguucgugguggugaugagcaacgugaagagacugagacccagacugagcgccauccuguucaagcugcaguucgaggagcaggugaacaacaucaagcccgacaucauggccgugagcaccgccugcgaggagaucaagaagagcaagagcuucagcaagcugcuggagcuggugcugcugaugggcaacuacaugaacgccggcagcagaaacgcccagaccuucggcuucaaccugagcagccugugcaagcugaaggacaccaagagcgccgaccagaagaccacccugcugcacuuccugguggagaucugcgaggagaaguaccccgacauccugaacuucguggacgaccuggagccccuggacaaggccagcaaggugagcguggagacccuggagaagaaccugagacagaugggcagacagcugcagcagcuggagaaggagcuggagaccuuccccccccccgaggaccugcacgacaaguucgugaccaagaugagcagauucgugaucagcgccaaggagcaguacgagacccugagcaagcugcacgagaacauggagaagcuguaccagagcaucaucggcuacuacgccaucgacgugaagaaggugagcguggaggacuuccugaccgaccugaacaacuucagaaccaccuucaugcaggccaucaaggagaacaucaagaagagagaggccgaggagaaggagaagagagugagaaucgccaaggagcuggccgagagagagagacuggagagacagcagaagaagaagagacugcuggagaugaagaccgagggcgacgagaccggcgugauggacaaccugcuggaggcccugcagagcggcgccgccuucagagacagaagaaagagaacccccaugcccaaggacgugagacagagccugagccccaugagccagagacccgugcugaaggugugcaaccacgagaaccagaaggugcagcugaccgagggcagcagaagccacuacaacaucaacugcaacagcaccagaacccccguggccaaggagcugaacuacaaccuggacacccacaccagcaccggcagaaucaaggccgccgagaagaaggaggccugcaacguggagagcaacagaaagaaggagaccgagcugcugggcagcuucagcaagaacgagagcgugcccgagguggaggcccugcuggccagacugagagcccuguaa

SEQ ID NO: 16127 - RNA, 5490 nt, Artificial Sequence
  DICER1__Homo_sapiens__NP_001182502
augaagagccccgcccugcagccccugagcauggccggccugcagcugaugacccccgccagcagccccaugggccccuucuucggccugcccuggcagcaggaggccauccacgacaacaucuacacccccagaaaguaccagguggagcugcuggaggccgcccuggaccacaacaccaucgugugccugaacaccggcagcggcaagaccuucaucgccgugcugcugaccaaggagcugagcuaccagaucagaggcgacuucagcagaaacggcaagagaaccguguuccuggugaacagcgccaaccagguggcccagcaggugagcgccgugagaacccacagcgaccugaaggugggcgaguacagcaaccuggaggugaacgccagcuggaccaaggagagauggaaccaggaguucaccaagcaccaggugcugaucaugaccugcuacguggcccugaacgugcugaagaacggcuaccugagccugagcgacaucaaccugcugguguucgacgagugccaccuggccauccuggaccaccccuacagagagaucaugaagcugugcgagaacugccccagcugccccagaauccugggccugaccgccagcauccugaacggcaagugcgaccccgaggagcuggaggagaagauccagaagcuggagaagauccugaagagcaacgccgagaccgccaccgaccugguggugcuggacagauacaccagccagcccugcgagaucgugguggacugcggccccuucaccgacagaagcggccuguacgagagacugcugauggagcuggaggaggcccugaacuucaucaacgacugcaacaucagcgugcacagcaaggagagagacagcacccugaucagcaagcagauccugagcgacugcagagccgugcugguggugcugggccccuggugcgccgacaagguggccggcaugauggugagagagcugcagaaguacaucaagcacgagcaggaggagcugcacagaaaguuccugcuguucaccgacaccuuccugagaaagauccacgcccugugcgaggagcacuucagccccgccagccuggaccugaaguucgugacccccaaggugaucaagcugcuggagauccugagaaaguacaagcccuacgagagacagcaguucgagagcguggagugguacaacaacagaaaccaggacaacuacgugagcuggagcgacagcgaggacgacgacgaggacgaggagaucgaggagaaggagaagcccgagaccaacuuccccagccccuucaccaacauccugugcggcaucaucuucguggagagaagauacaccgccguggugcugaacagacugaucaaggaggccggcaagcaggaccccgagcuggccuacaucagcagcaacuucaucaccggccacggcaucggcaagaaccagcccagaaacaagcagauggaggccgaguucagaaagcaggaggaggugcugagaaaguucagagcccacgagaccaaccugcugaucgccaccagcaucguggaggagggcguggacauccccaagugcaaccugguggugagauucgaccugcccaccgaguacagaagcuacgugcagagcaagggcagagccagagcccccaucagcaacuacaucaugcuggccgacaccgacaagaucaagagcuucgaggaggaccugaagaccuacaaggccaucgagaagauccugagaaacaagugcagcaagagcguggacaccggcgagaccgacaucgaccccgugauggacgacgacgacguguucccccccuacgugcugagacccgacgacggcggccccagagugaccaucaacaccgccaucggccacaucaacagauacugcgccagacugcccagcgaccccuucacccaccuggcccccaagugcagaaccagagagcugcccgacggcaccuucuacagcacccuguaccugcccaucaacagcccccugagagccagcaucgugggcccccccaugagcugcgugagacuggccgagagagugguggcccugaucugcugcgagaagcugcacaagaucggcgagcuggacgaccaccugaugcccgugggcaaggagaccgugaaguacgaggaggagcuggaccugcacgacgaggaggagaccagcgugcccggcagacccggcagcaccaagagaagacagugcuaccccaaggccauccccgagugccugagagacagcuaccccagacccgaccagcccugcuaccuguacgugaucggcauggugcugaccaccccccugcccgacgagcugaacuucagaagaagaaagcuguacccccccgaggacaccaccagaugcuucggcauccugaccgccaagcccaucccccagaucccccacuuccccguguacaccagaagcggcgaggugaccaucagcaucgagcugaagaagagcggcuucaugcugagccugcagaugcuggagcugaucaccagacugcaccaguacaucuucagccacauccugagacuggagaagcccgcccuggaguucaagcccaccgacgccgacagcgccuacugcgugcugccccugaacguggugaacgacagcagcacccuggacaucgacuucaaguucauggaggacaucgagaagagcgaggccagaaucggcauccccagcaccaaguacaccaaggagacccccuucguguucaagcuggaggacuaccaggacgccgugaucauccccagauacagaaacuucgaccagccccacagauucuacguggccgacguguacaccgaccugaccccccugagcaaguuccccagccccgaguacgagaccuucgccgaguacuacaagaccaaguacaaccuggaccugaccaaccugaaccagccccugcuggacguggaccacaccagcagcagacugaaccugcugacccccagacaccugaaccagaagggcaaggcccugccccugagcagcgccgagaagagaaaggccaagugggagagccugcagaacaagcagauccuggugcccgagcugugcgccauccaccccauccccgccagccuguggagaaaggccgugugccugcccagcauccuguacagacugcacugccugcugaccgccgaggagcugagagcccagaccgccagcgacgccggcgugggcgugagaagccugcccgccgacuucagauaccccaaccuggacuucggcuggaagaagagcaucgacagcaagagcuucaucagcaucagcaacagcagcagcgccgagaacgacaacuacugcaagcacagcaccaucgugcccgagaacgccgcccaccagggcgccaacagaaccagcagccuggagaaccacgaccagaugagcgugaacugcagaacccugcugagcgagagccccggcaagcugcacguggaggugagcgccgaccugaccgccaucaacggccugagcuacaaccagaaccuggccaacggcagcuacgaccuggccaacagagacuucugccagggcaaccagcugaacuacuacaagcaggagauccccgugcagcccaccaccagcuacagcauccagaaccuguacagcuacgagaaccagccccagcccagcgacgagugcacccugcugagcaacaaguaccuggacggcaacgccaacaagagcaccagcgacggcagccccgugauggccgugaugcccggcaccaccgacaccauccaggugcugaagggcagaauggacagcgagcagagccccagcaucggcuacagcagcagaacccugggccccaaccccggccugauccugcaggcccugacccugagcaacgccagcgacggcuucaaccuggagagacuggagaugcugggcgacagcuuccugaagcacgccaucaccaccuaccuguucugcaccuaccccgacgcccacgagggcagacugagcuacaugagaagcaagaaggugagcaacugcaaccuguacagacugggcaagaagaagggccugcccagcagaaugguggugagcaucuucgacccccccgugaacuggcugccccccggcuacguggugaaccaggacaagagcaacaccgacaagugggagaaggacgagaugaccaaggacugcaugcuggccaacggcaagcuggacgaggacuacgaggaggaggacgaggaggaggagagccugauguggagagcccccaaggaggaggccgacuacgaggacgacuuccuggaguacgaccaggagcacaucagauucaucgacaacaugcugaugggcagcggcgccuucgugaagaagaucagccugagccccuucagcaccaccgacagcgccuacgaguggaagaugcccaagaagagcagccugggcagcaugcccuucagcagcgacuucgaggacuucgacuacagcagcugggacgccaugugcuaccuggaccccagcaaggccguggaggaggacgacuucguggugggcuucuggaaccccagcgaggagaacugcggcguggacaccggcaagcagagcaucagcuacgaccugcacaccgagcagugcaucgccgacaagagcaucgccgacugcguggaggcccugcugggcugcuaccugaccagcugcggcgagagagccgcccagcuguuccugugcagccugggccugaaggugcugcccgugaucaagagaaccgacagagagaaggcccugugccccaccagagagaacuucaacagccagcagaagaaccugagcgugagcugcgccgccgccagcguggccagcagcagaagcagcgugcugaaggacagcgaguacggcugccugaagaucccccccagaugcauguucgaccaccccgacgccgacaagacccugaaccaccugaucagcggcuucgagaacuucgagaagaagaucaacuacagauucaagaacaaggccuaccugcugcaggccuucacccacgccagcuaccacuacaacaccaucaccgacugcuaccagagacuggaguuccugggcgacgccauccuggacuaccugaucaccaagcaccuguacgaggaccccagacagcacagccccggcgugcugaccgaccugagaagcgcccuggugaacaacaccaucuucgccagccuggccgugaaguacgacuaccacaaguacuucaaggccgugagccccgagcuguuccacgugaucgacgacuucgugcaguuccagcuggagaagaacgagaugcagggcauggacagcgagaagagcuuccugcagauguaccccgugccccugugcgagaacugccugaaguggaaccagaagcugcccaaccuggccagacugagagagcugaccaccggcagaagcgagagccuguggaaguaa

SEQ ID NO: 16128 - RNA, 1689 nt, Artificial Sequence
  DIDO1__Homo_sapiens__NP_071388
auggacgacaagggcgaccccagcaacgaggaggcccccaaggccaucaagcccaccagcaaggaguucagaaagaccuggggcuucagaagaaccaccaucgccaagagagagggcgccggcgacgccgaggccgacccccuggagcccccccccccccagcagcagcugggccugagccugagaagaagcggcagacagcccaagagaaccgagagaguggagcaguuccugaccaucgccagaagaagaggcagaagaagcaugcccgugagccuggaggacagcggcgagcccaccagcugccccgccaccgacgccgagaccgccagcgagggcagcguggagagcgccagcgagaccagaagcggcccccagagcgccagcaccgccgugaaggagagacccgccagcagcgagaaggugaagggcggcgacgaccacgacgacaccagcgacagcgacagcgacggccugacccugaaggagcugcagaacagacugagaagaaagagagagcaggagcccaccgagagaccccugaagggcauccagagcagacugagaaagaagagaagagaggagggccccgccgagaccgugggcagcgaggccagcgacaccguggagggcgugcugcccagcaagcaggagcccgagaacgaccagggcguggugagccaggccggcaaggacgacagagagagcaagcuggagggcaaggccgcccaggacaucaaggacgaggagcccggcgaccugggcagacccaagcccgagugcgagggcuacgaccccaacgcccuguacugcaucugcagacagccccacaacaacagauucaugaucugcugcgacagaugcgaggagugguuccacggcgacugcgugggcaucagcgaggccagaggcagacugcuggagagaaacggcgaggacuacaucugccccaacugcaccauccugcaggugcaggacgagacccacagcgagaccgccgaccagcaggaggccaaguggagacccggcgacgccgacggcaccgacugcaccagcaucggcaccaucgagcagaagagcagcgaggaccagggcaucaagggcagaaucgagaaggccgccaaccccagcggcaagaagaagcugaagaucuuccagcccgugaucgaggcccccggcgccagcaagugcaucggccccggcugcugccacguggcccagcccgacagcguguacugcagcaacgacugcauccugaagcacgccgccgccaccaugaaguuccugagcagcggcaaggagcagaagcccaagcccaaggagaagaugaagaugaagcccgagaagcccagccugcccaagugcggcgcccaggccggcaucaagaucagcagcgugcacaagagacccgcccccgagaagaaggagaccaccgugaagaaggccgugguggugcccgccagaagcgaggcccugggcaaggaggccgccugcgagagcagcacccccagcugggccagcgaccacaacuacaacgccgugaagcccgagaagaccgccgcccccagccccagccugcuguacaagugcauguaccaccugggcgugggccugcuggaccccagcagaagcuucuggaucgccauccccugggccugccccggccugggcguggccgcccugugcuaa

SEQ ID NO: 16129 - RNA, 2271 nt, Artificial Sequence
  DIEXF__Homo_sapiens__NP_055203
augggcaagagaggcagcagaagccagagccagcugcugaacacccugaccaagaagcagaagaagcaccugagagacuucggcgaggagcaccccuucuacgacagagugagcagaaaggaggccaagccccagaucugccagcugagcgagagcagcgacagcagcgacagcgagagcgacagcgagagcgagccccagcaggugagcggcuaccacagacugcuggccacccugaagaacgugagcgaggaggaggaggaggacgaggaggaggaggaggaggaggacagcaucguggacgacgccgagaugaacgacgaggacggcggcagcgacgugagcguggaggaggagauggccgccgagagcaccgagagccccgagaacguggcccugagcgccgaccccgagggcaaggaggacggcgaggagccccccggcaccagccagaccagccccgaggaguucaccgacgccaagcacgagagccuguucagccuggagaccaacuuccuggaggaggagagcggcgacaacagcagccugaaggccagccaggaccccuuccugcagcacgugaacaaggagcugaaggagaaggccauccaggccguggccaccaaccccaagaccacccacgagcugaaguggcccauccugggccagcuguucuucagcagcaaguuccagaagcuggagaccuucaagccccccaaggacaucgaccugaagagccugcaccugcagaagccccuggagagcaccuggaccaagaccaacagccaguuccugagcggcccccagaagagcagcagccccuucaccccccugcagaaggagcuguuccugaucaugaacagcuacagagaccuguucuaccccgagagaaccgcccugaagaacggcgaggagaucagacacguguacugccugcacgugaucaaccacauccugaaggccaacgcccaggugcugggcaacaacagcagaagaagaagccagaaguucggcgugggcgacgacgacgacuucagagaccagggccugaccagacccaaggugcugaucguggugcccuucagagaggccgcccugagaguggugcagcuguucaucagccugcuggagggcgacagcaagaagaagaucaucgugagcaacaagaagagauuccagggcgaguacggcagcgaccccgaggagagaccccccaaccugaagagacccgaggacuacgaggccguguucgugggcaacaucgacgaccacuucagaaucggcguggccauccugcagagaagcaucagacuguacgcccccuucuacagcagcgacauccugaucgccagcccccugggccugagaaccaucaucggcggcgagggcgagaagaagagagacuucgacuuccugagcagcaucgagcugcugaucaucgaccaggccgacaucuaccugaugcagaacugggagcacgugcugcaccugaugaaccacaugaaccugcugccccuggacagccacggcguggacuucagcagagugagaauguggagccugaacaacuggagcaaguacuacagacagacccugcuguucggcgcccugcaggacgcccagaucaacagcguguucaacaaguacugcgugaacaugcagggccagguggccgugagaaacgugcccaugaccggcagcaucagccacgugcuggugcagcugccccacguguuccagagaauggaggccgagaaccuggccagcgugaucgacgccagauucaacuucuucgugaacaagauccugccccaguacagagacgccgugaugagccacacccugaucuacauccccagcuacuucgacuucgugagacugagaaacuacuucaagaaggaggagcugaacuucacccacaucugcgaguacacccagaagagcggcgugagcagagccagacacuucuuccugcagggcgagaagcaguuccugcuguucaccgagagauuccacuucuacaagagauacaccaucaagggcaucagaaaccugaucuucuacgagcugcccaccuacccccacuucuacagcgagaucugcaacaugcugagagccaccaacagaggcgaggaggccaccuggaccugcaccgugcuguacagcaaguacgacgcccagagacuggccgccguggugggcguggagagagccgcccagaugcugcagagcaacaagaacgugcaccuguucaucaccggcgagaaguaa

SEQ ID NO: 16130 - RNA, 2397 nt, Artificial Sequence
  DIP2A__Homo_sapiens__NP_001139587
auggccgacagaggcugcccccuggaggccgccccccugcccgccgaggugagagagagccuggccgagcuggagcuggagcugagcgagggcgacaucacccagaagggcuacgagaagaagagagccaagcugcuggccagauacaucccccugauccagggcaucgaccccagccugcaggccgagaacagaauccccggccccagccagaccaccgccgccgcccccaagcagcagaagagcagacccaccgccagcagagacgagagauucagaagcgacgugcacaccgaggccgugcaggccgcccuggccaaguacaaggagagaaagaugcccaugcccagcaagagaagaagcgugcuggugcacagcagcguggagaccuacaccccccccgacaccagcagcgccagcgaggacgagggcagccugagaagacccggcagacugaccagcaccccccugcagagccacagcagcguggagcccuggcuggacagagugauccagggcagcagcaccagcagcagcgccagcagcaccagcagccaccccggcggcagacccaccaccgcccccagcgccgccgccacccccggcgccgccgccaccaccgcccuggccggccuggaggcccacacccacaucggcgugcccgugaacagcagagugagcagcaagauccagcagcugcugaacacccugaagagacccaagagacccccccugaaggaguucuucguggacgacuucgaggagcugcuggaggugcagcagcccgaccccaaccagcccaagcccgagggcagcgagaccagcgugcugagaggcgagccccugaccgccggcgugcccagaccccccagccugcuggccacccugcagagauggggcaccacccagcccaagagccccugccugaccgcccuggacaccaccggcaaggccguguacacccugaccuacggcaagcuguggagcagaagccugaagcuggccuacacccugcugaacaagcugaccagcaagaacgagccccugcugaagcccggcgacagaguggcccugguguuccccaacagcgaccccgugauguucaugguggccuucuacggcugccugcuggccgagcuggugcccgugcccaucgaggugccccugaccagaaaggacgccggcagccagcaggugggcuuccugcugggcagcugcggcguguuccuggcccugaccaccgacgccugccagaagggccugcccaaggcccagaccggcgagguggccgccuucaagggcuggcccccccugagcuggcuggugaucgacggcaagcaccuggccaagccccccaaggacuggcacccccuggcccaggacaccggcaccggcaccgccuacaucgaguacaagaccagcaaggagggcagcaccgugggcgugaccgugagccacgccagccugcuggcccagugcagagcccugacccaggccugcggcuacagcgaggccgagacccugaccaacgugcuggacuucaagagagacgccggccuguggcacggcgugcugaccagcgugaugaacagaaugcacguggugagcgugcccuacgcccugaugaaggccaacccccugagcuggauccagaaggugugcuucuacaaggccagagccgcccuggugaagagcagagacaugcacuggagccugcuggcccagagaggccagagagacgugagccugagcagccugagaaugcugaucguggccgacggcgccaaccccuggagcaucagcagcugcgacgccuuccugaacguguuccagagcagaggccugagacccgaggugaucugccccugcgccagcagccccgaggcccugaccguggccaucagaagaccccccgaccugggcggccccccccccagaaaggccgugcugagcaugaacggccugagcuacggcgugaucagaguggacaccgaggagaagcugagcgugcugaccgugcaggacgugggccaggugaugcccggcgccaacgugugcguggugaagcuggagggcacccccuaccugugcaagaccgacgaggugggcgagaucugcgugagcagcagcgccaccggcaccgccuacuacggccugcugggcaucaccaagaacguguucgaggccgugcccgugaccaccggcggcgcccccaucuucgacagacccuucaccagaaccggccugcugggcuucaucggccccgacaaccugguguucaucgugggcaagcuggacggccugauggugaccggcgugagaagacacaacgccgacgacgugguggccaccgcccuggccguggagcccaugaaguucguguacagaggcagauaa

SEQ ID NO: 16131 - RNA, 4731 nt, Artificial Sequence
  DIP2B__Homo_sapiens__NP_775873
auggccgagagaggccuggagcccagccccgccgccguggccgcccugccccccgaggugagagcccagcuggccgagcuggagcuggagcugagcgagggcgacaucacccagaagggcuacgagaagaagagaagcaagcugcugagccccuacagcccccagacccaggagaccgacagcgccgugcagaaggagcugagaaaccagacccccgcccccagcgccgcccagaccagcgcccccagcaaguaccacagaaccagaagcggcggcgccagagacgagagauacagaagcgacauccacaccgaggccgugcaggccgcccuggccaagcacaaggagcagaagauggcccugcccaugcccaccaagagaagaagcaccuucgugcagagccccgccgacgccugcaccccccccgacaccagcagcgccagcgaggacgagggcagccugagaagacaggccgcccugagcgccgcccugcagcagagccugcagaacgccgagagcuggaucaacagaagcauccagggcagcagcaccagcagcagcgccagcagcacccugagccacggcgaggugaagggcaccagcggcagccuggccgacguguucgccaacaccagaaucgagaacuucagcgccccccccgacgugaccaccaccaccagcagcagcagcagcagcagcagcaucagacccgccaacaucgaccugccccccagcggcaucgugaagggcaugcacaagggcagcaacagaagcagccugauggacaccgccgacggcgugcccgugagcagcagagugagcaccaagauccagcagcugcugaacacccugaagagacccaagagacccccccugaaggaguucuucguggacgacagcgaggagaucguggaggugccccagcccgaccccaaccagcccaagcccgagggcagacagaugacccccgugaagggcgagccccugggcgugaucugcaacuggccccccgcccuggagagcgcccugcagagauggggcaccacccaggccaagugcagcugccugaccgcccuggacaugaccggcaagcccguguacacccugaccuacggcaagcuguggagcagaagccugaagcuggccuacacccugcugaacaagcugggcaccaagaacgagcccgugcugaagcccggcgacagaguggcccugguguaccccaacaacgaccccgugauguucaugguggccuucuacggcugccugcuggccgaggugauccccgugcccaucgaggugccccugaccagaaaggacgccggcggccagcagaucggcuuccugcugggcagcugcggcaucgcccuggcccugaccagcgaggugugccugaagggccugcccaagacccagaacggcgagaucgugcaguucaagggcuggcccagacugaaguggguggugaccgacagcaaguaccugagcaagccccccaaggacuggcagccccacaucagccccgccggcaccgagcccgccuacaucgaguacaagaccagcaaggagggcagcgugaugggcgugaccgugagcagacuggccaugcugagccacugccaggcccugagccaggccugcaacuacagcgagggcgagaccaucgugaacgugcuggacuucaagaaggacgccggccuguggcacggcauguucgccaacgugaugaacaagaugcacaccaucagcgugcccuacagcgugaugaagaccugcccccugagcugggugcagagagugcacgcccacaaggccaagguggcccuggugaagugcagagaccugcacugggccaugauggcccacagagaccagagagacgugagccugagcagccugagaaugcugaucgugaccgacggcgccaaccccuggagcgugagcagcugcgacgccuuccugagccuguuccagagccacggccugaagcccgaggccaucugccccugcgccaccagcgccgaggccaugaccguggccaucagaagacccggcgugcccggcgccccccugcccggcagagccauccugagcaugaacggccugagcuacggcgugaucagagugaacaccgaggacaagaacagcgcccugaccgugcaggacgugggccacgugaugcccggcggcaugaugugcaucgugaagcccgacggccccccccagcugugcaagaccgacgagaucggcgagaucugcgugagcagcagaaccggcggcaugauguacuucggccuggccggcgugaccaagaacaccuucgaggugauccccgugaacagcgccggcagccccgugggcgacgugcccuucaucagaagcggccugcugggcuucgugggccccggcagccugguguucguggugggcaagauggacggccugcugauggugagcggcagaagacacaacgccgacgacaucguggccaccggccuggccguggagagcaucaagaccguguacagaggcagaaucgccguguucagcgugagcguguucuacgacgagagaaucguggugguggccgagcagagacccgacgccagcgaggaggacagcuuccaguggaugagcagagugcugcaggccaucgacagcauccaccaggugggcguguacugccuggcccuggugcccgccaacacccugcccaagaccccccugggcggcauccacaucagccagaccaagcagcuguuccuggagggcagccugcaccccugcaacauccugaugugcccccacaccugcgugaccaaccugcccaagcccagacagaagcagcccggcgugggccccgccagcgugauggugggcaaccugguggccggcaagagaaucgcccaggccgccggcagagaccugggccagaucgaggagaacgaccuggugagaaagcaccaguuccuggccgagauccugcaguggagagcccaggccacccccgaccacgugcuguucaugcugcugaacgccaagggcaccaccgugugcaccgccagcugccugcagcugcacaagagagccgagagaaucgccagcgugcugggcgacaagggccaccugaacgccggcgacaacguggugcugcuguacccccccggcaucgagcugaucgccgccuucuacggcugccuguacgccggcugcauccccgugaccgugagacccccccacgcccagaaccugaccgccacccugcccaccgugagaaugaucguggacgugagcaaggccgccugcauccugaccagccagacccugaugagacugcugagaagcagagaggccgccgccgccguggacgugaagaccuggcccaccaucaucgacaccgacgaccugcccagaaagagacugccccagcuguacaagccccccacccccgagaugcuggccuaccuggacuucagcgugagcaccaccggcaugcugaccggcgugaagaugagccacagcgccgugaacgcccugugcagagccaucaagcugcagugcgagcuguacagcagcagacagaucgccaucugccuggaccccuacugcggccugggcuucgcccuguggugccugugcagcguguacagcggccaccagagcgugcugaucccccccauggagcuggagaacaaccuguuccuguggcugagcaccgugaaccaguacaagaucagagacaccuucugcagcuacagcgugauggagcugugcaccaagggccugggcaaccagguggaggugcugaagaccagaggcaucaaccugagcugcgugagaaccugcguggugguggccgaggagagacccagaguggcccugcagcagagcuucagcaagcuguucaaggacaucggccugagccccagagccgugagcaccaccuucggcagcagagugaacguggccaucugccugcagggcaccagcggccccgaccccaccaccguguacguggaccugaagagccugagacacgacagagugagacugguggagagaggcgccccccagagccugcugcugagcgagagcggcaagauccugcccggcgugaagguggugaucgugaaccccgagaccaagggccccgugggcgacagccaccugggcgagaucugggugaacagcccccacaccgccagcggcuacuacaccaucuacgacagcgagacccugcaggccgaccacuucaacaccagacugagcuucggcgacgccgcccagacccugugggccagaaccggcuaccugggcuucgugagaagaaccgagcugaccgccgccaccggcgagagacacgacgcccuguacguggugggcgcccuggacgagacccuggagcugagaggccugagauaccaccccaucgacaucgagaccagcgugagcagaauccacagaagcaucgccgagugcgccguguucaccuggaccaaccugcuggugguggugguggagcugugcggcagcgagcaggaggcccuggaccuggugccccuggugaccaacguggugcuggaggagcacuaccugaucgugggcguggugguggugguggaccccggcgugauccccaucaacagcagaggcgagaagcagagaaugcaccugagagacagcuuccuggccgaccagcuggaccccaucuacguggccuacaacauguaa

SEQ ID NO: 16132 - RNA, 4671 nt, Artificial Sequence
  DIP2C__Homo_sapiens__NP_055789
auggccgacagaagccuggagggcauggcccugccccuggaggugagagccagacuggccgagcuggagcuggagcugagcgagggcgacaucacccagaagggcuacgagaagaagagaagcaagcugaucggcgccuaccugccccagccccccagaguggaccaggcccugccccaggagagaagagcccccgugacccccagcagcgccagcagauaccacagaagaagaagcagcggcagcagagacgagagauacagaagcgacgugcacaccgaggccgugcaggccgcccuggccaagcacaaggagagaaagauggccgugcccaugcccagcaagagaagaagccugguggugcagaccagcauggacgccuacaccccccccgacaccagcagcggcagcgaggacgagggcagcgugcagggcgacagccagggcacccccaccagcagccagggcagcaucaacauggagcacuggaucagccaggccauccacggcagcaccaccagcaccaccagcagcagcagcacccagagcggcggcagcggcgccgcccacagacuggccgacgugauggcccagacccacaucgagaaccacagcgccccccccgacgugaccaccuacaccagcgagcacagcauccagguggagagaccccagggcagcaccggcagcagaaccgcccccaaguacggcaacgccgagcugauggagaccggcgacggcgugcccgugagcagcagagugagcgccaagauccagcagcuggugaacacccugaagagacccaagagacccccccugagagaguucuucguggacgacuucgaggagcugcuggaggugcagcagcccgaccccaaccagcccaagcccgagggcgcccagaugcuggccaugagaggcgagcagcugggcguggugaccaacuggccccccagccuggaggccgcccugcagagauggggcaccaucagccccaaggcccccugccugaccaccauggacaccaacggcaagccccuguacauccugaccuacggcaagcuguggaccagaagcaugaagguggccuacagcauccugcacaagcugggcaccaagcaggagcccauggugagacccggcgacagaguggcccugguguuccccaacaacgaccccgccgccuucauggccgccuucuacggcugccugcuggccgagguggugcccgugcccaucgaggugccccugaccagaaaggacgccggcagccagcagaucggcuuccugcugggcagcugcggcgugaccguggcccugaccagcgacgccugccacaagggccugcccaagagccccaccggcgagaucccccaguucaagggcuggcccaagcugcugugguucgugaccgagagcaagcaccugagcaagccccccagagacugguucccccacaucaaggacgccaacaacgacaccgccuacaucgaguacaagaccugcaaggacggcagcgugcugggcgugaccgugaccagaaccgcccugcugacccacugccaggcccugacccaggccugcggcuacaccgaggccgagaccaucgugaacgugcuggacuucaagaaggacgugggccuguggcacggcauccugaccagcgugaugaacaugaugcacgugaucagcauccccuacagccugaugaaggugaacccccugagcuggauccagaaggugugccaguacaaggccaagguggccugcgugaagagcagagacaugcacugggcccugguggcccacagagaccagagagacaucaaccugagcagccugagaaugcugaucguggccgacggcgccaaccccuggagcaucagcagcugcgacgccuuccugaacguguuccagagcaagggccugagacaggaggugaucugccccugcgccagcagccccgaggcccugaccguggccaucagaagacccaccgacgacagcaaccagccccccggcagaggcgugcugagcaugcacggccugaccuacggcgugaucagaguggacagcgaggagaagcugagcgugcugaccgugcaggacgugggccuggugaugcccggcgccaucaugugcagcgugaagcccgacggcgugccccagcugugcagaaccgacgagaucggcgagcugugcgugugcgccguggccaccggcaccagcuacuacggccugagcggcaugaccaagaacaccuucgagguguuccccaugaccagcagcggcgcccccaucagcgaguaccccuucaucagaaccggccugcugggcuucgugggccccggcggccugguguucguggugggcaagauggacggccugaugguggugagcggcagaagacacaacgccgacgacaucguggccaccgcccuggccguggagcccaugaaguucguguacagaggcagaaucgccguguucagcgugaccgugcugcacgacgagagaaucgugaucguggccgagcagagacccgacagcaccgaggaggacagcuuccaguggaugagcagagugcugcaggccaucgacagcauccaccaggugggcguguacugccuggcccuggugcccgccaacacccugcccaagaccccccugggcggcauccaccugagcgagaccaagcagcuguuccuggagggcagccugcaccccugcaacgugcugaugugcccccacaccugcgugaccaaccugcccaagcccagacagaagcagcccgagaucggccccgccagcgugauggugggcaaccuggugagcggcaagagaaucgcccaggccagcggcagagaccugggccagaucgaggacaacgaccaggccagaaaguuccuguuccugagcgaggugcugcaguggagagcccagaccacccccgaccacauccuguacacccugcugaacugcagaggcgccaucgccaacagccugaccugcgugcagcugcacaagagagccgagaagaucgccgugaugcugauggagagaggccaccugcaggacggcgaccacguggcccugguguacccccccggcaucgaccugaucgccgccuucuacggcugccuguacgccggcugcgugcccaucaccgugagacccccccacccccagaacaucgccaccacccugcccaccgugaagaugaucguggaggugagcagaagcgccugccugaugaccacccagcugaucugcaagcugcugagaagcagagaggccgccgccgccguggacgugagaaccuggccccugauccuggacaccgacgaccugcccaagaagagacccgcccagaucugcaagcccugcaaccccgacacccuggccuaccuggacuucagcgugagcaccaccggcaugcuggccggcgugaagaugagccacgccgccaccagcgccuucugcagaagcaucaagcugcagugcgagcuguaccccagcagagagguggccaucugccuggaccccuacugcggccugggcuucgugcuguggugccugugcagcguguacagcggccaccagagcauccugaucccccccagcgagcuggagaccaaccccgcccuguggcugcuggccgugagccaguacaaggugagagacaccuucugcagcuacagcgugauggagcugugcaccaagggccugggcagccagaccgagagccugaaggccagaggccuggaccugagcagagugagaaccugcguggugguggccgaggagagacccagaaucgcccugacccagagcuucagcaagcuguucaaggaccugggccugcaccccagagccgugagcaccagcuucggcugcagagugaaccuggccaucugccugcagggcaccagcggccccgaccccaccaccguguacguggacaugagagcccugagacacgacagagugagacugguggagagaggcagcccccacagccugccccugauggagagcggcaagauccugcccggcgugagaaucaucaucgccaaccccgagaccaagggcccccugggcgacagccaccugggcgagaucugggugcacagcgcccacaacgccagcggcuacuucaccaucuacggcgacgagagccugcagagcgaccacuucaacagcagacugagcuucggcgacacccagaccaucugggccagaaccggcuaccugggcuuccugagaagaaccgagcugaccgacgccaacggcgagagacacgacgcccuguacguggugggcgcccuggacgaggccauggagcugagaggcaugagauaccaccccaucgacaucgagaccagcgugaucagagcccacaagagcgugaccgagugcgccguguucaccuggaccaaccugcuggugguggugguggagcuggacggcagcgagcaggaggcccuggaccuggugccccuggugaccaacguggugcuggaggagcacuaccugaucgugggcguggugguggugguggacaucggcgugauccccaucaacagcagaggcgagaagcagagaaugcaccugagagacggcuuccuggccgaccagcuggaccccaucuacguggccuacaacauguaa

SEQ ID NO: 16133 - RNA, 597 nt, Artificial Sequence
  DIRAS1__Homo_sapiens__NP_660156
augcccgagcagagcaacgacuacagaguggugguguucggcgccggcggcgugggcaagagcagccuggugcugagauucgugaagggcaccuucagagacaccuacauccccaccaucgaggacaccuacagacaggugaucagcugcgacaagagcgugugcacccugcagaucaccgacaccaccggcagccaccaguuccccgccaugcagagacugagcaucagcaagggccacgccuucauccugguguucagcgugaccagcaagcagagccuggaggagcugggccccaucuacaagcugaucgugcagaucaagggcagcguggaggacauccccgugaugcuggugggcaacaagugcgacgagacccagagagagguggacaccagagaggcccaggccguggcccaggaguggaagugcgccuucauggagaccagcgccaagaugaacuacaacgugaaggagcuguuccaggagcugcugacccuggagaccagaagaaacaugagccugaacaucgacggcaagagaagcggcaagcagaagagaaccgacagagugaagggcaagugcacccugauguaa

SEQ ID NO: 16134 - RNA, 600 nt, Artificial Sequence
  DIRAS2__Homo_sapiens__NP_060064
augcccgagcagagcaacgacuacagaguggccguguucggcgccggcggcgugggcaagagcagccuggugcugagauucgugaagggcaccuucagagagagcuacauccccaccguggaggacaccuacagacaggugaucagcugcgacaagagcaucugcacccugcagaucaccgacaccaccggcagccaccaguuccccgccaugcagagacugagcaucagcaagggccacgccuucauccugguguacagcaucaccagcagacagagccuggaggagcugaagcccaucuacgagcagaucugcgagaucaagggcgacguggagagcauccccaucaugcuggugggcaacaagugcgacgagagccccagcagagaggugcagagcagcgaggccgaggcccuggccagaaccuggaagugcgccuucauggagaccagcgccaagcugaaccacaacgugaaggagcuguuccaggagcugcugaaccuggagaagagaagaaccgugagccugcagaucgacggcaagaagagcaagcagcagaagagaaaggagaagcugaagggcaagugcgugaucauguaa

SEQ ID NO: 16135 - RNA, 315 nt, Artificial Sequence
  DIRC1__Homo_sapiens__XP_011508847
augcccgaggcccacaugcagcccgccaagcugcagaccagccugcccaccaccgaccacggcagcaagaagcccgugagcugcuaccugcccccccugagcaacgcccaccccaugugcaucgaggugcagaacgcccagaacugcagcagcgccgccgccacccuggagcccagcaucaucagcgacaccugcuucuacaagcccaucaccaaggaccagcugagcagcagaagcgagcugaacaccgugagacugaagugccugaacagccugagaggcuggaagauccugaaccagcugagccugaccuaa

SEQ ID NO: 16136 - RNA, 1437 nt, Artificial Sequence
  DIRC2__Homo_sapiens__NP_116228
augggcagcagauggagcagcgaggaggagagacagccccugcugggccccggccugggccccggccugggcgccagcuggagaagcagagaggccgccgccgccgcccugcccgccgccgugcccggccccggcagaguguacggcagaagauggcuggugcugcugcuguucagccugcuggccuucgugcagggccugguguggaacaccuggggccccauccagaacagcgccagacaggccuacggcuucagcagcugggacaucgcccugcuggugcuguggggccccaucggcuuccugcccugcuucgccuucauguggcugcuggacaagagaggccugagaaucaccgugcugcugaccagcuuccugauggugcugggcaccggccugagaugcauccccaucagcgaccugauccugaagagaagacugauccacggcggccagaugcugaacggccuggccggccccaccgugaugaacgccgcccccuuccugagcaccaccugguucagcgccgacgagagagccaccgccaccgccaucgccagcaugcugagcuaccugggcggcgccugcgccuuccuggugggcccccugguggugcccgcccccaacggcaccagcccccugcuggccgccgagagcagcagagcccacaucaaggacagaaucgaggccgugcuguacgccgaguucggcguggugugccugaucuucagcgccacccuggccuacuucccccccagacccccccugccccccagcguggccgccgccagccagagacugagcuacagaagaagcgugugcagacugcugagcaacuucagauuccugaugaucgcccuggccuacgccaucccccugggcguguucgccggcuggagcggcgugcuggaccugauccugacccccgcccacgugagccagguggacgccggcuggaucggcuucuggagcaucgugggcggcugcguggugggcaucgccauggccagauucgccgacuucaucagaggcaugcugaagcugauccugcugcugcuguucagcggcgccacccugagcagcaccugguucacccugaccugccugaacagcaucacccaccugccccugaccaccgugacccuguacgccagcugcauccugcugggcguguuccugaacagcagcgugcccaucuucuucgagcuguucguggagaccguguaccccgugcccgagggcaucaccugcggcguggugaccuuccugagcaacauguucaugggcgugcugcuguucuuccugaccuucuaccacaccgagcugagcugguucaacuggugccugcccggcagcugccugcugagccugcugcugauccugugcuucagagagagcuacgacagacuguaccuggacgugguggugagcguguaa

SEQ ID NO: 16137 - RNA, 2787 nt, Artificial Sequence
  DIS3__Homo_sapiens__NP_001121698
augcugaagagcaagaccuuccugaagaagaccagagccggcggcgugaugaagaucgugagagagcacuaccugagagacgacaucggcugcggcgcccccggcugcgccgccugcggcggcgcccacgagggccccgcccuggagccccagccccaggaccccgccagcagcgugugcccccagccccacuaccugcugcccgacaccaacgugcugcugcaccagaucgugagcgccuggagacccggcaccugggccagcguggccagcagccugagacugcccggcagccuggagaccuacguggagcaggagcagggcgagaacgccaacgacagaaacgacagagccaucagaguggccgccaagugguacaacgagcaccugaagaagaugagcgccgacaaccagcugcaggugaucuucaucaccaacgacagaagaaacaaggagaaggccaucgaggagggcauccccgccuucaccugcgaggaguacgugaagagccugaccgccaaccccgagcugaucgacagacuggccugccugagcgaggagggcaacgagaucgagagcggcaagaucaucuucagcgagcaccugccccugagcaagcugcagcagggcaucaagagcggcaccuaccugcagggcaccuucagagccagcagagagaacuaccuggaggccaccguguggauccacggcgacaacgaggagaacaaggagaucauccugcagggccugaagcaccugaacagagccgugcacgaggacaucguggccguggagcugcugcccaagagccaguggguggcccccagcagcguggugcugcacgacgagggccagaacgaggaggacguggagaaggaggaggagaccgagagaaugcugaagaccgccgugagcgagaagaugcugaagcccaccggcagaguggugggcaucaucaagagaaacuggagacccuacugcggcaugcugagcaagagcgacaucaaggagagcagaagacaccuguucacccccgccgacaagagaauccccagaaucagaaucgagaccagacaggccagcacccuggagggcagaagaaucaucguggccaucgacggcuggcccagaaacagcagauaccccaacggccacuucgugagaaaccugggcgacgugggcgagaaggagaccgagaccgaggugcugcugcuggagcacgacgugccccaccagcccuucagccaggccgugcugagcuuccugcccaagaugcccuggagcaucaccgagaaggacaugaagaacagagaggaccugagacaccugugcaucugcagcguggacccccccggcugcaccgacaucgacgacgcccugcacugcagagagcuggagaacggcaaccuggaggugggcgugcacaucgccgacgugagccacuucaucagacccggcaacgcccuggaccaggagagcgccagaagaggcaccaccguguaccugugcgagaagagaaucgacauggugcccgagcugcugagcagcaaccugugcagccugaagugcgacguggacagacuggccuucagcugcaucugggagaugaaccacaacgccgagauccugaagaccaaguucaccaagagcgugaucaacagcaaggccagccugaccuacgccgaggcccagcugagaaucgacagcgccaacaugaacgacgacaucaccaccagccugagaggccugaacaagcuggccaagauccugaagaagagaagaaucgagaagggcgcccugacccugagcagccccgaggugagauuccacauggacagcgagacccacgaccccaucgaccugcagaccaaggagcugagagagaccaacagcaugguggaggaguucaugcugcuggccaacaucagcguggccaagaagauccacgaggaguucagcgagcacgcccugcugagaaagcaccccgcccccccccccagcaacuacgagauccuggugaaggccgccagaagcagaaaccuggagaucaagaccgacaccgccaagagccuggccgagagccuggaccaggccgagagccccaccuuccccuaccugaacacccugcugagaauccuggccaccagaugcaugaugcaggccguguacuucugcagcggcauggacaacgacuuccaccacuacggccuggccagccccaucuacacccacuucaccagccccaucagaagauacgccgacgugaucgugcacagacugcuggccguggccaucggcgccgacugcaccuaccccgagcugaccgacaagcacaagcuggccgacaucugcaagaaccugaacuucagacacaagauggcccaguacgcccagagagccagcguggccuuccacacccagcuguucuucaagagcaagggcaucgugagcgaggaggccuacauccuguucgugagaaagaacgccaucguggugcugauccccaaguacggccuggagggcaccguguucuucgaggagaaggacaagcccaacccccagcugaucuacgacgacgagauccccagccugaagaucgaggacaccguguuccacguguucgacaaggugaaggugaagaucaugcuggacagcagcaaccugcagcaccagaagaucagaaugagccugguggagccccagauccccggcaucagcauccccaccgacaccagcaacauggaccugaacggccccaagaagaagaagaugaagcugggcaaguaa

SEQ ID NO: 16138 - RNA, 1812 nt, Artificial Sequence
  DIS3L2__Homo_sapiens__NP_001244210
augagccaccccgacuacagaaugaaccugagaccccugggcacccccagaggcgugagcgccguggccggcccccacgacaucggcgccagccccggcgacaagaagagcaagaacagaagcaccagaggcaagaagaagagcaucuucgagaccuacaugagcaaggaggacgugagcgagggccugaagagaggcacccugauccagggcgugcugagaaucaaccccaagaaguuccacgaggccuucauccccagccccgacggcgacagagacaucuucaucgacggcgugguggccagaaacagagcccugaacggcgaccuggugguggugaagcugcugcccgaggagcacuggaagguggugaagcccgagagcaacgacaaggagaccgaggccgccuacgagagcgacauccccgaggagcugugcggccaccaccugccccagcagagccugaagagcuacaacgacagccccgacgugaucguggaggcccaguucgacggcagcgacagcgaggacggccacggcaucacccagaacgugcugguggacggcgugaagaagcugagcgugugcgugagcgagaagggcagagaggacggcgacgcccccgugaccaaggacgagaccaccugcaucagccaggacaccagagcccugagcgagaagagccugcagagaagcgccaaggugguguacauccuggagaagaagcacagcagagccgccaccggcuuccugaagcugcuggccgacaagaacagcgagcuguucagaaaguacgcccuguucagccccagcgaccacagagugcccagaaucuacgugccccugaaggacugcccccaggacuucguggccagacccaaggacuacgccaacacccuguucaucugcagaaucguggacuggaaggaggacugcaacuucgcccugggccagcuggccaagagccugggccaggccggcgagaucgagcccgagaccgagggcauccugaccgaguacggcguggacuucagcgacuucagcagcgaggugcuggagugccugccccagggccugcccuggaccaucccccccgaggaguucagcaagagaagagaccugagaaaggacugcaucuucaccaucgaccccagcaccgccagagaccuggacgacgcccugagcugcaagccccuggccgacggcaacuucaaggugggcgugcacaucgccgacgugagcuacuucgugcccgagggcagcgaccuggacaagguggccgccgagagagccaccagcguguaccuggugcagaagguggugcccaugcugcccagacugcugugcgaggagcugugcagccugaaccccaugagcgacaagcugaccuucagcgugaucuggacccugacccccgagggcaagauccuggacgagugguucggcagaaccaucaucagaagcugcaccaagcugagcuacgagcacgcccagagcaugaucgagagccccaccgagaagauccccgccaaggagcugccccccaucagccccgagcacagcagcgaggaggugcaccagcagaacgccgacaaggacggcgccgcccaccugcaggccagccacagccccagcgccgaggacgccgaggcccagcccagcaccgaggagagacugcccgagaccagaggcaucugcgacagagaccccgacaccagacuguucuuccugcagcagcagagcagagugcuggaggccaagccccagaacaccaucagaguggaggagcagaccacccagcugcagaucuaa

SEQ ID NO: 16139 - RNA, 3165 nt, Artificial Sequence
  DIS3L__Homo_sapiens__NP_001137160
augcugcagaagagagagaaggugcugcugcugagaaccuuccagggcagaacccugagaaucgugagagagcacuaccugagacccugcgugcccugccacagcccccugugcccccagcccgccgccugcagccacgacggcaagcugcugagcagcgacgugacccacuacgugauccccgacuggaagguggugcaggacuaccuggagauccuggaguuccccgagcugaagggcaucaucuucaugcagaccgccugccaggccgugcagcaccagagaggcagaagacaguacaacaagcugagaaaccugcugaaggacgccagacacgacugcauccuguucgccaacgaguuccagcagugcugcuaccugcccagagagagaggcgagagcauggagaaguggcagaccagaagcaucuacaacgccgccgugugguacuaccaccacugccaggacagaaugcccaucgugauggugaccgaggacgaggaggccauccagcaguacggcagcgagaccgagggcguguucgugaucaccuucaagaacuaccuggacaacuucuggcccgaccugaaggccgcccacgagcugugcgacagcauccugcagagcagaagagagagagagaacgagagccaggagagccacggcaaggaguaccccgagcaccugccccuggaggugcuggaggccggcaucaagagcggcagauacauccagggcauccugaacgugaacaagcacagagcccagaucgaggccuucgugagacugcagggcgccagcagcaaggacagcgaccuggugagcgacauccugauccacggcaugaaggccagaaacagaagcauccacggcgacgugguggugguggagcugcugcccaagaacgaguggaagggcagaaccguggcccugugcgagaacgacugcgacgacaaggccagcggcgagagccccagcgagcccaugcccaccggcagaguggugggcauccugcagaagaacuggagagacuacguggugaccuuccccagcaaggaggaggugcagagccagggcaagaacgcccagaagauccuggugacccccugggacuacagaauccccaagaucagaaucagcacccagcaggccgagacccugcaggacuucagagugguggugagaaucgacagcugggagagcaccagcguguaccccaacggccacuucgugagagugcugggcagaaucggcgaccuggagggcgagaucgccaccauccugguggagaacagcaucagcgugauccccuucagcgaggcccagaugugcgagaugcccgugaacacccccgagagccccuggaaggugagccccgaggaggagcagaagagaaaggaccugagaaagagccaccugguguucagcaucgaccccaagggcugcgaggacguggacgacacccugagcgugagaacccugaacaacggcaaccuggagcugggcgugcacaucgccgacgugacccacuucguggcccccaacagcuacaucgacaucgaggccagaaccagagccaccaccuacuaccuggccgacagaagauacgacaugcugcccagcgugcugagcgccgaccugugcagccugcugggcggcguggacagauacgccgugagcaucaugugggagcuggacaaggccagcuacgagaucaagaaggugugguacggcagaaccaucaucagaagcgccuacaagcuguucuacgaggccgcccaggagcugcuggacggcaaccugagcgugguggacgacauccccgaguucaaggaccuggacgagaagagcagacaggccaagcuggaggagcuggugugggccaucggcaagcugaccgacaucgccagacacgugagagccaagagagacggcugcggcgcccuggagcuggagggcguggaggugugcgugcagcuggacgacaagaagaacauccacgaccugauccccaagcagccccuggaggugcacgagaccguggccgagugcaugauccuggccaaccacuggguggccaagaagaucugggagagcuucccccaccaggcccugcugagacagcacccccccccccaccaggaguucuucagcgagcugagagagugcgccaaggccaagggcuucuucaucgacaccagaagcaacaagacccuggccgacagccuggacaacgccaacgacccccacgaccccaucgugaacagacugcugagaagcauggccacccaggccaugagcaacgcccuguacuucagcaccggcagcugcgccgaggaggaguuccaccacuacggccuggcccuggacaaguacacccacuucaccagccccaucagaagauacagcgacaucguggugcacagacugcugauggccgccaucagcaaggacaagaagauggagaucaagggcaaccuguucagcaacaaggaccuggaggagcugugcagacacaucaacaacagaaaccaggccgcccagcacagccagaagcagagcaccgagcuguuccagugcauguacuucaaggacaaggaccccgccaccgaggagagaugcaucagcgacggcgugaucuacagcaucagaaccaacggcgugcugcuguucauccccagauucggcaucaagggcgccgccuaccugaagaacaaggacggccuggugaucagcugcggccccgacagcugcagcgaguggaagcccggcagccugcagagauuccagaacaagaucaccagcaccaccaccgacggcgagagcgugaccuuccaccuguucgaccacgugaccgugagaaucagcauccaggccagcagaugccacagcgacaccaucagacuggagaucaucagcaacaagcccuacaagauccccaacaccgagcugauccaccagagcagcccccugcugaagagcgagcuggugaaggaggugaccaagagcguggaggaggcccagcuggcccaggaggugaaggugaacaucauccaggaggaguaccaggaguacagacagaccaagggcagaagccuguacacccugcuggaggagaucagagaccuggcccugcuggacgugagcaacaacuacggcaucuaa

SEQ ID NO: 16140 - RNA, 2499 nt, Artificial Sequence
  DISC1__Homo_sapiens__NP_001012975
augcccggcggcggcccccagggcgcccccgccgccgccggcggcggcggcgugagccacagagccggcagcagagacugccugccccccgccgccugcuucagaagaagaagacuggccagaagacccggcuacaugagaagcagcaccggccccggcaucggcuuccugagccccgccgugggcacccuguucagauuccccggcggcgugagcggcgaggagagccaccacagcgagagcagagccagacagugcggccuggacagcagaggccugcuggugagaagccccgugagcaagagcgccgccgcccccaccgugaccagcgugagaggcaccagcgcccacuucggcauccagcugagaggcggcaccagacugcccgacagacugagcuggcccugcggccccggcagcgccggcuggcagcaggaguucgccgccauggacagcagcgagacccuggacgccagcugggaggccgccugcagcgacggcgccagaagagugagagccgccggcagccugcccagcgccgagcugagcagcaacagcugcagccccggcugcggccccgaggugccccccaccccccccggcagccacagcgccuucaccagcagcuucagcuucaucagacugagccugggcagcgccggcgagagaggcgaggccgagggcugcccccccagcagagaggccgagagccacugccagagcccccaggagaugggcgccaaggccgccagccuggacggcccccacgaggaccccagaugccugagcagacccuucagccugcuggccaccagagugagcgccgaccuggcccaggccgccagaaacagcagcagacccgagagagacaugcacagccugcccgacauggaccccggcagcagcagcagccuggaccccagccuggccggcugcggcggcgacggcagcagcggcagcggcgacgcccacagcugggacacccugcugagaaagugggagcccgugcugagagacugccugcugagaaacagaagacagauggaggugaucagccugagacugaagcugcagaagcugcaggaggacgccguggagaacgacgacuacgacaaggccgagacccugcagcagagacuggaggaccuggagcaggagaagaucagccugcacuuccagcugcccagcagacagcccgcccugagcagcuuccugggccaccuggccgcccaggugcaggccgcccugagaagaggcgccacccagcaggccagcggcgacgacacccacaccccccugagaauggagcccagacugcuggagcccaccgcccaggacagccugcacgugagcaucaccagaagagacuggcugcugcaggagaagcagcagcugcagaaggagaucgaggcccugcaggccagaauguucgugcuggaggccaaggaccagcagcugagaagagagaucgaggagcaggagcagcagcugcaguggcagggcugcgaccugaccccccuggugggccagcugagccugggccagcugcaggaggugagcaaggcccugcaggacacccuggccagcgccggccagauccccuuccacgccgagccccccgagaccaucagaagccugcaggagagaaucaagagccugaaccugagccugaaggagaucaccaccaaggugugcaugagcgagaaguucugcagcacccugagaaagaaggugaacgacaucgagacccagcugcccgcccugcuggaggccaagaugcacgccaucagcggcaaccacuucuggaccgccaaggaccugaccgaggagaucagaagccugaccagcgagagagagggccuggagggccugcugagcaagcugcuggugcugagcagcagaaacgugaagaagcugggcagcgugaaggaggacuacaacagacugagaagagagguggagcaccaggagaccgccuacgagaccagcgugaaggagaacaccaugaaguacauggagacccugaagaacaagcugugcagcugcaagugcccccugcugggcaaggugugggaggccgaccuggaggccugcagacugcugauccagagccugcagcugcaggaggccagaggcagccugagcguggaggacgagagacagauggacgaccuggagggcgccgccccccccaucccccccagacugcacagcgaggacaagagaaagaccccccugaaggagagcuacauccugagcgccgagcugggcgagaagugcgaggacaucggcaagaagcugcuguaccuggaggaccagcugcacaccgccauccacagccacgacgaggaccugauccagagccugagaagagagcugcagauggugaaggagacccugcaggccaugauccugcagcugcagcccgccaaggaggccggcgagagagaggccgccgccagcugcaugaccgccggcgugcacgaggcccaggccuaa

SEQ ID NO: 16141 - RNA, 4575 nt, Artificial Sequence
  DISP1__Homo_sapiens__NP_116279
auggccaugagcaacggcaacaacgacuucguggugcugagcaacagcagcaucgccaccagcgccgccaaccccagcccccugacccccugcgacggcgaccacgccgcccagcagcugacccccaaggaggccaccagaaccaaggugagccccaacggcugccugcagcugaacggcaccgugaagagcagcuuccugccccuggacaaccagagaaugccccagaugcugccccagugcugccaccccugccccuaccaccacccccugaccagccacagcagccaccaggagugccaccccgaggccggccccgccgcccccagcgcccuggccagcugcugcaugcagccccacagcgaguacagcgccagccugugccccaaccacagccccguguaccagaccaccugcugccugcagcccagccccagcuucugccugcaccaccccuggcccgaccacuuccagcaccagcccgugcagcagcacaucgccaacaucagacccagcagacccuucaagcugcccaagagcuacgccgcccugaucgccgacuggcccgugguggugcugggcaugugcaccauguucaucguggugugcgcccuggugggcgugcuggugcccgagcugcccgacuucagcgacccccugcugggcuucgagcccagaggcaccgccaucggccagagacuggugaccuggaacaacauggugaagaacaccggcuacaaggccacccuggccaacuaccccuucaaguacgccgacgagcaggccaagagccacagagacgacagauggagcgacgaccacuacgagagagagaagagagagguggacuggaacuuccacaaggacagcuucuucugcgacgugcccagcgacagauacagcagagugguguucaccagcagcggcggcgagacccuguggaaccugcccgccaucaagagcaugugcaacguggacaacagcagaaucagaagccacccccaguucggcgaccugugccagagaaccaccgccgccagcugcugccccagcuggacccugggcaacuacaucgccauccugaacaacagaagcagcugccagaagaucguggagagagacgugagccacacccugaagcugcugagaaccugcgccaagcacuaccagaacggcacccugggccccgacugcugggacauggccgccagaagaaaggaccagcugaagugcaccaacgugcccagaaagugcaccaaguacaacgccguguaccagauccugcacuaccugguggacaaggacuucaugacccccaagaccgccgacuacgccacccccgcccugaaguacagcaugcuguucagccccaccgagaagggcgagagcaugaugaacaucuaccuggacaacuucgagaacuggaacagcagcgacggcgugaccaccaucaccggcaucgaguucggcaucaagcacagccuguuccaggacuaccugcugauggacaccguguaccccgccaucgccaucgugaucgugcugcuggugaugugcguguacaccaagagcauguucaucacccugaugaccauguucgccaucaucagcagccugaucgugagcuacuuccuguacagagugguguuccacuucgaguucuuccccuucaugaaccugaccgcccugaucauccuggugggcaucggcgccgacgacgccuucgugcugugcgacguguggaacuacaccaaguucgacaagccccacgccgagaccagcgagaccgugagcaucacccugcagcacgccgcccugagcauguucgugaccagcuucaccaccgccgccgccuucuacgccaacuacgugagcaacaucaccgccaucagaugcuucggcguguacgccggcaccgccauccuggugaacuacgugcugauggugaccuggcugcccgccgugguggugcugcacgagagauaccugcugaacaucuucaccugcuucaagaagccccagcagcagaucuacgacaacaagagcugcuggaccguggccugccagaagugccacaaggugcuguucgccaucagcgaggccagcagaaucuucuucgagaaggugcugcccugcaucgugaucaaguucagauaccuguggcuguucugguuccuggcccugaccgugggcggcgccuacaucgugugcaucaaccccaagaugaagcugcccagccuggagcugagcgaguuccagguguucagaagcagccaccccuucgagagauacgacgccgaguacaagaagcuguucauguucgagagagugcaccacggcgaggagcugcacaugcccaucaccgugaucuggggcgugagccccgaggacaacggcaacccccugaaccccaagagcaagggcaagcugacccuggacagcagcuucaacaucgccagccccgccagccaggccuggauccugcacuucugccagaagcugagaaaccagaccuucuucuaccagaccgacgagcaggacuucaccagcugcuucaucgagaccuucaagcaguggauggagaaccaggacugcgacgagcccgcccuguaccccugcugcagccacuggagcuuccccuacaagcaggagaucuucgagcugugcaucaagagagccaucauggagcuggagagaagcaccggcuaccaccuggacagcaagacccccggccccagauucgacaucaacgacaccaucagagccguggugcuggaguuccagagcaccuaccuguucacccuggccuacgagaagaugcaccaguucuacaaggagguggacagcuggaucagcagcgagcugagcagcgcccccgagggccugagcaacggcugguucgugagcaaccuggaguucuacgaccugcaggacagccugagcgacggcacccugaucgccaugggccugagcguggccguggccuucagcgugaugcugcugaccaccuggaacaucaucaucagccuguacgccaucaucagcaucgccggcaccaucuucgugaccgugggcagccuggugcugcugggcugggagcugaacgugcuggagagcgugaccaucagcguggccgugggccugagcguggacuucgccgugcacuacggcguggccuacagacuggcccccgaccccgacagagagggcaaggugaucuucagccugagcagagugggcagcgccauggccauggccgcccugaccaccuucguggccggcgccaugaugaugcccagcaccgugcuggccuacacccagcugggcaccuucaugaugcugaucaugugcaucagcugggccuucgccaccuucuucuuccagugcaugugcagaugccugggcccccagggcaccugcggccagaucccccugcccaagaagcugcagugcagcgccuucagccacgcccugagcaccagccccagcgacaagggccagagcaagacccacaccaucaacgccuaccaccuggaccccagaggccccaagagcgagcuggagcacgaguucuacgagcuggagccccuggccagccacagcugcaccgcccccgagaagaccaccuacgaggagacccacaucugcagcgaguucuucaacagccaggccaagaaccugggcaugcccgugcacgccgccuacaacagcgagcugagcaagagcaccgagagcgacgccggcagcgcccugcugcagcccccccuggagcagcacaccgugugccacuucuucagccugaaccagagaugcagcugccccgacgccuacaagcaccugaacuacggcccccacagcugccagcagaugggcgacugccugugccaccagugcagccccaccaccagcagcuucgugcagauccagaacggcguggccccccugaaggccacccaccaggccguggagggcuucgugcaccccaucacccacauccaccacugccccugccugcagggcagagugaagcccgccggcaugcagaacagccugcccagaaacuucuuccugcaccccgugcagcacauccaggcccaggagaagaucggcaagaccaacgugcacagccugcagagaagcaucgaggagcaccugcccaagauggccgagcccagcagcuucgugugcagaagcaccggcagccugcugaagaccugcugcgaccccgagaacaagcagagagagcugugcaagaacagagacgugagcaaccuggagagcagcggcggcaccgagaacaaggccggcggcaagguggagcugagccugagccagaccgacgccagcgugaacagcgagcacuucaaccagaacgagcccaaggugcuguucaaccaccugaugggcgaggccggcugcagaagcugccccaacaacagccagagcugcggcagaaucgugagagugaagugcaacagcguggacugccagaugcccaacauggaggccaacgugcccgccgugcugacccacagcgagcugagcggcgagagccugcugaucaagacccuguaa

SEQ ID NO: 16142 - RNA, 2052 nt, Artificial Sequence
  DIXDC1__Homo_sapiens__NP_001033043
augcuggccugccugaccagaggcaaccugcuggacgugcugcaggagggcuucaacgagcagcagcugcaggccuacguggccugggugaacgcccagcugaagaagagacccgccgugaagcccgugcaggaccugagacaggaccugagagacggcgugauccuggccuaccugaucgagaucguggccggcgagaagcugagcggcgugcagcugagccccggcaaccagcaggagaugaagaacaacguggagaaggugcugcaguucguggccagcaagaagaucagaaugcaccagaccagcgccaaggacaucguggacggcaaccugaagagcaucaugagacuggugcuggcccuggccgcccacuucaagcccggcagcagcagaaccgugaaccagggcagagacagcagagccccccugcagagccacagaccccacugcgccaccgccguggcccagggcgccgccgccgcccuggccgacgugugccacgacaugagcagaagcggcagagacguguucagauacagacagagaaacagcagcauggacgaggagaucgagaaccccuacuggagcgugagagcccuggugcagcaguacgagggccagcagagaagccccagcgagagcagcugcagcagccugaccagccccagccccauccacagcgccaagagcgagagcaucaucacccagagcgaggagaaggccgacuucgugaucauccccgccgagggcaucgagaacagaaccgagggcaccgacagcccccugagcagagacuggagacccggcagccccggcaccuaccuggagaccagcugggaggagcagcugcuggagcagcaggaguaccuggagaaggagauggaggaggccaagaagaugaucagcggccugcaggcccugcugcugaacggcagccugcccgaggacgagcaggagagaccccuggcccugugcgagcccggcgugaaccccgaggagcagcugaucaucauccagagcagacuggaccagagcauggaggagaaccaggaccugaagaaggagcugcugaagugcaagcaggaggccagaaaccugcagggcaucaaggacgcccugcagcagagacugacccagcaggacaccagcgugcugcagcugaagcaggagcugcugagagccaacauggacaaggacgagcugcacaaccagaacguggaccugcagagaaagcuggacgagagaaacagacugcugggcgaguacaagaaggagcugggccagaaggacagacugcugcagcagcaccaggccaagcuggaggaggcccugagaaagcugagcgacgugagcuaccaccagguggaccuggagagagagcuggagcacaaggacgugcugcuggcccacugcaugaagagagaggccgacgaggccaccaacuacaacagccacaacagccagagcaacggcuuccugcugcccaccgccggcaagggcgccaccagcgugagcaacagaggcaccagcgaccugcagcuggugagagacgcccugagaagccugagaaacagcuucagcggccacgacccccagcaccacaccaucgacagccuggagcagggcaucagcagccugauggagagacugcacgugauggagacccagaagaagcaggagagaaaggugagagugaagagccccagaacccaggugggcagcgaguacagagagagcuggccccccaacagcaagcugccccacagccagagcagccccaccgugagcagcaccugcaccaaggugcuguacuucaccgacagaagccugacccccuucauggugaacauccccaagagacuggaggaggugacccugaaggacuucaaggccgccaucgacagagagggcaaccacagauaccacuucaaggcccuggaccccgaguucggcaccgugaaggaggagaucuuccacgacgacgacgccauccccggcugggagggcaagaucguggccuggguggaggaggaccacggcgagaacuaa

SEQ ID NO: 16143 - RNA, 1545 nt, Artificial Sequence
  DKC1__Homo_sapiens__NP_001354
auggccgacgccgaggugaucauccugcccaagaagcacaagaagaagaaggagagaaagagccugcccgaggaggacguggccgagauccagcacgccgaggaguuccugaucaagcccgagagcaagguggccaagcuggacaccagccaguggccccugcugcugaagaacuucgacaagcugaacgugagaaccacccacuacaccccccuggccugcggcagcaacccccugaagagagagaucggcgacuacaucagaaccggcuucaucaaccuggacaagcccagcaaccccagcagccacgaggugguggccuggaucagaagaauccugagaguggagaagaccggccacagcggcacccuggaccccaaggugaccggcugccugaucgugugcaucgagagagccaccagacuggugaagagccagcagagcgccggcaaggaguacgugggcaucgugagacugcacaacgccaucgagggcggcacccagcugagcagagcccuggagacccugaccggcgcccuguuccagagacccccccugaucgccgccgugaagagacagcugagagugagaaccaucuacgagagcaagaugaucgaguacgaccccgagagaagacugggcaucuucugggugagcugcgaggccggcaccuacaucagaacccugugcgugcaccugggccugcugcugggcgugggcggccagaugcaggagcugagaagagugagaagcggcgugaugagcgagaaggaccacauggugaccaugcacgacgugcuggacgcccaguggcuguacgacaaccacaaggacgagagcuaccugagaagagugguguacccccuggagaagcugcugaccagccacaagagacuggugaugaaggacagcgccgugaacgccaucugcuacggcgccaagaucaugcugcccggcgugcugagauacgaggacggcaucgaggugaaccaggagaucguggugaucaccaccaagggcgaggccaucugcauggccaucgcccugaugaccaccgccgugaucagcaccugcgaccacggcaucguggccaagaucaagagagugaucauggagagagacaccuaccccagaaaguggggccugggccccaaggccagccagaagaagcugaugaucaagcagggccugcuggacaagcacggcaagcccaccgacagcacccccgccaccuggaagcaggaguacguggacuacagcgagagcgccaagaaggaggugguggccgagguggugaaggccccccaggugguggccgaggccgccaagaccgccaagagaaagagagagagcgagagcgagagcgacgagaccccccccgccgccccccagcugaucaagaaggagaagaagaagagcaagaaggacaagaaggccaaggccggccuggagagcggcgccgagcccggcgacggcgacagcgacaccaccaagaagaagaagaagaagaagaaggccaaggagguggagcuggugagcgaguaa

SEQ ID NO: 16144 - RNA, 801 nt, Artificial Sequence
  DKK1__Homo_sapiens__NP_036374
augauggcccugggcgccgccggcgccaccagaguguucguggccaugguggccgccgcccugggcggccacccccugcugggcgugagcgccacccugaacagcgugcugaacagcaacgccaucaagaaccugccccccccccugggcggcgccgccggccaccccggcagcgccgugagcgccgcccccggcauccuguaccccggcggcaacaaguaccagaccaucgacaacuaccagcccuaccccugcgccgaggacgaggagugcggcaccgacgaguacugcgccagccccaccagaggcggcgacgccggcgugcagaucugccuggccugcagaaagagaagaaagagaugcaugagacacgccaugugcugccccggcaacuacugcaagaacggcaucugcgugagcagcgaccagaaccacuucagaggcgagaucgaggagaccaucaccgagagcuucggcaacgaccacagcacccuggacggcuacagcagaagaaccacccugagcagcaagauguaccacaccaagggccaggagggcagcgugugccugagaagcagcgacugcgccagcggccugugcugcgccagacacuucuggagcaagaucugcaagcccgugcugaaggagggccaggugugcaccaagcacagaagaaagggcagccacggccuggagaucuuccagagaugcuacugcggcgagggccugagcugcagaauccagaaggaccaccaccaggccagcaacagcagcagacugcacaccugccagagacacuaa

SEQ ID NO: 16145 - RNA, 780 nt, Artificial Sequence
  DKK2__Homo_sapiens__NP_055236
auggccgcccugaugagaagcaaggacagcagcugcugccugcugcugcuggccgccgugcugaugguggagagcagccagaucggcagcagcagagccaagcugaacagcaucaagagcagccugggcggcgagacccccggccaggccgccaacagaagcgccggcauguaccagggccuggccuucggcggcagcaagaagggcaagaaccugggccaggccuaccccugcagcagcgacaaggagugcgaggugggcagauacugccacagcccccaccagggcagcagcgccugcauggugugcagaagaaagaagaagagaugccacagagacggcaugugcugccccagcaccagaugcaacaacggcaucugcauccccgugaccgagagcauccugaccccccacauccccgcccuggacggcaccagacacagagacagaaaccacggccacuacagcaaccacgaccugggcuggcagaaccugggcagaccccacaccaagaugagccacaucaagggccacgagggcgaccccugccugagaagcagcgacugcaucgagggcuucugcugcgccagacacuucuggaccaagaucugcaagcccgugcugcaccagggcgaggugugcaccaagcagagaaagaagggcagccacggccuggagaucuuccagagaugcgacugcgccaagggccugagcugcaagguguggaaggacgccaccuacagcagcaaggccagacugcacgugugccagaagaucuaa

SEQ ID NO: 16146 - RNA, 1053 nt, Artificial Sequence
  DKK3__Homo_sapiens__XP_006718241
augcagagacugggcgccacccugcugugccugcugcuggccgccgccgugcccaccgcccccgcccccgcccccaccgccaccagcgcccccgugaagcccggccccgcccugagcuacccccaggaggaggccacccugaacgagauguucagagagguggaggagcugauggaggacacccagcacaagcugagaagcgccguggaggagauggaggccgaggaggccgccgccaaggccagcagcgaggugaaccuggccaaccugccccccagcuaccacaacgagaccaacaccgacaccaaggugggcaacaacaccauccacgugcacagagagauccacaagaucaccaacaaccagaccggccagaugguguucagcgagaccgugaucaccagcgugggcgacgaggagggcagaagaagccacgagugcaucaucgacgaggacugcggccccagcauguacugccaguucgccagcuuccaguacaccugccagcccugcagaggccagagaaugcugugcaccagagacagcgagugcugcggcgaccagcugugcguguggggccacugcaccaagauggccaccagaggcagcaacggcaccaucugcgacaaccagagagacugccagcccggccugugcugcgccuuccagagaggccugcuguuccccgugugcaccccccugcccguggagggcgagcugugccacgaccccgccagcagacugcuggaccugaucaccugggagcuggagcccgacggcgcccuggacagaugccccugcgccagcggccugcugugccagccccacagccacagccugguguacgugugcaagcccaccuucgugggcagcagagaccaggacggcgagauccugcugcccagagaggugcccgacgaguacgaggugggcagcuucauggaggaggugagacaggagcuggaggaccuggagagaagccugaccgaggagauggcccugagagagcccgccgccgccgccgccgcccugcugggcggcgaggagaucuaa

SEQ ID NO: 16147 - RNA, 675 nt, Artificial Sequence
  DKK4__Homo_sapiens__XP_011542791
augguggccgccgugcugcugggccugagcuggcugugcagcccccugggcgcccuggugcuggacuucaacaacaucagaagcagcgccgaccugcacggcgccagaaagggcagccagugccugagcgacaccgacugcaacaccagaaaguucugccugcagcccagagacgagaagcccuucugcgccaccugcagaggccugagaagaagaugccagagagacgccaugugcugccccggcacccugugcgugaacgacgugugcaccaccauggaggacgccacccccauccuggagagacagcuggacgagcaggacggcacccacgccgagggcaccaccggccaccccgugcaggagaaccagcccaagagaaagcccagcaucaagaagagccagggcagaaagggccaggagggcgagagcugccugagaaccuucgacugcggccccggccugugcugcgccagacacuucuggaccaagaucugcaagcccgugcugcuggagggccaggugugcagcagaagaggccacaaggacaccgcccaggcccccgagaucuuccagagaugcgacugcggccccggccugcugugcagaagccagcugaccagcaacagacagcacgccagacugagagugugccagaagaucgagaagcuguaa

SEQ ID NO: 16148 - RNA, 636 nt, Artificial Sequence
  DKKL1__Homo_sapiens__NP_001184230
augggcgaggccagcccccccgcccccgccagaagacaccugcuggugcugcugcugcugcugagcacccuggugauccccagcgccgccgcccccauccacgacgccgacgcccaggagagcagccugggccugaccggccugcagagccugcugcagggcuucagcagacuguuccugaagggcaaccugcugagaggcaucgacagccuguucagcgcccccauggacuucagaggccugcccggcaacuaccacaaggaggagaaccaggagcaccagcugggcaacaacacccugagcagccaccugcagaucgacaaggugcccagaauggaggagaaggaggcccuggugcccauccagaaggccaccgacagcuuccacaccgagcugcaccccagaguggccuucuggaucaucaagcugcccagaagaagaagccaccaggacgcccuggagggcggccacuggcugagcgagaagagacacagacugcaggccaucagagacggccugagaaagggcacccacaaggacgugcuggaggagggcaccgagagcagcagccacagcagacugagccccagaaagacccaccugcuguacauccugagacccagcagacagcuguaa

SEQ ID NO: 16149 - RNA, 1944 nt, Artificial Sequence
  DLAT__Homo_sapiens__NP_001922
auguggagagugugcgccagaagagcccagaacguggcccccugggccggccuggaggccagauggaccgcccugcaggaggugcccggcacccccagagugaccagcagaagcggccccgcccccgccagaagaaacagcgugaccaccggcuacggcggcgugagagcccugugcggcuggacccccagcagcggcgccacccccagaaacagacugcugcugcagcugcugggcagccccggcagaagauacuacagccugcccccccaccagaaggugccccugcccagccugagccccaccaugcaggccggcaccaucgccagaugggagaagaaggagggcgacaagaucaacgagggcgaccugaucgccgagguggagaccgacaaggccaccgugggcuucgagagccuggaggagugcuacauggccaagauccugguggccgagggcaccagagacgugcccaucggcgccaucaucugcaucaccgugggcaagcccgaggacaucgaggccuucaagaacuacacccuggacagcagcgccgcccccaccccccaggccgcccccgcccccacccccgccgccaccgccagcccccccacccccagcgcccaggcccccggcagcagcuaccccccccacaugcaggugcugcugcccgcccugagccccaccaugaccaugggcaccgugcagagaugggagaagaaggugggcgagaagcugagcgagggcgaccugcuggccgagaucgagaccgacaaggccaccaucggcuucgaggugcaggaggagggcuaccuggccaagauccuggugcccgagggcaccagagacgugccccugggcaccccccugugcaucaucguggagaaggaggccgacaucagcgccuucgccgacuacagacccaccgaggugaccgaccugaagccccaggugcccccccccacccccccccccguggccgccgugccccccaccccccagccccuggcccccacccccagcgcccccugccccgccacccccgccggccccaagggcagaguguucgugagcccccuggccaagaagcuggccguggagaagggcaucgaccugacccaggugaagggcaccggccccgacggcagaaucaccaagaaggacaucgacagcuucgugcccagcaagguggcccccgcccccgccgccguggugccccccaccggccccggcauggcccccgugcccaccggcguguucaccgacauccccaucagcaacaucagaagagugaucgcccagagacugaugcagagcaagcagaccaucccccacuacuaccugagcaucgacgugaacaugggcgaggugcugcuggugagaaaggagcugaacaagauccuggagggcagaagcaagaucagcgugaacgacuucaucaucaaggccagcgcccuggccugccugaaggugcccgaggccaacagcagcuggauggacaccgugaucagacagaaccacgugguggacgugagcguggccgugagcacccccgccggccugaucacccccaucguguucaacgcccacaucaagggcguggagaccaucgccaacgacguggugagccuggccaccaaggccagagagggcaagcugcagccccacgaguuccagggcggcaccuucaccaucagcaaccugggcauguucggcaucaagaacuucagcgccaucaucaaccccccccaggccugcauccuggccaucggcgccagcgaggacaagcuggugcccgccgacaacgagaagggcuucgacguggccagcaugaugagcgugacccugagcugcgaccacagagugguggacggcgccgugggcgcccaguggcuggccgaguucagaaaguaccuggagaagcccaucaccaugcugcuguaa

SEQ ID NO: 16150 - RNA, 3276 nt, Artificial Sequence
  DLC1__Homo_sapiens__NP_006085
augugcagaaagaagcccgacaccaugauccugacccagaucgaggccaaggaggccugcgacuggcugagagccaccggcuucccccaguacgcccagcuguacgaggacuuccuguuccccaucgacaucagccuggugaagagagagcacgacuuccuggacagagacgccaucgaggcccugugcagaagacugaacacccugaacaagugcgccgugaugaagcuggagaucagcccccacagaaagagaagcgacgacagcgacgaggacgagcccugcgccaucagcggcaaguggaccuuccagagagacagcaagagauggagcagacuggaggaguucgacguguucagccccaagcaggaccuggugcccggcagccccgacgacagccaccccaaggacggccccagccccggcggcacccugauggaccugagcgagagacaggaggugagcagcgugagaagccugagcagcaccggcagccugcccagccacgccccccccagcgaggacgccgccacccccagaaccaacagcgugaucagcgugugcagcagcagcaaccuggccggcaacgacgacagcuucggcagccugcccagccccaaggagcugagcagcuucagcuucagcaugaagggccacgagaagaccgccaagagcaagaccagaagccugcugaagagaauggagagccugaagcugaagagcagccaccacagcaagcacaaggcccccagcaagcugggccugaucaucagcggccccauccugcaggagggcauggacgaggagaagcugaagcagcugaacugcguggagaucagcgcccugaacggcaacagaaucaacgugcccauggugagaaagagaagcgugagcaacagcacccagaccagcagcagcagcagccagagcgagaccagcagcgccgugagcacccccagccccgugaccagaaccagaagccugagcgccugcaacaagagagugggcauguaccuggagggcuucgaccccuucaaccagagcaccuucaacaacgugguggagcagaacuucaagaacagagagagcuaccccgaggacaccguguucuacauccccgaggaccacaagcccggcaccuuccccaaggcccugaccaacggcagcuucagccccagcggcaacaacggcagcgugaacuggagaaccggcagcuuccacggccccggccacaucagccugagaagagagaacagcagcgacagccccaaggagcugaagagaagaaacagcagcagcagcaugagcagcagacugagcaucuacgacaacgugcccggcagcauccuguacagcagcagcggcgaccuggccgaccuggagaacgaggacaucuuccccgagcuggacgacauccuguaccacgugaagggcaugcagagaaucgugaaccaguggagcgagaaguucagcgacgagggcgacagcgacagcgcccuggacagcgugagccccugccccagcagccccaagcagauccaccuggacguggacaacgacagaaccacccccagcgaccuggacagcaccggcaacagccugaacgagcccgaggagcccagcgagauccccgagagaagagacagcggcgugggcgccagccugaccagaagcaacagacacagacugagauggcacagcuuccagagcagccacagacccagccugaacagcgugagccugcagaucaacugccagagcguggcccagaugaaccugcugcagaaguacagccugcugaagcugaccgcccugcuggagaaguacacccccagcaacaagcacggcuucagcugggccgugcccaaguucaugaagagaaucaaggugcccgacuacaaggacagaagcguguucggcgugccccugaccgugaacgugcagagaaccggccagccccugccccagagcauccagcaggccaugagauaccugagaaaccacugccuggaccaggugggccuguucagaaagagcggcgugaagagcagaauccaggcccugagacagaugaacgagggcgccaucgacugcgugaacuacgagggccagagcgccuacgacguggccgacaugcugaagcaguacuucagagaccugcccgagccccugaugaccaacaagcugagcgagaccuuccugcagaucuaccaguacgugcccaaggaccagagacugcaggccaucaaggccgccaucaugcugcugcccgacgagaacagagaggugcugcagacccugcuguacuuccugagcgacgugaccgccgccgugaaggagaaccagaugacccccaccaaccuggccgugugccuggcccccagccuguuccaccugaacacccugaagagagagaacagcagccccagagugaugcagagaaagcagagccugggcaagcccgaccagaaggaccugaacgagaaccuggccgccacccagggccuggcccacaugaucgccgagugcaagaagcuguuccaggugcccgaggagaugagcagaugcagaaacagcuacaccgagcaggagcugaagccccugacccuggaggcccugggccaccugggcaacgacgacagcgccgacuaccagcacuuccugcaggacugcguggacggccuguucaaggaggugaaggagaaguucaagggcugggugagcuacagcaccagcgagcaggccgagcugagcuacaagaaggugagcgagggccccccccugagacuguggagaagcgugaucgaggugcccgccgugcccgaggagauccugaagagacugcugaaggagcagcaccugugggacguggaccugcuggacagcaaggugaucgagauccuggacagccagaccgagaucuaccaguacgugcagaacagcauggccccccaccccgccagagacuacguggugcugagaaccuggagaaccaaccugcccaagggcgccugcgcccugcugcugaccagcguggaccacgacagagcccccguggugggcgugagagugaacgugcugcugagcagauaccugaucgagcccugcggccccggcaagagcaagcugaccuacaugugcagaguggaccugagaggccacaugcccgagugguacaccaagagcuucggccaccugugcgccgccgagguggugaagaucagagacagcuucagcaaccagaacaccgagaccaaggacaccaagagcagauaa

SEQ ID NO: 16151 - RNA, 1530 nt, Artificial Sequence
  DLD__Homo_sapiens__NP_000099
augcagagcuggagcagaguguacugcagccuggccaagagaggccacuucaacagaaucagccacggccugcagggccugagcgccgugccccugagaaccuacgccgaccagcccaucgacgccgacgugaccgugaucggcagcggccccggcggcuacguggccgccaucaaggccgcccagcugggcuucaagaccgugugcaucgagaagaacgagacccugggcggcaccugccugaacgugggcugcauccccagcaaggcccugcugaacaacagccacuacuaccacauggcccacggcaaggacuucgccagcagaggcaucgagaugagcgaggugagacugaaccuggacaagaugauggagcagaagagcaccgccgugaaggcccugaccggcggcaucgcccaccuguucaagcagaacaagguggugcacgugaacggcuacggcaagaucaccggcaagaaccaggugaccgccaccaaggccgacggcggcacccaggugaucgacaccaagaacauccugaucgccaccggcagcgaggugacccccuuccccggcaucaccaucgacgaggacaccaucgugagcagcaccggcgcccugagccugaagaaggugcccgagaagaugguggugaucggcgccggcgugaucggcguggagcugggcagcguguggcagagacugggcgccgacgugaccgccguggaguuccugggccacgugggcggcgugggcaucgacauggagaucagcaagaacuuccagagaauccugcagaagcagggcuucaaguucaagcugaacaccaaggugaccggcgccaccaagaagagcgacggcaagaucgacgugagcaucgaggccgccagcggcggcaaggccgaggugaucaccugcgacgugcugcuggugugcaucggcagaagacccuucaccaagaaccugggccuggaggagcugggcaucgagcuggaccccagaggcagaauccccgugaacaccagauuccagaccaagauccccaacaucuacgccaucggcgacgugguggccggccccaugcuggcccacaaggccgaggacgagggcaucaucugcguggagggcauggccggcggcgccgugcacaucgacuacaacugcgugcccagcgugaucuacacccaccccgagguggccugggugggcaagagcgaggagcagcugaaggaggagggcaucgaguacaaggugggcaaguuccccuucgccgccaacagcagagccaagaccaacgccgacaccgacggcauggugaagauccugggccagaagagcaccgacagagugcugggcgcccacauccugggccccggcgccggcgagauggugaacgaggccgcccuggcccuggaguacggcgccagcugcgaggacaucgccagagugugccacgcccaccccacccugagcgaggccuucagagaggccaaccuggccgccagcuucggcaagagcaucaacuucuaa

SEQ ID NO: 16152 - RNA, 5268 nt, Artificial Sequence
  DLEC1__Homo_sapiens__NP_031361
auggagaccagaagcagcaagaccagaagaagccuggccagcagaaccaacgagugccagggcaccaugugggcccccaccagcccccccgccggcagcagcagccccagccagcccaccuggaagagcagccuguacagcagccuggccuacagcgaggccuuccacuacagcuucgccgccagacccagaagacugacccagcuggcccuggcccagagacccgagccccagcugcugagacugagacccagcagccugagaacccaggacaucagccaccugcugaccggcguguucagaaaccuguacagcgccgaggugaucggcgacgaggugagcgccagccugaucaaggccagaggcagcgagaacgagagacacgaggaguucguggaccagcugcagcagaucagagagcuguacaagcagagacuggacgaguucgagaugcuggagagacacaucacccaggcccaggccagagccaucgccgagaacgagagagugaugagccaggccggcgugcaggaccuggagagccuggugagacugccccccgugaagagcgugagcagauggugcaucgacagcgagcugcugagaaagcaccaccugaucagccccgaggacuacuacaccgacaccgugcccuuccacagcgcccccaagggcaucagccugcccggcugcagcaagcugaccuucagcugcgagaagagaagcgugcagaagaaggagcugaacaagaagcuggaggacagcugcagaaagaagcuggccgaguucgaggacgagcuggaccacaccguggacagccugaccuggaaccugacccccaaggccaaggagagaaccagagagccccugaagaaggccagccagcccagaaacaagaacuggaugaaccaccugagagugccccagagagagcuggacagacugcugcuggccagaauggagagcagaaaccacuuccugaagaaccccagauucuucccccccaacaccagauacggcggcaagagccugguguucccccccaagaagcccgcccccaucggcgaguuccagagcaccgagcccgagcagagcugcgccgacacccccguguuccuggccaagccccccaucggcuucuucaccgacuacgagaucggccccguguacgagauggugaucgcccugcagaacaccaccaccaccagcagauaccugagagugcugccccccagcacccccuacuucgcccugggccugggcauguuccccggcaagggcggcaugguggcccccggcaugaccugccaguacaucgugcaguucuuccccgacugccugggcgacuucgacgacuucauccugguggagacccagagcgcccacacccugcugaucccccugcaggccagaagacccccccccgugcugacccugagccccgugcuggacugcggcuacugccugaucggcggcgugaagaugaccagauucaucugcaagaacgugggcuucagcgugggcagauucugcaucaugcccaagaccagcuggcccccccugagcuucaaggccaucgccaccgugggcuucguggagcagccccccuucggcauccugcccagcguguucgagcuggcccccggccacgccauccugguggaggugcuguucagccccaagagccugggcaaggccgagcagaccuucaucaucaugugcgacaacugccagaucaaggagcuggugaccaucggcaucggccagcugaucgcccuggaccugaucuacaucagcggcgagaagagccagcccgaccccggcgagcugaccgaccugaccgcccagcacuucaucagauucgagcccgagaaccugagaagcaccgccagaaagcagcugaucaucagaaacgccacccacguggagcuggccuucuacuggcagaucaugaagcccaaccugcagccccugaugcccggcgagaccuucagcauggacagcaucaagugcuaccccgacaaggagaccgccuucagcaucaugcccagaaagggcgugcugagcccccacaccgaccacgaguucauccugagcuucagcccccacgagcugagagacuuccacagcgugcugcagauggugcuggaggaggugcccgagcccgugagcagcgaggccgagagccugggccacagcagcuacagcguggacgacgugaucgugcuggagaucgaggugaagggcagcguggagcccuuccaggugcugcuggagcccuacgcccugaucauccccggcgagaacuacaucggcaucaacgugaagaaggccuucaagauguggaacaacagcaagagccccaucagauaccuguggggcaagaucagcgacugccacaucaucgagguggagcccggcaccggcgugaucgagcccagcgaggugggcgacuucgagcugaacuucaccggcggcgugcccggccccaccagccaggaccugcugugcgagaucgaggacagccccagccccguggugcugcacaucgaggccguguucaagggccccgcccugaucaucaacgugagcgcccugcaguucggccugcugagacugggccagaaggccaccaacagcauccagaucagaaacgugagccagcugcccgccaccuggagaaugaaggagagccccgugagccugcaggagagacccgaggacgugagccccuucgacaucgagcccagcagcggccagcugcacagccugggcgagugcagaguggacaucacccuggaggcccugcacugccagcaccuggagaccgugcuggagcuggagguggagaacggcgccuggagcuaccugcccguguacgccgaggugcagaagccccacguguaccugcagagcagccagguggaggugagaaaccuguaccugggcgugcccaccaagaccaccaucacccugaucaacggcacccugcugcccacccaguuccacuggggcaagcugcugggccaccaggccgaguucugcauggugaccgugagccccaagcacggccugcugggccccagcgaggagugccagcugaagcuggagcugaccgcccacacccaggaggagcugacccaccuggcccugcccugccacgugagcggcaugaagaagccccuggugcugggcaucagcggcaagccccagggccugcagguggccaucaccaucagcaaggagagcagcgacugcagcaccgagcaguggcccggccaccccaaggagcugagacuggacuucggcagcgccgugccccugagaaccagagugaccagacagcugauccugaccaacagaagccccaucagaaccagauucagccugaaguucgaguacuucggcagcccccagaacagccugagcaagaagaccagccugcccaacaugccccccgcccugcugaagaccgugagaaugcaggagcaccuggccaagagagagcagcuggacuucauggagagcaugcugagccacggcaagggcgccgccuucuucccccacuucagccagggcaugcugggccccuaccagcagcugugcaucgacaucaccggcugcgccaacauguggggcgaguacugggacaaccugaucugcaccgugggcgaccugcugcccgaggugauccccgugcacauggccgccgugggcugccccaucagcagccugagaaccaccagcuacaccaucgaccaggcccagaaggagcccgccaugagauucggcacccaggugagcggcggcgacaccgugaccagaacccugagacugaacaacagcagccccugcgacaucagacuggacugggagaccuacgugcccgaggacaaggaggacagacugguggagcugcugguguucuacggcccccccuucccccugagagaccaggccggcaacgagcuggugugccccgacacccccgagggcggcugccugcuguggagccccggccccagcagcagcagcgaguucagccacgagaccgacagcagcguggagggcagcagcagcgccagcaacagaguggcccagaagcugaucagcgugauccugcaggcccacgagggcgugcccagcggccaccuguacugcaucagccccaagcaggugguggugcccgccggcggcagcagcaccaucuacaucagcuucacccccauggugcugagccccgagauccugcacaagguggagugcaccggcuacgcccugggcuucaugagccuggacagcaagguggagagagagauccccggcaagagacacagacugcaggacuucgccgugggcccccugaagcuggaccugcacagcuacgugagacccgcccagcugagcguggagcuggacuacggcggcagcauggaguuccagugccaggccagcgaccugauccccgagcagcccugcagcggcgugcugagcgagcuggugaccacccaccaccugaagcugaccaacaccaccgagaucccccacuacuucagacugauggugagcagacccuucagcgugagccaggacggcgccagccaggaccacagagcccccggccccggccagaagcaggagugcgaggaggagaccgccagcgccgacaagcagcuggugcugcaggcccaggagaacaugcuggugaacgugagcuucagccugagccuggagcugcugagcuaccagaagcugcccgccgaccagacccugcccggcguggacauccagcagagcgccagcggcgagagagagaugguguucacccagaaccugcugcuggaguacaccaaccagaccacccagguggugccccugagagccgugguggccgugcccgagcugcagcugagcaccagcuggguggacuucggcaccugcuucgugagccagcagagagugagagagguguaccugaugaaccugagcggcugcagaagcuacuggaccaugcugaugggccagcaggagcccgccaaggccgccguggccuucagagugagccccaacagcggccugcuggaggccagaagcgccaacgccccccccaccagcaucgcccugcagguguucuucaccgccagaagcagcgagcuguacgagagcaccauggugguggagggcgugcugggcgagaagagcugcacccugagacugagaggccagggcagcuacgacgagagauacaugcugccccaccagcccuaa

SEQ ID NO: 16153 - RNA, 483 nt, Artificial Sequence
  DLEU7__Homo_sapiens__NP_945340
auggccagccccgccccccugguggccagcaucagccaccagaugguggcccugcagacccugcagcugcugcagcaggaguggggcuggggcgacggccccguggcccccggcaaccccagagaccccgaccacgugagcaccgcccccgccagaagaagcggcccccccagagccagacccggccccggcagagaggagagaggcggcggcgugggcaccagaagcagaagaaccgccgccagagccaacagccccgaggaggagguggugagaggcgccgagggcggcgccgagcugcugcccuuccccagagacagaggccccugcacccuggcccagauggccaugagaagcgcccuggccagagugguggacagcaccagcgagcuggugagcguggagcagacccugcugggcccccugcagcaggagagaagcuuccccauccaccugaagcugcagcugcuggccaacgaguaa

SEQ ID NO: 16154 - RNA, 2679 nt, Artificial Sequence
  DLG1__Homo_sapiens__NP_001191315
augcccgugagaaagcaggacacccagagagcccugcaccugcuggaggaguacagaagcaagcugagccagaccgaggacagacagcugagaagcagcaucgagagagugaucaacaucuuccagagcaaccuguuccaggcccugaucgacauccaggaguucuacgaggugacccugcuggacaaccccaagugcaucgacagaagcaagcccagcgagcccauccagcccgugaacaccugggagaucagcagccugcccagcagcaccgugaccagcgagacccugcccagcagccugagccccagcguggagaaguacagauaccaggacgaggacacccccccccaggagcacaucagcccccagaucaccaacgaggugaucggccccgagcuggugcacgugagcgagaagaaccugagcgagaucgagaacgugcacggcuucgugagccacagccacaucagccccaucaaggccaaccccccccccgugcuggugaacaccgacagccuggagacccccaccuacgugaacggcaccgacgccgacuacgaguacgaggagaucacccuggagagaggcaacagcggccugggcuucagcaucgccggcggcaccgacaacccccacaucggcgacgacagcagcaucuucaucaccaagaucaucaccggcggcgccgccgcccaggacggcagacugagagugaacgacugcauccugagagugaacgagguggacgugagagacgugacccacagcaaggccguggaggcccugaaggaggccggcagcaucgugagacuguacgugaagagaagaaagcccgugagcgagaagaucauggagaucaagcugaucaagggccccaagggccugggcuucagcaucgccggcggcgugggcaaccagcacauccccggcgacaacagcaucuacgugaccaagaucaucgagggcggcgccgcccacaaggacggcaagcugcagaucggcgacaagcugcuggccgugaacaacgugugccuggaggaggugacccacgaggaggccgugaccgcccugaagaacaccagcgacuucguguaccugaagguggccaagcccaccagcauguacaugaacgacggcuacgccccccccgacaucaccaacagcagcagccagcccguggacaaccacgugagccccagcagcuuccugggccagacccccgccagccccgccagauacagccccgugagcaaggccgugcugggcgacgacgagaucaccagagagcccagaaagguggugcugcacagaggcagcaccggccugggcuucaacaucgugggcggcgaggacggcgagggcaucuucaucagcuucauccuggccggcggccccgccgaccugagcggcgagcugagaaagggcgacagaaucaucagcgugaacagcguggaccugagagccgccagccacgagcaggccgccgccgcccugaagaacgccggccaggccgugaccaucguggcccaguacagacccgaggaguacagcagauucgaggccaagauccacgaccugagagagcagaugaugaacagcagcaucagcagcggcagcggcagccugagaaccagccagaagagaagccuguacgugagagcccuguucgacuacgacaagaccaaggacagcggccugcccagccagggccugaacuucaaguucggcgacauccugcacgugaucaacgccagcgacgacgagugguggcaggccagacaggugacccccgacggcgagagcgacgaggugggcgugauccccagcaagagaagaguggagaagaaggagagagccagacugaagaccgugaaguucaacagcaagaccagagacaagggcagcuucaacgacaagagaaagaagaaccuguucagcagaaaguuccccuucuacaagaacaaggaccagagcgagcaggagaccagcgacgccgaccagcacgugaccagcaacgccagcgacagcgagagcagcuacagaggccaggaggaguacgugcugagcuacgagcccgugaaccagcaggaggugaacuacaccagacccgugaucauccugggccccaugaaggacagaaucaacgacgaccugaucagcgaguuccccgacaaguucggcagcugcgugccccacaccaccagacccaagagagacuacgagguggacggcagagacuaccacuucgugaccagcagagagcagauggagaaggacauccaggagcacaaguucaucgaggccggccaguacaacaaccaccuguacggcaccagcgugcagagcgugagagagguggccgagaagggcaagcacugcauccuggacgugagcggcaacgccaucaagagacugcagaucgcccagcuguaccccaucagcaucuucaucaagcccaagagcauggagaacaucauggagaugaacaagagacugaccgaggagcaggccagaaagaccuucgagagagccaugaagcuggagcaggaguucaccgagcacuucaccgccaucgugcagggcgacacccuggaggacaucuacaaccaggugaagcagaucaucgaggagcagagcggcagcuacaucugggugcccgccaaggagaagcuguaa

SEQ ID NO: 16155 - RNA, 2250 nt, Artificial Sequence
  DLG2__Homo_sapiens__NP_001136172
augcagagacccagcgugagcagagccgagaacuaccagcugcugugggacaccaucgccagccugaagcagugcgagcaggccaugcagcacgccuucauccccgugaacggcaccgagaucgaguacgaguucgaggagaucacccuggagagaggcaacagcggccugggcuucagcaucgccggcggcaccgacaacccccacaucggcgacgaccccggcaucuucaucaccaagaucauccccggcggcgccgccgccgaggacggcagacugagagugaacgacugcauccugagagugaacgagguggacgugagcgaggugagccacagcaaggccguggaggcccugaaggaggccggcagcaucgugagacuguacgugagaagaagaagacccauccuggagaccgugguggagaucaagcuguucaagggccccaagggccugggcuucagcaucgccggcggcgugggcaaccagcacauccccggcgacaacagcaucuacgugaccaagaucaucgacggcggcgccgcccagaaggacggcagacugcaggugggcgacagacugcugauggugaacaacuacagccuggaggaggugacccacgaggaggccguggccauccugaagaacaccagcgaggugguguaccugaaggugggcaagcccaccaccaucuacaugaccgaccccuacggcccccccgacaucacccacagcuacagcccccccauggagaaccaccugcugagcggcaacaacggcacccuggaguacaagaccagccugccccccaucagccccggcagauacagccccauccccaagcacaugcugguggacgacgacuacaccagccacagccagcacagcaccgccaccagacagcccagcaugacccugcagagagccgugagccuggagggcgagcccagaaagguggugcugcacaagggcagcaccggccugggcuucaacaucgugggcggcgaggacggcgagggcaucuucgugagcuucauccuggccggcggccccgccgaccugagcggcgagcugcagagaggcgaccagauccugagcgugaacggcaucgaccugagaggcgccagccacgagcaggccgccgccgcccugaagggcgccggccagaccgugaccaucaucgcccaguaccagcccgaggacuacgccagauucgaggccaagauccacgaccugagagagcagaugaugaaccacagcaugagcagcggcagcggcagccugagaaccaaccagaagagaagccuguacgugagagccauguucgacuacgacaagagcaaggacagcggccugcccagccagggccugagcuucaaguacggcgacauccugcacgugaucaacgccagcgacgacgagugguggcaggccagaagagugaugcuggagggcgacagcgaggagaugggcgugauccccagcaagagaagaguggagagaaaggagagagccagacugaagaccgugaaguucaacgccaagcccggcgugaucgacagcaagggcgacauccccggccugggcgacgacggcuacggcaccaagacccugagaggccaggaggaccugauccugagcuacgagcccgugaccagacaggagaucaacuacaccagacccgugaucauccugggccccaugaaggacagaaucaacgacgaccugaucagcgaguuccccgacaaguucggcagcugcgugccccacaccaccagacccaagagagacuacgagguggacggcagagacuaccacuucgugaucagcagagagcagauggagaaggacauccaggagcacaaguucaucgaggccggccaguacaacgacaaccuguacggcaccagcgugcagagcgugagauucguggccgagagaggcaagcacugcauccuggacgugagcggcaacgccaucaagagacugcagguggcccagcuguaccccaucgccaucuucaucaagcccagaagccuggagccccugauggagaugaacaagagacugaccgaggagcaggccaagaagaccuacgacagagccaucaagcuggagcaggaguucggcgaguacuucaccgccaucgugcagggcgacacccuggaggacaucuacaaccagugcaagcuggugaucgaggagcagagcggccccuucaucuggauccccagcaaggagaagcuguaa

SEQ ID NO: 16156 - RNA, 1101 nt, Artificial Sequence
  DLG3__Homo_sapiens__NP_001159750
augaugaacagcagcaugagcagcggcagcggcagccugagaaccagcgagaagagaagccuguacgugagagcccuguucgacuacgacagaaccagagacagcugccugcccagccagggccugagcuucagcuacggcgacauccugcacgugaucaacgccagcgacgacgagugguggcaggccagacuggugaccccccacggcgagagcgagcagaucggcgugauccccagcaagaagagaguggagaagaaggagagagccagacugaagaccgugaaguuccacgccagaaccggcaugaucgagagcaacagaagcaucaagaccaagagaaagaagagcuucagacugagcagaaaguuccccuucuacaagagcaaggagaacauggcccaggagagcagcauccaggagcagggcgugaccagcaacaccagcgacagcgagagcagcagcaagggccaggaggacgccauccugagcuacgagcccgugaccagacaggagauccacuacgccagacccgugaucauccugggccccaugaaggacagagugaacgacgaccugaucagcgaguucccccacaaguucggcagcugcgugccccacaccaccagacccagaagagacaacgagguggacggccaggacuaccacuucguggugagcagagagcagauggagaaggacauccaggacaacaaguucaucgaggccggccaguucaacgacaaccuguacggcaccagcauccagagcgugagagccguggccgagagaggcaagcacugcauccuggacgugagcggcaacgccaucaagagacugcagcaggcccagcuguaccccaucgccaucuucaucaagcccaagagcaucgaggcccugauggagaugaacagaagacagaccuacgagcaggccaacaagaucuacgacaaggccaugaagcuggagcaggaguucggcgaguacuucaccgccaucgugcagggcgacagccuggaggagaucuacaacaagaucaagcagaucaucgaggaccagagcggccacuacaucugggugcccagccccgagaagcuguaa

SEQ ID NO: 16157 - RNA, 2166 nt, Artificial Sequence
  DLG4__Homo_sapiens__NP_001122299
auggacugccugugcaucgugaccaccaagaaguacagauaccaggacgaggacacccccccccuggagcacagccccgcccaccugcccaaccaggccaacagcccccccgugaucgugaacaccgacacccuggaggcccccggcuacgugaacggcaccgagggcgagauggaguacgaggagaucacccuggagagaggcaacagcggccugggcuucagcaucgccggcggcaccgacaacccccacaucggcgacgaccccagcaucuucaucaccaagaucauccccggcggcgccgccgcccaggacggcagacugagagugaacgacagcauccuguucgugaacgagguggacgugagagaggugacccacagcgccgccguggaggcccugaaggaggccggcagcaucgugagacuguacgugaugagaagaaagccccccgccgagaaggugauggagaucaagcugaucaagggccccaagggccugggcuucagcaucgccggcggcgugggcaaccagcacauccccggcgacaacagcaucuacgugaccaagaucaucgagggcggcgccgcccacaaggacggcagacugcagaucggcgacaagauccuggccgugaacagcgugggccuggaggacgugaugcacgaggacgccguggccgcccugaagaacaccuacgacgugguguaccugaagguggccaagcccagcaacgccuaccugagcgacagcuacgccccccccgacaucaccaccagcuacagccagcaccuggacaacgagaucagccacagcagcuaccugggcaccgacuaccccaccgccaugacccccaccagccccagaagauacagccccguggccaaggaccugcugggcgaggaggacauccccagagagcccagaagaaucgugauccacagaggcagcaccggccugggcuucaacaucgugggcggcgaggacggcgagggcaucuucaucagcuucauccuggccggcggccccgccgaccugagcggcgagcugagaaagggcgaccagauccugagcgugaacggcguggaccugagaaacgccagccacgagcaggccgccaucgcccugaagaacgccggccagaccgugaccaucaucgcccaguacaagcccgaggaguacagcagauucgaggccaagauccacgaccugagagagcagcugaugaacagcagccugggcagcggcaccgccagccugagaagcaaccccaagagaggcuucuacaucagagcccuguucgacuacgacaagaccaaggacugcggcuuccugagccaggcccugagcuucagauucggcgacgugcugcacgugaucgacgccagcgacgaggagugguggcaggccagaagagugcacagcgacagcgagaccgacgacaucggcuucauccccagcaagagaagaguggagagaagagaguggagcagacugaaggccaaggacuggggcagcagcagcggcagccagggcagagaggacagcgugcugagcuacgagaccgugacccagauggaggugcacuacgccagacccaucaucauccugggccccaccaaggacagagccaacgacgaccugcugagcgaguuccccgacaaguucggcagcugcgugccccacaccaccagacccaagagagaguacgagaucgacggcagagacuaccacuucgugagcagcagagagaagauggagaaggacauccaggcccacaaguucaucgaggccggccaguacaacagccaccuguacggcaccagcgugcagagcgugagagagguggccgagcagggcaagcacugcauccuggacgugagcgccaacgccgugagaagacugcaggccgcccaccugcaccccaucgccaucuucaucagacccagaagccuggagaacgugcuggagaucaacaagagaaucaccgaggagcaggccagaaaggccuucgacagagccaccaagcuggagcaggaguucaccgagugcuucagcgccaucguggagggcgacagcuucgaggagaucuaccacaaggugaagagagugaucgaggaccugagcggccccuacaucugggugcccgccagagagagacuguaa

SEQ ID NO: 16158 - RNA, 5760 nt, Artificial Sequence
  DLG5__Homo_sapiens__NP_004738
auggagccccagagaagagagcugcuggcccagugccagcagagccuggcccaggccaugaccgagguggaggccgugcugggccugcuggaggccgccggcgcccugagccccggcgagagaagacagcuggacgaggaggccggcggcgccaaggccgagcugcugcugaagcugcugcuggccaaggagagagaccacuuccaggaccugagagccgcccuggagaagacccagccccaccugcugcccauccuguaccugaacggcguggugggccccccccagcccgccgagggcgccggcagcaccuacagcgugcugagcaccaugcccagcgacagcgagagcagcagcagccugagcagcgugggcaccaccggcaaggcccccagcccccccccccugcugaccgaccagcaggugaacgagaagguggagaaccugagcauccagcugagacugaugaccagagagagaaacgagcugagaaagagacuggccuucgccacccacggcaccgccuucgacaagagacccuaccacagacugaaccccgacuacgagagacugaagauccagugcgugagagccaugagcgaccugcagagccugcagaaccagcacaccaacgcccugaagagaugcgaggagguggccaaggagaccgacuucuaccacacccugcacagcagacugcugagcgaccagaccagacugaaggacgacguggacaugcugagaagagagaacggccagcugcugagagagagaaaccugcugcagcagagcugggaggacaugaagagacugcacgaggaggaccagaaggagaucggcgaccugagagcccagcagcagcaggugcugaagcacaacggcagcagcgagauccugaacaagcuguacgacaccgccauggacaagcuggagguggugaagaaggacuacgacgcccugagaaagagauacagcgagaagguggccauccacaacgccgaccugagcagacuggagcagcugggcgaggagaaccagagacugcugaagcagaccgagaugcugacccagcagagagacaccgccauccagcugcagcaccagugcgcccugagccugagaagauucgaggccauccaccacgagcugaacaaggccaccgcccagaacaaggaccugcagugggagauggagcugcugcagagcgagcugaccgagcugagaaccacccaggugaagaccgccaaggagagcgagaaguacagagaggagagagacgccguguacagcgaguacaagcugaucaugagcgagagagaccaggugaucagcgagcuggacaagcugcagaccgagguggagcuggccgagagcaagcugaagagcagcaccagcgagaagaaggccgccaacgaggagauggaggcccugagacagaucaaggacaccgugaccauggacgccggcagagccaacaaggagguggagauccugagaaagcagugcaaggcccugugccaggagcugaaggaggcccugcaggaggccgacguggccaagugcagaagagacugggccuuccaggagagagacaagaucguggccgagagagacagcaucagaacccugugcgacaaccugagaagagagagagacagagccgugagcgagcuggccgaggcccugagaagccuggacgacaccagaaagcagaagaacgacgugagcagagagcugaaggagcugaaggagcagauggagagccagcuggagaaggaggccagauucagacagcugauggcccacagcagccacgacagcgccaucgacaccgacagcauggagugggagaccgaggugguggaguucgagagagagaccgaggacaucgaccugaaggcccugggcuucgacauggccgagggcgugaacgagcccugcuuccccggcgacugcggcaucuucgugaccaagguggacaagggcagcaucgccgacggcagacugagagugaacgacuggcugcugagaaucaacgacguggaccugaucaacaaggacaagaagcaggccaucaaggcccugcugaacggcgagggcgccaucaacaugguggugagaagaagaaagagccugggcggcaagguggugaccccccugcacaucaaccugagcggccagaaggacagcggcaucagccuggagaacggcguguacgccgccgccgugcugcccggcagccccgccgccaaggagggcagccuggccgugggcgacagaaucguggccaucaacggcaucgcccuggacaacaagagccugaacgagugcgagagccugcugagaagcugccaggacagccugacccugagccugcugaagguguucccccagagcagcagcuggagcggccagaacaucuucgagaacaucaaggacagcgacaagaugcugagcuucagagcccacggccccgaggugcaggcccacaacaagagaaaccugauccagcacaacaacagcacccagaccgacaucuucuacaccgacagacuggaggacagaaaggagcccggcccccccggcggcagcagcagcuuccugcacaagcccuuccccggcggcccccugcaggugugcccccaggccugccccagcgccagcgagagaagccugagcagcuucagaagcgacgccagcggcgacagaggcuucggccugguggacgugagaggcagaagaccccugcugcccuucgagaccgaggugggccccugcggcgugggcgaggccagccuggacaaggccgacagcgagggcagcaacagcggcggcaccuggcccaaggccaugcugagcagcaccgccgugcccgagaagcugagcguguacaagaagcccaagcagagaaagagcaucuucgaccccaacaccuucaagagaccccagaccccccccaagaucgacuaccugcugcccggccccggccccgcccacagcccccagcccagcaagagagccggcccccugaccccccccaagccccccagaagaagcgacagcaucaaguuccagcacagacuggagaccagcagcgagagcgaggccacccuggugggcagcagccccagcaccagcccccccagcgcccugccccccgacguggaccccggcgagcccaugcacgccagcccccccagaaaggccagagugagaaucgccagcagcuacuaccccgagggcgacggcgacagcagccaccugcccgccaagaagagcugcgacgaggaccugaccagccagaagguggacgagcugggccagaagagaagaagacccaagagcgcccccagcuucagacccaagcuggcccccguggugauccccgcccaguuccuggaggagcagaagugcgugcccgccagcggcgagcugagccccgagcugcaggagugggcccccuacagccccggccacagcagcagacacagcaaccccccccuguaccccagcagacccagcgugggcaccgugcccagaagccugacccccagcaccaccgugagcagcauccugagaaaccccaucuacaccgugagaagccacagagugggccccugcagcagcccccccgccgccagagacgccggcccccagggccugcaccccagcgugcagcaccagggcagacugagccuggaccugagccacagaaccugcagcgacuacagcgagaugagagccacccacggcagcaacagccugcccagcagcgccagacugggcagcagcagcaaccugcaguucaaggccgagagaaucaagauccccagcacccccagauaccccagaagcguggugggcagcgagagaggcagcgugagccacagcgagugcagcacccccccccagagcccccugaacaucgacacccugagcagcugcagccagagccagaccagcgccagcacccugcccagaaucgccgugaaccccgccagccugggcgagagaagaaaggacagacccuacguggaggagcccagacacgugaaggugcagaagggcagcgagccccugggcaucagcaucgugagcggcgagaagggcggcaucuacgugagcaaggugaccgugggcagcaucgcccaccaggccggccuggaguacggcgaccagcugcuggaguucaacggcaucaaccugagaagcgccaccgagcagcaggccagacugaucaucggccagcagugcgacaccaucaccauccuggcccaguacaacccccacgugcaccagcugagcagccacagcagaagcagcagccaccuggaccccgccggcacccacagcacccugcagggcagcggcaccaccacccccgagcaccccagcgugaucgacccccugauggagcaggacgagggccccagcaccccccccgccaagcagagcagcagcagaaucgccggcgacgccaacaagaagacccuggagcccagagugguguucaucaagaagagccagcuggagcugggcgugcaccugugcggcggcaaccugcacggcguguucguggccgagguggaggacgacagccccgccaagggccccgacggccuggugcccggcgaccugauccuggaguacggcagccuggacgugagaaacaagaccguggaggagguguacguggagaugcugaagcccagagacggcgugagacugaaggugcaguacagacccgaggaguucaccaaggccaagggccugcccggcgacagcuucuacaucagagcccuguacgacagacuggccgacguggagcaggagcugagcuucaagaaggacgacauccuguacguggacgacacccugccccagggcaccuucggcagcuggauggccuggcagcuggacgagaacgcccagaagauccagagaggccagauccccagcaaguacgugauggaccaggaguucagcagaagacugagcaugagcgaggugaaggacgacaacagcgccaccaagacccugagcgccgccgccagaagaagcuucuucagaagaaagcacaagcacaagagaagcggcagcaaggacggcaaggaccugcuggcccuggacgccuucagcagcgacagcaucccccuguucgaggacagcgugagccuggccuaccagagagugcagaagguggacugcaccgcccugagacccgugcugauccugggcccccugcuggacguggugaaggagaugcuggugaacgaggcccccggcaaguucugcagaugcccccuggaggugaugaaggccagccagcaggccaucgagagaggcgugaaggacugccuguucguggacuacaagagaagaagcggccacuucgacgugaccaccguggccagcaucaaggagaucaccgagaagaacagacacugccugcuggacaucgccccccacgccaucgagagacugcaccacaugcacaucuaccccaucgugaucuucauccacuacaagagcgccaagcacaucaaggagcagagagaccccaucuaccugagagacaaggugacccagagacacagcaaggagcaguucgaggccgcccagaagcuggagcaggaguacagcagauacuucaccggcgugauccagggcggcgcccugagcagcaucugcacccagauccuggccauggugaaccaggagcagaacaaggugcuguggauccccgccugcccccuguaa

SEQ ID NO: 16159 - RNA, 2028 nt, Artificial Sequence
  DLGAP1__Homo_sapiens__NP_001003809
augaaccugaucuuccacaaggacauccuguucggcauccccgccaacaaggugccccaggacgaguggaccggcuacacccccagaggcaaggacgacgagauccccugcagaagaaugagaagcggcagcuacaucaaggccaugggcgacgaggacagcggcgacagcgacaccagccccaagcccagccccaagguggccgccagaagagagagcuaccugaaggccacccagcccagccugaccgagcugaccacccugaagaucagcaacgagcacagccccaagcugcagaucagaagccacagcuaccugagagccgugagcgaggugagcaucaacagaagccuggacagccuggaccccgccggccugcugaccagccccaaguucagaagcagaaacgagagcuacaugagagccaugagcaccaucagccaggugagcgagauggaggugaacggccaguucgagagcgugugcgagagcguguucagcgagcuggagagccaggccguggaggcccuggaccugcccaugcccggcugcuucagaaugagaagccacagcuacgugagagccaucgagaagggcugcagccaggacgacgagugcgugagccugagaagcagcagcccccccagaaccaccaccaccgugagaaccauccagagcagcaccgugagcagcugcaucaccaccuacaagaagacccccccccccgugccccccagaaccaccaccaagcccuucaucagcaucaccgcccagagcagcaccgagagcgcccaggacgccuacauggacggccagggccagagaggcgacaucaucagccagagcggccugagcaacagcaccgagagccuggacagcaugaaggcccugaccgccgccaucgaggccgccaacgcccagauccacggccccgccagccagcacaugggcaacaacaccgccaccgugaccaccaccaccaccaucgccaccgugaccaccgaggacagaaagaaggaccacuucaagaagaacagaugccugagcaucggcauccagguggacgacgccgaggagcccgacaagaccggcgagaacaaggcccccagcaaguuccagagcgugggcgugcagguggaggaggagaagugcuucagaagauucaccagaagcaacagcgugaccaccgccgugcaggccgaccuggacuuccacgacaaccuggagaacagccuggagagcaucgaggacaacagcugccccggccccauggccagacaguucagcagagacgccagcaccagcaccgugagcauccagggcagcggcaaccacuaccacgccugcgccgccgacgacgacuucgacaccgacuucgaccccagcauccugcccccccccgaccccuggaucgacagcaucaccgaggacccccuggaggccgugcagagaagcgugugccacagagacggccacugguuccugaagcugcugcaggccgagagagacagaauggagggcuggugccagcagauggagagagaggagagagagaacaaccugcccgaggacauccugggcaagaucagaaccgccgugggcagcgcccagcugcugauggcccagaaguucuaccaguucagagagcugugcgaggagaaccugaaccccaacgcccaccccagacccaccagccaggaccuggccggcuucugggacaugcugcagcugagcaucgagaacaucagcaugaaguucgacgagcugcaccagcugaaggccaacaacuggaagcagauggacccccuggacaagaaggagagaagagcccccccccccgugcccaagaagcccgccaagggccccgccccccugaucagagagagaagccuggagagcagccagagacaggaggccagaaagagacugauggccgccaagagagccgccagcgugagacagaacagcgccaccgagagcgccgagagcaucgagaucuacauccccgaggcccagaccagacuguaa

SEQ ID NO: 16160 - RNA, 2928 nt, Artificial Sequence
  DLGAP2__Homo_sapiens__XP_011533064
augaagggccugagcggcagcagaacccagcccccccugugcagcggccacaccugcggccuggccccccccgaggacugcgagcaccugcaccacggccccgacgccagaccccccuaccugcugagccccgccgacagcugccccggcggcagacacagaugcagccccagaagcagcgugcacagcgagugcgugaugaugcccguggugcugggcgaccacgugagcagcagcaccuuccccagaaugcacuacagcagccacuacgacaccagagacgacugcgccguggcccacgccggcgccaagaucaacagaauccccgccaaccugcuggaccaguucgagaagcagcugccccugcacagagacggcuuccacacccugcaguaccagagaaccagcgccgccgccgagcagagaagcgagagccccggcagaaucagacaccuggugcacagcgugcagaagcuguucaccaagagccacagccuggagggcagcagcaagagcaacgccaacggcaccaaggccgacggcagagccgacgaccaccaccacgcccaccacgccaagcacagcaagagaagcaagagcaaggagagaaagcccgagggcaagcccagacccggcaugagcagcugguggagcagcgacgacaaccuggacagcgacagcaccuacagaacccccagcgugcugaacagacaccaccugggccccguggcccacugcuaccccgacgcccugcagagccccuucggcgaccugagccugaagaccagcaagagcaacaacgacgugaagugcagcgccugcgagggccuggcccugacccccgacgccaaguaccugaagagaagcagcuggagcacccugaccgugagccaggccaaggaggccuacagaaagagcagccugaaccuggacaagccccugcugcaccaggacgccaagcccgcccugagacccugccacuaccugcaggugccccaggacgaguggggcggcuaccccaccggcggcaaggacgaggagauccccugcagaagaaugagaagcggcagcuacaucaaggccaugggcgacgaggagagcggcgagagcgacagcagccccaagaccagccccaagagcgccauccugcccgagccccugcugaagagcaucggccagagaccccugggcgagcaccagacccagaccuaccugcaggccgccagcgacgugcccgugggccacagccuggaccccgccgccaacuacaacagccccaaguucagaagcagaaaccagagcuacaugagagccgugagcacccugagccaggccagcugcgugagccaggugagcgaggccgagaucaacggccaguucgagagcgugugcgagagcguguucagcgagguggagagccaggccauggacgcccuggaccugcccggcugcuucagaaccagaagccacagcuaccugagagccauccaggccggcuacagccaggacgacgagugcauccccaugaugacccccagcgacaucaccagcaccaucagaagcaccgccgccgugagcuacaccaacuacaagaagacccccccccccgugccccccagaaccaccagcaagccccugaucagcgugaccgcccagagcagcaccgagagcacccaggacgccuaccaggacagcagagcccagagaaugagccccuggccccaggacagcagaggccuguacaacagcaccgacagccuggacagcaacaaggccaugaaccuggcccuggagaccgccgccgcccagagacaccugcccgagagccagagcagcagcgugagaaccagcgacaaggccauccuggugagcaaggccgaggagcugcugaagagcagaugcagcagcaucggcauccaggacagcgaguuccccgagcaccagcccuaccccagaagcgacguggagaccgccaccgacagcgacaccgagagcagaggccugagagaguaccacagcgugggcgugcagguggaggacgagaagagacacggcagauucaagagaagcaacagcgugaccgccgccgugcaggccgaccuggagcuggagggcuuccccggccacaucaccaccgaggacaagggccugcaguucggcagcagcuuccagagacacagcgagcccagcacccccacccaguacagcgccgugagaaccgugagaacccagggccuguucagcuacagagaggacuacagaacccagguggacaccagcacccugcccccccccgaccccuggcuggagcccgccaucgacaccguggagaccggcagaaugagccccugcagaagagacggcagcugguuccugaagcugcugcacgccgagaccaagagaauggagggcuggugcaaggagauggagagagaggccgaggagaacgaccugagcgaggagauccugggcaagaucagaagcgccgugggcagcgcccagcugcugaugagccagaaguuccagcaguucuacuggcugugccagcagaacauggaccccagcgccaugcccagacccaccagccaggaccuggccggcuacugggacaugcugcagcugagcaucgaggacgugagcaugaaguucgacgagcugcagagacugagacugaacgacuggaagaugauggagagccccgagagaaaggaggagagaaaggugcccccccccauccccaagaagccccccaagggcaaguuccccaucaccagagagaagagccuggaccugcccgacagacagagacaggaggccagaagaagacugauggccgccaagagagccgccagcuucagacagaacagcgccagcgagagagccgacagcaucgagaucuacauccccgaggcccagaccagacuguaa

SEQ ID NO: 16161 - RNA, 2940 nt, Artificial Sequence
  DLGAP3__Homo_sapiens__XP_011540181
augagaggcuaccacggcgacagaggcagccaccccagacccgccagauucgccgaccagcagcacauggacgugggccccgccgccagagcccccuaccugcugggcagcagagaggccuucagcaccgagcccagauucugcgcccccagagccggccugggccacaucagccccgagggcccccugagccugagcgagggccccagcgugggccccgagggcggccccgccggcgccggcgugggcggcggcagcagcaccuuccccagaauguaccccggccagggccccuucgacaccugcgaggacugcgugggccacccccagggcaagggcgcccccagacugccccccacccugcuggaccaguucgagaagcagcugcccgugcagcaggacggcuuccacacccugcccuaccagagaggccccgccggcgccggccccggccccgcccccggcaccggcaccgcccccgagcccagaagcgagagccccagcagaaucagacaccuggugcacagcgugcagaagcuguucgccaagagccacagccuggaggcccccggcaagagagacuacaacggccccaaggccgagggcagaggcggcagcggcggcgacagcuaccccggccccggcagcggcggcccccacaccagccaccaccaccaccaccaccaccaccaccaccaccaccagagcagacacggcaagagaagcaagagcaaggacagaaagggcgacggcagacaccaggccaagagcaccggcugguggagcagcgacgacaaccuggacagcgacagcggcuuccuggccggcggcagaccccccggcgagcccggcggccccuucugccuggagggccccgacggcagcuacagagaccugagcuucaagggcagaagcggcggcagcgagggcagaugccuggccugcaccggcaugagcaugagccuggacggccagagcgugaagagaagcgccuggcacaccaugauggugagccagggcagagacggcuaccccggcgccggccccggcaagggccugcugggccccgagaccaaggccaaggccagaaccuaccacuaccugcaggugccccaggacgacuggggcggcuaccccaccggcggcaaggacggcgagauccccugcagaagaaugagaagcggcagcuacaucaaggccaugggcgacgaggagagcggcgacagcgacggcagccccaagaccagccccaaggccguggccagaagauucaccaccagaagaagcagcagcguggaccaggccagaaucaacugcugcgugccccccagaauccaccccagaagcagcauccccggcuacagcagaagccugaccaccggccagcugagcgacgagcugaaccagcagcuggaggccgugugcggcagcguguucggcgagcuggagagccaggccguggacgcccuggaccugcccggcugcuucagaaugagaagccacagcuaccugagagccauccaggccggcugcagccaggacgacgacugccugccccugcuggccacccccgccgccgugagcggcagacccggcagcagcuucaacuucagaaaggcccccccccccaucccccccggcagccaggccccccccagaaucagcaucaccgcccagagcagcaccgacagcgcccacgagagcuucaccgccgccgagggccccgccagaagaugcagcagcgccgacggccuggacggccccgccaugggcgccagaacccuggagcuggcccccgugccccccagagccagccccaagccccccacccugaucaucaagaccauccccggcagagaggagcugagaagccuggccagacagagaaaguggagacccagcaucggcgugcagguggagaccaucagcgacagcgacaccgagaacagaagcagaagagaguuccacagcaucggcgugcagguggaggaggacaagagaagagccagauucaagagaagcaacagcgugaccgccggcgugcaggccgaccuggagcuggagggccuggccggccuggccaccguggccaccgaggacaaggcccugcaguucggcagaagcuuccagagacacgccagcgagccccagcccggccccagagcccccaccuacagcguguucagaaccgugcacacccagggccagugggccuacagagagggcuacccccugcccuacgagccccccgccaccgacggcagccccggccccgcccccgcccccacccccggccccggcgccggcagaagagacagcuggaucgagagaggcagcagaagccugcccgacagcggcagagccagccccugccccagagacggcgagugguucaucaagaugcugagagccgagguggagaagcuggagcacuggugccagcagauggagagagaggccgaggacuacgagcugcccgaggagauccuggagaagaucagaagcgccgugggcagcacccagcugcugcugagccagaaggugcagcaguucuucagacugugccagcagagcauggaccccaccgccuuccccgugcccaccuuccaggaccuggccggcuucugggaccugcugcagcugagcaucgaggacgugacccugaaguuccuggagcugcagcagcugaaggccaacagcuggaagcugcuggagcccaaggaggagaagaaggugcccccccccauccccaagaagccccugagaggcagaggcgugcccgugaaggagagaagccuggacagcguggacagacagagacaggaggccagaaagagacugcuggccgccaagagagccgccagcuucagacacagcagcgccaccgagagcgccgacagcaucgagaucuacauccccgaggcccagaccagacuguaa

SEQ ID NO: 16162 - RNA, 2529 nt, Artificial Sequence
  DLGAP5__Homo_sapiens__NP_001139487
augagcagcagccacuucgccagcagacacagaaaggacaucagcaccgagaugaucagaaccaagaucgcccacagaaagagccugagccagaaggagaacagacacaaggaguacgagagaaacagacacuucggccugaaggacgugaacauccccacccuggagggcagaauccugguggagcuggacgagaccagccagggccuggugcccgagaagaccaacgugaagcccagagccaugaagaccauccugggcgaccagagaaagcagaugcugcagaaguacaaggaggagaagcagcugcagaagcugaaggagcagagagagaaggccaagagaggcaucuucaaggugggcagauacagacccgacaugcccugcuuccugcugagcaaccagaacgccgugaaggccgagcccaagaaggccauccccagcagcgugagaaucaccagaagcaaggccaaggaccagauggagcagaccaagaucgacaacgagagcgacgugagagccaucagacccggccccagacagaccagcgagaagaaggugagcgacaaggagaagaagguggugcagcccgugaugcccaccagccugagaaugaccagaagcgccacccaggccgccaagcaggugcccagaaccgugagcagcaccaccgccagaaagcccgugaccagagccgccaacgagaacgagcccgagggcaaggugcccagcaagggcagacccgccaagaacguggagaccaagcccgacaagggcaucagcugcaagguggacagcgaggagaacacccugaacagccagaccaacgccaccagcggcaugaaccccgacggcgugcugagcaagauggagaaccugcccgagaucaacaccgccaagaucaagggcaagaacagcuucgcccccaaggacuucauguuccagccccuggacggccugaagaccuaccaggugacccccaugacccccagaagcgccaacgccuuccugacccccagcuacaccuggaccccccugaagaccgagguggacgagagccaggccaccaaggagauccuggcccagaagugcaagaccuacagcaccaagaccauccagcaggacagcaacaagcugcccugcccccugggcccccugaccguguggcacgaggagcacgugcugaacaagaacgaggccaccaccaagaaccugaacggccugcccaucaaggaggugcccagccuggagagaaacgagggcagaaucgcccagccccaccacggcgugcccuacuucagaaacauccugcagagcgagaccgagaagcugaccagccacugcuucgagugggacagaaagcuggagcuggacauccccgacgacgccaaggaccugaucagaaccgccgugggccagaccagacugcugaugaaggagagauucaagcaguucgagggccugguggacgacugcgaguacaagagaggcaucaaggagaccaccugcaccgaccuggacggcuucugggacauggugagcuuccagaucgaggacgugauccacaaguucaacaaccugaucaagcuggaggagagcggcuggcaggugaacaacaacaugaaccacaacaugaacaagaacguguucagaaagaagguggugagcggcaucgccagcaagcccaagcaggacgacgccggcagaaucgccgccagaaacagacuggccgccaucaagaacgccaugagagagagaaucagacaggaggagugcgccgagaccgccgugagcgugauccccaaggagguggacaagaucguguucgacgccggcuucuucagaguggagagccccgugaagcuguucagcggccugagcgugagcagcgagggccccagccagagacugggcacccccaagagcgugaacaaggccgugagccagagcagaaacgagaugggcaucccccagcagaccaccagccccgagaacgccggcccccagaacaccaagagcgagcacgugaagaagacccuguuccugagcauccccgagagcagaagcagcaucgaggacgcccagugccccggccugcccgaccugaucgaggagaaccacguggugaacaagaccgaccugaagguggacugccugagcagcgagagaaugagccugccccugcuggccggcggcguggccgacgacaucaacaccaacaagaaggagggcaucagcgacgugguggagggcauggagcugaacagcagcaucaccagccaggacgugcugaugagcagccccgagaagaacaccgccagccagaacagcauccuggaggagggcgagaccaagaucagccagagcgagcuguucgacaacaagagccugaccaccgagugccaccugcuggacagcgugggcagcugcuacguggccagagccggccuggaggugcugggcagcagcgaccccaccaccagcgccagcagaguggccggcaccaccgccagaagcaagcugcaguaa

SEQ ID NO: 16163 - RNA, 1152 nt, Artificial Sequence
  DLK1__Homo_sapiens__NP_003827
augaccgccaccgaggcccugcugagagugcugcugcugcugcuggccuucggccacagcaccuacggcgccgagugcuuccccgccugcaacccccagaacggcuucugcgaggacgacaacgugugcagaugccagcccggcuggcagggcccccugugcgaccagugcgugaccagccccggcugccugcacggccugugcggcgagcccggccagugcaucugcaccgacggcugggacggcgagcugugcgacagagacgugagagccugcagcagcgcccccugcgccaacaacggcaccugcgugagccuggacgacggccuguacgagugcagcugcgcccccggcuacagcggcaaggacugccagaagaaggacggccccugcgugaucaacggcagccccugccagcacggcggcaccugcguggacgacgagggcagagccagccacgccagcugccugugcccccccggcuucagcggcaacuucugcgagaucguggccaacagcugcacccccaaccccugcgagaacgacggcgugugcaccgacaucggcggcgacuucagaugcagaugccccgccggcuucaucgacaagaccugcagcagacccgugaccaacugcgccagcagccccugccagaacggcggcaccugccugcagcacacccaggugagcuacgagugccugugcaagcccgaguucaccggccugaccugcgugaagaagagagcccugagcccccagcaggugaccagacugcccagcggcuacggccuggccuacagacugacccccggcgugcacgagcugcccgugcagcagcccgagcacagaauccugaaggugagcaugaaggagcugaacaagaagaccccccugcugaccgagggccaggccaucugcuucaccauccugggcgugcugaccagccugguggugcugggcaccgugggcaucguguuccugaacaagugcgagaccugggugagcaaccugagauacaaccacaugcugagaaagaagaagaaccugcugcugcaguacaacagcggcgaggaccuggccgugaacaucaucuuccccgagaagaucgacaugaccaccuucagcaaggaggccggcgacgaggagaucuaa

SEQ ID NO: 16164 - RNA, 2172 nt, Artificial Sequence
  DLL1__Homo_sapiens__XP_011534060
augggcagcagaugcgcccuggcccuggccgugcugagcgcccugcugugccagguguggagcagcggcguguucgagcugaagcugcaggaguucgugaacaagaagggccugcugggcaacagaaacugcugcagaggcggcgccggccccccccccugcgccugcagaaccuucuucagagugugccugaagcacuaccaggccagcgugagccccgagccccccugcaccuacggcagcgccgugacccccgugcugggcguggacagcuucagccugcccgacggcggcggcgccgacagcgccuucagcaaccccaucagauuccccuucggcuucaccuggcccggcaccuucagccugaucaucgaggcccugcacaccgacagccccgacgaccuggccaccgagaaccccgagagacugaucagcagacuggccacccagagacaccugaccgugggcgaggaguggagccaggaccugcacagcagcggcagaaccgaccugaaguacagcuacagauucgugugcgacgagcacuacuacggcgagggcugcagcguguucugcagacccagagacgacgccuucggccacuucaccugcggcgagagaggcgagaaggugugcaaccccggcuggaagggccccuacugcaccgagcccaucugccugcccggcugcgacgagcagcacggcuucugcgacaagcccggcgagugcaagugcagagugggcuggcagggcagauacugcgacgagugcaucagauaccccggcugccugcacggcaccugccagcagcccuggcagugcaacugccaggagggcuggggcggccuguucugcaaccaggaccugaacuacugcacccaccacaagcccugcaagaacggcgccaccugcaccaacaccggccagggcagcuacaccugcagcugcagacccggcuacaccggcgccaccugcgagcugggcaucgacgagugcgaccccagccccugcaagaacggcggcagcugcaccgaccuggagaacagcuacagcugcaccugcccccccggcuucuacggcaagaucugcgagcugagcgccaugaccugcgccgacggccccugcuucaacggcggcagaugcagcgacagccccgacggcggcuacagcugcagaugccccgugggcuacagcggcuucaacugcgagaagaagaucgacuacugcagcagcagccccugcagcaacggcgccaagugcguggaccugggcgacgccuaccugugcagaugccaggccggcuucagcggcagacacugcgacgacaacguggacgacugcgccagcagccccugcgccaacggcggcaccugcagagacggcgugaacgacuucagcugcaccugcccccccggcuacaccggcagaaacugcagcgcccccgugagcagaugcgagcacgcccccugccacaacggcgccaccugccacgagagaggccacagauacgugugcgagugcgccagaggcuacggcggccccaacugccaguuccugcugcccgagcugccccccggccccgccgugguggaccugaccgagaagcuggagggccagggcggccccuuccccuggguggccgugugcgccggcgugauccuggugcugaugcugcugcugggcugcgccgccgugguggugugcgugagacugagacugcagaagcacagaccccccgccgaccccugcagaggcgagaccgagaccaugaacaaccuggccaacugccagagagagaaggacaucagcgugagcaucaucggcgccacccagaucaagaacaccaacaagaaggccgacuuccacggcgaccacagcgccgacaagaacggcuucaaggccagauaccccgccguggacuacaaccuggugcaggaccugaagggcgacgacaccgccgugagagacgcccacagcaagagagacaccaagugccagccccagggcagcagcggcgaggagaagggcacccccaccacccugagaggcggcgaggccagcgagagaaagagacccgacagcggcugcagcaccagcaaggacaccaaguaccagagcguguacgugaucagcgaggagaaggacgagugcgugaucgccaccgagguguaa

SEQ ID NO: 16165 - RNA, 1857 nt, Artificial Sequence
  DLL3__Homo_sapiens__NP_058637
auggugagccccagaaugagcggccugcugagccagaccgugauccuggcccugaucuuccugccccagaccagacccgccggcguguucgagcugcagauccacagcuucggccccggccccggccccggcgcccccagaagccccugcagcgccagacugcccugcagacuguucuucagagugugccugaagcccggccugagcgaggaggccgccgagagccccugcgcccugggcgccgcccugagcgccagaggccccguguacaccgagcagcccggcgcccccgcccccgaccugccccugcccgacggccugcugcaggugcccuucagagacgccuggcccggcaccuucagcuucaucaucgagaccuggagagaggagcugggcgaccagaucggcggccccgccuggagccugcuggccagaguggccggcagaagaagacuggccgccggcggccccugggccagagacauccagagagccggcgccugggagcugagauucagcuacagagccagaugcgagccccccgccgugggcaccgccugcaccagacugugcagacccagaagcgcccccagcagaugcggccccggccugagacccugcgccccccuggaggacgagugcgaggccccccuggugugcagagccggcugcagccccgagcacggcuucugcgagcagcccggcgagugcagaugccuggagggcuggaccggcccccugugcaccgugcccgugagcaccagcagcugccugagccccagaggccccagcagcgccaccaccggcugccuggugcccggccccggccccugcgacggcaaccccugcgccaacggcggcagcugcagcgagacccccagaagcuucgagugcaccugccccagaggcuucuacggccugagaugcgaggugagcggcgugaccugcgccgacggccccugcuucaacggcggccugugcgugggcggcgccgaccccgacagcgccuacaucugccacugcccccccggcuuccagggcagcaacugcgagaagagaguggacagaugcagccugcagcccugcagaaacggcggccugugccuggaccugggccacgcccugagaugcagaugcagagccggcuucgccggccccagaugcgagcacgaccuggacgacugcgccggcagagccugcgccaacggcggcaccugcguggagggcggcggcgcccacagaugcagcugcgcccugggcuucggcggcagagacugcagagagagagccgaccccugcgccgccagacccugcgcccacggcggcagaugcuacgcccacuucagcggccuggugugcgccugcgcccccggcuacaugggcgccagaugcgaguuccccgugcaccccgacggcgccagcgcccugcccgccgccccccccggccugagacccggcgacccccagagauaccugcugccccccgcccugggccugcugguggccgccggcguggccggcgccgcccugcugcuggugcacgugagaagaagaggccacagccaggacgccggcagcagacugcuggccggcacccccgagcccagcgugcacgcccugcccgacgcccugaacaaccugagaacccaggagggcagcggcgacggccccagcagcagcguggacuggaacagacccgaggacguggacccccagggcaucuacgugaucagcgcccccagcaucuacgccagagagguggccaccccccuguuccccccccugcacaccggcagagccggccagagacagcaccugcuguuccccuaccccagcagcauccugagcgugaaguaa

SEQ ID NO: 16166 - RNA, 2058 nt, Artificial Sequence
  DLL4__Homo_sapiens__NP_061947
auggccgccgccagcagaagcgccagcggcugggcccugcugcugcugguggcccuguggcagcagagagccgccggcagcggcguguuccagcugcagcugcaggaguucaucaacgagagaggcgugcuggccagcggcagacccugcgagcccggcugcagaaccuucuucagagugugccugaagcacuuccaggccguggugagccccggccccugcaccuucggcaccgugagcacccccgugcugggcaccaacagcuucgccgugagagacgacagcagcggcggcggcagaaacccccugcagcugcccuucaacuucaccuggcccggcaccuucagccugaucaucgaggccuggcacgcccccggcgacgaccugagacccgaggcccugccccccgacgcccugaucagcaagaucgccauccagggcagccuggccgugggccagaacuggcugcuggacgagcagaccagcacccugaccagacugagauacagcuacagagugaucugcagcgacaacuacuacggcgacaacugcagcagacugugcaagaagagaaacgaccacuucggccacuacgugugccagcccgacggcaaccugagcugccugcccggcuggaccggcgaguacugccagcagcccaucugccugagcggcugccacgagcagaacggcuacugcagcaagcccgccgagugccugugcagacccggcuggcagggcagacugugcaacgagugcaucccccacaacggcugcagacacggcaccugcagcacccccuggcagugcaccugcgacgagggcuggggcggccuguucugcgaccaggaccugaacuacugcacccaccacagccccugcaagaacggcgccaccugcagcaacagcggccagagaagcuacaccugcaccugcagacccggcuacaccggcguggacugcgagcuggagcugagcgagugcgacagcaaccccugcagaaacggcggcagcugcaaggaccaggaggacggcuaccacugccugugcccccccggcuacuacggccugcacugcgagcacagcacccugagcugcgccgacagccccugcuucaacggcggcagcugcagagagagaaaccagggcgccaacuacgccugcgagugcccccccaacuucaccggcagcaacugcgagaagaagguggacagaugcaccagcaaccccugcgccaacggcggccagugccugaacagaggccccagcagaaugugcagaugcagacccggcuucaccggcaccuacugcgagcugcacgugagcgacugcgccagaaaccccugcgcccacggcggcaccugccacgaccuggagaacggccugaugugcaccugccccgccggcuucagcggcagaagaugcgaggugagaaccagcaucgacgccugcgccagcagccccugcuucaacagagccaccugcuacaccgaccugagcaccgacaccuucgugugcaacugccccuacggcuucgugggcagcagaugcgaguuccccgugggccugccccccagcuuccccuggguggccgugagccugggcgugggccuggccgugcugcuggugcugcugggcaugguggccguggccgugagacagcugagacugagaagacccgacgacggcagcagagaggccaugaacaaccugagcgacuuccagaaggacaaccugauccccgccgcccagcugaagaacaccaaccagaagaaggagcuggagguggacugcggccuggacaagagcaacugcggcaagcagcagaaccacacccuggacuacaaccuggcccccggcccccugggcagaggcaccaugcccggcaaguucccccacagcgacaagagccugggcgagaaggccccccugagacugcacagcgagaagcccgagugcagaaucagcgccaucugcagccccagagacagcauguaccagagcgugugccugaucagcgaggagagaaacgagugcgugaucgccaccgagguguaa

SEQ ID NO: 16167 - RNA, 1362 nt, Artificial Sequence
  DLST__Homo_sapiens__NP_001924
augcugagcagaagcagaugcgugagcagagccuucagcagaagccugagcgccuuccagaagggcaacugcccccugggcagaagaagccugcccggcgugagccugugccagggccccggcuaccccaacagcagaaagguggugaucaacaacagcguguucagcgugagauucuucagaaccaccgccgugugcaaggacgaccuggugaccgugaagacccccgccuucgccgagagcgugaccgagggcgacgugagaugggagaaggccgugggcgacaccguggccgaggacgagguggugugcgagaucgagaccgacaagaccagcgugcaggugcccagccccgccaacggcgugaucgaggcccugcuggugcccgacggcggcaagguggagggcggcaccccccuguucacccugagaaagaccggcgccgcccccgccaaggccaagcccgccgaggcccccgccgccgccgcccccaaggccgagcccaccgccgccgccgugcccccccccgccgcccccauccccacccagaugccccccgugcccagccccagccagccccccagcggcaagcccgugagcgccgugaagcccaccguggcccccccccuggccgagcccggcgccggcaagggccugagaagcgagcacagagagaagaugaacagaaugagacagagaaucgcccagagacugaaggaggcccagaacaccugcgccaugcugaccaccuucaacgagaucgacaugagcaacauccaggagaugagagccagacacaaggaggccuuccugaagaagcacaaccugaagcugggcuucaugagcgccuucgugaaggccagcgccuucgcccugcaggagcagcccguggugaacgccgugaucgacgacaccaccaaggaggugguguacagagacuacaucgacaucagcguggccguggccacccccagaggccugguggugcccgugaucagaaacguggaggccaugaacuucgccgacaucgagagaaccaucaccgagcugggcgagaaggccagaaagaacgagcuggccaucgaggacauggacggcggcaccuucaccaucagcaacggcggcguguucggcagccuguucggcacccccaucaucaaccccccccagagcgccauccugggcaugcacggcaucuucgacagacccguggccaucggcggcaagguggaggugagacccaugauguacguggcccugaccuacgaccacagacugaucgacggcagagaggccgugaccuuccugagaaagaucaaggccgccguggaggaccccagagugcugcugcuggaccuguaa

SEQ ID NO: 16168 - RNA, 390 nt, Artificial Sequence
  DLX1__Homo_sapiens__NP_001033582
augaccaugaccaccaugcccgagagccugaacagccccgugagcggcaaggccguguucauggaguucggcccccccaaccagcagaugagccccagccccaugagccacggccacuacagcaugcacugccugcacagcgccggccacagccagcccgacggcgccuacagcagcgccagcagcuucagcagaccccugggcuaccccuacgugaacagcgugagcagccacgccagcagccccuacaucagcagcgugcagagcuaccccggcagcgccagccuggcccagagcagacuggaggaccccggccaggaccuggugcccaagcaggccauccaggugcaggaggccgacgaggccggcuggggcggcagcggcggcuaa

SEQ ID NO: 16169 - RNA, 987 nt, Artificial Sequence
  DLX2__Homo_sapiens__NP_004396
augaccggcguguucgacagccugguggccgacaugcacagcacccagaucgccgccagcagcaccuaccaccagcaccagcagccccccagcggcggcggcgccggccccggcggcaacagcagcagcagcagcagccugcacaagccccaggagagccccacccugcccgugagcaccgccaccgacagcagcuacuacaccaaccagcagcaccccgccggcggcggcggcggcggcggcagccccuacgcccacaugggcagcuaccaguaccaggccagcggccugaacaacgugcccuacagcgccaagagcagcuacgaccugggcuacaccgccgccuacaccagcuacgcccccuacggcaccagcagcagccccgccaacaacgagcccgagaaggaggaccuggagcccgagaucagaaucgugaacggcaagcccaagaaggugagaaagcccagaaccaucuacagcagcuuccagcuggccgcccugcagagaagauuccagaagacccaguaccuggcccugcccgagagagccgagcuggccgccagccugggccugacccagacccaggugaagaucugguuccagaacagaagaagcaaguucaagaagauguggaagagcggcgagauccccagcgagcagcaccccggcgccagcgccagcccccccugcgccagcccccccgugagcgcccccgccagcugggacuucggcgugccccagagaauggccggcggcggcggccccggcagcggcggcagcggcgccggcagcagcggcagcagccccagcagcgccgccagcgccuuccugggcaacuaccccugguaccaccagaccagcggcagcgccagccaccugcaggccaccgccccccugcugcaccccacccagaccccccagccccaccaccaccaccaccaccacggcggcggcggcgcccccgugagcgccggcaccaucuucuaa

SEQ ID NO: 16170 - RNA, 864 nt, Artificial Sequence
  DLX3__Homo_sapiens__NP_005211
augagcggcagcuucgacagaaagcugagcagcauccugaccgacaucagcagcagccugagcugccacgccggcagcaaggacagccccacccugcccgagagcagcgugaccgaccugggcuacuacagcgccccccagcacgacuacuacagcggccagcccuacggccagaccgugaaccccuacaccuaccaccaccaguucaaccugaacggccuggccggcaccggcgccuacagccccaagagcgaguacaccuacggcgccagcuacagacaguacggcgccuacagagagcagccccugcccgcccaggaccccgugagcgugaaggaggagcccgaggccgaggugagaauggugaacggcaagcccaagaaggugagaaagcccagaaccaucuacagcagcuaccagcuggccgcccugcagagaagauuccagaaggcccaguaccuggcccugcccgagagagccgagcuggccgcccagcugggccugacccagacccaggugaagaucugguuccagaacagaagaagcaaguucaagaagcuguacaagaacggcgaggugccccuggagcacagccccaacaacagcgacagcauggccugcaacagcccccccagccccgcccugugggacaccagcagccacagcacccccgcccccgccagaagccagcugccccccccccugcccuacagcgccagccccagcuaccuggacgaccccaccaacagcugguaccacgcccagaaccugagcggcccccaccugcagcagcagcccccccagcccgccacccugcaccacgccagccccggccccccccccaaccccggcgccguguacuaa

SEQ ID NO: 16171 - RNA, 723 nt, Artificial Sequence
  DLX4__Homo_sapiens__NP_612138
augaccagccugcccugcccccugcccggcagagacgccagcaaggccguguuccccgaccuggcccccgugcccagcguggccgccgccuacccccugggccugagccccaccaccgccgccagccccaaccugagcuacagcagacccuacggccaccugcugagcuaccccuacaccgagcccgccaaccccggcgacagcuaccugagcugccagcagcccgccgcccugagccagccccugugcggccccgccgagcacccccaggagcuggaggccgacagcgagaagcccagacugagccccgagcccagcgagagaagaccccaggcccccgccaagaagcugagaaagcccagaaccaucuacagcagccugcagcugcagcaccugaaccagagauuccagcacacccaguaccuggcccugcccgagagagcccagcuggccgcccagcugggccugacccagacccaggugaagaucugguuccagaacaagagaagcaaguacaagaagcugcugaagcagaacagcggcggccaggagggcgacuuccccggcagaaccuucagcgugagccccugcagccccccccugcccagccugugggaccugcccaaggccggcacccugcccaccagcggcuacggcaacagcuucggcgccugguaccagcaccacagcagcgacgugcuggccagcccccagaugauguaa

SEQ ID NO: 16172 - RNA, 870 nt, Artificial Sequence
  DLX5__Homo_sapiens__NP_005212
augaccggcguguucgacagaagagugcccagcaucagaagcggcgacuuccaggcccccuuccagaccagcgccgccaugcaccaccccagccaggagagccccacccugcccgagagcagcgccaccgacagcgacuacuacagccccaccggcggcgccccccacggcuacugcagccccaccagcgccagcuacggcaaggcccugaaccccuaccaguaccaguaccacggcgugaacggcagcgccggcagcuaccccgccaaggccuacgccgacuacagcuacgccagcagcuaccaccaguacggcggcgccuacaacagagugcccagcgccaccaaccagcccgagaaggaggugaccgagcccgaggugagaauggugaacggcaagcccaagaaggugagaaagcccagaaccaucuacagcagcuuccagcuggccgcccugcagagaagauuccagaagacccaguaccuggcccugcccgagagagccgagcuggccgccagccugggccugacccagacccaggugaagaucugguuccagaacaagagaagcaagaucaagaagaucaugaagaacggcgagaugccccccgagcacagccccagcagcagcgaccccauggccugcaacagcccccagagccccgccgugugggagccccagggcagcagcagaagccugagccaccacccccacgcccacccccccaccagcaaccagagccccgccagcagcuaccuggagaacagcgccagcugguacaccagcgccgccagcagcaucaacagccaccugcccccccccggcagccugcagcacccccuggcccuggccagcggcacccuguacuaa

SEQ ID NO: 16173 - RNA, 882 nt, Artificial Sequence
  DLX6__Homo_sapiens__NP_005213
augaugaccaugaccaccauggccgacggccuggagggccaggacagcagcaagagcgccuucauggaguucggccagcagcagcagcagcagcagcagcagcagcagcagcagcagcagcagcagcagcagccccccccccccccccccccccccccccagccccacagccagcagagcagccccgccauggccggcgcccacuacccccugcacugccugcacagcgccgccgccgccgccgccgccggcagccaccaccaccaccaccaccagcaccaccaccacggcagccccuacgccagcggcggcggcaacagcuacaaccacagaagccuggccgccuaccccuacaugagccacagccagcacagccccuaccugcagagcuaccacaacagcagcgccgccgcccagaccagaggcgacgacaccgaccagcagaagaccaccgugaucgagaacggcgagaucagauucaacggcaagggcaagaagaucagaaagcccagaaccaucuacagcagccugcagcugcaggcccugaaccacagauuccagcagacccaguaccuggcccugcccgagagagccgagcuggccgccagccugggccugacccagacccaggugaagaucugguuccagaacaagagaagcaaguucaagaagcugcugaagcagggcagcaacccccacgagagcgacccccugcagggcagcgccgcccugagccccagaagccccgcccugccccccgugugggacgugagcgccagcgccaagggcgugagcaugccccccaacagcuacaugcccggcuacagccacugguacagcagcccccaccaggacaccaugcagagaccccagaugauguaa

SEQ ID NO: 16174 - RNA, 5358 nt, Artificial Sequence
  DMBT1__Homo_sapiens__NP_004397
augggcaucagcaccgugauccuggagaugugccugcuguggggccaggugcugagcaccggcggcuggauccccagaaccaccgacuacgccagccugauccccagcgaggugccccuggaccccaccguggccgagggcagccccuuccccagcgagagcacccuggagagcaccguggccgagggcagccccaucagccuggagagcacccuggagagcaccguggccgagggcagccugauccccagcgagagcacccuggagagcaccguggccgagggcagcgacagcggccuggcccugagacuggugaacggcgacggcagaugccagggcagaguggagauccuguacagaggcagcuggggcaccgugugcgacgacagcugggacaccaacgacgccaacguggugugcagacagcugggcugcggcugggccaugagcgcccccggcaacgccugguucggccagggcagcggccccaucgcccuggacgacgugagaugcagcggccacgagagcuaccuguggagcugcccccacaacggcuggcugagccacaacugcggccacggcgaggacgccggcgugaucugcagcgccgcccagccccagagcacccugagacccgagagcuggcccgugagaaucagcccccccgugcccaccgagggcagcgagagcagccuggcccugagacuggugaacggcggcgacagaugcagaggcagaguggaggugcuguacagaggcagcuggggcaccgugugcgacgacuacugggacaccaacgacgccaacguggugugcagacagcugggcugcggcugggccaugagcgcccccggcaacgcccaguucggccagggcagcggccccaucgugcuggacgacgugagaugcagcggccacgagagcuaccuguggagcugcccccacaacggcuggcugacccacaacugcggccacagcgaggacgccggcgugaucugcagcgccccccagagcagacccacccccagccccgacaccuggcccaccagccacgccagcaccgccggccccgagagcagccuggcccugagacuggugaacggcggcgacagaugccagggcagaguggaggugcuguacagaggcagcuggggcaccgugugcgacgacagcugggacaccagcgacgccaacguggugugcagacagcugggcugcggcugggccaccagcgcccccggcaacgccagauucggccagggcagcggccccaucgugcuggacgacgugagaugcagcggcuacgagagcuaccuguggagcugcccccacaacggcuggcugagccacaacugccagcacagcgaggacgccggcgugaucugcagcgccgcccacagcuggagcacccccagccccgacacccugcccaccaucacccugcccgccagcaccgugggcagcgagagcagccuggcccugagacuggugaacggcggcgacagaugccagggcagaguggaggugcuguaccagggcagcuggggcaccgugugcgacgacagcugggacaccaacgacgccaacguggugugcagacagcugggcugcggcugggccaugagcgcccccggcaacgccagauucggccagggcagcggccccaucgugcuggacgacgugagaugcagcggccacgagagcuaccuguggagcugcccccacaacggcuggcugagccacaacugcggccacagcgaggacgccggcgugaucugcagcgccagccagagcagacccacccccagccccgacaccuggcccaccagccacgccagcaccgccggcagcgagagcagccuggcccugagacuggugaacggcggcgacagaugccagggcagaguggaggugcuguacagaggcagcuggggcaccgugugcgacgacuacugggacaccaacgacgccaacguggugugcagacagcugggcugcggcugggccaugagcgcccccggcaacgccagauucggccagggcagcggccccaucgugcuggacgacgugagaugcagcggccacgagagcuaccuguggagcugcccccacaacggcuggcugagccacaacugcggccaccacgaggacgccggcgugaucugcagcgccagccagagccagcccacccccagccccgacaccuggcccaccagccacgccagcaccgccggcagcgagagcagccuggcccugagacuggugaacggcggcgacagaugccagggcagaguggaggugcuguacagaggcagcuggggcaccgugugcgacgacuacugggacaccaacgacgccaacguggugugcagacagcugggcugcggcugggccaccagcgcccccggcaacgccagauucggccagggcagcggccccaucgugcuggacgacgugagaugcagcggccacgagagcuaccuguggagcugcccccacaacggcuggcugagccacaacugcggccaccacgaggacgccggcgugaucugcagcgccagccagagccagcccacccccagccccgacaccuggcccaccagcagagccagcaccgccggcagcgagagcacccuggcccugagacuggugaacggcggcgacagaugcagaggcagaguggaggugcuguaccagggcagcuggggcaccgugugcgacgacuacugggacaccaacgacgccaacguggugugcagacagcugggcugcggcugggccaugagcgcccccggcaacgcccaguucggccagggcagcggccccaucgugcuggacgacgugagaugcagcggccacgagagcuaccuguggagcugcccccacaacggcuggcugagccacaacugcggccaccacgaggacgccggcgugaucugcagcgccgcccagagccagagcacccccagacccgacaccuggcugaccaccaaccugcccgcccugaccgugggcagcgagagcagccuggcccugagacuggugaacggcggcgacagaugcagaggcagaguggaggugcuguacagaggcagcuggggcaccgugugcgacgacagcugggacaccaacgacgccaacguggugugcagacagcugggcugcggcugggccaugagcgcccccggcaacgccagauucggccagggcagcggccccaucgugcuggacgacgugagaugcagcggcaacgagagcuaccuguggagcugcccccacaagggcuggcugacccacaacugcggccaccacgaggacgccggcgugaucugcagcgccacccagaucaacagcaccaccaccgacugguggcaccccaccaccaccaccaccgccagacccagcagcaacugcggcggcuuccuguucuacgccagcggcaccuucagcagccccagcuaccccgccuacuaccccaacaacgccaagugcgugugggagaucgaggugaacagcggcuacagaaucaaccugggcuucagcaaccugaagcuggaggcccaccacaacugcagcuucgacuacguggagaucuucgacggcagccugaacagcagccugcugcugggcaagaucugcaacgacaccagacagaucuucaccagcagcuacaacagaaugaccauccacuucagaagcgacaucagcuuccagaacaccggcuuccuggccugguacaacagcuuccccagcgacgccacccugagacuggugaaccugaacagcagcuacggccugugcgccggcagaguggagaucuaccacggcggcaccuggggcaccgugugcgacgacagcuggaccauccaggaggccgagguggugugcagacagcugggcugcggcagagccgugagcgcccugggcaacgccuacuucggcagcggcagcggccccaucacccuggacgacguggagugcagcggcaccgagagcacccuguggcagugcagaaacagaggcugguucagccacaacugcaaccacagagaggacgccggcgugaucugcagcggcaaccaccugagcacccccgcccccuuccugaacaucaccagacccaacaccgacuacagcugcggcggcuuccugagccagcccagcggcgacuucagcagccccuucuaccccggcaacuaccccaacaacgccaagugcgugugggacaucgaggugcagaacaacuacagagugaccgugaucuucagagacgugcagcuggagggcggcugcaacuacgacuacaucgagguguucgacggccccuacagaagcagcccccugaucgccagagugugcgacggcgccagaggcagcuucaccagcagcagcaacuucaugagcaucagauucaucagcgaccacagcaucaccagaagaggcuucagagccgaguacuacagcagccccagcaacgacagcaccaaccugcugugccugcccaaccacaugcaggccagcgugagcagaagcuaccugcagagccugggcuucagcgccagcgaccuggugaucagcaccuggaacggcuacuacgagugcagaccccagaucacccccaaccuggugaucuucaccauccccuacagcggcugcggcaccuucaagcaggccgacaacgacaccaucgacuacagcaacuuccugaccgccgccgugagcggcggcaucaucaagagaagaaccgaccugagaauccacgugagcugcagaaugcugcagaacaccuggguggacaccauguacaucgccaacgacaccauccacguggccaacaacaccauccagguggaggaggugcaguacggcaacuucgacgugaacaucagcuucuacaccagcagcagcuuccuguaccccgugaccagcagacccuacuacguggaccugaaccaggaccuguacgugcaggccgagauccugcacagcgacgccgugcugacccuguucguggacaccugcguggccagccccuacagcaacgacuucaccagccugaccuacgaccugaucagaagcggcugcgugagagacgacaccuacggccccuacagcagccccagccugagaaucgccagauucagauucagagccuuccacuuccugaacagauuccccagcguguaccugagaugcaagaugguggugugcagagccuacgaccccagcagcagaugcuacagaggcugcgugcugagaagcaagagagacgugggcagcuaccaggagaagguggacguggugcugggccccauccagcugcagaccccccccagaagagaggaggagcccagauaa

SEQ ID NO: 16175 - RNA, 1023 nt, Artificial Sequence
  DMC1__Homo_sapiens__NP_008999
augaaggaggaccaggugguggccgaggagcccggcuuccaggacgaggaggagagccuguuccaggacaucgaccugcugcagaagcacggcaucaacguggccgacaucaagaagcugaagagcgugggcaucugcaccaucaagggcauccagaugaccaccagaagagcccugugcaacgugaagggccugagcgaggccaagguggacaagaucaaggaggccgccaacaagcugaucgagcccggcuuccugaccgccuucgaguacagcgagaagagaaagaugguguuccacaucaccaccggcagccaggaguucgacaagcugcugggcggcggcaucgagagcauggccaucaccgaggccuucggcgaguucagaaccggcaagacccagcugagccacacccugugcgugaccgcccagcugcccggcgccggcggcuaccccggcggcaagaucaucuucaucgacaccgagaacaccuucagacccgacagacugagagacaucgccgacagauucaacguggaccacgacgccgugcuggacaacgugcuguacgccagagccuacaccagcgagcaccagauggagcugcuggacuacguggccgccaaguuccacgaggaggccggcaucuucaagcugcugaucaucgacagcaucauggcccuguucagaguggacuucagcggcagaggcgagcuggccgagagacagcagaagcuggcccagaugcugagcagacugcagaagaucagcgaggaguacaacguggccguguucgugaccaaccagaugaccgccgaccccggcgccaccaugaccuuccaggccgaccccaagaagcccaucggcggccacauccuggcccacgccagcaccaccagaaucagccugagaaagggcagaggcgagcugagaaucgccaagaucuacgacagccccgagaugcccgagaacgaggccaccuucgccaucaccgccggcggcaucggcgacgccaaggaguaa

SEQ ID NO: 16176 - RNA, 11034 nt, Artificial Sequence
  DMD__Homo_sapiens__NP_000100
auggaggacgagagagaggacgugcagaagaagaccuucaccaagugggugaacgcccaguucagcaaguucggcaagcagcacaucgagaaccuguucagcgaccugcaggacggcagaagacugcuggaccugcuggagggccugaccggccagaagcugcccaaggagaagggcagcaccagagugcacgcccugaacaacgugaacaaggcccugagagugcugcagaacaacaacguggaccuggugaacaucggcagcaccgacaucguggacggcaaccacaagcugacccugggccugaucuggaacaucauccugcacuggcaggugaagaacgugaugaagaacaucauggccggccugcagcagaccaacagcgagaagauccugcugagcugggugagacagagcaccagaaacuacccccaggugaacgugaucaacuucaccaccagcuggagcgacggccuggcccugaacgcccugauccacagccacagacccgaccuguucgacuggaacagcguggugugccagcagagcgccacccagagacuggagcacgccuucaacaucgccagauaccagcugggcaucgagaagcugcuggaccccgaggacguggacaccaccuaccccgacaagaagagcauccugauguacaucaccagccuguuccaggugcugccccagcaggugagcaucgaggccauccaggagguggagaugcugcccagaccccccaaggugaccaaggaggagcacuuccagcugcaccaccagaugcacuacagccagcagaucaccgugagccuggcccagggcuacgagagaaccagcagccccaagcccagauucaagagcuacgccuacacccaggccgccuacgugaccaccagcgaccccaccagaagccccuuccccagccagcaccuggaggcccccgaggacaagagcuucggcagcagccugauggagagcgaggugaaccuggacagauaccagaccgcccuggaggaggugcugagcuggcugcugagcgccgaggacacccugcaggcccagggcgagaucagcaacgacguggagguggugaaggaccaguuccacacccacgagggcuacaugauggaccugaccgcccaccagggcagagugggcaacauccugcagcugggcagcaagcugaucggcaccggcaagcugagcgaggacgaggagaccgaggugcaggagcagaugaaccugcugaacagcagaugggagugccugagaguggccagcauggagaagcagagcaaccugcacagagugcugauggaccugcagaaccagaagcugaaggagcugaacgacuggcugaccaagaccgaggagagaaccagaaagauggaggaggagccccugggccccgaccuggaggaccugaagagacaggugcagcagcacaaggugcugcaggaggaccuggagcaggagcaggugagagugaacagccugacccacauggugguggugguggacgagagcagcggcgaccacgccaccgccgcccuggaggagcagcugaaggugcugggcgacagaugggccaacaucugcagauggaccgaggacagaugggugcugcugcaggacauccugcugaaguggcagagacugaccgaggagcagugccuguucagcgccuggcugagcgagaaggaggacgccgugaacaagauccacaccaccggcuucaaggaccagaacgagaugcugagcagccugcagaagcuggccgugcugaaggccgaccuggagaagaagaagcagagcaugggcaagcuguacagccugaagcaggaccugcugagcacccugaagaacaagagcgugacccagaagaccgaggccuggcuggacaacuucgccagaugcugggacaaccuggugcagaagcuggagaagagcaccgcccagaucagccaggccgugaccaccacccagcccagccugacccagaccaccgugauggagaccgugaccaccgugaccaccagagagcagauccuggugaagcacgcccaggaggagcugccccccccccccccccagaagaagagacagaucaccguggacagcgagaucagaaagagacuggacguggacaucaccgagcugcacagcuggaucaccagaagcgaggccgugcugcagagccccgaguucgccaucuucagaaaggagggcaacuucagcgaccugaaggagaaggugaacgccaucgagagagagaaggccgagaaguucagaaagcugcaggacgccagcagaagcgcccaggcccugguggagcagauggugaacgagggcgugaacgccgacagcaucaagcaggccagcgagcagcugaacagcagauggaucgaguucugccagcugcugagcgagagacugaacuggcuggaguaccagaacaacaucaucgccuucuacaaccagcugcagcagcuggagcagaugaccaccaccgccgagaacuggcugaagauccagcccaccacccccagcgagcccaccgccaucaagagccagcugaagaucugcaaggacgaggugaacagacugagcggccugcagccccagaucgagagacugaagauccagagcaucgcccugaaggagaagggccagggccccauguuccuggacgccgacuucguggccuucaccaaccacuucaagcagguguucagcgacgugcaggccagagagaaggagcugcagaccaucuucgacacccugccccccaugagauaccaggagaccaugagcgccaucagaaccugggugcagcagagcgagaccaagcugagcaucccccagcugagcgugaccgacuacgagaucauggagcagagacugggcgagcugcaggcccugcagagcagccugcaggagcagcagagcggccuguacuaccugagcaccaccgugaaggagaugagcaagaaggcccccagcgagaucagcagaaaguaccagagcgaguucgaggagaucgagggcagauggaagaagcugagcagccagcugguggagcacugccagaagcuggaggagcagaugaacaagcugagaaagauccagaaccacauccagacccugaagaaguggauggccgagguggacguguuccugaaggaggaguggcccgcccugggcgacagcgagauccugaagaagcagcugaagcagugcagacugcuggugagcgacauccagaccauccagcccagccugaacagcgugaacgagggcggccagaagaucaagaacgaggccgagcccgaguucgccagcagacuggagaccgagcugaaggagcugaacacccagugggaccacaugugccagcagguguacgccagaaaggaggcccugaagggcggccuggagaagaccgugagccugcagaaggaccugagcgagaugcacgaguggaugacccaggccgaggaggaguaccuggagagagacuucgaguacaagacccccgacgagcugcagaaggccguggaggagaugaagagagccaaggaggaggcccagcagaaggaggccaaggugaagcugcugaccgagagcgugaacagcgugaucgcccaggccccccccguggcccaggaggcccugaagaaggagcuggagacccugaccaccaacuaccaguggcugugcaccagacugaacggcaagugcaagacccuggaggaggugugggccugcuggcacgagcugcugagcuaccuggagaaggccaacaaguggcugaacgagguggaguucaagcugaagaccaccgagaacauccccggcggcgccgaggagaucagcgaggugcuggacagccuggagaaccugaugagacacagcgaggacaaccccaaccagaucagaauccuggcccagacccugaccgacggcggcgugauggacgagcugaucaacgaggagcuggagaccuucaacagcagauggagagagcugcacgaggaggccgugagaagacagaagcugcuggagcagagcauccagagcgcccaggagaccgagaagagccugcaccugauccaggagagccugaccuucaucgacaagcagcuggccgccuacaucgccgacaagguggacgccgcccagaugccccaggaggcccagaagauccagagcgaccugaccagccacgagaucagccuggaggagaugaagaagcacaaccagggcaaggaggccgcccagagagugcugagccagaucgacguggcccagaagaagcugcaggacgugagcaugaaguucagacuguuccagaagcccgccaacuucgagcagagacugcaggagagcaagaugauccuggacgaggugaagaugcaccugcccgcccuggagaccaagagcguggagcaggagguggugcagagccagcugaaccacugcgugaaccuguacaagagccugagcgaggugaagagcgagguggagauggugaucaagaccggcagacagaucgugcagaagaagcagaccgagaaccccaaggagcuggacgagagagugaccgcccugaagcugcacuacaacgagcugggcgccaaggugaccgagagaaagcagcagcuggagaagugccugaagcugagcagaaagaugagaaaggagaugaacgugcugaccgaguggcuggccgccaccgacauggagcugaccaagagaagcgccguggagggcaugcccagcaaccuggacagcgagguggccuggggcaaggccacccagaaggagaucgagaagcagaaggugcaccugaagagcaucaccgaggugggcgaggcccugaagaccgugcugggcaagaaggagacccugguggaggacaagcugagccugcugaacagcaacuggaucgccgugaccagcagagccgaggaguggcugaaccugcugcuggaguaccagaagcacauggagaccuucgaccagaacguggaccacaucaccaaguggaucauccaggccgacacccugcuggacgagagcgagaagaagaagccccagcagaaggaggacgugcugaagagacugaaggccgagcugaacgacaucagacccaagguggacagcaccagagaccaggccgccaaccugauggccaacagaggcgaccacugcagaaagcugguggagccccagaucagcgagcugaaccacagauucgccgccaucagccacagaaucaagaccggcaaggccagcaucccccugaaggagcuggagcaguucaacagcgacauccagaagcugcuggagccccuggaggccgagauccagcagggcgugaaccugaaggaggaggacuucaacaaggacaugaacgaggacaacgagggcaccgugaaggagcugcugcagagaggcgacaaccugcagcagagaaucaccgacgagagaaagagagaggagaucaagaucaagcagcagcugcugcagaccaagcacaacgcccugaaggaccugagaagccagagaagaaagaaggcccuggagaucagccaccagugguaccaguacaagagacaggccgacgaccugcugaagugccuggacgacaucgagaagaagcuggccagccugcccgagcccagagacgagagaaagaucaaggagaucgacagagagcugcagaagaagaaggaggagcugaacgccgugagaagacaggccgagggccugagcgaggacggcgccgccauggccguggagcccacccagauccagcugagcaagagauggagagagaucgagagcaaguucgcccaguucagaagacugaacuucgcccagauccacaccgugagagaggagaccaugauggugaugaccgaggacaugccccuggagaucagcuacgugcccagcaccuaccugaccgagaucacccacgugagccaggcccugcuggagguggagcagcugcugaacgcccccgaccugugcgccaaggacuucgaggaccuguucaagcaggaggagagccugaagaacaucaaggacagccugcagcagagcagcggcagaaucgacaucauccacagcaagaagaccgccgcccugcagagcgccacccccguggagagagugaagcugcaggaggcccugagccagcuggacuuccagugggagaaggugaacaagauguacaaggacagacagggcagauucgacagaagcguggagaaguggagaagauuccacuacgacaucaagaucuucaaccaguggcugaccgaggccgagcaguuccugagaaagacccagauccccgagaacugggagcacgccaaguacaagugguaccugaaggagcugcaggacggcaucggccagagacagaccguggugagaacccugaacgccaccggcgaggagaucauccagcagagcagcaagaccgacgccagcauccugcaggagaagcugggcagccugaaccugagauggcaggaggugugcaagcagcugagcgacagaaagaagagacuggaggagcagaagaacauccugagcgaguuccagagagaccugaacgaguucgugcuguggcuggaggaggccgacaacaucgccagcaucccccuggagcccggcaaggagcagcagcugaaggagaagcuggagcaggugaagcugcugguggaggagcugccccugagacagggcauccugaagcagcugaacgagaccggcggccccgugcuggugagcgcccccaucagccccgaggagcaggacaagcuggagaacaagcugaagcagaccaaccugcaguggaucaaggugagcagagcccugcccgagaagcagggcgagaucgaggcccagaucaaggaccugggccagcuggagaagaagcuggaggaccuggaggagcagcugaaccaccugcugcuguggcugagccccaucagaaaccagcuggagaucuacaaccagcccaaccaggagggccccuucgacgugcaggagaccgagaucgccgugcaggccaagcagcccgacguggaggagauccugagcaagggccagcaccuguacaaggagaagcccgccacccagcccgugaagagaaagcuggaggaccugagcagcgaguggaaggccgugaacagacugcugcaggagcugagagccaagcagcccgaccuggcccccggccugaccaccaucggcgccagccccacccagaccgugacccuggugacccagcccguggugaccaaggagaccgccaucagcaagcuggagaugcccagcagccugaugcuggaggugcccgcccuggccgacuucaacagagccuggaccgagcugaccgacuggcugagccugcuggaccaggugaucaagagccagagagugauggugggcgaccuggaggacaucaacgagaugaucaucaagcagaaggccaccaugcaggaccuggagcagagaagaccccagcuggaggagcugaucaccgccgcccagaaccugaagaacaagaccagcaaccaggaggccagaaccaucaucaccgacagaaucgagagaauccagaaccagugggacgaggugcaggagcaccugcagaacagaagacagcagcugaacgagaugcugaaggacagcacccaguggcuggaggccaaggaggaggccgagcaggugcugggccaggccagagccaagcuggagagcuggaaggagggccccuacaccguggacgccauccagaagaagaucaccgagaccaagcagcuggccaaggaccugagacaguggcagaccaacguggacguggccaacgaccuggcccugaagcugcugagagacuacagcgccgacgacaccagaaaggugcacaugaucaccgagaacaucaacgccagcuggagaagcauccacaagagagugagcgagagagaggccgcccuggaggagacccacagacugcugcagcaguucccccuggaccuggagaaguuccuggccuggcugaccgaggccgagaccaccgccaacgugcugcaggacgccaccagaaaggagagacugcuggaggacagcaagggcgugaaggagcugaugaagcaguggcaggaccugcagggcgagaucgaggcccacaccgacguguaccacaaccuggacgagaacagccagaagauccugagaagccuggagggcagcgacgacgccgugcugcugcagagaagacuggacaacaugaacuucaaguggagcgagcugagaaagaagagccugaacaucagaagccaccuggaggccagcagcgaccaguggaagagacugcaccugagccugcaggagcugcugguguggcugcagcugaaggacgacgagcugagcagacaggcccccaucggcggcgacuuccccgccgugcagaagcagaacgacgugcacagagccuucaagagagagcugaagaccaaggagcccgugaucaugagcacccuggagaccgugagaaucuuccugaccgagcagccccuggagggccuggagaagcuguaccaggagcccagagagcugccccccgaggagagagcccagaacgugaccagacugcugagaaagcaggccgaggaggugaacaccgagugggagaagcugaaccugcacagcgccgacuggcagagaaagaucgacgagacccuggagagacugcaggagcugcaggaggccaccgacgagcuggaccugaagcugagacaggccgaggugaucaagggcagcuggcagcccgugggcgaccugcugaucgacagccugcaggaccaccuggagaaggugaaggcccugagaggcgagaucgccccccugaaggagaacgugagccacgugaacgaccuggccagacagcugaccacccugggcauccagcugagccccuacaaccugagcacccuggaggaccugaacaccagauggaagcugcugcagguggccguggaggacagagugagacagcugcacgaggcccacagagacuucggccccgccagccagcacuuccugagcaccagcgugcagggccccugggagagagccaucagccccaacaaggugcccuacuacaucaaccacgagacccagaccaccugcugggaccaccccaagaugaccgagcuguaccagagccuggccgaccugaacaacgugagauucagcgccuacagaaccgccaugaagcugagaagacugcagaaggcccugugccuggaccugcugagccugagcgccgccugcgacgcccuggaccagcacaaccugaagcagaacgaccagcccauggacauccugcagaucaucaacugccugaccaccaucuacgacagacuggagcaggagcacaacaaccuggugaacgugccccugugcguggacaugugccugaacuggcugcugaacguguacgacaccggcagaaccggcagaaucagagugcugagcuucaagaccggcaucaucagccugugcaaggcccaccuggaggacaaguacagauaccuguucaagcagguggccagcagcaccggcuucugcgaccagagaagacugggccugcugcugcacgacagcauccagauccccagacagcugggcgagguggccagcuucggcggcagcaacaucgagcccagcgugagaagcugcuuccaguucgccaacaacaagcccgagaucgaggccgcccuguuccuggacuggaugagacuggagccccagagcaugguguggcugcccgugcugcacagaguggccgccgccgagaccgccaagcaccaggccaagugcaacaucugcaaggagugccccaucaucggcuucagauacagaagccugaagcacuucaacuacgacaucugccagagcugcuucuucagcggcagaguggccaagggccacaagaugcacuaccccaugguggaguacugcacccccaccaccagcggcgaggacgugagagacuucgccaaggugcugaagaacaaguucagaaccaagagauacuucgccaagcaccccagaaugggcuaccugcccgugcagaccgugcuggagggcgacaacauggagacccccgugacccugaucaacuucuggcccguggacagcgcccccgccagcagcccccagcugagccacgacgacacccacagcagaaucgagcacuacgccagcagacuggccgagauggagaacagcaacggcagcuaccugaacgacagcaucagccccaacgagagcaucgacgacgagcaccugcugauccagcacuacugccagagccugaaccaggacagcccccugagccagcccagaagccccgcccagauccugaucagccuggagagcgaggagagaggcgagcuggagagaauccuggccgaccuggaggaggagaacagaaaccugcaggccgaguacgacagacugaagcagcagcacgagcacaagggccugagcccccugcccagcccccccgagaugaugcccaccagcccccagagccccagagacgccgagcugaucgccgaggccaagcugcugagacagcacaagggcagacuggaggccagaaugcagauccuggaggaccacaacaagcagcuggagagccagcugcacagacugagacagcugcuggagcagccccaggccgaggccaaggugaacggcaccaccgugagcagccccagcaccagccugcagagaagcgacagcagccagcccaugcugcugagaguggugggcagccagaccagcgacagcaugggcgaggaggaccugcugagccccccccaggacaccagcaccggccuggaggaggugauggagcagcugaacaacagcuuccccagcagcagaggcagaaacacccccggcaagcccaugagagaggacaccauguaa

SEQ ID NO: 16177 - RNA, 2601 nt, Artificial Sequence
  DMGDH__Homo_sapiens__NP_037523
augcugagacccggcgcccagcugcugagaggccugcugcugagaagcugcccccugcagggcagccccggcagacccagaagcgugugcggcagagagggcgaggagaagcccccccugagcgccgagacccaguggaaggacagagccgagaccgugaucaucggcggcggcugcgugggcgugagccuggccuaccaccuggccaaggccggcaugaaggacguggugcugcuggagaagagcgagcugaccgccggcagcaccuggcacgccgccggccugaccaccuacuuccaccccggcaucaaccugaagaagauccacuacgacagcaucaagcuguacgagaagcuggaggaggagaccggccagguggugggcuuccaccagcccggcagcaucagacuggccaccacccccgugagaguggacgaguucaaguaccagaugaccagaaccggcuggcacgccaccgagcaguaccugaucgagcccgagaagauccaggagauguucccccugcugaacaugaacaaggugcuggccggccuguacaaccccggcgacggccacaucgaccccuacagccugaccauggcccuggccgccggcgccagaaagugcggcgcccugcugaaguaccccgcccccgugaccagccugaaggccagaagcgacggcaccugggacguggagaccccccagggcagcaugagagccaacagaaucgugaacgccgccggcuucugggccagagaggugggcaagaugaucggccuggagcacccccugauccccgugcagcaccaguacguggugaccagcaccaucagcgaggugaaggcccugaagagagagcugcccgugcugagagaccuggagggcagcuacuaccugagacaggagagagacggccugcuguucggccccuacgagagccaggagaagaugaaggugcaggacagcugggugaccaacggcgugccccccggcuucggcaaggagcuguucgagagcgaccuggacagaaucauggagcacaucaaggccgccauggagauggugcccgugcugaagaaggccgacaucaucaacguggugaacggccccaucaccuacagccccgacauccugcccauggugggcccccaccagggcgugagaaacuacuggguggccaucggcuucggcuacggcaucauccacgccggcggcgugggcaaguaccugagcgacuggauccugcacggcgagccccccuucgaccugaucgagcuggaccccaacagauacggcaaguggaccaccacccaguacaccgaggccaaggccagagagagcuacggcuucaacaacaucgugggcuaccccaaggaggagagauucgccggcagacccacccagagagugagcggccuguaccagagacuggagagcaagugcagcaugggcuuccacgccggcugggagcagccccacugguucuacaagcccggccaggacacccaguacagacccagcuucagaagaaccaacugguucgagcccgugggcagcgaguacaagcaggugaugcagagaguggccgugaccgaccugagccccuucggcaaguucaacaucaagggccaggacagcaucagacugcuggaccaccuguucgccaacgugauccccaaggugggcuucaccaacaucagccacaugcugacccccaagggcagaguguacgccgagcugaccgugagccaccagagccccggcgaguuccugcugaucaccggcagcggcagcgagcugcacgaccugagauggaucgaggaggaggccgugaagggcggcuacgacguggagaucaagaacaucaccgacgagcugggcgugcugggcguggccggcccccaggccagaaaggugcugcagaagcugaccagcgaggaccugagcgacgacguguucaaguuccugcagaccaagagccugaaggugagcaacauccccgugaccgccaucagaaucagcuacaccggcgagcugggcugggagcuguaccacagaagagaggacagcguggcccuguacgacgccaucaugaacgccggccaggaggagggcaucgacaacuucggcaccuacgccaugaacgcccugagacuggagaaggccuucagagccuggggccuggagaugaacugcgacaccaacccccuggaggccggccuggaguacuucgugaagcugaacaagcccgccgacuucaucggcaagcaggcccugaagcagaucaaggccaagggccugaagagaagacuggugugccugacccuggccaccgacgacguggaccccgagggcaacgagagcaucugguacaacggcaagguggugggcaacaccaccagcggcagcuacagcuacagcauccagaagagccuggccuucgccuacgugcccgugcagcugagcgaggugggccagcagguggagguggagcugcugggcaagaacuaccccgccgugaucauccaggagccccuggugcugaccgagcccaccagaaacagacugcagaagaagggcggcaaggacaagaccuaa

SEQ ID NO: 16178 - RNA, 273 nt, Artificial Sequence
  DMKN__Homo_sapiens__NP_001030593
augaacaugaagcccgccaccgccagcgcccugcugcugcugcugcugggccuggccuggacccagggcagccacggcuggggcgccgacgccagcagccugcagaagagagccggcagagccgaccagaacuacaacuacaaccagcacgccuaccccaccgccuacggcggcaaguacagcgugaagacccccgccaagggcggcgugagccccagcagcagcgccagcagagugcagcccggccugcugcagugggugaaguucugguaa

SEQ ID NO: 16179 - RNA, 1494 nt, Artificial Sequence
  DMP1__Homo_sapiens__NP_001073380
augaagaucagcauccugcugauguuccuguggggccugagcugcgcccugcccgugaccagauaccagaacaacgagagcgaggacagcgaggaguggaagggccaccuggcccaggcccccacccccccccuggccaacgaggaccccagcgacagcacccagagcgaggagggccugggcagcgacgaccaccaguacaucuacagacuggccggcggcuucagcagaagcaccggcaagggcggcgacgacaaggacgacgacgaggacgacagcggcgacgacaccuucggcgacgacgacagcggccccggccccaaggacagacaggagggcggcaacagcagacugggcagcgacgaggacagcgacgacaccauccaggccagcgaggagagcgccccccagggccaggacagcgcccaggacaccaccagcgagagcagagagcuggacaacgaggacagaguggacagcaagcccgagggcggcgacagcacccaggagagcgagagcgaggagcacugggugggcggcggcagcgacggcgagagcagccacggcgacggcagcgagcuggacgacgagggcaugcagagcgacgaccccgagagcaucagaagcgagagaggcaacagcagaaugaacagcgccggcaugaagagcaaggagagcggcgagaacagcgagcaggccaacacccaggacagcggcggcagccagcugcuggagcaccccagcagaaagaucuucagaaagagcagaaucagcgaggaggacgacagaagcgagcuggacgacaacaacaccauggaggaggugaagagcgacagcaccgagaacagcaacagcagagacaccggccugagccagcccagaagagacagcaagggcgacagccaggaggacagcaaggagaaccugagccaggaggagagccagaacguggacggccccagcagcgagagcagccaggaggccaaccugagcagccaggagaacagcagcgagagccaggaggagguggugagcgagagcagaggcgacaaccccgaccccaccaccagcuacguggaggaccaggaggacagcgacagcagcgaggaggacagcagccacacccugagccacagcaagagcgagagcagagaggagcaggccgacagcgagagcagcgagagccugaacuucagcgaggagagccccgagagccccgaggacgagaacagcagcagccaggagggccugcagagccacagcagcagcgccgagagccagagcgaggagagccacagcgaggaggacgacagcgacagccaggacagcagcagaagcaaggaggacagcaacagcaccgagagcaagagcagcagcgaggaggacggccagcugaagaacaucgagaucgagagcagaaagcugaccguggacgccuaccacaacaagcccaucggcgaccaggacgacaacgacugccaggacggcuacuaa

SEQ ID NO: 16180 - RNA, 1875 nt, Artificial Sequence
  DMPK__Homo_sapiens__NP_001075029
augagcgccgaggugagacugagaagacugcagcagcuggugcuggaccccggcuuccugggccuggagccccugcuggaccugcugcugggcgugcaccaggagcugggcgccagcgagcuggcccaggacaaguacguggccgacuuccugcagugggccgagcccaucguggugagacugaaggaggugagacugcagagagacgacuucgagauccugaaggugaucggcagaggcgccuucagcgagguggccguggugaagaugaagcagaccggccagguguacgccaugaagaucaugaacaagugggacaugcugaagagaggcgaggugagcugcuucagagaggagagagacgugcuggugaacggcgacagaagauggaucacccagcugcacuucgccuuccaggacgagaacuaccuguaccuggugauggaguacuacgugggcggcgaccugcugacccugcugagcaaguucggcgagagaauccccgccgagauggccagauucuaccuggccgagaucgugauggccaucgacagcgugcacagacugggcuacgugcacagagacaucaagcccgacaacauccugcuggacagaugcggccacaucagacuggccgacuucggcagcugccugaagcugagagccgacggcaccgugagaagccugguggccgugggcacccccgacuaccugagccccgagauccugcaggccgugggcggcggccccggcaccggcagcuacggccccgagugcgacuggugggcccugggcguguucgccuacgagauguucuacggccagacccccuucuacgccgacagcaccgccgagaccuacggcaagaucgugcacuacaaggagcaccugagccugccccugguggacgagggcgugcccgaggaggccagagacuucauccagagacugcugugcccccccgagaccagacugggcagaggcggcgccggcgacuucagaacccaccccuucuucuucggccuggacugggacggccugagagacagcgugccccccuucacccccgacuucgagggcgccaccgacaccugcaacuucgaccugguggaggacggccugaccgccauggagacccugagcgacaucagagagggcgccccccugggcgugcaccugcccuucgugggcuacagcuacagcugcauggcccugagagacagcgaggugcccggccccacccccauggagcuggaggccgagcagcugcuggagccccacgugcaggcccccagccuggagcccagcgugagcccccaggacgagaccgccgagguggccgugcccgccgccgugcccgccgccgaggccgaggccgaggugacccugagagagcugcaggaggcccuggaggaggaggugcugaccagacagagccugagcagagagauggaggccaucagaaccgacaaccagaacuucgccagccagcugagagaggccgaggccagaaacagagaccuggaggcccacgugagacagcugcaggagagaauggagcugcugcaggccgagggcgccaccgccgugaccggcgugcccagccccagagccaccgacccccccagccaccuggacggcccccccgccguggccgugggccagugcccccuggugggccccggccccaugcacagaagacaccugcugcugcccgccagagugcccagacccggccugagcgaggcccugagccugcugcuguucgccguggugcugagcagagccgccgcccugggcugcaucggccugguggcccacgccggccagcugaccgccguguggagaagacccggcgccgccagagcccccuaa

SEQ ID NO: 16181 - RNA, 1122 nt, Artificial Sequence
  DMRT1__Homo_sapiens__NP_068770
augcccaacgacgaggccuucagcaagcccagcacccccagcgaggccccccacgcccccggcgugcccccccagggcagagccggcggcuucggcaaggccagcggcgcccuggugggcgccgccagcggcagcagcgccggcggcagcagcagaggcggcggcagcggcagcggcgccagcgaccugggcgccggcagcaagaagagccccagacugcccaagugcgccagaugcagaaaccacggcuacgccagcccccugaagggccacaagagauucugcauguggagagacugccagugcaagaagugcaaccugaucgccgagagacagagagugauggccgcccagguggcccugagaagacagcaggcccaggaggaggagcugggcaucagccaccccaucccccugcccagcgccgccgagcugcuggugaagagagagaacaacggcagcaaccccugccugaugaccgagugcagcggcaccagccagcccccccccgccagcgugcccaccaccgccgccagcgagggcagaauggugauccaggacauccccgccgugaccagcagaggccacguggagaacacccccgaccuggugagcgacagcaccuacuacagcagcuucuaccagcccagccuguuccccuacuacaacaaccuguacaacugcccccaguacagcauggcccuggccgccgacagcgccagcggcgaggugggcaacccccugggcggcagccccgugaagaacagccugagaggccugcccggccccuacgugcccggccagaccggcaaccaguggcagaugaagaacauggagaacagacacgccaugagcagccaguacagaaugcacagcuacuaccccccccccagcuaccugggccagagcgugccccaguucuucaccuucgaggacgcccccagcuaccccgaggccagagccagcguguucagcccccccagcagccaggacagcggccuggugagccugagcagcagcagccccaucagcaacaagagcaccaaggccgugcuggagugcgagcccgccagcgagcccagcagcuucaccgugacccccgugaucgaggaggacgaguaa

SEQ ID NO: 16182 - RNA, 1164 nt, Artificial Sequence
  DMRT2__Homo_sapiens__XP_006716781
auggacaagaagggccugagcggcaagcagaacaacuucgagagaaaggccguguaccagagacaggugagagcccccagccugcuggccaagagcauccuggagggcuacagacccauccccgccgagaccuacgugggcggcaccuucccccugcccccccccgugagcgacagaaugagaaagagaagagccuucgccgacaaggagcuggagaacaucaugcuggagagagaguacaaggagagagagaugcuggagaccagccaggccgccgcccuguuccugcccaacagaauggugcccggccccgacuacaacagcuacaagagcgccuacagccccagccccguggagccccccagcaaggacuucugcaacuuccugcccaccugccuggaccugaccaugcaguacagcggcagcggcaacauggagcugaucagcagcaacgugagcguggccaccaccuacagacaguacccccugagcagcagauuccugguguggcccaagugcggccccaucagcgacacccugcuguaccagcagugccugcugaacgccaccaccagcgugcaggcccugaagcccggcgccagcugggaccugaagggcgccagagugcaggacggccugagcgccgagcaggacaugaugcccagcaagcuggagggcagccuggugcugccccacacccccgagauccagaccaccagaagcgaccugcagggccaccaggccgugcccgagagaagcgccuucagcccccccagaagaaacuucagccccaucguggacaccgacagccuggccgcccagggccacgugcugaccaagaucagcaaggagaacaccagacacccccugccccugagacacaaccccuuccacagccuguuccagcagacccugaccgacaagagcggccccgagcugaagacccccuucgugaaggaggccuucgaggagacccccaagaagcacagagagugccuggugaaggacaaccagaaguacaccuucaccaucgacagaugcgccaaggaccuguucguggccaagcaggugggcaccaagcugagcgugaacgagccccugagcuucagcguggagagcauccugaagagacccagcagcgccaucaccagagugagccaguaa

SEQ ID NO: 16183 - RNA, 1419 nt, Artificial Sequence
  DMRT3__Homo_sapiens__NP_067063
augaacggcuacggcagccccuaccuguacaugggcggccccgugagccagccccccagagccccccugcagagaacccccaagugcgccagaugcagaaaccacggcgugcugagcuggcugaagggccacaagagauacugcagauucaaggacugcaccugcgagaagugcauccugaucaucgagagacagagagugauggccgcccagguggcccugagaagacagcaggccaacgagagccuggagagccugauccccgacagccugagagcccugcccggcccccccccccccggcgacgccguggccgccccccagcccccccccgccagccagcccagccagccccagccccccagacccgccgccgagcuggccgccgccgccgcccugagauggaccgccgagccccagcccggcgcccugcaggcccagcuggccaagcccgaccugaccgaggagagacugggcgacggcaagagcgccgacaacaccgagguguucagcgacaaggacaccgaccagagaagcagccccgacguggccaagagcaagggcugcuucacccccgagagccccgagaucgugagcguggaggagggcggcuacgccgugcagaagaacggcggcaaccccgagagcagacccgacagccccaagugccacgccgagcagaaccaccugcugaucgagggccccagcggcaccgugagccugcccuucagccugaaggccaacagacccccccuggaggugcugaagaagaucuuccccaaccagaagcccaccgugcuggagcugauccugaagggcugcggcggcgaccuggugagcgccguggaggugcugcugagcagcagaagcagcgugaccggcgccgagagaaccagcgccgagcccgagagccuggcccugcccagcaacggccacaucuucgagcacacccugagcagcuaccccaucagcagcagcaaguggagcgugggcagcgccuucagagugcccgacacccugagauucagcgccgacagcagcaacguggugcccagcccccuggccggcccccugcagccccccuucccccagccccccagauacccccugaugcugagaaacacccuggccagaagccagagcagccccuuccugcccaacgacgugacccuguggaacaccaugacccugcagcagcaguaccagcugagaagccaguacgugagccccuuccccagcaacagcaccagcguguucagaagcagccccgugcugcccgccagagccaccgaggaccccagaaucagcauccccgacgacggcugccccuucgugagcaagcagagcaucuacaccgaggacgacuacgacgagagaagcgacagcagcgacagcagaacccugaacaccagcagcuaa

SEQ ID NO: 16184 - RNA, 1515 nt, Artificial Sequence
  DMRTA1__Homo_sapiens__NP_071443
auggagagaagccagugcggcagcagagacagaggcgugagcggcagaccccaccuggcccccggccuggugguggccgccccccccccccccagccccgcccugcccgugcccagcggcaugcaggugccccccgccuuccugagaccccccagccuguuccugagagccgccgccgccgccgccgccgccgccgccgccaccagcggcagcggcggcugcccccccgcccccggccuggagagcggcgugggcgccgugggcugcggcuaccccagaacccccaagugcgccagaugcagaaaccacggcguggugagcgcccugaagggccacaagagauucugcagauggagagacugcgccugcgccaagugcacccugaucgccgagagacagagagugauggccgcccagguggcccugagaagacagcaggcccaggaggagagcgaggccagaggccugcagagacugcugugcagcggccugagcuggccccccggcggcagagccagcggcggcggcggcagagccgagaacccccagagcaccggcggccccgccgccggcgccgcccugggccugggcgcccugagacaggccagcggcagcgccacccccgccuucgagguguuccagcaggacuaccccgaggagaagcaggagcagaaggagagcaagugcgagagcugccagaacggccaggaggagcugaucagcaagagccaccagcuguaccugggcagcagcagcagaagcaacggcgugaucggcaagcagagcaucggcagcagcaucagcgaguacagcaacaagcccgacagcauccugagcccccaccccggcgagcagagcggcggcgaggagagccccagaagccugagcagcagcgaccuggagagcggcaacgagagcgagugggugaaggaccugaccgccaccaaggccagccugcccaccgugagcagcagacccagagacccccuggacauccugaccaagaucuuccccaacuacagaagaagcagacuggagggcauccugagauucugcaagggcgacguggugcaggccaucgagcaggugcugaacggcaaggagcacaagcccgacaacagaaaccuggccaacagcgaggagcuggagaacaccgccuuccagagagccagcagcuucagccuggccggcaucggcuucggcacccugggcaacaagagcgccuucagcccccugcagaccaccagcgccagcuacggcggcgacagcagccuguacggcgugaaccccagagugggcaucagcccccugagacuggccuacagcagcgccggcagaggccugagcggcuucaugagccccuaccugacccccggccuggugcccacccugcccuucagacccgcccuggacuacgccuucagcggcaugaucagagacagcagcuaccugagcagcaaggacagcaucaccugcggcagacuguacuucagacccaaccaggacaaccccuaa

SEQ ID NO: 16185 - RNA, 2019 nt, Artificial Sequence
  DMTF1__Homo_sapiens__NP_001135798
augaccgccaccaccgagguggccgacgacgaggugaccgagggcaccgugacccagauccagauccugcagaacgagcagcuggacgagaucagcccccugggcaacgaggaggugagcgccgugagccaggccugguucaccaccaaggaggacaaggacagccugaccaacaagggccacaaguggaagcagggcauguggagcaaggaggagaucgacauccugaugaacaacaucgagagauaccugaaggccagaggcaucaaggacgccaccgagaucaucuucgagaugagcaaggacgagagaaaggacuucuacagaaccaucgccuggggccugaacagaccccuguucgccguguacagaagagugcugagaauguacgacgacagaaaccacgugggcaaguacacccccgaggagaucgagaagcugaaggagcugagaaucaagcacggcaacgacugggccaccaucggcgccgcccugggcagaagcgccagcagcgugaaggacagaugcagacugaugaaggacaccugcaacaccggcaaguggaccgaggaggaggagaagagacuggccgagguggugcacgagcugaccagcaccgagcccggcgacaucgugacccagggcgugagcugggccgccguggccgagagagugggcaccagaagcgagaagcagugcagaagcaaguggcugaacuaccugaacuggaagcagagcggcggcaccgaguggaccaaggaggacgagaucaaccugauccugagaaucgccgagcuggacguggccgacgagaacgacaucaacugggaccugcuggccgagggcuggagcagcgugagaagcccccaguggcugagaagcaagugguggaccaucaagagacagaucgccaaccacaaggacgugagcuuccccgugcugaucaagggccugaagcagcugcacgagaaccagaagaacaaccccacccugcuggagaacaagagcggcagcggcgugcccaacagcaacaccaacagcagcgugcagcacgugcagaucagaguggccagacuggaggacaacaccgccaucagcagcagccccauggccgcccugcagauccccgugcagaucacccacgugagcagcgccgacagccccgccaccguggacagcgagaccaucacccugaacagcggcacccugcagaccuucgagauccugcccagcuuccaccugcagcccaccggcacccccggcaccuaccugcugcagaccagcagcagccagggccugccccugacccugaccgccagccccaccgugacccugaccgccgccgcccccgccagccccgagcagaucaucgugcacgcccugagccccgagcaccugcugaacaccagcgacaacgugaccgugcagugccacacccccagagugaucauccagaccguggccaccgaggacaucaccagcagcaucagccaggccgagcugaccguggacagcgacauccagagcagcgacuuccccgagccccccgacgcccuggaggccgacaccuuccccgacgagauccaccaccccaagaugaccguggagcccagcuucaacgacgcccacgugagcaaguucagcgaccagaacagcaccgagcugaugaacagcgugauggugagaaccgaggaggagaucagcgacaccgaccugaagcaggaggagagccccagcgaccuggccagcgccuacgugaccgagggccuggagagccccaccaucgaggagcagguggaccagaccaucgacgacgagaccauccugaucgugcccagcccccacggcuucauccaggccagcgacgugaucgacaccgagagcgugcugccccugaccacccugaccgaccccauccugcagcaccaccaggaggagagcaacaucaucggcagcagccugggcagccccgugagcgaggacagcaaggacguggaggaccuggugaacugccacuaa

SEQ ID NO: 16186 - RNA, 1077 nt, Artificial Sequence
  DMTN__Homo_sapiens__NP_001107611
auggagagacugcagaaggccaagauggacaaccaggugcugggcuacaaggaccuggccgccauccccaaggacaaggccauccuggacaucgagagacccgaccugaugaucuacgagccccacuucaccuacagccugcuggagcacguggagcugcccagaagcagagagagaagccugagccccaagagcaccagccccccccccagccccgaggugugggccgacagcagaagccccggcaucaucagccaggccagcgcccccagaaccaccggcacccccagaaccagccugccccacuuccaccaccccgagaccagcagacccgacagcaacaucuacaagaagccccccaucuacaagcagagagagagcgugggcggcagcccccagaccaagcaccugaucgaggaccugaucaucgagagcagcaaguuccccgccgcccagccccccgaccccaaccagcccgccaagaucgagaccgacuacuggcccugcccccccagccuggccgugguggagaccgaguggagaaagagaaaggccagcagaagaggcgccgaggaggaggaggaggaggaggacgacgacagcggcgaggagaugaaggcccugagagagagacagagagaggagcugagcaaggugaccagcaaccugggcaagaugauccugaaggaggagauggagaagagccugcccaucagaagaaagaccagaagccugcccgacagaacccccuuccacaccagccugcaccagggcaccagcaagagcagcagccugcccgccuacggcagaaccacccugagcagacugcagagcaccgaguucagccccagcggcagcgagaccggcagccccggccugcagaucuaccccuacgagaugcugguggugaccaacaagggcagaaccaagcugccccccggcguggacagaaugagacuggagagacaccugagcgccgaggacuucagcagaguguucgccaugagccccgaggaguucggcaagcuggcccuguggaagagaaacgagcugaagaagaaggccagccuguucuaa

SEQ ID NO: 16187 - RNA, 2025 nt, Artificial Sequence
  DMWD__Homo_sapiens__NP_004934
auggccgccggcggcgccgagggcggcagcggccccggcgccgccaugggcgacugcgccgagaucaagagccaguucagaaccagagagggcuucuacaagcugcugcccggcgacggcgccgccagaagaagcggccccgccagcgcccagacccccgugcccccccagcccccccagcccccccccggccccgccagcgccagcggccccggcgccgccggccccgccagcagccccccccccgccggccccggccccggccccgcccugcccgccgugagacugagccuggugagacugggcgagcccgacagcgccggcgccggcgagccccccgccacccccgccggccugggcagcggcggcgacagagugugcuucaaccugggcagagagcuguacuucuaccccggcugcugcagaagaggcagccagagaagcaucgaccugaacaagcccaucgacaagagaaucuacaagggcacccagcccaccugccacgacuucaaccaguucaccgccgccaccgagaccaucagccugcuggugggcuucagcgccggccaggugcaguaccuggaccugaucaagaaggacaccagcaagcuguucaacgaggagagacugaucgacaagaccaaggugaccuaccugaaguggcugcccgagagcgagagccuguuccuggccagccacgccagcggccaccuguaccuguacaacgugagccaccccugcgccagcgcccccccccaguacagccugcugaagcagggcgagggcuucagcguguacgccgccaagagcaaggcccccagaaacccccuggccaagugggccgugggcgagggcccccugaacgaguucgccuucagccccgacggcagacaccuggccugcgugagccaggacggcugccugagaguguuccacuucgacagcaugcugcugagaggccugaugaagagcuacuucggcggccugcugugcgugugcuggagccccgacggcagauacguggugaccggcggcgaggacgaccuggugaccguguggagcuucaccgagggcagagugguggccagaggccacggccacaagagcugggugaacgccguggccuucgaccccuacaccaccagagccgaggaggccgccaccgccgccggcgccgacggcgagagaagcggcgaggaggaggaggaggagcccgaggccgccggcaccggcagcgccggcggcgccccccugagcccccugcccaaggccggcagcaucaccuacagauucggcagcgccggccaggacacccaguucugccugugggaccugaccgaggacgugcuguacccccaccccccccuggccagaaccagaacccugcccggcacccccggcaccaccccccccgccgccagcagcagcagaggcggcgagcccggccccggcccccugcccagaagccugagcagaagcaacagccugccccaccccgccggcggcggcaaggccggcggccccggcguggccgccgagcccggcacccccuucagcaucggcagauucgccacccugacccugcaggagagaagagacagaggcgccgagaaggagcacaagagauaccacagccugggcaacaucagcagaggcggcagcggcggcagcggcagcggcggcgagaagcccagcggccccgugcccagaagcagacuggaccccgccaaggugcugggcaccgcccugugccccagaauccacgaggugccccugcuggagccccuggugugcaagaagaucgcccaggagagacugaccgugcugcuguuccuggaggacugcaucaucaccgccugccaggagggccugaucugcaccugggccagacccggcaaggccuucaccgacgaggagaccgaggcccagaccggcgagggcagcuggcccagaagccccagcaagagcgugguggagggcaucagcagccagcccggcaacagccccagcggcaccgugguguaa

SEQ ID NO: 16188 - RNA, 9147 nt, Artificial Sequence
  DMXL1__Homo_sapiens__NP_001277250
augaaccugcaccaggugcugaccggcgccgugaaccccggcgaccacugcuucagcgugggcagcaucggcgaccagagauucaccgccuacgccagcggcugcgacaucgugauccugggcagcgacuucgagagacugcagaucauccccggcgccaagcacggcaacauccaggugggcugcguggacugcagcaugcagcagggcaagaucgccgccagcuacggcaacgugaucagcaucuucgagcccgugaaccugcccaagcagaagaagaaccuggagcuguacagccaguggcagaagagcggccaguucuuccuggagagcaucgcccacaacaucaccugggaccccaccggcagcagacugcugaccggcagcagcuaccugcagcuguggagcaacaccaaccuggagaagcccaccgaggacgagaaccugaacaagaccgaccugaacuucggcgacuggaagugcaucuggcacugcaagaccgccagccaggugcaccugaugaaguucagccccgacggcgaguucuucgccaccgccggcaaggacgacugccugcugaaggugugguacaacguggagaacuggagaaccgccgugaccagccccgacggcagcagcgagaagcagagccagggcgagaucgacuucagcuucguguaccuggcccaccccagagccgugaacggcuucagcuggagaaagaccagcaaguacaugcccagagccagcgugugcaacgugcugcugaccugcugcaaggacaacgugugcagacuguggguggagaccuuccugcccaacgacugccugcuguacggcggcgacugcagccacuggaccgagagcaucaaccugaccaacaacuucaagagaaacgccagcagcaaggagagagugcagaacgcccuggaggugaaccugagacacuucagaagaggcagaagaagaagccuggcccugguggcccacaccggcuaccugccccaccagcaggacccccaccacgugcacagaaacaccccccugcacgccaacgcccugugccacuuccacaucgccgccagcaucaaccccgccaccgacaucccccugcugcccagcaucaccagccugagccugaacgagaacgaggagaagaccggccccuucguggugcacuggcugaacaacaaggagcugcacuucacccugagcauggagguguuccugcagcagcugagaaagagcuucgagcagcccagcagcgaggccagcguggaggacagcaaccaggccgacgugaagagcgacgaggagaccgacgacggcguggacgaccugaagaucaaccccgagaagaaggagcugggcugcgacaagauggugcccaacagcagcuucaccagccugagcagcgccgccaucgaccaccagaucgaggugcugcugagcgaguggagcaagaacgccgacaugcuguucagcauccaccccauggacggcagccugcugguguggcacguggacuggcuggacgaguaccagcccggcauguucagacaggugcaggugagcuucgugagcagaauccccguggccuuccccaccggcgacgccaacagccugugcaagagcaucaugauguacgccugcaccaagaacguggaccuggccauccagcagggcaagcagaagcccagcggccugaccagaagcaccagcaugcugaucagcagcggccacaacaagagcagcaacagccugaagcugagcaucuucacccccaacgugaugaugaucagcaagcacgccgacggcagccugaaccaguggcuggugagcuucgccgaggagagcgccuucagcaccgugcugagcaucagccacaagagcagauacugcggccacagauuccaccugaacgaccuggccugccacagcgugcugccccugcugcugaccaccagccaccacaacgcccugagaacccccgacguggacaaccccgagcagcccuucgacgcccugaacaucgaggagugcagccugacccagcagaacaagagcaccguggacguggccuuccaggaccccagcgccguguacagcgagcugauccuguggagaguggaccccgugggcccccugagcuucagcggcggcgugagcgagcuggccagaaucaacagccugcacgugagcgccuucagcaacguggccuggcugcccacccugauccccagcuacugccugggcgccuacugcaacagccccagcgccugcuucguggccagcgacggccaguaccugagacuguacgaggccgugaucgacgccaagaagcugcugagcgagcugagcaaccccgagaucagcaaguacgugggcgagguguucaacaucgugagccagcagagcaccgccagacccggcugcaucaucgcccuggaccccaucaccaagcugcacggcagaaagacccagcugcugcacguguucgaggaggacuucauccugaacaaccuggagaagaagagccugggcaaggacagcauccugagcaacgccggcagcagccccaacggcuucagcgagaaguucuaccugaucgugaucgagugcacccaggacaacagaagccugcugcacauguggaaccugcaccugaagagcauccccgugagccuggacgagaagguggacaccaagcugagcgaggccguguggcagcccgaggagcacuacagcagcagccccgagaagauccugagccccuucagccagaaguaccaggccugcagagccaaccugcagagcaccagcagacugacccuguucagcgagaugguguacagccaggagcugcaccugcccgagggcguggagaucaucagcaucaagcccagcgccggccaccugagcagcagcagcaucuaccccgccugcagcgcccccuaccugcuggccaccagcugcagcgacgagaaggugagauucuggagaugcagagugaccgacggcgagagcgccaccagcaagaacggcaagaucgaccuggccuacaucugggaggaguggccccugcugaucgaggacggccugcagagcaacagcagcaucaccgugcccggcagacccguggaggugagcugcgcccacaccaacagacuggccguggccuacaagcagcccgccagcaacagcagaagcagccaggacuucgugaugcacgugagcaucuucgagugcgagagcaccggcggcagcugcugggugcuggagcagaccauccaccuggacgagcugagcaccgugcuggacagcggcaucagcguggacagcaaccugguggccuacaacaagcaggacauguaccugagcagcaaggagaacaucaccagcaacaccaagcaccuggugcaccuggacuggaugagcagagaggacggcagccacauccugaccgugggcaucggcagcaagcuguucauguacggcccccuggccggcaaggugcaggaccagaccggcaaggagacccuggccuucccccugugggagagcaccaagguggugccccugagcaaguucgugcugcugagaagcguggaccuggugagcagcguggacggcagcccccccuuccccgugagccugagcugggugagagacggcauccugguggugggcauggacugcgagaugcacguguacugccaguggcagcccagcagcaagcaggagcccgugaucaccgacagcuacagcggcagcacccccagcaucaccagccugaucaagcagagcaacagcagcagcggccugcacccccccaagaagacccugaccagaagcaugaccagccuggcccagaagaucugcggcaagaagaccgccuucgaccccagcguggacauggaggacagcggccuguucgaggccgcccacgugcugagccccacccugccccaguaccacccccugcagcugcuggagcugauggaccugggcaaggugagaagagccaaggccauccugagccaccuggugaagugcaucgccggcgaggugguggcccugaacgaggccgagagcaaccacgagagaagacugagaagccugaccaucagcgccagcggcagcaccaccagagacccccaggccuucaacaaggccgagaacaccgacuacaccgagaucgacagcgugcccccccugccccuguacgcccugcuggccgccgacgacgacagcugcuacagcagccuggagaagagcagcaacgagagcacccugagcaagagcaaccagcugagcaaggagagcuacgacgagcuguuccagacccagcugcugaugaccgacacccacaugcuggagaccgacgaggagaacaccaagcccagagugaucgaccugagccaguacagccccaccuacuucggccccgagcacgcccaggugcugagcggccaccugcugcacagcagccugcccggccugagcagaauggagcagaugagccugauggcccuggccgacaccaucgccaccaccagcaccgacaucggcgagagcagagacagaagccagggcggcgagacccuggacgagugcggccugaaguuccugcuggccgugagacugcacaccuuccugaccaccagccugcccgccuacagagcccagcugcugcaccagggccugagcaccagccacuucgccugggccuuccacagcguggccgaggaggagcugcugaacaugcugcccgccaugcagaaggacgaccccaccuggagcgagcugagagccaugggcgugggcuggugggugagaaacaccagaauccugagaaagugcaucgagaagguggccaaggccgccuucuacagaaagaacgacccccuggacgccgccaucuucuaccuggccaugaagaagaaggccgugaucuggggccuguacagagccgagaagaacaccagaaugacccaguucuucggccacaacuucgaggacgagagauggagaaaggccgcccugaagaacgccuucagccugcugggcaagcagagauucgagcacagcgccgccuucuuccugcuggccggcugccugagagacgccaucgaggugugccuggagaagcugaacgacauccagcuggcccuggugaucgccagacuguacgagagcgaguucgacaccagcgccgccuacaagagcauccugagaaagaaggugcugggcaucgacagccccgugagcgagcugugcagccugaacaucaacaugcaccacgaccccuuccugagaagcauggccuacuggauccuggaggacuacagcggcgcccuggagacccugaucaagcagcccaucagagagaacgacgaccaggugcugagcgccagcaaccccaccguguucaacuucuacaacuaccugagaacccacccccugcugcugagaagacacuucggcagcagcgacaccuucagcacccacaugagccugaccggcaagagcggccuggccggcaccaucaaccugagcgagagaagacuguucuucaccaccgccagcgcccaccugaaggccggcugccccaugcuggcccuggaggugcugagcaagaugcccaaggugaucaagaagaccagacccuucuacagagccagcagcuuccuggacaccagcaaggacugcagccccagcagcccccugaagcuggacgccagagaggacaagagcagcgccguggacuggagccagagccugaucaacggcuucggcagcagcagcgagggcagcagcgagaagcagagcaacagcacccugagcuucgacuggagccagcccagcgugguguuccaggacgacagccuggagcugaagugggacagcgacaacgacgaggagaacgaggacgugcccaucagcaugaaggagcugaagccccugcagagaaagaccgacaagaagcuggacgacaucagcagcaacuacaccgagagcuucagcacccuggacgagaacgaccugcugaaccccagcgaggacaucaucgccgugcagcugaaguucagagccugccugaagauccugaccguggagcugagaacccugagcaccggcuacgagaucgacggcggcaagcugagauaccagcuguaccacuggcuggagaaggaggugaucgcccugcagagaaccugcgacuucugcagcgacgccgaggagcugcagagcgccuucggcagaaacgaggacgaguucggccugaacgaggacgccgaggaccugccccaccagaccaaggugaagcagcugagagagaacuuccaggagaagagacaguggcugcugaaguaccagagccugcugagaauguuccugagcuacugcauccugcacggcagccacggcggcggccuggccagcgugagaauggagcugauccugcugcugcaggagagccagcaggagaccagcgagccccuguucagcagcccccugagcgagcagaccagcgugccccugcuguucgccugcaccgccaacgccaagaccgugguggccaacccccugcugcaccugagcaaccugacccacgacauccugcacgccaucaucaacuucgacagccccccccaccccgacauccagagcaacaagguguacgugaugcacacccuggccgccagccugagcgccugcaucuaccagugccugugcggcagccacaacuacagcagcuuccagaccaaccaguucaccggcaugguguaccagaccgugcugcugccccacagacccagccugaagaccggcagccuggacgaggcccugacccccaacaccagccccgcccaguggcccggcaucaccugccugaucagacugcugaacagcagcggcgaggaggcccagagcggccugaccgugcugcugugcgagauccugaccgccguguaccugagccuguucauccacggccuggccacccacagcagcaacgagcuguucagaaucguggcccacccccugaacgagaagauguggagcgccguguucggcggcggcgcccacgugcccagcaaggagcagacccacagcaagacccugcccgugagcagccugguggaggagggcgagaagcagaacaagagauucagacccagcaagaugagcugcagagagagcgccccccugacccccagcagcgcccccgugagccaggagagccuggccgugaaggagaaguucaucccccccgagcugagcaucugggacuacuucaucgccaagcccuuccugcccagcagccagagcagagccgaguacgacagcgaggagagccugggcagcgacgacgacgacaacgacgacgacgacgacgugcuggccagcgacuuccaccugcaggagcacagcaacagcaacagcuacagcuggagccugaugagacuggccauggugcagcuggugcugaacaaccugaagaccuucuaccccuucgccggccacgaccuggccgagcugcccgugagcagcccccugugccacgccgugcugaagacccugcagugcugggagcaggugcugcugagaagacuggagauccacggcggccccccccagaacuacaucgccagccacaccgccgaggagagccugagcgccggccccgccauccugagacacaaggcccugcuggagcccaccaacacccccuucaagagcaagcaccaccuggcccugagcgugaagagacuguggcaguaccuggugaagcaggaggagauccaggagaccuucaucaagaacaucuucaccaagaagagaugccugaacgagagccuggaggacaacagcgagaccaucaagaacagcaugauggaggagcccaacaucaacaagaucgaggccgaccugggcuaccccggcggcaaggccagaaucauccacaaggagagcgacaucaucaccgccuucgccgugaacaaggccaacagaaacugcaucgccaucgccagcagccacgacgugcaggagcuggacgugagcggcauccuggccacccagguguacaccuggguggacgacgacaucgagguggagaccaagggcagcgaggacuuccuggugauccacgccagagacgaccugaccgccgugcagggcaccacccccuacacccacagcaaccccggcacccccaucaacaugcccuggcugggcagcacccagaccggcagaggcgccagcgugaugaucaagaaggccaucaacaacgugagaagaaugaccagccaccccacccugcccuacuaccugaccggcgcccaggacggcagcgugagaauguucgaguggggccacagccagcagaucaccugcuucagaagcggcggcaacagcagagugaccagaaugagauucaacuaccagggcaacaaguucggcaucguggacgccgacggcuaccugagccuguaccagaccaacuggaagugcugccccgugaccggcagcaugcccaagcccuaccugaccuggcagugccacaacaagaccgccaacgacuucguguucgugagcagcagcagccugaucgccaccgccggccugagcaccgacaacagaaacgugugccugugggacacccugguggcccccgccaacagccuggugcacgccuucaccugccacgacagcggcgccaccgugcuggccuacgcccccaagcaccagcugcugaucagcggcggcagaaagggcuucaccuacguguucgaccugugccagagacagcagagacagcuguuccagagccacgacagccccgugaaggccguggccguggaccccaccgaggaguacuucgugaccggcagcgccgagggcaacaucaagaucuggagccugagcaccuucggccugcugcacaccuucgugagcgagcacgccagacagagcaucuucagaaacaucggcaccggcgugaugcagaucgagaccggccccgccaaccacaucuucagcugcggcgccgacggcaccaugaagaugagaauccugcccgaccaguucagcccccugaacgaggugcugaagaacgacgugaaguucaugcuguaa

SEQ ID NO: 16189 - RNA, 9114 nt, Artificial Sequence
  DMXL2__Homo_sapiens__NP_001167587
augcaccugcaccaggugcugaccggcgccgugaaccccggcgacaacugcuacagcgugggcagcgugggcgacgugcccuucaccgccuacggcagcggcugcgacaucgugauccuggccaacgacuucgagugcgugcagaucauccccggcgccaagcacggcaacauccaggugagcugcguggagugcagcaaccagcagggcagaaucgccgccagcuacggcaacgccgugugcaucuucgagccccugggcaucaacagccacaagagaaacugccagcugaagugccaguggcugaagaccggccaguucuuccugagcagcgugaccuacaaccuggccugggacccccaggacaacagacugcugaccgccaccgacagcauccagcugugggccccccccggcgacgacauccuggaggaggaggaggagaucgacaacaccgugccccccgugcugaacgacuggaagugcguguggcagugcaagaccagcgugagcgugcaccugauggaguggagccccgacggcgaguacuucgccaccgccggcaaggacgacugccugcugaaggugugguaccccaugaccggcuggaagagcagcaucaucccccaggaccaccacgaggugaagagaagacagagcagcacccaguucagcuucguguaccuggcccaccccagagccgugaccggcuucagcuggagaaagaccagcaaguacaugcccagaggcagcgugugcaacgugcugcugaccagcugccacgacggcgugugcagacugugggccgagacccugcugcccgaggacugccugcugggcgagcagaucugcgagaccaccaccagcagcaucgccagcagccugagccacgccggcagacacaaggacagaauccagcacgcccuggagaccauccaccaccugaagaaccugagaaagggccagagaagaagcagcgugcuggugacccacgccgagcugaugcccgaccagaccgccaugcacgaggugcagagacacaucagccaccacgccaacgcccugugccacuuccacaucgccgccagcaucaaccccgccaccgacauccccaacgugcuggugggcaccgccuucaacguggacgacggcaacggcggcuucguggugcacuggcugaacaacaaggaguuccacuucaccagcagcaccgagguguucaugcaccagcugagaaagcugagcgacaagcagguggaccacgagaacgacgacgccgacagagaggacgaggagcacagccaggaggacagagagagaggccugcacaugaagcuggaccacgaccugagccuggacagagagagcgaggccggcaccggcagcagcgagcacgaggacggcgagagagagggcagccccagaaccuacagcagacugagcgugcccaugccccugcccaccgugcugcuggacagaaagaucgagacccugcugaccgaguggaacaagaaccccgacaugcuguucaccauccaccccguggacggcaccuuccugguguggcacgugaaguaccuggacgaguacaaccccggcaucuucagacaggugcaggugagcuucagcagcagaauccccguggccuuccccagcggcgacgccagcagccugagcaagaacaucaugauguacgccugcaucaacgccaccaaggacagccaccacacccugcugcaccaggagggcaugagcgugggcagcccccacggcagccagccccacagcagaagccacagcacccacaugaacauccuggcccccaccgugaugaugaucagcaagcacaucgacggcagccugaaccagugggccgugaccuucgccgacaagagcgccuucaccaccgugcugaccgugagccacaaguucagauacugcggccacagauuccaccugaacgaccuggccugccacagcgugcugccccugcugcugaccagcagccaccacaacgcccugcugacccccgagcuggacugccagugggacagcgacaacaagcugagcagacugauggaccccgugaagcacaucaagggcagcagcaagcagccccugagaaacgccgccaccagaaccuuccacgaccccaacgccaucuacagcgagcugauccuguggagaguggaccccaucggcccccugagcuacaccggcggcgugagcgagcuggccagaaucaacagccugcacaccagcgccuucagcaacguggccuggcugcccacccugauccccagcuacugccugggcaccuacugcaacagcgccagcgccugcuucguggccagcgacggcaagaaccugagacuguaccaggccgugguggacgccagaaagcugcuggacgagcugagcgaccccgagagcagcaagcugaucggcgagguguucaacaucgugagccagcagagcaccgccagacccggcugcaucaucgagcuggacgccaucaccaaccagugcggcagcaacacccagcugcugcacguguuccaggaggacuucaucaucggcuacaagccccacaaggaggacauggagaagaaggagaccgagaucuucuuccagcccagccagggcuacagacccccccccuucagcgagaaguucuuccugguggugaucgagaaggacagcaacaacaacagcauccugcacauguggcaccugcaccugaagagcgugcaggccugccuggccaaggccagcgagggcgccagcagcgagagccugcugagcgugcccggccagaagaacguggacagcagccccgagaccagccccagcgugagccccaugccccacagcagcagcaucgccaaccugcagaccgccagcaagcugauccugagcagcagacugguguacagccagccccuggaccugcccgagagcguggaggugaucagagccacccccagcgccggccaccugagcagcagcagcaucuaccccgugugccuggcccccuaccugguggugaccaccugcagcgacaacaaggugagauucuggaagugcugcauggaggccaaccccgagugcaacaagagcgacgagaaggagaucuaccacuggaagagauggccccugaugaacgacgagggcgaggacaacagcagcaccgugagcaucgugggcagacccguggccgugagcugcagcuacaccggcagacuggccguggccuacaagcagcccauccaccacaacggcuucgugagcaaggaguucagcaugcacgugugcaucuucgagugcgagagcaccggcggcagcgagugggugcuggagcagaccauccaccuggacgaccuggugaaggugggcagcgugcuggacagcagagugagcguggacagcaaccuguucguguacagcaagagcgacgcccugcugagcaaggacagauaccugauccccaacaucaagcaccuggugcaccuggacugggugagcaaggaggacggcagccacauccugaccgugggcgugggcgccaacaucuucauguacggcagacugagcggcaucgugaccgagcagaccaacagcaaggacggcguggccgugaucacccugccccugggcggcagcaucaagcagggcgugaagagcagaugggugcugcugagaagcaucgaccuggugagcagcguggacggcacccccagccugcccgugagccugagcugggugagagacggcauccugguggugggcauggacugcgagaugcacguguacgcccaguggaagcacgccgugaaguucggcgacaccgaggccgacagcagcaacgccgaggaggccgccaugcaggaccacagcaccuucaagagcaacaugcuggccagaaagagcgugguggagggcaccgccaucagcgacgacguguucugcagccccaccgugauccaggacggcggccuguucgaggccgcccacgugcugagccccacccugccccaguaccaccccacccagcugcuggagcugauggaccugggcaaggugagaagagccaaggccauccugagccaccuggugaagugcaucgccggcgagguggccaucgugagagaccccgacgccggcgagggcaccaagagacaccugagcagaaccaucagcgugagcggcagcaccgccaaggagaccgugaccgugggcaaggacggcaccagagacuacaccgagaucgacagcauccccccccugccccuguacgcccugcuggccgccgaccaggacaccagcuacagaaucagcgaggagagcaccaagaucccccagagcuacgaggaccagaccgugagccagcccgaggaccaguacagcgagcuguuccagauccaggacauccccaccgacgacaucgaccuggagcccgagaagagagagaacaagagcaaggugaucaaccugagccaguacggccccgccuacuucggccaggagcacgccagagugcugagcagccaccugaugcacagcagccugcccggccugaccagacuggagcagauguuccugguggcccuggccgacaccguggccaccaccagcaccgagcuggacgagagcagagacaagagcugcagcggcagagacacccuggacgagugcggccugagauaccugcuggccaugagacugcacaccugccugcugaccagccugcccccccuguacagagugcagcugcugcaccagggcgugagcaccugccacuucgccugggccuuccacagcgaggccgaggaggagcugaucaacaugauccccgccauccagagaggcgacccccaguggagcgagcugagagccaugggcaucggcuggugggugagaaacaucaacacccugagaagaugcaucgagaagguggccaaggccagcuuccagagaaacaacgacgcccuggacgccgcccuguucuaccugagcaugaagaagaaggccgugguguggggccuguucagaagccagcacgacgagaagaugaccaccuucuucagccacaacuucaacgaggacagauggagaaaggccgcccugaagaacgccuucagccugcugggcaagcagagauucgagcagagcgccgccuucuuccugcuggccggcagccugaaggacgccaucgaggugugccuggagaagauggaggacauccagcuggccauggugaucgccagacuguacgagagcgaguucgagaccagcagcaccuacaucagcauccugaaccagaagauccugggcugccagaaggacggcagcggcuucagcugcaagagacugcaccccgaccccuuccugagaagccuggccuacugggugaugaaggacuacaccagagcccuggacacccugcuggagcagacccccaaggaggacgacgagcaccaggugaucaucaagagcugcaaccccguggccuucagcuucuacaacuaccugagaacccacccccugcugaucagaagaaaccuggccagccccgagggcacccuggccacccugggccugaagaccgagaagaacuucguggacaagaucaaccugaucgagagaaagcuguucuucaccaccgccaacgcccacuucaaggugggcugccccgugcuggcccuggaggugcugagcaagauccccaaggugaccaagaccagcgcccugagcgccaagaaggaccagcccgacuucaucagccacagaauggacgacgugcccagccacagcaaggcccugagcgacggcaacggcagcagcggcaucgaguggagcaacgugaccagcagccaguacgacuggagccagcccaucgugaagguggacgaggagccccugaaccuggacuggggcgaggaccacgacagcgcccuggacgaggaggaggacgacgccgugggccuggugaugaagagcaccgacgccagagagaaggacaagcagagcgaccagaaggccagcgaccccaacaugcugcugaccccccaggaggaggacgaccccgagggcgacaccgagguggacgugaucgccgagcagcugaaguucagagccugccugaagauccugaugaccgagcugagaacccuggccaccggcuacgagguggacggcggcaagcugagauuccagcuguacaacuggcuggagaaggagaucgccgcccugcacgagaucugcaaccacgagagcgugaucaaggaguacagcagcaagaccuacagcaagguggagagcgaccugcuggaccaggaggagaugguggacaagcccgacaucggcagcuacgagagacaccagaucgagagaagaagacugcaggccaagagagagcacgccgagagaagaaagagcuggcugcagaagaaccaggaccugcugagaguguuccugagcuacugcagccugcacggcgcccagggcggcggccuggccagcgugagaauggagcugaaguuccugcugcaggagagccagcaggagaccaccgugaagcagcugcagagcccccugccccugcccaccacccugccccugcugagcgccagcaucgccagcaccaagaccgugaucgccaaccccgugcuguaccugaacaaccacauccacgacauccuguacaccaucgugcagaugaagacccccccccaccccagcaucgaggacgugaaggugcacacccugcacagccuggccgccagccugagcgccagcaucuaccaggcccugugcgacagccacagcuacagcagccagaccgagggcaaccaguucaccggcauggccuaccagggccugcugcugagcgacagaagaagacugagaaccgagagcaucgaggagcacgccacccccaacagcagccccgcccaguggcccggcgugagcagccugaucaaccugcugagcagcgcccaggacgaggaccagcccaagcugaacauccugcugugcgaggccgugguggccguguaccugagccugcugauccacgcccuggccaccaacagcagcagcgagcuguucagacuggccgcccacccccugaacaacagaaugugggccgccguguucggcggcggcgugaagcugguggugaagcccagaagacagagcgagaacaucagcgccccccccgugcugagcgaggacaucgacaagcacagaagaagauucaacaugagaaugcuggugcccggcagacccgugaaggacgccacccccccccccgugcccgccgagagacccagcuacaaggagaaguucaucccccccgagcugagcaugugggacuacuucguggccaagcccuuccugccccugagcgacagcggcgugaucuacgacagcgacgagagcauccacagcgacgaggaggacgacgccuucuucagcgacacccagauccaggagcaccaggaccccaacagcuacagcugggcccugcugcaccugaccauggugaagcuggcccugcacaacgugaagaacuucuuccccaucgccggccuggaguucagcgagcugcccgugaccagcccccugggcaucgccgugaucaagaaccuggagaacugggagcagauccugcaggagaagauggaccaguucgagggccccccccccaacuacaucaacaccuaccccaccgaccugagcgugggcgccggccccgccauccugagaaacaaggccaugcuggagcccgagaacacccccuucaagagcagagacagcagcgccuuccccgugaagagacuguggcacuuccuggugaagcaggaggugcugcaggagaccuucaucagauacaucuucaccaagaagagaaagcagagcgagguggaggccgaccugggcuaccccggcggcaaggccaaggugauccacaaggagagcgacaugaucauggccuucagcgugaacaaggccaacugcaacgagaucgugcuggccagcacccacgacgugcaggagcuggacgugaccagccugcuggccugccagagcuacaucuggaucggcgaggaguacgacagagagagcaagagcagcgacgacguggacuacagaggcagcaccaccacccuguaccagcccagcgccaccagcuacagcgccagccaggugcacccccccagcagccugcccuggcugggcaccggccagaccagcaccggcgccagcgugcugaugaagagaaaccugcacaacgugaagagaaugaccagccaccccgugcaccaguacuaccugaccggcgcccaggacggcagcgugagaauguucgaguggaccagaccccagcagcuggugugcuucagacaggccggcaacgccagagugaccagacuguacuucaacagccagggcaacaagugcggcguggccgacggcgagggcuuccugagcaucuggcaggugaaccagaccgccagcaaccccaagcccuacaugagcuggcagugccacagcaaggccaccagcgacuucgccuucaucaccagcagcagccugguggccaccagcggccacagcaacgacaacagaaacgugugccugugggacacccugaucagccccggcaacagccugauccacggcuucaccugccacgaccacggcgccaccgugcugcaguacgcccccaagcagcagcugcugaucagcggcggcagaaagggccacgugugcaucuucgacaucagacagagacagcugauccacaccuuccaggcccacgacagcgccaucaaggcccuggcccuggaccccuacgaggaguacuucaccaccggcagcgccgagggcaacaucaagguguggagacugaccggccacggccugauccacagcuucaagagcgagcacgccaagcagagcaucuucagaaacaucggcgccggcgugaugcagaucgacaucauccagggcaacagacuguucagcugcggcgccgacggcacccugaagaccagagugcugcccaacgccuucaacauccccaacagaauccuggacauccuguaa

SEQ ID NO: 16190 - RNA, 3183 nt, Artificial Sequence
  DNA2__Homo_sapiens__NP_001073918
auggagcagcugaacgagcuggagcugcugauggagaagagcuucugggaggaggccgagcugcccgccgagcuguuccagaagaaggugguggccagcuuccccagaaccgugcugagcaccggcauggacaacagauaccuggugcuggccgugaacaccgugcagaacaaggagggcaacugcgagaagagacuggugaucaccgccagccagagccuggagaacaaggagcugugcauccugagaaacgacuggugcagcgugcccguggagcccggcgacaucauccaccuggagggcgacugcaccagcgacaccuggaucaucgacaaggacuucggcuaccugauccuguaccccgacaugcugaucagcggcaccagcaucgccagcagcaucagaugcaugagaagagccgugcugagcgagaccuucagaagcagcgaccccgccaccagacagaugcugaucggcaccgugcugcacgagguguuccagaaggccaucaacaacagcuucgcccccgagaagcugcaggagcuggccuuccagaccauccaggagaucagacaccugaaggagauguacagacugaaccugagccaggacgagaucaagcaggagguggaggacuaccugcccagcuucugcaagugggccggcgacuucaugcacaagaacaccagcaccgacuucccccagaugcagcugagccugcccagcgacaacagcaaggacaacagcaccugcaacaucgagguggugaagcccauggacaucgaggagagcaucuggagccccagauucggccugaagggcaagaucgacgugaccgugggcgugaagauccacagaggcuacaagaccaaguacaagaucaugccccuggagcugaagaccggcaaggagagcaacagcaucgagcacagaagccagguggugcuguacacccugcugagccaggagagaagagccgaccccgaggccggccugcugcuguaccugaagaccggccagauguaccccgugcccgccaaccaccuggacaagagagagcugcugaagcugagaaaccagauggccuucagccuguuccacagaaucagcaagagcgccaccagacagaagacccagcuggccagccugccccagaucaucgaggaggagaagaccugcaaguacugcagccagaucggcaacugcgcccuguacagcagagccguggagcagcagauggacugcagcagcgugcccaucgugaugcugcccaagaucgaggaggagacccagcaccugaagcagacccaccuggaguacuucagccuguggugccugaugcugacccuggagagccagagcaaggacaacaagaagaaccaccagaacaucuggcugaugcccgccagcgagauggagaagagcggcagcugcaucggcaaccugaucagaauggagcacgugaagaucgugugcgacggccaguaccugcacaacuuccagugcaagcacggcgccauccccgugaccaaccugauggccggcgacagagugaucgugagcggcgaggagagaagccuguucgcccugagcagaggcuacgugaaggagaucaacaugaccaccgugaccugccugcuggacagaaaccugagcgugcugcccgagagcacccuguucagacuggaccaggaggagaagaacugcgacaucgacaccccccugggcaaccugagcaagcugauggagaacaccuucgugagcaagaagcugagagaccugaucaucgacuucagagagccccaguucaucagcuaccugagcagcgugcugccccacgacgccaaggacaccguggccugcauccugaagggccugaacaagccccagagacaggccaugaagaaggugcugcugagcaaggacuacacccugaucgugggcaugcccggcaccggcaagaccaccaccaucugcacccuggugagaauccuguacgccugcggcuucagcgugcugcugaccagcuacacccacagcgccguggacaacauccugcugaagcuggccaaguucaagaucggcuuccugagacugggccagauccagaaggugcaccccgccauccagcaguucaccgagcaggagaucugcagaagcaagagcaucaagagccuggcccugcuggaggagcuguacaacagccagcugaucguggccaccaccugcaugggcaucaaccaccccaucuucagcagaaagaucuucgacuucugcaucguggacgaggccagccagaucagccagcccaucugccugggcccccuguucuucagcagaagauucgugcuggugggcgaccaccagcagcugcccccccuggugcugaacagagaggccagagcccugggcaugagcgagagccuguucaagagacuggagcagaacaagagcgccguggugcagcugaccgugcaguacagaaugaacagcaagaucaugagccugagcaacaagcugaccuacgagggcaagcuggagugcggcagcgacaagguggccaacgccgugaucaaccugagacacuucaaggacgugaagcuggagcuggaguucuacgccgacuacagcgacaaccccuggcugaugggcguguucgagcccaacaaccccgugugcuuccugaacaccgacaaggugcccgcccccgagcagguggagaagggcggcgugagcaacgugaccgaggccaagcugaucguguuccugaccagcaucuucgugaaggccggcugcagccccagcgacaucggcaucaucgcccccuacagacagcagcugaagaucaucaacgaccugcuggccagaagcaucggcaugguggaggugaacaccguggacaaguaccagggcagagacaagagcaucgugcuggugagcuucgugagaagcaacaaggacggcaccgugggcgagcugcugaaggacuggagaagacugaacguggccaucaccagagccaagcacaagcugauccugcugggcugcgugcccagccugaacugcuaccccccccuggagaagcugcugaaccaccugaacagcgagaagcugaucaucgaccugcccagcagagagcacgagagccugugccacauccugggcgacuuccagagagaguaa

SEQ ID NO: 16191 - RNA, 2178 nt, Artificial Sequence
  DNAAF1__Homo_sapiens__NP_848547
augcaccccgagcccagcgagcccgccaccggcggcgccgccgagcuggacugcgcccaggagcccggcguggaggagagcgccggcgaccacggcagcgccggcagaggcggcugcaaggaggagaucaacgaccccaaggagaucugcgugggcagcagcgacaccagcuaccacagccagcagaagcagagcggcgacaacggcagcggcggccacuucgcccaccccagagaggacagagaggacagaggccccagaaugaccaagagcagccugcagaagcugugcaagcagcacaagcuguacaucacccccgcccugaacgacacccuguaccugcacuucaagggcuucgacagaaucgagaaccuggaggaguacaccggccugagaugccuguggcugcagagcaacggcauccagaagaucgagaaccuggaggcccagaccgagcugagaugccuguuccugcagaugaaccugcugagaaagaucgagaaccuggagccccugcagaagcuggacgcccugaaccugagcaacaacuacaucaagaccaucgagaaccugagcugccugcccgugcugaacacccugcagauggcccacaaccaccuggagaccguggaggacauccagcaccugcaggagugccugagacugugcgugcuggaccugagccacaacaagcugagcgaccccgagauccugagcauccuggagagcaugcccgaccugagagugcugaaccugaugggcaaccccgugaucagacagauccccaacuacagaagaaccgugaccgugagacugaagcaccugaccuaccuggacgacagacccguguuccccaaggacagagccugcgccgaggccugggccagaggcggcuacgccgccgagaaggaggagagacagcagugggagagcagagagagaaagaagaucaccgacagcaucgaggcccuggccaugaucaagcagagagccgaggagagaaagagacagagagagagccaggagagaggcgagaugaccagcagcgacgacggcgagaacgugcccgccagcgccgagggcaaggaggagccccccggcgacagagagaccagacagaagauggagcuguucgugaaggagagcuucgaggccaaggacgagcugugccccgagaagcccagcggcgaggagccccccguggaggccaagagagaggacggcggccccgagcccgagggcacccugcccgccgagacccugcugcugagcagccccguggaggugaagggcgaggacggcgacggcgagcccgagggcacccugcccgccgaggccccccccccccccccccccguggaggugaagggcgaggacggcgaccaggagcccgagggcacccugcccgccgagacccugcugcugagcccccccgugaaggugaagggcgaggacggcgacagagagcccgagggcacccugcccgccgaggccccccccccccccccccugggcgccgccagagaggagcccaccccccaggccguggccaccgagggcguguucgugaccgagcuggacggcaccagaaccgaggaccuggagaccaucagacuggagaccaaggagaccuucugcaucgacgaccugcccgaccuggaggacgacgacgagaccggcaagagccuggaggaccagaacaugugcuuccccaagaucgaggugaucagcagccugagcgacgacagcgaccccgagcuggacuacaccagccugcccgugcuggagaaccugcccaccgacacccugagcaacaucuucgccgugagcaaggacaccagcaaggccgccagagugcccuucaccgacaucuucaagaaggaggccaagagagaccuggagaucagaaagcaggacaccaagagccccagaccccugauccaggagcugagcgacgaggaccccagcggccagcugcugaugccccccaccugccagagagacgccgccccccugaccagcagcggcgacagagacagcgacuuccuggccgccagcagccccgugcccaccgagagcgccgccaccccccccgagaccugcgugggcguggcccagcccagccaggcccugcccaccugggaccugaccgccuuccccgcccccaaggccagcuaa

SEQ ID NO: 16192 - RNA, 2370 nt, Artificial Sequence
  DNAAF2__Homo_sapiens__NP_001077377
auggccaaggccgccgccagcagcagccuggaggaccuggaccugagcggcgaggaggugcagagacugaccagcgccuuccaggaccccgaguucagaagaauguucagccaguacgccgaggagcugaccgaccccgagaacagaagaagauacgaggccgagaucaccgcccuggagagagagagaggcguggaggugagauucgugcaccccgagcccggccacgugcugagaaccagccuggacggcgccagaagaugcuucgugaacgugugcagcaacgcccuggugggcgcccccagcagcagacccggcagcggcggcgacagaggcgccgcccccggcagccacuggagccugcccuacagccuggcccccggcagagaguacgccggcagaagcagcagcagauacaugguguacgacgugguguuccaccccgacgcccuggcccuggccagaagacacgagggcuucagacagaugcuggacgccaccgcccuggaggccguggagaagcaguucggcgugaagcuggacagaagaaacgccaagacccugaaggccaaguacaagggcacccccgaggccgccgugcugagaaccccccugcccggcgugauccccgccagacccgacggcgagcccaagggcccccugcccgacuuccccuaccccuaccaguaccccgccgcccccggccccagagcccccagcccccccgaggccgcccugcagcccgcccccaccgagcccagauacagcguggugcagagacaccacguggaccugcaggacuacagaugcagcagagacagcgcccccagccccgugccccacgagcuggugaucaccaucgagcugccccugcugagaagcgccgagcaggccgcccuggaggugaccagaaagcugcugugccuggacagcagaaagcccgacuacagacugagacugagccugcccuaccccguggacgacggcagaggcaaggcccaguucaacaaggccagaagacagcugguggugacccugcccguggugcugcccgccgccagaagagagcccgccguggccguggccgccgccgcccccgaggagagcgccgacagaagcggcaccgacggccaggccugcgccagcgccagagagggcgaggccggccccgccagaagcagagccgaggacggcggccacgacaccugcguggccggcgccgccggcagcggcgugaccacccugggcgaccccgagguggcccccccccccgccgccgccggcgaggagagagugcccaagcccggcgagcaggaccugagcagacacgccggcagcccccccggcagcguggaggagcccagccccggcggcgagaacagccccggcggcggcggcagccccugccugagcagcagaagccuggccuggggcagcagcgccggcagagagagcgccagaggcgacagcagcguggagaccagagaggagagcgagggcaccggcggccagagaagcgccugcgccaugggcggccccggcaccaagagcggcgagccccugugccccccccugcugugcaaccaggacaaggagacccugacccugcugauccaggugcccagaauccagccccagagccugcagggcgaccugaacccccugugguacaagcugagauucagcgcccaggaccugguguacagcuucuuccugcaguucgcccccgagaacaagcugagcaccaccgagcccgugaucagcaucagcagcaacaacgccgugaucgagcuggccaagagccccgagagccacggccacuggagagagugguacuacggcgugaacaacgacagccuggagcugcaggagugcagcaacagcgaccagcugcagggcaaggaggagagagugaacgaggagagccaccugaccgagaaggaguacaucgagcacugcaacacccccaccaccgacagcgacagcagcaucgccgugaaggcccugcagaucgacagcuucggccuggugaccugcuuccagcaggagagccuggacgugagccagaugauccugggcaagagccagcagcccgagagcaagaugcagagcgaguucaucaaggagaagagcgccaccugcagcaacgaggagaaggacaaccugaacgagagcgugaucaccgaggagaaggagaccgacggcgaccaccugagcagccugcugaacaagaccaccgugcacaacauccccggcuucgacagcaucaaggagaccaacaugcaggacggcagcgugcaggugaucaaggaccacgugaccaacugcgccuucagcuuccagaacagccugcuguacgaccuggacuaa

SEQ ID NO: 16193 - RNA, 1827 nt, Artificial Sequence
  DNAAF3__Homo_sapiens__NP_001243643
augcugccccugcuggacagcagcaagagagccggcacccugggcagcggcugcggcgugcccagagugcacagcgccgcccugagcagagaggagggcgccagcagagacaucuggagaaucaaggugugggccagagugaugaccacccccgccggcagcggcagcggcuucggcagcgugagcugguggggccugagccccgcccuggaccugcaggccgagagagacgccaccguggacgcccugcccaccaccauggugccccagcccgccgugauccugcccggcccccccguggaccccgacagccaggccgacaccgugcacagcaaccccgagcuggacgugcugcugcugggcagcguggacggcagacaccugcugagaacccugagcagagccaaguucuggcccagaagaagauucaacuucuucgugcuggagaacaaccuggaggccguggccagacacaugcugaucuucagccuggcccuggaggagcccgagaagaugggccugcaggagagaagcgagaccuuccuggagguguggggcaacgcccugcugagaccccccguggccgccuucgugagagcccaggccgaccugcuggcccaccuggugcccgagcccgacagacuggaggagcagcugcccuggcugagccugagagcccugaaguucagagagagagacgcccuggaggccguguucagauucugggccggcggcgagaagggcccccaggccuuccccaugagcagacugugggacagcagacugagacacuaccugggcagcagauacgacgccagaagaggcgugagcgacugggaccugagaaugaagcugcacgacagaggcgcccaggugauccacccccaggaguucagaagauggagagacaccggcguggccuucgagcugagagacagcagcgccuaccacgugcccaacagaacccuggccagcggcagacugcugagcuacagaggcgagagaguggccgccagaggcuacuggggcgacaucgccaccggccccuucguggccuucggcaucgaggccgacgacgagagccugcugagaaccagcaacggccagcccgugaagaccgccggcgagaucacccagcacaacgugaccgagcugcugagagacguggccgccuggggcagagccagagccaccggcggcgaccuggaggagcagcagcacgccgagggcagccccgagcccggcacccccgcccccacccccgagagcuucaccgugcacuuccugccccugaacagcgcccagacccugcaccacaagagcugcuacaacggcagauuccagcugcuguacguggccugcggcauggugcaccugcugauccccgagcugggcgccugcguggcccccggcggcaaccugaucguggagcuggccagauaccugguggacgugagacaggagcagcugcagggcuucaacaccagagugagagagcuggcccaggccgccggcuucgccccccagaccggcgccagacccagcgagaccuucgccagauucugcaagagccaggagagcgcccugggcaacaccgugcccgccguggagcccggcacccccccccuggacauccuggcccagccccuggaggccagcaaccccgcccuggagggccugacccagccccugcagggcggcaccccccacugcgagcccugccagcugcccagcgagagccccggcagccugagcgaggugcuggcccagccccagggcgcccuggccccccccaacugcgagagcgacagcaagaccggcguguaa

SEQ ID NO: 16194 - RNA, 2568 nt, Artificial Sequence
  DNAAF5__Homo_sapiens__NP_060272
auggccgcccugggcguggccgaggccguggccgccccccaccccgccgagggcgccgagaccgccgaggccguggagcugagcagagcccugagcagacugcugcccggccuggaggccgacagcaagcccggcagaagaagagcccuggaggcccugagaagagcccuggaggagcccggccccgccgccgaccccaccgccuuccagggccccugggccagacugcugcugcccagacugcugagaugccugagcgaccccgccgagggcugcagagcccuggccgugcaccugcuggaccugggccugagaagagccgccagacccagagacgcccugcccagacugcugcccgcccuggccgccagacuggccggccccgugcccgccagaagaccccccgaggccugcgaggagcugagacuggcccuggugcagcugcugggccuggccguggaccugugcggcgccgcccuggccccccaccuggacgacgcccugagagcccugagaugcagccugcuggaccccuucgccgccgugagaagagagagcugcagcugcgccgccgcccuggcccaggccacccccgaccacuuccacaugcagagcgagagccugaucggcccccugaugcagaccaucagccaccagcacuggaaggugagaguggccgccaucgaggccaccggcgccgugauccacuucggcaacggcaagagcguggacgacgugcugagccacuucgcccagagacuguucgacgacgugccccaggugagaagagccguggccagcguggugggcggcuggcugcugugccugagagacagauacagcuucuuccacaagcugaucccccugcugcugagcagccugaacgacgaggugcccgaggugagacagcuggccgccagccugugggaggacgugggccugcaguggcagaaggagaacgaggaggaccugaaggacaagcuggacuucgccccccccacccccccccacuaccccccccacgagagaagacccgugcugggcugcagagagcugguguucagaaaccugagcaagauccugcccgcccugugccacgacaucaccgacuggguggugggcaccagagugaagagcgcccagcugcugcccgugcugcugcugcacgccgaggaccacgccacccagcaccuggagguggugcugagaacccuguuccaggccugcaccgacgaggaggccgccguggugcagagcugcaccagaagcgccgagcuggugggcaccuucgugagccccgagguguuccugaagcugauccugagcacccugaagaagacccccagcgccagcggccugcuggugcuggccagcgccaugagaggcugccccagagaggcccugcagccccaccuggccgccaucgccaccgagcuggcccaggcccacaucugccaggccagcgagaacgaccuguaccuggagagacugcugcugugcgugcaggcccuggugagcgugugccacgaggacugcggcguggccagccugcagcugcuggacgugcugcugaccaucguggcccuggccggcgccaccggccugagagacaaggcccaggagaccauggacagccuggccaugguggagggcgugagcagcugccaggaccuguacagaaagcacaucggcccccugcuggagagagugaccgccagccaccuggacuggaccgcccacagccccgagcugcugcaguucagcgugaucguggcccagagcggccccgcccugggcgaggcccugccccacguggugcccacccugagagccugccugcagcccagccaggacccccagaugagacugaagcuguucagcauccugagcaccgugcugcugagagccaccgacaccaucaacagccagggccaguuccccagcuaccuggagaccgugaccaaggacauccuggcccccaaccugcaguggcacgccggcagaaccgccgccgccaucagaaccgccgccgugagcugccugugggcccugaccagcagcgaggugcugagcgccgagcagaucagagacgugcaggagacccugaugccccaggugcugaccacccuggaggaggacagcaagaugaccagacugaucagcugcagaaucaucaacaccuuccugaagaccagcggcggcaugaccgaccccgagaagcugaucagaaucuaccccgagcugcugaagagacuggacgacgugagcaacgacgugagaauggccgccgccagcacccuggugaccuggcugcagugcgugaagggcgccaacgccaagagcuacuaccagagcagcgugcaguaccuguacagagagcugcuggugcaccuggacgaccccgagagagccauccaggacgccauccuggaggugcugaaggagggcagcggccuguuccccgaccugcuggugagagagaccgaggccgugauccacaagcacagaagcgccaccuacugcgagcagcugcugcagcacgugcaggccgugcccgccacccaguaa

SEQ ID NO: 16195 - RNA, 13551 nt, Artificial Sequence
  DNAH11__Homo_sapiens__NP_001264044
auggccgcccagguggccgccagagaggccagagacuucagagaggcccccacccugagacugaccagcggcgccggccuggaggccgugggcgccguggagcuggaggaggaggaggagaacgaggaggaggccgccgccagaagagccagaagcuucgcccaggacgccagagugagauuccugggcggcagacuggccaugaugcugggcuucaccgaggagaaguggagccaguaccuggagagcgaggacaacagacaggugcugggcgaguuccuggagagcaccagccccgccugccugguguucagcuucgccgccagcggcagacuggccgccagccaggagauccccagagacgccaaccacaagcugguguucaucagcaagaagaucaccgagagcaucggcgugaacgacuucagccagguggugcuguucggcgagcugcccgcccugagccugggccacgugagcgccuuccuggacgagauccuggugcccgugcugagcaacaagaacaaccacaagagcuggagcugcuucaccagccaggacauggaguaccacaucgaggugaugaagaagaagauguacaucuucagaggcaagaugagcagaagaacccugcugcccauccccaccguggccggcaagauggaccuggaccagaacugcagcgagaacaagccccccagcaacgagagaaucauccugcacgccaucgagagcguggugaucgaguggagccaccagauccaggagaucaucgagagagacagcgugcagagacugcugaacggccugcaccugagcccccaggccgagcuggacuucuggaugaugagaagagagaaccugagcugcaucuacgaccagcugcaggcccccguggugcugaagauggugaagauccugaccaccaagcagagcagcuacuuccccacccugaaggacaucuuccuggccguggagaacgcccugcuggaggcccaggacguggagcuguaccugagaccccugagaagacacauccagugccugcaggagaccgaguucccccagaccagaauccugaucgccccccuguuccacaccaucugccugaucuggagccacagcaaguucuacaacacccccgccagagugaucgugcugcugcaggaguucugcaaccuguucaucaaccaggccaccgccuaccugagccccgaggaccugcugagaggcgagaucgaggagagccuggagaaggugcagguggccgugaacauccugaagaccuucaagaacagcuucuucaacuacagaaagaagcuggccagcuacuucaugggcagaaagcugagacccugggacuuccagagccaccugguguucugcagauucgacaaguuccuggacagacugaucaagaucgaggacaucuucgccaccacccuggaguucgagaagcuggagagacuggaguucggcggcaccaagggcgccauccugaacggccaggugcacgagaugagcgaggagcugauggagcugugcaagcuguucaagcagagcaccuacgaccccagcgacugcaccaacauggaguucgagagcgacuacguggccuucaagagcaagacccuggaguucgacagaagacugggcaccaucaucugcgaggccuucuucaacugcaacggccuggaggccgccuucaagcugcugaccaucuucggcaacuuccuggagaagcccguggugauggagaucuucagccugcacuacagcacccuggugcacauguucaacaccgagcuggacgugugcaagcagcuguacaacgagcacaugaagcagaucgagugcggccacguggugcugaacaagaacaugcccuucaccagcggcaacaugaagugggcccagcaggugcugcagagacugcagauguucuggagcaacuucgccagccugagauaccuguuccugggcaaccccgaccacgcccugguguaccagaaguacguggagaugaccacccugcuggaccaguucgagagcagaaucuacaacgaguggaagagcaacguggacgagaucugcgaguucaaccugaaccagccccuggugaaguucagcgccaucaacggccugcugugcgugaacuucgaccccaagcugguggccgugcugagagaggugaaguaccugcugaugcugaagaagcaggacauccccgacagcgcccuggccaucuucaagaagagaaacaccauccugaaguacaucggcaaccuggaccugcuggugcagggcuacaacaagcugaagcagacccugcuggagguggaguacccccugaucgaggacgagcugagagccaucgacgagcagcugaccgccgccaccaccuggcugaccuggcaggacgacugcuggggcuacaucgagagagugagagccgccaccagcgagcuggagcacagaguggagagaacccagaagaacgugaaggugauccagcagaccaugagaggcugggccagaugcgugcugccccccagaagagagcacagaagagaggccgccuucacccuggaggacaagggcgaccuguucaccaagaaguacaagcugauccagggcgacggcugcaagauccacaaccugguggaggagaacagaaagcuguucaaggccaaccccagccuggacaccuggaagaucuacguggaguucaucgacgacaucgugguggagggcuucuuccaggccaucaugcacgaccuggacuucuuccugaagaacaccgagaagcagcugaagcccgcccccuucuuccaggcccagaugauccugcugccccccgagaucguguucaagcccagccuggacagagaggccggcgacggcuucuacgaccugguggaggagaugcugugcaacagcuucagaaugagcgcccagaugaacagaaucgccacccaccuggagaucaagaacuaccagaacgacauggacaacaugcugggccuggccgaggugagacaggagaucaugaacagaguggugaacgugaucaacaaggugcuggacuucagaaacacccuggagacccacaccuaccuguggguggacgacagagccgaguucaugaagcacuuccugcuguacggccacgccgugagcagcgacgagauggacgcccacgccaacgaggagauccccgagcagccccccacccuggagcaguucaaggagcagaucgacaucuacgaggcccuguacgugcagaugagcaaguucgaggacuucagaguguucgacagcugguucaagguggacaugaagcccuucaaggugagccugcugaccaucaucaagaaguggagcuggauguuccaggagcaccugcugagauucgugaucgacagccugaacgagcugcaggaguucaucaaggagaccgacagcggccugcagagagagcugaacgagggcgaccacgacggccugguggacaucauggugcaccugcuggccgugagaagcagacagagagccaccgacgagcuguucgagccccugaaggagaccaucacccugcuggagagcuacggccagaagaugcccgagcagguguacauccagcuggaggagcugcccgagagaugggagaccaccaagaagaucgccgccaccgugagacacgaggugagcccccugcacaacgccgaggugacccugaucagaaagaagugcauccuguucgacgccaagcaggccgaguucagagagagauucagacacuacgccccccugggcuucaacgccgagaaccccuacaccgcccuggacaaggccaacgaggagcuggaggcccuggaggaggagaugcugcagaugcaggagagcaccagacuguucgagguggcccugcccgaguacaagcagaugaagcagugcagaaaggagaucaagcugcugaagggccugugggacgugaucaucuacgugagaagaagcaucgacaacuggaccaagacccaguggagacagauccacguggagcagauggacguggagcugagaagauucgccaaggagaucuggagccugaacaaggaggugagagugugggacgccuacaccggccuggagggcaccgugaaggacaugaccgccagccugagagccaucaccgagcugcagagccccgcccugagagacagacacuggcaccagcugaugaaggccaucggcgugaaguuccugaucaacgaggccaccacccuggccgaccugcuggcccugagacugcacagaguggaggacgacgugagaagaaucguggacaaggccgugaaggagcugggcaccgagaaggugaucaccgagaucagccagaccugggccaccaugaaguucagcuacgaggugcacuacagaaccggcaucccccugcugaagagcgacgagcagcuguucgagacccuggagcacaaccaggugcagcugcagacccugcugcagagcaaguacguggaguacuucaucgagcaggugcugagcuggcagaacaagcugaacaucgccgaccuggugaucuucaccuggauggaggugcagagaaccuggagccaccuggagagcaucuucgugugcagcgaggacaucagaauccagcuggugaaggacgccagaagauucgacggcguggacgccgaguucaaggagcugauguucaagaccgccaagguggagaacgugcuggaggccaccugcagacccaaccuguacgagaagcugaaggaccugcagagcagacugagccugugcgagaaggcccuggccgaguaccuggagaccaagagaaucgccuuccccagauucuacuucgugagcagcgccgaccugcuggacauccugagcaagggcgcccagcccaagcaggugaccugccaccuggccaagcuguucgacagcaucgccgaccugcaguucgaggacaaccaggacgugagcgcccacagagccgugggcauguacagcaaggagaaggaguacgugcccuuccaggccgagugcgagugcgugggccacguggagaccuggcugcugcagcuggagcagaccaugcaggagaccgugagacacagcaucaccgaggccaucguggccuacgaggagaagcccagagagcuguggaucuucgacuuccccgcccagguggcccugaccagcagccagaucugguggaccaccgacgugggcaucgccuucagcagacuggaggagggcuacgagaccgcccugaaggacuuccacaagaagcagaucagccagcugaacacccugaucacccugcugcugggcgagcugccccccggcgacagacagaagaucaugaccaucugcaccaucgacgugcacgccagagacgugguggccaagcugaucagccagaagguggugagcccccaggccuucaccuggcugagccagcugagacacagaugggaggacacccagaagcacugcuucgugaacaucugcgacgcccaguuccaguacuucuacgaguaccugggcaacagccccagacuggugaucaccccccugaccgacagaugcuacaucacccugacccagagccugcaccugaccaugagcggcgcccccgccggccccgccggcaccggcaagaccgagaccaccaaggaccugggcagagcccugggcaugaugguguacguguucaacugcagcgagcagauggacuacaagagcaucggcaacaucuacaagggccuggugcagaccggcgccuggggcugcuucgacgaguucaacagaaucagcguggaggugcugagcgugguggccgugcaggugaagaugauccacgacgccaucagaaacagaaagaagagauucguguuccugggcgaggccaucacccugaagcccagcgugggcaucuucaucaccaugaaccccggcuacgccggcagaaccgagcugcccgagaaccugaaggcccuguucagacccugcgccaugguggcccccgacaucgagcugaucugcgagauccugcugguggccgagggcuucguggacgccagagcccuggccagaaaguucaucacccuguacacccugugcaaggagcugcugagcaagcaggaccacuacgacuggggccugagagccaucaagagcgugcuggugguggccggcagccugaagagaggcgacaagaacagacccgaggaccaggugcugaugagagcccugagagacuucaacaugcccaagaucgugaccgacgacauccccguguuccugggccuggugggcgaccuguuccccgcccuggacgugcccagaagaagaaagcugcacuucgagcagauggugagacagagcacccuggagcugagacugcagcccgaggagagcuucauccugaagguggugcagcuggaggagcugcuggccgugagacacagcguguucguggugggcaacgccggcaccggcaagagcaagauccugagaacccugaacagaaccuacgugaacaugaagcagaagcccguguggaacgaccugaaccccaaggccgugaccaccgacgagcuguucggcuucauccaccacgccaccagagaguggaaggacggcaagaucguguacagcuacuucaucggccuguucagcagcauccugagagagcaggccaaccugaagcacgacggccccaaguggaucgugcuggacggcgacaucgaccccauguggaucgagagccugaacaccgugauggacgacaacaaggugcugacccuggccagcaacgagagaaucgcccugacccccuucaugagacugcuguucgagauccaccaccugagaagcgccacccccgccaccgugagcagagccggcauccuguacgugaacccccaggaccugggcuggaaccccuacguggccagcuggaucgacagaagaagacaccagagcgagaaggccaaccugaccauccuguucgacaaguacgugcccgccugccuggacaagcugagaaccagcuucaagaccaucaccagcauccccgagagcagccuggugcagacccugugcgugcugcuggagugccugcugacccccgagaacgugcccagcgacagccccaaggagguguacgagguguacuucguguucgccugcaucugggccuucggcggcacccugcugcaggaccagaucagcgacuaccaggccgacuucagcagaugguggcagaaggagaugaaggccgugaaguuccccagccagggcaccaucuucgacuacuacguggaccacaagaccaagaagcugcugcccugggccgacaagaucgcccaguucaccauggaccccgacgugccccugcagaccgugcuggugcacaccaccgagaccgccagacugagauacuucauggagcugcugcuggagaagggcaagccccugaugcuggugggcaacgccggcgugggcaagaccguguucgugggcgacacccuggccagccugagcgaggacuacaucgugagcagagugcccuucaacuacuacaccaccagcaccgcccugcagaagauccuggagaagccccuggagaagaaggccggccacaacuacggccccggcggcaacaagaagcugaucuacuucaucgacgacaugaacaugcccgagguggaccuguacggcaccgugcagccccacacccugaucagacagcacaucgacuacggccacugguacgacagacagaaggugaugcugaaggagauccacaacugccaguacguggccugcaugaaccccauggugggcagcuucaccaucaaccccagacugcagagacacuucaccguguucgccuucaacuuccccagccuggacgcccugaacaccaucuacggccagaucuucagcuuccacuuccagcagcaggccuucgcccccagcauccugagaagcggccccacccugauccaggccaccaucgccuuccaccagaccaugaugugcaacuuccugcccaccgccaucaaguuccacuacaucuucaaccugagagaccugagcaacguguuccagggcauccuguucgccagccccgagugccugaagggcccccuggaccugauccaccuguggcugcacgagagcgccagaguguacggcgacaagcugaucgacaagaaggacugcgaccuguuccagagaagaaugcuggagaccgccuacaaguacuucgagggcaucgacagccacaugcugcugcagcagccccugaucuacugccacuucgccgacagaggcaaggacccccacuacaugcccgugaaggacugggaggugcugaagaccauccugaccgagacccuggacaacuacaacgagcugaacgccgccaugcaccuggugcuguucgaggacgccaugcagcacgugugcagaaucagcagaauccugagaaccccccagggcugcgcccugcuggugggcgugggcggcagcggcaagcagagccugagcagacuggccgccuaccugagaggccuggagguguuccagaucacccugaccgagggcuacggcauccaggagcugagaguggaccuggccaaccuguacaucagaaccggcgccaagaacaugcccaccguguuccugcugaccgacgcccaggugcuggacgagagcuuccuggugcugaucaacgaccugcuggccagcggcgagauccccgaccuguucagcgacgaggacguggacaagaucaucagcggcauccacaacgaggugcacgcccugggcaugguggacagcagagagaacugcuggaaguucuucauggccagagugagacugcagcugaagaucauccugugcuucagccccgugggcagaacccugagagugagagccagaaaguuccccgccaucgugaacugcaccgccaucgacugguuccacgccuggccccaggaggcccuggugagcgugagcagaagauucaucgaggagaccaagggcaucgagcccgugcacaaggacagcaucagccuguucauggcccacgugcacaccaccgugaacgagaugagcaccagauacuaccagaacgagagaagacacaacuacaccacccccaagagcuuccuggagcagaucagccuguucaagaaccugcugaagaagaagcagaacgaggugagcgagaagaaggagagacuggugaacggcauccagaagcugaagaccaccgccagccaggugggcgaccugaaggccagacuggccagccaggaggccgagcugcagcugagaaaccacgacgccgaggcccugaucaccaagaucggccugcagaccgagaaggugagcagagagaagaccaucgccgacgccgaggagagaaaggugaccgccauccagaccgagguguuccagaagcagagagagugcgaggccgaccugcugaaggccgagcccgcccugguggccgccaccgccgcccugaacacccugaacagagugaaccugagcgagcugaaggccuuccccaacccccccaucgccgugaccaacgugaccgccgccgugauggugcugcuggcccccagaggcagagugcccaaggacagaagcuggaaggccgccaagguguucaugggcaagguggacgacuuccugcaggcccugaucaacuacgacaaggagcacauccccgagaacugccugaagguggugaacgagcacuaccugaaggaccccgaguucaaccccaaccugaucagaaccaagagcuucgccgccgccggccugugcgccugggugaucaacaucaucaaguucuacgagguguacugcgacguggagcccaagagacaggcccuggcccaggccaaccuggagcuggccgccgccaccgagaagcuggaggccaucagaaagaagcugguggaccuggacagaaaccugagcagacugaccgccagcuucgagaaggccaccgccgagaaggugagaugccaggaggaggugaaccagaccaacaagaccaucaagcuggccaacagacuggugaaggagcuggaggccaagaagaucagauggggccagagcaucaagagcuucgaggcccaggagaagacccugugcggcgacgugcugcugaccgccgccuucgugagcuacgugggccccuucaccagacaguacagacaggagcuggugcacugcaagugggugcccuuccugcagcagaaggugagcaucccccugaccgagggccuggaccugaucagcaugcugaccgacgacgccaccaucgccgccuggaacaacgagggccugcccagcgacagaaugagcaccgagaacgccgccauccugacccacugcgagagauggccccuggugaucgacccccagcagcagggcaucaaguggaucaagaacaaguacggcauggaccugaaggugacccaccugggccagaagggcuuccugaacgccaucgagaccgcccuggccuucggcgacgugauccugaucgagaaccuggaggagaccaucgaccccgugcuggacccccugcugggcagaaacaccaucaagaagggcaaguacaucagaaucggcgacaaggagugcgaguucaacaagaacuucagacugauccugcacaccaagcuggccaacccccacuacaagcccgagcugcaggcccagaccacccugcugaacuucaccgugaccgaggacggccuggaggcccagcugcuggccgagguggugagcaucgagagacccgaccuggagaagcugaagcuggugcugaccaagcaccagaacgacuucaagaucgagcugaaguaccuggaggacgaccugcugcugagacugagcgccgccgagggcagcuuccuggacgacaccaagcugguggagagacuggaggccaccaagaccaccguggccgagaucgagcacaaggugaucgaggccaaggagaacgagagaaagaucaacgaggccagagagugcuacagacccguggccgccagagccagccugcuguacuucgugaucaacgaccugcagaagaucaacccccuguaccaguucagccugaaggccuucaacgugcuguuccacagagccaucgagcaggccgacaagguggaggacaugcagggcagaaucagcauccugauggagagcaucacccacgccguguuccuguacaccagccaggcccuguucgagaaggacaagcugaccuuccugagccagauggccuuccagauccugcugagaaagaaggagaucgacccccuggagcuggacuuccugcugagauucaccguggagcacacccaccugagccccguggacuuccugaccagccagagcuggagcgccaucaaggccaucgccgugauggaggaguucagaggcaucgacagagacguggagggcagcgccaagcaguggagaaaguggguggagagcgagugccccgagaaggagaagcugccccaggaguggaagaagaagagccugauccagaagcugauccugcugagagccaugagacccgacagaaugaccuacgcccugagaaacuucguggaggagaagcugggcgccaaguacguggagagaaccagacuggaccuggugaaggccuucgaggagagcagccccgccacccccaucuucuucauccugagccccggcguggacgcccugaaggaccuggagauccugggcaagagacugggcuucaccaucgacagcggcaaguuccacaacgugagccugggccagggccaggagaccguggccgagguggcccuggagaaggccagcaagggcggccacugggugauccugcagaacgugcaccugguggccaaguggcugggcacccuggagaagcugcuggagagauucagccagggcagccacagagacuacagaguguucaugagcgccgagagcgcccccacccccgacgagcacaucaucccccagggccugcuggagaacagcaucaagaucaccaacgagccccccaccggcaugcuggccaaccugcacgccgcccuguacaacuucgaccaggacacccuggagaucugcagcaaggagcaggaguucaagagcauccuguucagccugugcuacuuccacgccugcguggccggcagacugagauucggcccccagggcuggagcagaagcuaccccuucaaccccggcgaccugaccaucugcgccagcgugcuguacaacuaccuggaggccaacagcaaggugcccugggaggaccugagauaccuguucggcgagaucauguacggcggccacaucaccgacgacugggacagaaagcugugcagaguguaccuggaggaguucaugaaccccagccugaccgaggacgagcugaugcuggcccccggcuucgccgccccccccuaccuggacuacgccggcuaccaccaguacaucgaggagaugcugccccccgagagccccgcccuguacggccugcaccccaacgccgagaucgaguuccugaccgugaccagcaacacccuguucagaacccugcuggagaugcagcccagaaacgcccugagcggcgacgagcugggccagagcaccgaggagaaggugaagaacgugcuggacgacauccuggagaagcugcccgaggaguucaacauggccgagaucaugcagaagaacagcaacagaagccccuacgugcuggugugcuuccaggagugcgagagaaugaacauccugaucagagagaucagaaucagccuggagcagcuggaccugagccugaagggcgagcuggcccugagccccgccguggaggcccagcaguucgcccugagcuacgacaccgugcccgacaccuggagcaagcuggccuaccccagcaccuacggccuggcccagugguucaacgaccugcugcugagaugcagagagcuggacaccuggacccaggaccugacccugcccgccgugguguggcugagcggcuucuucaacccccagagcuuccugaccgccaucaugcagaccauggccagaaagaacgaguggccccuggacaagaccagacugaccgccgacgugaccaagaagaccaaggaggacuacggccacccccccagagagggcgccuaccugcacggccuguucauggagggcgccagaugggacacccaggccggcaccaucguggaggccagacugaaggagcuggccugccccaugcccgugaucuucgccaaggccacccccguggacagacaggagaccaagcagaccuacgagugccccguguacagaaccaagcugagaggccccagcuacaucuggaccuucagacugaagagcgaggagaagaccgccaagugggugcuggccggcguggcccugcugcuggaggccuaa

SEQ ID NO: 16196 - RNA, 11895 nt, Artificial Sequence
  DNAH12__Homo_sapiens__NP_001278590
augagcgacgccaacaaggccgccaucgccgccgagaaggaggcccugaaccugaagcugccccccaucgugcaccugcccgagaacaucggcguggacacccccacccagagcaagcugcugaaguacagaagaagcaaggagcagcagcagaagaucaaccagcuggugaucgacggcgccaagagaaaccuggacagaacccugggcaagagaaccccccugcugcccccccccgacuacccccagaccaugaccagcgagaugaagaagaagggcuucaacuacaucuacaugaagcagugcguggagagcagcccccuggugcccauccagcaggaguggcuggaccacaugcugagacugauccccgagagccugaaggagggcaaggagagagaggagcugcuggagagccugaucaacgaggugagcagcgacuucgagaacagcaugaagagauaccuggugcagagcgugcuggugaagccccccgugaagagccuggaggacgagggcggcccccugcccgagagccccgugggccuggacuacagcaaccccuggcacagcagcuacgugcaggccagaaaccagaucuucagcaaccugcacaucauccaccccaccaugaagaugcugcuggaccugggcuacaccaccuucgccgacaccgugcugcuggacuucaccggcaucagagccaagggccccaucgacugcgagagccugaagaccgaccugagcauccagaccagaaacgccgaggagaagaucaugaacaccugguaccccaaggugaucaaccuguucaccaagaaggaggcccuggagggcgugaagcccgagaagcuggacgccuucuacagcugcgugagcacccugaugagcaaccagcugaaggaccugcugagaagaaccguggagggcuucgugaagcuguucgaccccaaggaccagcagagacugcccaucuucaagaucgagcugaccuucgacgacgacaagauggaguucuaccccaccuuccaggaccuggaggacaacgugcugagccugguggagagaaucgccgaggcccugcagaacgugcagaccauccccagcuggcugagcggcaccagcacccccgugaaccuggacaccgagcugcccgagcacgugcugcacugggccguggacacccugaaggccgccgugcacagaaaccuggagggcgccagaaagcacuacgagaccuacguggagaaguacaacuggcugcuggacggcaccgccguggagaacaucgagaccuuccagaccgaggaccacaccuucgacgaguacaccgaguucaucgagaaguuccugagccuggccagcgagaucaugcugcugccccaguggauccacuacaccauggugagacuggacugcgaggaccugaagaccggccugaccaacaaggccaaggccuucgccaacauccugcugaacgacaucgccagcaaguacagaaaggagaacgagugcaucugcagcgaguucgaggccaucaaggagcacgcccugaaggugcccgagaccaccgaggagaugauggaccugaucagcuacguggagaaggccagaaccgugggcaucgaggagcugauccugagaauccaggagagcaagagacagaugagcuacuuccuggacguguuccuguucccccaggaggaccuggcccugaacgccaccgugcugauguggcccagaaagaucaaccccaucuucgacgagaacgacgagcugaucgagaacgccaagcacaagaaggagaacgagcugauggccaagagagagaagcugauccuggagaucgagaaggagagcagaagaauggaggaguucaccgaguucgccgagcuggagagaaugcagcaguacgugaccgacgugagacagcugcagaagagaauccaggagagcgaggaggccgugcaguucaucaacaaggaggaggagcuguucaagugggagcugaccaaguaccccgagcuggacaagcugaaggugaacaucgagcccuaccagaaguucuucaacuucgugcugaaguggcagagaagcgagaagagauggauggacggcggcuuccuggaccugaacggcgagagcauggaggccgacguggaggaguucagcagagagaucuucaagacccugaaguucuuccagaccaagcugaagaaggagcugcaggagaagagaaaggccgccagaaagagaagccuggaggaggagaagaucgaggaggagcccaaggacaacgccaccaucaccaugugcagcaccgugauggagcagaucaaggccuucaaggaguacauccccaccgugagcauccugugcaaccccggcaugagagccagacacuggaagcagaucagcgagaucgugggcuacgaccugacccccgacagcggcaccacccugagaaaggugcugaagcugaaccugacccccuaccuggagcaguucgaggugaucagcgccggcgccagcaaggaguucagccuggagaaggccaugaacaccaugaucggcaccugggaggacaucgccuuccacaucagccuguacagagacaccggcgugugcauccugagcagcguggacgagauccaggccauccuggacgaccagaucaucaagacccagaccaugagaggcagccccuucaucaagcccuucgagcacgagaucaaggccugggaggacagacugaucagaauccaggagaccaucgacgaguggcugaaggugcaggcccaguggcuguaccuggagcccaucuucugcagcgaggacaucaugcagcagaugcccgaggagggcagacaguuccagaccguggacagacacuggagagacaucaugaaguucugcgccaaggaccccaaggugcuggccgccaccagccugaccggccugcuggagaagcugcagaacugcaacgagcugcuggagaagaucaugaagggccugaacgccuaccuggagaagaagagacuguucuuccccagauucuucuuccugagcaacgacgagaugcuggagauccugagcgagaccaaggacccccugagagugcagccccaccugaagaagugcuucgagggcaucgccaagcuggaguuccugcccaaccuggacaucaaggccauguacagcagcgagggcgagagaguggagcugaucgcccugaucagcaccagcgccgccagaggcgccguggagaaguggcugauccagguggaggaccugaugcugagaagcgugcacgacgugaucgccgccgccagacuggccuaccccgagagcgccagaagagacugggugagagaguggcccggccagguggugcugugcaucagccagauguucuggaccagcgagacccaggaggugaucagcggcggcaccgagggccugaagaaguacuacaaggagcugcagaaccagcugaacgagaucguggagcuggugagaggcaagcugagcaagcagaccagaaccacccugggcgcccuggugaccaucgacgugcacgccagagacguggugauggacaugaucaagaugggcgugagccacgacaccgacuuccuguggcuggcccagcugagauacuacugggagaacgagaacgccagagugagaaucaucaacugcaacgugaaguacgccuacgaguaccugggcaacagccccagacuggugaucaccccccugaccgacagaugcuacagaacccugaucggcgccuucuaccugaaccugggcggcgcccccgagggccccgccggcaccggcaagaccgagaccaccaaggaccuggccaaggcccuggccgugcagugcgugguguucaacugcagcgacggccuggacuaccuggccaugggcaaguucuucaagggccuggccagcagcggcgccugggccugcuucgacgaguucaacagaaucgagcuggaggugcugagcgugguggcccagcagauccugugcauccagagagccauccagcagaagcuggugguguucguguucgagggcaccgagcugaagcugaaccccaacugcuucguggccaucaccaugaaccccggcuacgccggcagaagcgagcugcccgacaaccugaaggugcuguucagaaccguggccaugauggugcccaacuacgcccugaucgccgagaucagccuguacagcuacggcuuccugaacgccagaccccugagcgugaagaucgugaugaccuacagacugugcagcgagcagcugagcagccaguuccacuacgacuacggcaugagagccgugaaggccgugcugguggccgccggcaaccugaagcugaaguaccccaacgagaacgaggacauccugcugcugagaagcaucaaggacgugaacgagcccaaguuccugagccacgacaucccccuguucaacggcaucaccagcgaccuguuccccggcaucaagcugcccgaggccgacuaccacgaguuccuggagugcgcccacgaggccugcaacgugcacaaccugcagcccgugaaguucuuccuggagaagaucauccagaccuacgagaugaugaucgugagacacggcuucaugcuggugggcgagcccuucgccgccaagaccaaggugcugcacgugcuggccgacacccugacccugaugaacgagcacggcuacggcgaggaggagaaggugaucuacagaaccgugaaccccaagagcaucaccaugggccagcuguucggccaguucgaccccgugagccacgaguggaccgacggcaucguggccaacaccuucagagaguucgcccugagcgagacccccgacagaaagugggugguguucgacggccccaucgacacccuguggaucgagagcaugaacaccgugcuggacgacaacaagaagcugugccugaugagcggcgagaucauccagaugagcccccagaugagccugaucuucgagaccauggaccugagccaggccagccccgccaccgugagcagaugcggcaugaucuaccuggagcccagccagcugggcugggagccccuggugagcagcuggcugaacagccugaagggcccccugugcgagcccgaguaccaggcccugcugagaggccuguucgccuggcugaucccccccagccugaaccagagaguggagcuguuccagcugaacuaccuguacaccaccaucgugagcaagauccugaagauccugaucaccuucagaaucagcaacuacuucaaguacgugccccugaagacccagugcaccuucaucaaguucuuccugcaccagcaggccugcuucaucuucagccugaucuggagcaucggcggcagcugcgacaccgacggcagaagaguguucgacaccuucaucagacugaucauccugggcaaggacgacgagaaccccgugcccgacagcgugggcaagugggagugccccuucgacgagaagggccugguguacgacuacauguacgagcugaagaacaagggcagaugggugcacuggaacgagcugaucaagaacaccaaccugggcgacaagcagaucaagauccaggacaucaucgugcccaccauggacaccaucagauacaccuuccugauggaccugagcaucaccuacgccaagccccugcuguucgugggccccaccggcaccggcaagagcguguacgugaaggacaagcugaugaaccaccuggagaaggaccaguacuuccccuucuacaucaaccugagcgccagaaccagcgccaaccaggugcagaacaucaucauggccagacuggacaagagaagaaagggcguguucggcccccccaugggcaagaagugcaucaucuucaucgacgacaugaacaugcccgcccuggagaaguacggcgcccagccccccaucgagcugcugagacaguucuucgacugcggccacugguacgaccugaaggacaccagcaagaucacccugguggacaucgagcugaucgccgccaugggcccccccggcggcggcagaaaccccgugacccccagaugcaucagacacuucaacaucugcagcaucaacagcuucagcgacgagaccauggugagaaucuucagcagcaucguggccuucuaccugagaacccacgaguucccccccgaguacuucgugaucggcaaccagaucgugaacggcaccauggagaucuacaagcagagcguggagaaccugcugcccacccccaccaagagccacuacaccuucaaccugagagacuucagcagagugaucagaggcugccugcugaucgagagagacgccguggccaacaagcacaccaugaucagacuguucgugcacgaggugcugagaguguucuacgacagacugaucaacgacgacgacagaagauggcuguuccagcugaccaagaccgugaucaaggaccacuucaaggagagcuuccacagcaucuucagccaccugagaaagcagaacgcccccgugaccgaggaggaccugagaaaccugauguucggcgacuacaugaaccccgaccuggagggcgacgacagaguguacaucgagauccccaacauccaccacuucagcgacgugguggaccagugccuggacgaguacaaccagacccacaagaccagaaugaaccuggugaucuucagauacgugcuggagcaccugagcagaaucugcagagugcugaagcagagcggcggcaacgcccugcuggugggccugggcggcagcggcagacagagccugaccagacuggccaccagcauggccaagaugcacaucuuccagcccgagaucagcaagagcuacggcaugaacgaguggagagaggacaugaagggccugcugagaaacgugggcaugaagggccagaagaccguguuccugaucaccgacacccagaucaaggaggaggccuuccuggaggacaucgacagcgugcugaacaccggcgaggugcccaacaucuucgccgccgacgagaagcaggaggugauggagggcgugagacccguggcccaggccggcaacaagcacgacgagcugagcccccuggcccuguucgccuucuucgugaacagaugcaaggacaaccugcacguggugguggccuucagccccaucggcgacgccuucagaaacagacugagacaguuccccagccugaucaacugcugcaccaucgacugguuccagagcuggcccgaggacgcccuggagagaguggccgugaaguuccuggagacccuggagcugaccgagguggagcagcaggagaucgugcccaucugcaagcacuuccacaccagcaucauggaccugagcgagagauuccugcacgagcugggcagacacaacuacgugaccgccaccagcuaccuggagcugaucggcagcuucagacagcugcugacccagaagagacaggccgugauggaggccaagcagagauacaugaacggccuggacaagcuggccuucgccgagagccaggugggcgagaugcagauggagcugguggagcugcagcccaagcuggaggaggccaagaucgagaacgccaacaugaugcaggugaucgagaucgagagcgugcagguggaggccaagagacaguucgugaagcuggacgaggagaucgccagcggcaaggccgaggaggcccaggcccugaagaacgagugcgagagcgaccuggccgaggccauccccgcccuggaggccgcccugagcgcccuggacacccugaagcccgccgacaucaccaucgugaagagcaugaagaacccccccagcggcgugaagcuggugauggccgccgugugcgugaugaaggacaucaagcccgagaagaucagcgaccccagcggcaccggcggcaagauccuggacuacuggggccccagcaagaagcugcugggcgacaugaacuuccugagagaccugaaggaguacgacaaggacaacauccccgugaccgugaugcagaagaucagaagcgaguaccugaugaaccccgaguucgacccccccaagguggccaaggccagcagcgccgccgagggccugugcaaguggaucauggccauggagguguacgacagaguggccaaggugguggcccccaagaaggccagacugagcgaggcccagaagagccuggccgagaccauggagcugcugaaccagaagagagccgagcuggccgagguggagcaccaccuggagaaccugcagaugaccuuccuggagaagaccgaggagaaggccgcccuggaggaccagguggagcugugcgccaagaagcuggagagagccagccagcugaucggcggccugggcggcgagaagagcagaugggcccaggccgccgacgaccugcagaucaccuacgagaaccugaccggcgacgugcuggugagcgccggcgugaucgccuaccugggcgccuucaccagcggcuucagacagaccugcaccaaggacuggagcaugcugugcaagaagaagaagauccccugcagcgaggaguuccugcugagcaagacccugggcgaccccgugaagaucagagccuggaacaucgccggccugcccaccgacaccuucagcaucgacaacggcgugaucgugaacaacugcagaagauggccccugaugaucgacccccagggccaggccaacaaguggaucaagaacagcgagaaggagaaccagcugagcgugaucaagcugagcgacagcgacuacaugagaacccuggagaacugcauccaguucggcaccccccugcugcuggagaacgugggcgaggagcuggaccccagccuggagccccugcugcugagacagaccuucaagcagggcggcaucgacugcaucagacugggcgaggugaucaucgaguacagcuucgacuucaaguucuacaucaccaccaagcugagaaacccccacuacaugcccgagcuggccaccaaggugagccugcugaacuucaugaucacccccgagggccuggaggaccagcugcugggcaucgugguggccaaggagagacccgagcuggaggaggagagaaacgcccugauccugcagagcgccgccaacaagaagcagcugaaggacaucgagaagaagauccuggagacccugagcagcagcgagggcaacauccuggaggacgagagcgccaucaaggugcuggacagcgccaagaugaugagcaacgagaucaccaagaagcagcagaucgccgagaagaccgagcugaagaucgccgagagcagagagggcuacagacccaucgccaagcacagcagcgugcuguucuucagcaucgccgaccuggccaacaucgaccccauguaccaguacagccugaccugguucgugaaccuguacaucaacagcauccacgacagcaacaagagcaagauccuggagaagagacugagauaccugaacgaccacuucaccuacaaccuguacugcaacaucugcagaagccuguucgagaaggacaagcugcuguucagcuuccugcugugcgccaaccugcugcuggccagaaaggagaucgaguaccaggagcugauguuccugcugaccggcggcgugagccugaagagcgccgagaagaaccccgaccccaccuggcugcaggacaagagcugggaggagaucugcagagccagcgaguuccccgccuucagaggccugagacagcacuucugcgagcacaucuacgaguggagagagaucuacgacagcaaggagccccacaacgccaaguuccccgcccccauggacaagaaccugaacgagcugcagaagaucaucauccugagaugccugagacccgacaagaucacccccgccaucaccaacuacgugaccgacaagcugggcaagaaguucguggagcccccccccuucgaccugaccaagagcuaccuggacagcaacugcaccaucccccugaucuucgugcugagccccggcgccgaccccauggccagccugcugaaguucgccaacgacaagagcaugagcggcaacaaguuccaggccaucagccugggccagggccagggccccaucgccgccaagaugaucaaggccgccaucgaggagggcaccugggugugccugcagaacugccaccuggccgugagcuggaugcccaugcuggagaagaucugcgaggacuucaccagcgagaccugcaacagcagcuucagacuguggcugaccagcuaccccagcagcaaguuccccgugaccauccugcagaacggcgugaagaugaccaacgagccccccaccggccugagacugaaccugcugcagagcuaccugaccgaccccgugagcgaccccgaguucuucaagggcugcagaggcaaggagcuggccugggagaagcugcuguucggcgugugcuucuuccacgcccuggugcaggagagaaagaaguucggcccccugggcuggaacauccccuacggcuucaacgagagcgaccugagaaucagcaucagacagcugcagcuguucaucaacgaguacgacaccauccccuucgaggccaucagcuaccugaccggcgagugcaacuacggcggcagagugaccgacgacugggacagaagacugcugcugaccaugcuggccgacuucuacaaccuguacaucguggagaacccccacuacaaguucagccccagcggcaacuacuucgccccccccaagggcaccuacgaggacuacaucgaguucaucaagaagcugcccuucacccagcaccccgagaucuucggccugcacgagaacguggacaucagcaaggaccugcagcagaccaagacccuguucgagagccugcugcugacccagggcggcagcaagcagaccggcgccagcggcagcaccgaccagauccugcuggagaucaccaaggacauccugaacaagcugcccagcgacuucgacaucgagauggcccugagaaaguaccccgugagauacgaggagagcaugaacaccgugcuggugcaggagauggagagauucaacaaccugaucaucaccaucagaaacacccugagagaccuggagaaggccaucaagggcgugguggugauggacagcgcccuggaggcccugagcggcagccugcuggugggcaaggugcccgagaucugggccaagagaagcuaccccagccugaagccccugggcagcuacaucaccgacuuccuggccagacugaacuuccugcaggacugguacaacagcggcaagcccugcguguucuggcugagcggcuucuucuucacccaggccuuccugaccggcgccaugcagaacuacgccagaaaguacaccacccccaucgaccugcugggcuacgaguucgaggugauccccagcgacaccagcgacaccagccccgaggacggcguguacauccacggccuguaccuggacggcgccagaugggacagagagagcggccugcuggccgagcaguaccccaagcugcuguucgaccugaugcccaucaucuggaucaagcccacccagaagagcagaaucaucaagagcgacgccuacgugugcccccuguacaagaccagcgagagaaagggcacccugagcaccaccggccacagcaccaacuucgugaucgccaugcugcugaagaccgaccagcccaccagacacuggaucaagagaggcguggcccugcugugccagcuggacgacuaa

SEQ ID NO: 16197 - RNA, 13389 nt, Artificial Sequence
  DNAH17__Homo_sapiens__NP_775899
augaccauggcccccgacgugagacuggaguaccuggaggagguggccagcaucgugcugaaguucaagcccgacaaguggagcaagcugaucggcgccgaggagaacguggcccuguucaccgaguucuucgagaagcccgacgugcaggugcuggugcugacccugaacgccgccggcaugaucauccccugccugggcuucccccagagccugaagagcaagggcguguacuucaucaagaccaagagcgagaacaucaacaaggacaacuacagagccagacugcuguacggcgacaucagccccacccccguggaccagcugaucgccgugguggaggaggugcugagcagccugcugaaccagagcgagaacauggccggcuggccccagguggugagcgaggacaucgugaagcaggugcacagacugaagaacgagauguucgugaugagcggcaagaucaagggcaagacccugcugcccauccccgagcaccugggcagccuggacggcacccuggagagcauggagagaauccccagcagccuggacaaccugcugcugcacgccaucgagaccaccaucaucgacuggagccaccagaucagagacgugcugagcaaggacagcgcccaggcccugcuggacggccugcacccccugccccagguggaguucgaguucugggacaccagacugcugaaccugaagugcauccacgagcagcugaacagacccaaggugaacaagaucguggagauccuggagaaggccaagagcugcuacuggcccgcccugcagaacguguacaccaacgugaccgagggccugaaggaggccaacgacaucgugcuguaccugaagccccugagaauccugcuggaggagauggagcaggccgacuucaccaugcugcccaccuucaucgccaaggugcuggacaccaucugcuucaucugggccaccagcgaguacuacaacacccccgccagaaucaucgugauccugcaggaguucugcaaccagaucaucgagaugaccagaaccuuccugagccccgaggaggugcugaagggccugcagggcgagaucgaggaggugcugagcggcaucagccuggccgugaacgugcugaaggagcuguaccagaccuacgacuucugcugcgugaacaugaagcuguucuucaaggacaaggagcccgugcccugggaguuccccagcagccuggccuucagcagaaucaacagcuucuuccagagaauccagaccaucgaggagcuguacaagaccgccaucgaguuccugaagcuggagaagaucgagcugggcggcgugagaggcaaccugcugggcagccuggugaccagaaucuacgacgagguguucgagcuggugaagguguucgccgacugcaaguacgacccccuggaccccggcgacagcaacuucgacagagacuacgccgacuucgagaucaagauccaggaccuggacagaagacuggccaccaucuucugccagggcuucgacgacugcagcugcaucaagagcagcgccaagcugcuguacaugugcggcggccugauggagagaccccugauccuggccgagguggcccccagauacagcgugaugcuggagcuguucgacgccgagcuggacaacgccaagauccuguacgacgcccagauggccgccagcgaggagggcaacaucccccugauccacaagaacaugccccccguggccggccagcugaaguggagccuggagcugcaggagagacuggaggugagcaugaagcaccugaagcacguggagcaccccgugaugagcggcgccgaggccaagcugaccuaccagaaguacgacgagaugauggagcugcugagaugccacagagagaagaucuaccagcaguggguggccggcguggaccaggacugccacuucaaccugggccagccccugauccugagagacgccgccagcaaccugauccacgugaacuucagcaaggcccugguggccgugcugagagaggugaaguaccugaacuuccagcagcagaaggagauccccgacagcgccgagagccuguucagcgagaacgagaccuucagaaaguucgugggcaaccuggagcugaucgugggcugguacaacgagaucaagaccaucgugaaggccguggaguuccugcugaucaagagcgagcuggaggccaucgacgugaagcugcugagcgccgagaccacccuguucuggaacggcgagggcguguuccaguacauccaggaggugagagagauccugcacaaccugcagaacagaaugcagaaggccaagcagaacaucgagggcaucagccaggccaugaaggacuggagcgccaacccccuguucgagagaaaggacaacaagaaggaggcccugcuggaccuggacggcagaaucgccaaccugaacaagagauacgccgccgugagagacgccggcgugaagauccaggccaugguggccgagaacgccgagcuguucagagccgacacccugagccugcccuggaaggacuacgugaucuacaucgacgacauggugcuggacgaguucgaccaguucaucagaaagagccugagcuuccugauggacaacauggugaucgacgagagcaucgccccccuguucgagaucagaauggagcuggacgaggacggccugaccuucaaccccacccuggaggugggcagcgacagaggcuuccuggcccugaucgagggccuggugaacgacaucuacaacguggccagacugauccccagacuggccaaggacagaaugaacuacaagauggaccuggaggacaacaccgaccugaucgagaugagagaggaggugagcagccuggugaucaacgccaugaaggaggccgaggaguaccaggacagcuucgagagauacagcuaccuguggaccgacaaccugcaggaguucaugaagaacuuccugaucuacggcugcgccgugaccgccgaggaccuggacaccuggaccgacgacaccauccccaagaccccccccacccuggcccaguuccaggagcagaucgacagcuacgagaagcuguacgaggaggugagcaagugcgagaacaccaagguguuccacggcuggcugcagugcgacugcagacccuucaagcaggcccugcugagcaccaucagaagauggggcuucauguucaagagacaccugagcaaccacgugaccaacagccuggccgaccuggaggccuucaugaagguggccagaaugggccugaccaagccccugaaggagggcgacuacgacggccugguggaggugaugggccaccugaugaaggugaaggagagacaggccgccaccgacaacauguucgagccccugaagcagaccaucgagcugcugaagaccuacggcgaggagaugcccgaggagauccaccugaagcugcaggagcugcccgagcacugggccaacaccaagaagcuggccauccaggugaagcugaccguggccccccugcaggccaacgaggugagcauccugagaagaaagugccagcaguucgagcugaagcagcacgaguucagagagagauucagaagagaggcccccuucagcuucagcgaccccaaccccuacaagagccugaacaagcagcagaagagcaucagcgccauggagggcaucauggaggcccugagcaagagcggcggccuguucgaggugcccgugcccgacuacaagcagcugaaggccugccacagagaggugagacugcugaaggagcugugggacaugguggugguggugaacaccagcaucgaggacuggaagaccaccaaguggaaggacaucaacguggagcagauggacaucgacugcaagaaguucgccaaggacaugagaagccuggacaaggagaugaagaccugggacgccuucgugggccuggacaacaccgugaagaacgugaucaccagccugagagccgugagcgagcugcagaaccccgccaucagagagagacacuggcagcagcugaugcaggccacccaggugaaguucaagaugagcgaggagaccacccuggccgaccugcugcagcugaaccugcacagcuacgaggacgaggugagaaacaucguggacaaggccgugaaggagagcggcauggagaaggugcugaaggcccuggacagcaccuggagcaugauggaguuccagcacgagccccaccccagaaccggcaccaugaugcugaagagcagcgaggugcugguggagacccuggaggacaaccaggugcagcugcagaaccugaugaugagcaaguaccuggcccacuuccugaaggaggugaccagcuggcagcagaagcugagcaccgccgacagcgugaucagcaucugguucgaggugcagagaaccuggagccaccuggagagcaucuucaucggcagcgaggacaucagaacccagcugcccggcgacagccagagauucgacgacaucaaccaggaguucaaggcccugauggaggacgccgugaagacccccaacgugguggaggccaccagcaagcccggccuguacaacaagcuggaggcccugaagaagagccuggccaucugcgagaaggcccuggccgaguaccuggagaccaagagacuggccuuccccagauucuacuucgugagcagcgccgaccugcuggacauccugagcaacggcaacgaccccguggaggugagcagacaccugagcaagcuguucgacagccugugcaagcugaaguucagacuggacgccagcgacaagccccugaaggugggccugggcauguacagcaaggaggacgaguacaugguguucgaccaggagugcgaccugagcggccagguggagguguggcugaacagagugcuggacagaaugugcagcacccugagacacgagauccccgaggccguggugaccuacgaggagaagcccagagagcaguggauccuggacuaccccgcccagguggcccugaccugcacccagaucugguggaccaccgaggugggccuggccuucgccagacuggaggagggcuacgagaacgccaucagagacuacaacaagaagcagaucagccagcugaacgugcugaucacccugcugaugggcaaccugaacgccggcgacagaaugaagaucaugaccaucugcaccaucgacgugcacgccagagacgugguggccaagaugaucguggccaagguggagagcagccaggccuucaccuggcaggcccagcugagacacagaugggacgaggagaagagacacugcuucgccaacaucugcgacgcccagauccaguacagcuacgaguaccugggcaacacccccagacuggugaucaccccccugaccgacagaugcuacaucacccugacccagagccugcaccugaucaugggcggcgcccccgccggccccgccggcaccggcaagaccgagaccaccaaggaccugggcagagcccugggcaccaugguguacguguucaacugcagcgagcagauggacuacaagagcugcggcaacaucuacaagggccuggcccagaccggcgccuggggcugcuucgacgaguucaacagaaucagcguggaggugcugagcgugaucgccgugcaggugaagugcgugcaggacgccaucagagccaagaagaaggccuucaacuuccugggcgagaucaucggccugauccccaccgugggcaucuucaucaccaugaaccccggcuacgccggcagagccgagcugcccgagaaccugaaggcccuguucagacccugcgccaugguggugcccgacuucgagcugaucugcgagaucaugcugauggccgagggcuuccuggaggccagacugcuggccagaaaguucaucacccuguacacccugugcaaggagcugcugagcaagcaggaccacuacgacuggggccugagagccaucaagagcgugcuggugguggccggcagccugaagagaggcgaccccagcagagccgaggaccaggugcugaugagagcccugagagacuucaacauccccaagaucgugaccgacgaccugcccguguucaugggccugaucggcgaccuguuccccgcccuggacgugcccagaaagagagaccugaacuucgagaagaucaucaagcagagcaucguggagcugaagcugcaggccgaggacagcuucgugcugaagguggugcagcuggaggagcugcugcaggugagacacagcguguucaucgugggcaacgccggcagcggcaagagccaggugcugaagagccugaacaagaccuaccagaaccugaagagaaagcccguggccguggaccuggaccccaaggccgugaccugcgacgagcuguucggcaucaucaaccccgugaccagagaguggaaggacggccuguucagcaccaucaugagagaccuggccaacaucacccacgacggccccaaguggaucauccuggacggcgacaucgaccccauguggaucgagagccugaacaccgugauggacgacaacaaggugcugacccuggccagcaacgagagaaucccccugaacagaaccaugagacugguguucgagaucagccaccugagaaccgccacccccgccaccgugagcagagccggcauccuguacaucaaccccgccgaccugggcuggaaccccguggugagcagcuggaucgagagaagaaaggugcagagcgagaaggccaaccugaugauccuguucgacaaguaccugcccaccugccuggacaagcugagauucggcuucaagaagaucacccccgugcccgagaucaccgugauccagaccauccuguaccugcuggagugccugcugaccgagaagaccgugccccccgacagccccagagagcuguacgagcuguacuucguguucaccugcuucugggccuucggcggcgccauguuccaggaccagcugguggacuacagaguggaguucagcaagugguggaucaacgaguucaagaccaucaaguuccccagccagggcaccaucuucgacuacuacaucgaccccgacaccaagaaguuccugcccuggaccgacaaggugcccagcuucgagcuggaccccgacgugccccugcaggccagccuggugcacaccaccgagaccaucagaaucagauacuucauggaccugcugauggagaagagcuggcccgugaugcuggugggcaacgccggcaccggcaagagcgugcugaugggcgacaagcuggagagccugaacaccgacaacuaccuggugcaggccgugcccuucaacuucuacaccaccagcgccaugcugcagggcgugcuggagaagccccuggagaagaagagcggcagaaacuacggcccccccggcaccaagaagcugguguacuucaucgacgacaugaacaugcccgagguggacaaguacggcaccguggccccccacacccugaucagacagcacauggaccacagacacugguacgacagacacaagcugacccugaaggacauccacaacugccaguacguggccugcaugaaccccaccagcggcagcuucaccaucgacagcagacugcagagacacuucugcguguucgccgugagcuuccccggccaggaggcccugaccaccaucuacaacaccauccugacccagcaccuggccuucagaagcgugagcauggccauccagagaaucagcagccagcugguggccgccgcccuggcccugcaccagaagaucaccgccaccuuccugcccaccgccaucaaguuccacuacguguucaaccugagagaccugagcaacaucuuccagggccugcuguucagcaccgccgaggugcugaagaccccccuggaccuggugagacuguggcugcacgagaccgagagaguguacggcgacaagaugguggacgagaaggaccaggagacccugcacagagugaccauggccagcaccaagaaguucuucgacgaccugggcgacgagcugcuguucgccaagcccaacaucuucugccacuucgcccagggcaucggcgaccccaaguacgugcccgugaccgacauggccccccugaacaagcugcugguggacgugcuggacagcuacaacgaggugaacgccgugaugaaccuggugcuguucgaggacgccguggcccacaucugcagaaucaacagaauccuggagagccccagaggcaacgcccugcuggugggcgugggcggcagcggcaagcagagccugagcagacuggccgccuacaucagcggccuggacguguuccagaucacccugaagaagggcuacggcauccccgaccugaagaucgaccuggccgcccaguacaucaaggccgccgugaagaacgugcccagcguguuccugaugaccgacagccagguggccgaggagcaguuccuggugcugaucaacgaccugcuggccagcggcgagauccccggccuguucauggaggacgagguggagaacaucaucagcagcaugagaccccaggugaagagccugggcaugaacgacaccagagagaccugcuggaaguucuucaucgagaaggugagaagacagcugaaggugauccugugcuucagccccgugggcagcgugcugagagugagagccagaaaguuccccgccguggugaacugcaccgccaucgacugguuccacgaguggcccgaggacgcccuggugagcgugagcgccagauuccuggaggagaccgagggcauccccugggaggugaaggccagcaucagcuucuucaugagcuacgugcacaccaccgugaacgagaugagcagaguguaccuggccaccgagagaagauacaacuacaccacccccaagaccuuccuggagcagaucaagcuguaccagaaccugcuggccaagaagagaaccgagcugguggccaagaucgagagacuggagaacggccugaugaagcugcagagcaccgccagccagguggacgaccugaaggccaagcuggccauccaggaggccgagcugaagcagaagaacgagagcgccgaccagcugauccagguggugggcaucgaggccgagaaggugagcaaggagaaggccaucgccgaccaggaggaggugaagguggaggugaucaacaagaacgugaccgagaagcagaaggccugcgagaccgaccuggccaaggccgagcccgcccugcuggccgcccaggaggcccuggacacccugaacaagaacaaccugaccgagcugaagagcuucggcagcccccccgacgccguggugaacgugaccgccgccgugaugauccugaccgcccccggcggcaagauccccaaggacaagagcuggaaggccgccaagaucaugaugggcaagguggacaccuuccuggacagccugaagaaguucgacaaggagcacauccccgaggccugccugaaggccuucaagcccuaccagggcaaccccaccuucgaccccgaguucaucagaagcaagagcaccgccgccgccggccugugcagcuggugcaucaacaucgugagauucuacgagguguacugcgacguggcccccaagagacaggcccuggaggaggccaacgccgagcuggccgaggcccaggagaagcugagcagaaucaagaacaagaucgccgagcugaacgccaaccugagcaaccugaccagcgccuucgagaaggccaccgccgagaagaucaagugccagcaggaggccgacgccaccaacagagugauccugcuggccaacagacuggugggcggccuggccagcgagaacaucagaugggccgagagcguggagaacuucagaagccagggcgugacccugugcggcgacgugcugcugaucagcgccuucgugagcuacgugggcuacuucaccaagaaguacagaaacgagcugauggagaaguucuggauccccuacauccacaaccugaaggugcccauccccaucaccaacggccuggacccccugagccugcugaccgacgacgccgacguggccaccuggaacaaccagggccugcccagcgacagaaugagcaccgagaacgccaccauccugggcaacaccgagagauggccccugaucguggacgcccagcugcagggcaucaaguggaucaagaacaaguacagaagcgagcugaaggccaucagacugggccagaagagcuaccuggacgugaucgagcaggccaucagcgagggcgacacccugcugaucgagaacaucggcgagaccguggaccccgugcuggacccccugcugggcagaaacaccaucaagaagggcaaguacaucaagaucggcgacaaggagguggaguaccaccccaaguucagacugauccugcacaccaaguacuucaacccccacuacaagcccgagaugcaggcccagugcacccugaucaacuuccuggugaccagagacggccuggaggaccagcugcuggccgccgugguggccaaggagagacccgaccuggagcagcugaaggccaaccugaccaagagccagaacgaguucaagaucgugcugaaggagcuggaggacagccugcuggccagacugagcgccgccagcggcaacuuccugggcgacaccgcccugguggagaaccuggagaccaccaagcacaccgccagcgagaucgaggagaaggugguggaggccaagaucaccgaggugaagaucaacgaggccagagagaacuacagacccgccgccgagagagccagccugcuguacuucauccugaacgaccugaacaagaucaaccccguguaccaguucagccugaaggccuucaacgugguguucgagaaggccauccagagaaccacccccgccaacgaggugaagcagagagugaucaaccugaccgacgagaucaccuacagcguguacauguacaccgccagaggccuguucgagagagacaagcugaucuuccuggcccaggugaccuuccaggugcugagcaugaagaaggagcugaaccccguggagcuggacuuccugcugagauuccccuucaaggccggcguggugagccccguggacuuccugcagcaccagggcuggggcggcaucaaggcccugagcgagauggacgaguucaagaaccuggacagcgacaucgagggcagcgccaagagauggaagaagcugguggagagcgaggcccccgagaaggagaucuuccccaaggaguggaagaacaagaccgcccugcagaagcugugcauggugagaugccugagacccgacagaaugaccuacgccaucaagaacuucguggaggagaagaugggcagcaaguucguggagggcagaagcguggaguucagcaagagcuacgaggagagcagccccagcaccagcaucuucuucauccugagccccggcguggacccccugaaggacguggaggcccugggcaagaagcugggcuucaccaucgacaacggcaagcugcacaacgugagccugggccagggccaggaggugguggccgagaacgcccuggacguggccgccgagaagggccacugggugauccugcagaacauccaccugguggccagauggcugggcacccuggacaagaagcuggagcacuacagcaccggcagccacgaggacuacagaguguucaucagcgccgagcccgcccccagccccgagacccacaucaucccccagggcauccuggagaacgccaucaagaucaccaacgagccccccaccggcaugcacgccaaccugcacaaggcccuggaccuguucacccaggacacccuggagaugugcaccaaggagauggaguucaagugcaugcuguucgcccugugcuacuuccacgccgugguggccgagagaagaaaguucggcgcccagggcuggaacagaagcuaccccuucaacaacggcgaccugaccaucagcaucaacgugcuguacaacuaccuggaggccaaccccaaggugcccugggacgaccugagauaccuguucggcgagaucauguacggcggccacaucaccgacgacugggacagaagacugugcagaaccuaccuggccgaguacaucagaaccgagaugcuggagggcgacgugcugcuggcccccggcuuccagaucccccccaaccuggacuacaagggcuaccacgaguacaucgacgagaaccugccccccgagagccccuaccuguacggccugcaccccaacgccgagaucggcuuccugaccgugaccagcgagaagcuguucagaaccgugcuggagaugcagcccaaggagaccgacagcggcgccggcaccggcgugagcagagaggagaaggugaaggccgugcuggacgacauccuggagaagauccccgagaccuucaacauggccgagaucauggccaaggccgccgagaagacccccuacguggugguggccuuccaggagugcgagagaaugaacauccugaccaacgagaugagaagaagccugaaggagcugaaccugggccugaagggcgagcugaccaucaccaccgacguggaggaccugagcaccgcccuguucuacgacaccgugcccgacaccuggguggccagagccuaccccagcaugaugggccuggccgccugguacgccgaccugcugcugagaaucagagagcuggaggccuggaccaccgacuucgcccugcccaccaccguguggcuggccggcuucuucaacccccagagcuuccugaccgccaucaugcagagcauggccagaaagaacgaguggccccuggacaagaugugccugagcguggaggugaccaagaagaacagagaggacaugaccgccccccccagagagggcagcuacguguacggccuguucauggagggcgccagaugggacacccagaccggcgugaucgccgaggccagacugaaggagcugacccccgccaugcccgugaucuucaucaaggccauccccguggacagaauggagaccaagaacaucuacgagugccccguguacaagaccagaaucagaggccccaccuacguguggaccuucaaccugaagaccaaggagaaggccgccaaguggauccuggccgccguggcccugcugcugcagguguaa

SEQ ID NO: 16198 - RNA, 12798 nt, Artificial Sequence
  DNAH1__Homo_sapiens__NP_056327
auggagcagcccaacagcaagggcuacagccugggcagaaccccccagggccccgagugcagcagcgcccccgccgugcaggugggcacccacagaggccuggaguacaaccccggcaagauccugcccggcagcgacuacggccugggcaacccccccgcccuggaccccaagcugccccaccugccccugccccccgccccccccacccugagcgaccugggccagcccagaaagagcccccugaccggcaccgacaagaaguacccccugaugaagcagagaggcuucuacagcgacauccugagccccggcacccuggaccagcugggcgaggugugcagaggccccagaaugagccagaaccugcugagacaggccgaccuggacaaguucacccccagagugggcagcuucgaggugcccgaggacuuccaggagagaauggagcagcagugcaucggcagcaccaccagacugcuggcccagaccgacuucccccugcaggccuacgagcccaagaugcaggugcccuuccaggugcugcccggccagcaccccagaaagaucgagaucgagagaagaaagcagcaguaccugagccuggacaucgagcagcugcuguucagccagggcaucgacagcaacaagcugaugcccagacaccuggaccaccagcacccccagaccaucgagcagggccacgaccccaucuuccccaucuaccugccccugaagguguucgacaacgaggacuucgacugcagaacccccagagaguggaucaacaugggccuggagcccggcagccuggacagaaagcccgugcccggcaaggcccugcugcccaccgacgacuuccugggccacgaggaccccaagagccagaagcugaaguacaaguggugcgaggugggcgugcuggacuacgacgaggagaagaagcuguaccuggugcacaagaccgacgagaagggccuggugagagacgagaugggcagacccauccugaacgccggcgugaccaccgagggcagacccccccugcaggugugccaguacugggugcccagaauccagcugcuguucugcgccgaggaccccugcauguucgcccagagaguggugcaggccaacgcccugagaaagaacaccgaggcccugcugcuguacaaccuguacguggacugcaugcccagcgacggccagcacgugaucagcgagcagagccugagcaagaucaagcagugggcccugagcacccccagaaugagaaagggccccagcgugcuggagcaccugagcagccuggccagagaggugagccuggacuacgagagaagcaugaacaagaucaacuucgaccacguggugagcagcaagcccgagaccuucagcuacgugacccugcccaagaaggaggaggagcaggugcccgagagaggccuggugagcgugcccaaguaccacuucugggagcagaaggaggacuucaccuucgugagccugcugaccagacccgaggugaucaccgcccugagcaaggugagagccgagugcaacaaggugaccgccaugagccuguuccacagcagccugagcaaguacagccaccuggaggaguucgagcagauccagagccagaccuucagccaggugcagauguuccugaaggacagcuggaucagcagccugaagguggccaugagaagcagccugagagacaugagcaagggcugguacaaccuguacgagaccaacugggagguguaccugaugagcaagcugagaaagcugauggagcuggugaaguacaugcugcaggacacccugagauuccuggugcaggacagccuggccagcuucagccaguucaucagcgacaccugcugcagcgugcugaacugcaccgacgacaugguguggggcgacgaccugaucaacagccccuacagacccagaaagaacccccuguucaucauggaccuggugcuggacagcagcggcgugcacuacagcaccccccuggagcaguucgaggccagccugcugaaccuguucgacaagggcauccuggccacccacgccgugccccagcuggagaagcuggugauggaggacaucuucaucagcggcgacccccugcuggagagcgugggccugcacgagccccugguggaggagcugagagccaccaucgccagcgccgugagcaaggccaugaucccccugcaggccuacgccaaggaguacagaaaguaccuggagcugaacaacaacgacaucgccagcuuccugaagaccuaccagacccagggccugcuggcccaggaggugagagagguggugcugacccaccugagagagaaggagauccuggacagcagccugcccagcagcaucaucaucggccccuucuacaucaacaccgacaacgugaagcagagccugagcaagaagagaaaggcccuggccaccagcgugcuggacauccuggccaagaaccugcacaaggagguggacagcaucugcgaggaguucagaagcaucagcagaaagaucuacgagaagcccaacagcaucgaggagcuggccgagcugagagaguggaugaagggcauccccgagagacuggugggccuggaggagagaaucgugaaggugauggacgacuaccaggugauggacgaguuccuguacaaccugagcagcgacgacuucaacgacaaguggaucgccagcaacuggcccagcaagauccugggccagaucgagcuggugcagcagcagcacguggaggacgaggagaaguucagaaagauccagaucauggaccagaacaacuuccaggagaagcuggagggccugcagcuggugguggccggcuucagcauccacguggagaucagcagagcccacgagaucgccaacgaggugagaagagugaagaagcagcugaaggacugccagcagcuggccaugcuguacaacaacagagagagaaucuucagccugcccaucaccaacuacgacaagcugagcagaauggugaaggaguuccagcccuaccuggaccuguggaccaccgccagcgacuggcugagauggagcgagagcuggaugaacgacccccugagcgccaucgacgccgagcagcuggagaagaacgugguggaggccuucaagaccaugcacaagugcgugaagcaguucaaggacaugcccgccugccaggagguggcccuggacaucagagccagaaucgaggaguucaagcccuacaucccccugauccagggccugagaaaccccggcaugagaaucagacacugggagacccugagcaaccagaucaacaucaacgugagacccaaggccaaccugaccuucgccagaugccuggagaugaaccugcaggaccacaucgagagcaucagcaagguggccgagguggccggcaaggaguacgccaucgagcaggcccuggacaagauggagaaggaguggagcaccauccuguucaacgugcugcccuacaaggccaccgacaccuacauccugaagagccccgacgaggccagccagcugcuggacgaccacaucgugaugacccagaacaugagcuucagccccuacaagaagcccuucgagcagagaaucaacagcugggagaacaagcugaagcugacccaggaggugcuggaggaguggcugaacugccagagaagcuggcuguaccuggagcccaucuucagcagcgaggacaucaaccagcagcugcccguggagagcaagagauaccagaccauggagagaaucuggaagaagaucaugaagaacgccuacgagaacagagaggugaucaacgugugcagcgaccugagaaugcuggacagccugagagacugcaacaagauccuggaccuggugcagaagggccugagcgaguaccuggagaccaagagaagcgccuuccccagauucuacuuccugagcgacgacgagcugcuggagauccugagccagaccaaggaccccaccgccgugcagccccaccugagaaagugcuucgagaacaucgccagacugcuguuccaggaggaccuggagaucacccacauguacagcgccgagggcgaggaggugcagcugugcuucagcaucuaccccagcagcaacguggaggacuggcugagagagguggagagaagcaugaaggccagcgugcacgacaucaucgagaaggccaucagagccuaccccaccaugcccagaacccagugggugcugaacuggcccggccaggugaccaucgccggcugccagaccuacuggaccauggagguggccgaggcccuggaggccggcaaccugagaagccagcuguucccccagcugugccagcagcugagcgaccugguggcccuggugagaggcaagcugagcagaaugcagagagccgugcugagcgcccugaucgugaucgaggugcacgccaaggacguggugagcaagcugauccaggagaacguggugagcgugaacgacuuccaguggaucagccagcugagauacuacuggaccaacaacgaccuguacaucagagccgugaacgccgaguucaucuacggcuacgaguaccugggcaacagcggcagacuggugaucaccccccugaccgacagaugcuaccugacccugaccggcgcccugcaccugaaguucggcggcgcccccgccggccccgccggcaccggcaagaccgagaccaccaaggaccugggcaaggcccuggccauccagaccgugguguucaacugcagcgaccagcuggacuucauggccaugggcaaguucuucaagggccuggccagcgccggcgccugggccugcuucgacgaguucaacagaaucgacaucgaggugcugagcgugguggcccagcagaucaccaccauccagaaggcccagcagcagagaguggagagauucauguucgagggcguggagaucccccuggugcccagcugcgccguguucaucaccaugaaccccggcuacgccggcagaaccgagcugcccgacaaccugaaggcccuguucagacccguggccaugauggugcccgacuacgccaugaucaccgagaucagccuguacagcuucggcuucaacgaggccagcgugcuggccaagaagaucaccaccaccuucaagcugagcagcgagcagcugagcagccaggaccacuacgacuucggcaugagagccgugaagaccgugaucagcgccgccggcaaccugaagagagagaaccccagcaugaacgaggagcugaucugccugagagccaucagagacgugaacgugcccaaguuccugcaggaggaccugaagcuguucagcggcaucgugagcgaccuguuccccaccaucaaggaggaggacaccgacuacggcauccuggacgaggccaucagagaggccugcagaaacagcaaccugaaggacguggagggcuuccugaccaagugcauccagcuguacgagaccaccguggugagacacggccugaugcuggugggccccaccggcagcggcaagagcaccugcuacagagugcuggccgccgccaugaccagccugaagggccagcccagcaucagcggcggcauguacgaggccgugaacuacuacgugcugaaccccaagagcaucaccaugggccagcuguacggcgaguucgaccugcugacccacgaguggaccgacggcaucuucagcagcuucaucagagccggcgccaucaccagcgacaccaacaagaagugguacauguucgacggccccguggacgccaucuggaucgagaacaugaacaccgugcuggacgacaacaagaagcugugccugagcagcggcgagaucaucaagcugaccgaggccaugaccaugauguucgaggugcaggaccuggccguggccagccccgccaccgugagcagaugcggcaugguguaccuggagcccagcauccugggccugaugcccuucaucgagugcuggcugagaaagcugcccccccugcugaagcccuacgaggagcacuucaaggcccuguucgugagcuuccuggaggagagcaucagcuucgugagaagcagcgugaaggaggugaucgccagcaccaacugcaaccugaccaugagccugcugaagcugcuggacugcuucuucaagcccuuccugcccagagagggccugaagaagauccccagcgagaagcugagcagaaucguggagcugaucgagcccugguucaucuucagccugaucuggagcgugggcgccaccggcgacagcagcggcagaaccagcuucagccacuggcugagacugaagauggagaacgagcagcugacccugcuguuccccgaggagggccugguguucgacuacagacuggaggacgccggcaucagcggcaccaacgacagcgaggacgaggaggaggaguacaagcagguggccugggugaaguggauggacagcagcgcccccuucaccauggugcccgacaccaacuacugcaacaucaucgugcccaccauggacaccgugcagaugagccaccugcuggacaugcugcugaccaacaagaagcccgugcugugcaucggccccaccggcaccggcaagacccugaccaucagcgacaagcugcugaagaaccuggcccuggacuacaucagccacuuccugaccuucagcgccagaaccagcgccaaccagacccaggacuucaucgacagcaagcuggacaagagaagaaagggcguguucggccccccccugggcagaaacuucaucuucuucaucgacgaccugaacaugcccgcccuggagaccuacggcgcccagccccccaucgagcugcugagacaguggauggaccacggcggcugguacgacagaaagaucaucggcgccuucaagaaccugguggacaucaacuucgugugcgccaugggcccccccggcggcggcagaaacaccgugacccccagacugaugagacacuucaacuaccugagcuucgccgagauggacgaggugagcaagaagagaaucuucagcaccauccugggcaacuggcuggacggccugcugggcgagaagagcuacagagagagagugcccggcgccccccacaucgcccacuucaccgagccccugguggaggccaccaucaugguguacgccaccaucaccagccagcugcugcccacccccgccaagagccacuacaccuucaaccugagagaccugagcaagguguuccagggcaugcugauggccgaccccgccaagguggaggaccaggugcagcugcugagacugugguaccacgagaacugcagaguguucagagacagacuggugaacgaggaggacagaagcugguucgaccagcugcugaagagaugcauggagcagugggaggugaccuucaacaaggugugccccuuccagcccauccuguacggcgacuucaugagccccggcagcgacgugaagagcuacgagcugaucaccagcgagagcaagaugaugcaggugaucgaggaguacaucgaggacuacaaccagaucaacaccgccaagcugaagcuggugcuguucauggacgccaugagccacaucugcagaaucagcagaacccugagacaggcccugggcaacgcccugcugcugggcgugggcggcagcggcagaagcagccugaccagacuggccagccacauggccgaguacgagugcuuccagaucgagcugagcaagaacuacggcaugagcgaguggagagacgacgugaagaaggugcugcugaaggccggccugcagaaccugcccaucaccuuccuguucagcgacacccagaucaagaacgagagcuuccuggaggacaucaacaacgugcugaacagcggcgacauccccaaccuguacaccgccgacgagcaggaccagaucgugagcaccaugagacccuacauccaggagcagggccugcagcccaccaaggccaaccugauggccgccuacaccggcagagugagaagcaacauccacauggugcugugcaugagccccaucggcgagguguucagagccagacugagacaguuccccagccuggugaacugcugcaccaucgacugguucaacgaguggcccgccgaggcccugaagagcguggccaccguguuccugaacgagauccccgagcuggagagcagccaggaggagauccagggccugauccaggugugcguguacauccaccagagcgugagcaagaagugcaucgaguaccuggccgagcugaccagacacaacuacgugacccccaagagcuaccuggagcugcugcacaucuucagcauccugaucggccagaagaagcuggagcugaagaccgccaagaacagaaugaagagcggccuggacaagcugcugagaaccagcgaggacguggccaagaugcaggaggaccuggagagcaugcacccccugcuggaggaggccgccaaggacaccaugcugaccauggagcagaucaagguggacaccgccaucgccgaggagaccagaaacagcgugcagaccgaggagaucaaggccaacgagaaggccaagaaggcccaggccaucgccgacgacgcccagaaggaccuggacgaggcccugcccgcccuggacgccgcccuggccagccugagaaaccugaacaagaacgacgugaccgaggugagagccaugcagagacccccccccggcgugaagcuggugaucgaggccgugugcaucaugaagggcaucaagcccaagaaggugcccggcgagaagcccggcaccaagguggacgacuacugggagcccggcaagggccugcugcaggaccccggccacuuccuggagagccuguucaaguucgacaaggacaacaucggcgacguggugaucaaggccauccagcccuacaucgacaacgaggaguuccagcccgccaccaucgccaaggugagcaaggccugcaccagcaucugccagugggugagagccaugcacaaguaccacuucguggccaaggccguggagcccaagagacaggcccugcuggaggcccaggacgaccugggcgugacccagagaauccuggacgaggccaagcagagacugagagagguggaggacggcaucgccaccaugcaggccaaguacagagagugcaucaccaagaaggaggagcuggagcugaagugcgagcagugcgagcagagacugggcagagccggcaagcugaucaacggccugagcgacgagaaggugagauggcaggagaccguggagaaccugcaguacaugcugaacaacaucagcggcgacgugcugguggccgccggcuucguggccuaccugggccccuucaccggccaguacagaaccgugcuguacgacagcugggugaagcagcugagaagccacaacgugccccacaccagcgagcccacccugaucggcacccugggcaaccccgugaagaucagaagcuggcagaucgccggccugcccaacgacacccugagcguggagaacggcgugaucaaccaguucagccagagauggacccacuucaucgacccccagagccaggccaacaaguggaucaagaacauggagaaggacaacggccuggacguguucaagcugagcgacagagacuuccugagaagcauggagaacgccaucagauucggcaagcccugccugcuggagaacgugggcgaggagcuggaccccgcccuggagcccgugcugcugaagcagaccuacaagcagcagggcaacaccgugcugaagcugggcgacaccgugauccccuaccacgaggacuucagaauguacaucaccaccaagcugcccaacccccacuacacccccgagaucagcaccaagcugacccugaucaacuucacccugagccccagcggccuggaggaccagcugcugggccaggugguggccgaggagagacccgaccuggaggaggccaagaaccagcugaucaucagcaacgccaagaugagacaggagcugaaggacaucgaggaccagauccuguacagacugagcagcagcgagggcaaccccguggacgacauggagcugaucaaggugcuggaggccagcaagaugaaggccgccgagauccaggccaaggugagaaucgccgagcagaccgagaaggacaucgaccugaccagaauggaguacauccccguggccaucagaacccagauccuguucuucugcgugagcgaccuggccaacguggaccccauguaccaguacagccuggagugguuccugaacaucuuccugagcggcaucgccaacagcgagagagccgacaaccugaagaagagaaucagcaacaucaacagauaccugaccuacagccuguacagcaacgugugcagaagccuguucgagaagcacaagcugauguucgccuuccugcugugcgugagaaucaugaugaacgagggcaagaucaaccagagcgaguggagauaccugcugagcggcggcagcaucagcaucaugaccgagaaccccgcccccgacuggcugagcgacagagccuggagagacauccuggcccugagcaaccugcccaccuucagcagcuucagcagcgacuucgugaagcaccugagcgaguucagagugaucuucgacagccuggagccccacagagagccccugcccggcaucugggaccaguaccuggaccaguuccagaagcugcuggugcugagaugccugagaggcgacaaggugaccaacgccaugcaggacuucguggccaccaaccuggagcccagauucaucgagccccagaccgccaaccugagcgugguguucaaggacagcaacagcaccaccccccugaucuucgugcugagccccggcaccgaccccgccgccgaccuguacaaguucgccgaggagaugaaguucagcaagaagcugagcgccaucagccugggccagggccagggccccagagccgaggccaugaugagaagcagcaucgagagaggcaaguggguguucuuccagaacugccaccuggcccccagcuggaugcccgcccuggagagacugaucgagcacaucaaccccgacaaggugcacagagacuucagacuguggcugaccagccugcccagcaacaaguuccccgugagcauccugcagaacggcagcaagaugaccaucgagccccccagaggcgugagagccaaccugcugaagagcuacagcagccugggcgaggacuuccugaacagcugccacaaggugauggaguucaagagccugcugcugagccugugccuguuccacggcaacgcccuggagagaagaaaguucggcccccugggcuucaacauccccuacgaguucaccgacggcgaccugagaaucugcaucagccagcugaagauguuccuggacgaguacgacgacauccccuacaaggugcugaaguacaccgccggcgagaucaacuacggcggcagagugaccgacgacugggacagaagaugcaucaugaacauccuggaggacuucuacaaccccgacgugcugagccccgagcacagcuacagcgccagcggcaucuaccaccagaucccccccaccuacgaccugcacggcuaccugagcuacaucaagagccugccccugaacgacaugcccgagaucuucggccugcacgacaacgccaacaucaccuucgcccagaacgagaccuucgcccugcugggcaccaucauccagcugcagcccaagagcagcagcgccggcagccagggcagagaggagaucguggaggacgugacccagaacauccugcugaaggugcccgagcccaucaaccugcagugggugauggccaaguaccccgugcuguacgaggagagcaugaacaccgugcuggugcaggaggugaucagauacaacagacugcugcaggugaucacccagacccugcaggaccugcugaaggcccugaagggccugguggugaugagcagccagcuggagcugauggccgccagccuguacaacaacaccgugcccgagcuguggagcgccaaggccuaccccagccugaagccccugagcagcugggugauggaccugcugcagagacuggacuuccugcaggccuggauccaggacggcauccccgccguguucuggaucagcggcuucuucuucccccaggccuuccugaccggcacccugcagaacuucgccagaaaguucgugaucagcaucgacaccaucagcuucgacuucaaggugauguucgaggcccccagcgagcugacccagagaccccaggugggcugcuacauccacggccuguuccuggagggcgccagaugggaccccgaggccuuccagcuggccgagagccagcccaaggagcuguacaccgagauggccgugaucuggcugcugcccacccccaacagaaaggcccaggaccaggacuucuaccugugccccaucuacaagacccugaccagagccggcacccugagcaccaccggccacagcaccaacuacgugaucgccguggagauccccacccaccagccccagagacacuggaucaagagaggcguggcccugaucugcgcccuggacuacuaa

SEQ ID NO: 16199 - RNA, 2619 nt, Artificial Sequence
  DNAH2__Homo_sapiens__NP_001290199
augagcagcaaggccgagaagaagcagagacugagcggcagaggcagcagccaggccagcuggagcggcagagccaccagagccgccguggccacccaggagcagggcaacgcccccgccgugagcgagcccgagcugcaggccgagcugcccaaggaggagcccgagcccagacuggagggcccccaggcccagagcgaggagagcguggagcccgaggccgacgugaagccccuguuccugagcagagccgcccugaccggccuggccgacgccguguggacccaggagcacgacgccauccuggagcacuucgcccaggaccccaccgagagcauccugaccaucuucaucgaccccugcuucggccugaagcuggagcugggcaugcccgugcagacccagaaccagcugguguacuucaucagacaggcccccgugcccaucaccugggagaacuucgaggccaccgugcaguucggcaccgugagaggccccuacauccccgcccugcugagacugcugggcggcguguucgccccccagaucuucgccaacaccggcuggcccgagagcaucagaaaccacuucgccagccaccugcacaaguuccuggccugccugaccgacaccagauacaagcuggagggccacaccgugcuguacauccccgccgaggccaugaacaugaagcccgagauggugaucaaggacaaggagcuggugcagagacuggagaccagcaugauccacuggaccagacagaucaaggagaugcugagcgcccaggagaccguggagaccggcgagaaccugggcccccuggaggagaucgaguucuggagaaacagaugcauggaccugagcggcaucagcaagcagcuggugaagaagggcgugaagcacguggagagcauccugcaccuggccaagagcagcuaccuggcccccuucaugaagcuggcccagcagauccaggacggcagcagacaggcccagagcaaccugaccuuccugagcauccugaaggagcccuaccaggagcuggccuucaugaagcccaaggacaucagcagcaagcugcccaagcugaucagccugaucagaaucaucugggugaacagcccccacuacaacaccagagagagacugaccagccuguucagaaagaugagcaacgagaucaucagacugugcugccacgccaucagccuggacagaaucuucgagggcuacgugagcagcagcaaggaggaccugcagggcugcauccugugcugccacgccuggaaggaccacuacgugcaggccgugcagaugcacauccaguucagcagcagaggcugggugcuggaccagaccagcaucuucgcccagguggacgccuucgugcagagaugcaaggaccugaucgaggugugcgacugccaguaccacuucgccagaugggaggacggcaagcagggcccccugcccugcuucuucggcgcccagggcccccagaucaccagaaaccugcuggagaucgaggacaucuuccacaagaaccugcacacccugagagccgugagaggcggcauccuggacgugaagaacaccugcuggcacgaggacuacaacaaguucagagccggcaucaaggaccuggaggugaugacccagaaccugaucaccagcgccuucgagcuggugagagacgugccccacggcgugcugcugcuggacaccuuccacagacuggccagcagagaggccaucaagagaaccuacgacaagaaggccguggaccuguacaugcuguucaacagcgagcuggcccuggugaacagagagagaaacaagaaguggcccgaccuggagcccuacguggcccaguacagcggcaaggccagaugggugcacauccugagaagaagaaucgacagagugaugaccugccuggccggcgcccacuuccugcccagaaucggcaccggcaaggagagcgugcacaccuaccagcagauggugcaggccaucgacgagcuggugagaaagaccuuccaggaguggaccagcagccuggacaaggacugcaucagaagacuggacaccccccugcugagaaucagccaggagaaggccggcaugcuggacgugaacuucgacaaguacagaagccaccuggcccccuuccccuacaccccccugcugcagcugagccaggaguuccacagccaccugcugaccccccuguucaucauccugagccugagccacaccaucugccugcugagcagcuucuacuucuucuucagcagcuucaucuucgugagcccccaccugccccccugcuaccagcacuucaacuucaccaccuaccugaagacccagcagaacaagaccaugaucggccaggccagauggcugacccccgugauccccgcccugugggaggccgaggugggcgccagccuggagcccagaagccugagaaccgccugggccaccuggcagaaccccgugagcgccaagaacaccaagaucagcugggccugguggcacaagcccguggugagcgccaccugggagggcgaggugggcggcagccccgagcccggcagacagagacugcaguaa

SEQ ID NO: 16200 - RNA, 12351 nt, Artificial Sequence
  DNAH3__Homo_sapiens__NP_060009
augggcgccaccggcagacuggagcugacccuggccgcccccccccaccccggccccgccuuccagagaagcaaggccagagagacccagggcgaggaggagggcagcgagaugcagaucgccaagagcgacagcauccaccacaugagccacagccagggccagcccgagcugcccccccugcccgccagcgccaacgaggagcccagcggccuguaccagaccgugaugagccacagcuucuaccccccccugaugcagagaaccagcuggacccuggccgcccccuucaaggagcagcaccaccacagaggccccagcgacagcaucgccaacaacuacagccugauggcccaggaccugaagcugaaggaccugcugaagguguaccagcccgccaccaucagcgugcccagagacagaaccggccagggccugcccagcagcggcaacagaagcagcagcgagcccaugagaaagaagaccaaguucagcagcagaaacaaggaggacagcaccagaaucaagcuggccuucaagaccagcaucuucagccccaugaagaaggaggugaagaccagccugaccuuccccggcagcagacccaugagccccgagcagcagcuggacgugaugcugcagcaggagauggagauggagagcaaggagaagaagcccagcgagagcgaccuggagagauacuacuacuaccugaccaacggcaucagaaaggacaugaucgcccccgaggagggcgaggugauggugagaaucagcaagcugaucagcaacacccugcugaccagccccuuccuggagccccugaugguggugcuggugcaggagaaggagaacgacuacuacugcagccugaugaagagcaucguggacuacauccugauggaccccauggagagaaagagacuguucaucgagagcauccccagacuguucccccagagagugaucagagcccccgugcccuggcacagcguguacagaagcgccaagaaguggaacgaggagcaccugcacaccgugaaccccaugaugcugagacugaaggagcugugguucgccgaguucagagaccugagauucgugagaaccgccgagauccuggccggcaagcugccccugcagccccaggaguucugggacgugauccagaagcacugccuggaggcccaccagacccugcugaacaaguggauccccaccugcgcccagcuguucaccagcagaaaggagcacuggauccacuucgcccccaagagcaacuacgacagcagcagaaacaucgaggaguacuucgccagcguggccagcuucaugagccugcagcugagagagcuggugaucaagagccuggaggaccuggugagccuguucaugauccacaaggacggcaacgacuucaaggagcccuaccaggagaugaaguucuucaucccccagcugaucaugaucaagcuggaggugagcgagcccaucaucguguucaaccccagcuucgacggcugcugggagcugaucagagacagcuuccuggagaucaucaagaacagcaacggcauccccaagcugaaguacaucccccugaaguucagcuucaccgccgccgccgccgacagacagugcgugaaggccgccgagcccggcgagcccagcaugcacgccgccgccaccgccauggccgagcugaagggcuacaaccugcugcugggcaccgugaacgccgaggagaagcuggugagcgacuuccugauccagaccuucaagguguuccagaagaaccaggugggccccugcaaguaccugaacguguacaagaaguacguggaccugcuggacaacaccgccgagcagaacaucgccgccuuccugaaggagaaccacgacaucgacgacuucgugaccaagaucaacgccaucaagaagagaagaaacgagaucgccagcaugaacaucaccgugccccuggccauguucugccuggacgccaccgcccugaaccacgaccugugcgagagagcccagaaccugaaggaccaccugauccaguuccagguggacgugaacagagacaccaacaccagcaucugcaaccaguacagccacaucgccgacaaggugagcgaggugcccgccaacaccaaggagcuggugagccugaucgaguuccugaagaagagcagcgccgugaccguguucaagcugagaagacagcugagagacgccagcgagagacuggaguuccugauggacuacgccgaccugcccuaccagaucgaggacaucuucgacaacagcagaaaccugcugcugcacaagagagaccaggccgagauggaccugaucaagagaugcagcgaguucgagcugagacuggagggcuaccacagagagcuggagagcuucagaaagagagaggugaugaccaccgaggagaugaagcacaacguggagaagcugaacgagcugagcaagaaccugaacagagccuucgccgaguucgagcugaucaacaaggaggaggagcugcuggagaaggagaagagcaccuacccccugcugcaggccaugcugaagaacaaggugcccuacgagcagcuguggagcaccgccuacgaguucagcaucaagagcgaggaguggaugaacggcccccuguuccugcugaacgccgagcagaucgccgaggagaucggcaacauguggagaaccaccuacaagcugaucaagacccugagcgacgugcccgcccccagaagacuggccgagaacgugaagaucaagaucgacaaguucaagcaguacauccccauccugagcaucagcugcaaccccggcaugaaggacagacacuggcagcagaucagcgagaucgugggcuacgagaucaagcccaccgagaccaccugccugagcaacaugcuggaguucggcuucggcaaguucguggagaagcuggagcccaucggcgccgccgccagcaaggaguacagccuggagaagaaccuggacagaaugaagcuggacugggugaacgugaccuucagcuucgugaaguacagagacaccgacaccaacauccugugcgccaucgacgacauccagaugcugcuggacgaccacgugaucaagacccagaccaugugcggcagccccuucaucaagcccaucgaggccgagugcagaaagugggaggagaagcugaucagaauccaggacaaccuggacgccuggcugaagugccaggccaccuggcuguaccuggagcccaucuucagcagcgaggacaucaucgcccagaugcccgaggagggcagaaaguucggcaucguggacagcuacuggaagagccugaugagccaggccgugaaggacaacagaauccugguggccgccgaccagcccagaauggccgagaagcugcaggaggccaacuuccugcuggaggacauccagaagggccugaacgacuaccuggagaagaagagacuguucuuccccagauucuucuuccugagcaacgacgagcugcuggagauccugagcgagaccaaggacccccugagagugcagccccaccugaagaagugcuucgagggcaucgccaagcuggaguucaccgacaaccuggagaucgugggcaugaucagcagcgagaaggagaccgugcccuucauccagaagaucuaccccgccaacgccaagggcaugguggagaaguggcugcagcagguggagcagaugaugcuggccagcaugagagaggugaucggccugggcaucgaggccuacgugaaggugcccagaaaccacugggugcugcaguggcccggccagguggugaucugcgugagcagcaucuucuggacccaggaggugagccaggcccuggccgagaacacccugcuggacuuccugaagaagagcaacgaccagaucgcccagaucgugcagcuggugagaggcaagcugagcagcggcgccagacugacccugggcgcccugaccgugaucgacgugcacgccagagacgugguggccaagcugagcgaggacagagugagcgaccugaacgacuuccaguggaucagccagcugagauacuacuggguggccaaggacgugcaggugcagaucaucaccaccgaggcccuguacggcuacgaguaccugggcaacagccccagacuggugaucaccccccugaccgacagaugcuacagaacccugaugggcgcccugaagcugaaccugggcggcgcccccgagggccccgccggcaccggcaagaccgagaccaccaaggaccuggccaaggcccuggccaagcagugcgugguguucaacugcagcgacggccuggacuacaaggccaugggcaaguucuucaagggccuggcccaggccggcgccugggccugcuucgacgaguucaacagaaucgagguggaggugcugagcgugguggcccagcagauccugagcauccagcaggccaucaucagaaagcugaagaccuucaucuucgagggcaccgagcugagccugaaccccaccugcgccguguucaucaccaugaaccccggcuacgccggcagagccgagcugcccgacaaccugaaggcccuguucagaaccguggccaugauggugcccgacuacgcccugaucggcgagaucagccuguacagcaugggcuuccuggacagcagaagccuggcccagaagaucguggccaccuacagacugugcagcgagcagcugagcagccagcaccacuacgacuacggcaugagagccgugaagagcgugcugaccgccgccggcaaccugaagcugaaguaccccgaggagaacgagagcgugcugcugcugagagcccugcuggacgugaaccuggccaaguuccuggcccaggacgugccccuguuccagggcaucaucagcgaccuguuccccggcguggugcugcccaagcccgacuacgagguguuccugaaggugcugaacgacaacaucaagaagaugaagcugcagcccgugcccugguucaucggcaagaucauccagaucuacgagaugaugcuggugagacacggcuacaugaucgugggcgaccccaugggcggcaagaccagcgccuacaaggugcuggccgccgcccugggcgaccugcacgccgccaaccagauggaggaguucgccguggaguacaagaucaucaaccccaaggccaucaccaugggccagcuguacggcugcuucgaccaggugagccacgaguggauggacggcgugcuggccaacgccuucagagagcaggccagcagccugagcgacgacagaaaguggaucaucuucgacggccccguggacgccaucuggaucgagaacaugaacaccgugcuggacgacaacaagaagcugugccugaugagcggcgagaucauccagaugaacagcaagaugagccugaucuucgagcccgccgaccuggagcaggccagccccgccaccgugagcagaugcggcaugaucuacauggagccccaccagcugggcuggaagccccugaaggacagcuacauggacacccugcccagcagccugaccaaggagcacaaggagcuggugaacgacauguucauguggcuggugcagcccugccuggaguucggcagacugcacugcaaguucguggugcagaccagccccauccaccuggccuucagcaugaugagacuguacagcagccugcuggacgagaucagagccguggaggaggaggagauggagcugggcgagggccugagcagccagcagaucuuccuguggcugcagggccuguuccuguucagccugguguggaccguggccggcaccaucaacgccgacagcagaaagaaguucgacguguucuucagaaaccugaucaugggcauggacgacaaccaccccagacccaagagcgugaagcugaccaagaacaacaucuuccccgagagaggcagcaucuacgacuucuacuucaucaagcaggccagcggccacugggagaccuggacccaguacaucaccaaggaggaggagaaggugcccgccggcgccaaggugagcgagcugaucauccccaccauggagaccgccagacagagcuucuuccugaagaccuaccuggaccacgagauccccaugcuguucgugggccccaccggcaccggcaagagcgccaucaccaacaacuuccugcugcaccugcccaagaacaccuaccugcccaacugcaucaacuucagcgccagaaccagcgccaaccagacccaggacaucaucaugagcaagcuggacagaagaagaaagggccuguucggcccccccaucggcaagaaggccgugguguucguggacgaccugaacaugcccgccaaggagguguacggcgcccagccccccaucgagcugcugagacaguggaucgaccacggcuacugguucgacaagaaggacaccaccagacuggacaucguggacaugcugcuggugaccgccaugggcccccccggcggcggcagaaacgacaucaccggcagauucaccagacaccugaacaucaucagcaucaacgccuucgaggacgacauccugaccaagaucuucagcagcaucguggacuggcacuucggcaagggcuucgacgugauguuccugagauacggcaagaugcuggugcaggccaccaagaccaucuacagagacgccguggagaacuuccugcccacccccagcaagagccacuacguguucaaccugagagacuucagcagagugauccagggcgugcugcugugcccccacacccaccugcaggacguggagaagugcaucagacuguggauccacgagguguacagaguguucuacgacagacugaucgacaaggaggacagacagguguucuucaacauggugaaggagaccaccagcaacugcuucaagcagaccaucgagaaggugcugauccaccugagccccaccggcaagaucguggacgacaacaucagaagccuguucuucggcgacuacuucaagcccgagagcgaccagaagaucuacgacgagaucaccgaccugaagcagcugaccguggugauggagcacuaccuggaggaguucaacaacaucagcaaggcccccaugagccuggugauguucagauucgccaucgagcacaucagcagaaucugcagagugcugaagcaggacaagggccaccugcugcuggugggcaucggcggcagcggcagacagagcgccgccaagcugagcaccuucaugaacgccuacgagcuguaccagaucgagaucaccaagaacuacgccggcaacgacuggagagaggaccugaagaagaucauccugcaggugggcguggccaccaagagcaccguguuccuguucgccgacaaccagaucaaggacgagagcuucguggaggacaucaacaugcugcugaacaccggcgacgugcccaacaucuuccccgccgacgagaaggccgacaucguggagaagaugcagaccgccgccagaacccagggcgagaagguggaggugaccccccugagcauguacaacuucuucaucgagagagugaucaacaagaucagcuucagccuggccaugagccccaucggcgacgccuucagaaacagacugagaauguuccccagccugaucaacugcugcaccaucgacugguuccagagcuggcccaccgacgcccuggagcugguggccaacaaguuccuggaggacguggagcuggacgacaacaucagaguggagguggugagcaugugcaaguacuuccaggagagcgugaagaagcugagccuggacuacuacaacaagcugagaagacacaacuacgugacccccaccagcuaccuggagcugauccugaccuucaagacccugcugaacagcaagagacaggagguggccaugaugagaaacagauaccugaccggccugcagaagcuggacuucgccgccagccagguggccgugaugcagagagagcugaccgcccugcagccccagcugauccugaccagcgaggagaccgccaagaugauggugaagaucgaggccgagaccagagaggccgacggcaagaagcugcuggugcaggccgacgagaaggaggccaacguggccgccgccaucgcccagggcaucaagaacgagugcgagggcgaccuggccgaggccaugcccgcccuggaggccgcccuggccgcccuggacacccugaaccccgccgacaucagccuggugaagagcaugcagaacccccccggccccgugaagcuggugauggagagcaucugcaucaugaagggcaugaagcccgagagaaagcccgaccccagcggcagcggcaagaugaucgaggacuacuggggcgugagcaagaagauccugggcgaccugaaguuccuggagagccugaagaccuacgacaaggacaacauccccccccugaccaugaagagaaucagagagagauucaucaaccaccccgaguuccagcccgccgugaucaagaacgugagcagcgccugcgagggccugugcaagugggugagagccauggagguguacgacagaguggccaaggugguggcccccaagagagagagacugagagaggccgagggcaagcuggccgcccagaugcagaagcugaaccagaagagagccgagcugaagcuggugguggacagacugcaggcccugaacgacgacuucgaggagaugaacaccaagaagaaggaccuggaggagaacaucgagaucugcagccagaagcuggugagagccgagaagcugaucagcggccugggcggcgagaaggacagauggaccgaggccgccagacagcugggcaucagauacaccaaccugaccggcgacgugcugcugagcagcggcaccguggccuaccugggcgccuucaccguggacuacagagugcagugccagaaccaguggcuggccgagugcaaggacaaggugauccccggcuucagcgacuucagccugagccacacccugggcgaccccaucaagaucagagccuggcagaucgccggccugcccguggacagcuucagcaucgacaacggcaucaucgugagcaacagcagaagaugggcccugaugaucgacccccacggccaggccaacaaguggaucaagaacauggagaaggccaacaagcuggccgugaucaaguucagcgacagcaacuacaugagaaugcuggagaacgcccugcagcugggcacccccgugcugaucgagaacaucggcgaggagcuggacgccagcaucgagcccauccugcugaaggccaccuucaagcagcagggcguggaguacaugagacugggcgagaacaucaucgaguacagcagagacuucaagcuguacaucaccaccagacugagaaacccccacuaccugcccgagguggccgugaaggugugccugcugaacuucaugaucaccccccugggccugcaggaccagcugcugggcaucguggccgccaaggagaagcccgagcuggaggagaagaagaaccagcugaucguggagagcgccaagaacaagaagcaccugaaggagaucgaggacaagauccuggaggugcugagcaugagcaagggcaacauccuggaggacgagaccgccaucaaggugcugagcagcagcaaggugcugagcgaggagaucagcgagaagcagaagguggccagcaugaccgagacccagaucgacgagaccagaaugggcuacaagcccguggccgugcacagcgccaccaucuucuucugcaucagcgaccuggccaacaucgagcccauguaccaguacagccugaccugguucaucaaccuguacaugcacagccugacccacagcaccaagagcgaggagcugaaccugagaaucaaguacaucaucgaccacuucacccugagcaucuacaacaacgugugcagaagccuguucgagaaggacaagcugcuguucagccugcugcugaccaucggcaucaugaagcagaagaaggagaucaccgaggaggugugguacuuccugcugaccggcggcaucgcccuggacaaccccuaccccaaccccgccccccaguggcugagcgagaaggccugggccgagaucgugagagccagcgcccugcccaagcugcacggccugauggagcaccuggagcagaaccugggcgaguggaagcugaucuacgacagcgccuggccccacgaggagcagcugcccggcagcuggaaguucagccagggccuggagaagauggugauccugagaugccugagacccgacaagauggugcccgccgugagagaguucaucgccgagcacaugggcaagcuguacaucgaggcccccaccuucgaccugcagggcagcuacaacgacagcagcugcugcgccccccugaucuucgugcugagccccagcgccgaccccauggccggccugcugaaguucgccgacgaccugggcaugggcggcaccagaacccagaccaucagccugggccagggccagggccccaucgccgccaagaugaucaacaacgccaucaaggacggcaccuggguggugcugcagaacugccaccuggccgccagcuggaugcccacccuggagaagaucugcgaggaggugaucgugcccgagagcaccaacgccagauucagacuguggcugaccagcuaccccagcgagaaguuccccgugagcauccugcagaacggcaucaagaugaccaacgagccccccaagggccugagagccaaccugcugagaagcuaccugaacgaccccaucagcgaccccguguucuuccagagcugcgccaaggccgugauguggcagaagaugcuguucggccugugcuucuuccacgccguggugcaggagagaagaaacuucggcccccugggcuggaacauccccuacgaguucaacgagagcgaccugagaaucagcauguggcagauccagauguuccugaacgacuacaaggaggugcccuucgacgcccugaccuaccugaccggcgagugcaacuacggcggcagagugaccgacgacaaggacagaagacugcugcugagccugcugagcauguucuacugcaaggagaucgaggaggacuacuacagccuggcccccggcgacaccuacuacauccccccccacggcagcuaccagagcuacaucgacuaccugagaaaccugcccaucaccgcccaccccgagguguucggccugcacgagaacgccgacaucaccaaggacaaccaggagaccaaccagcuguucgagggcgugcugcugacccugcccagacagagcggcggcagcggcaagagcccccaggaggugguggaggagcuggcccaggacauccugagcaagcugcccagagacuucgaccuggaggaggugaugaagcuguaccccgugguguacgaggagagcaugaacaccgugcugagacaggagcugaucagauucaacagacugaccaagguggugagaagaagccugaucaaccugggcagagccaucaagggccaggugcugaugagcagcgagcuggaggagguguucaacagcaugcuggugggcaaggugcccgccaugugggccgccaagagcuaccccagccugaagccccugggcggcuacguggccgaccugcuggccagacugaccuucuuccaggaguggaucgacaagggcccccccgugguguucuggaucagcggcuucuacuucacccagagcuuccugaccggcgugagccagaacuacgccagaaaguacaccauccccaucgaccacaucggcuucgaguucgaggugaccccccaggagaccgugauggagaacaaccccgaggacggcgccuacaucaagggccuguuccuggagggcgccagaugggacagaaagaccaugcagaucggcgagagccugcccaagauccuguacgacccccugcccaucaucuggcugaagcccggcgagagcgccauguuccugcaccaggacaucuacgugugccccguguacaagaccagcgccagaagaggcacccugagcaccaccggccacagcaccaacuacgugcugagcaucgagcugcccaccgacaugccccagaagcacuggaucaacagaggcguggccagccugugccagcuggacaacuaa

SEQ ID NO: 16201 - RNA, 13875 nt, Artificial Sequence
  DNAH5__Homo_sapiens__NP_001360
auguucagaaucggcagaagacagcuguggaagcacagcgugaccagagugcugacccagagacugaagggcgagaaggaggccaagagagcccugcuggacgccagacacaacuaccuguucgccaucguggccagcugccuggaccugaacaagaccgagguggaggacgccauccuggagggcaaccagaucgagagaaucgaccagcuguucgccgugggcggccugagacaccugauguucuacuaccaggacguggaggaggccgagaccggccagcugggcagccugggcggcgugaaccuggugagcggcaagaucaagaagcccaagguguucgugaccgagggcaacgacguggcccugaccggcgugugcguguucuucaucagaaccgaccccagcaaggccaucacccccgacaacauccaccaggaggugagcuucaacaugcuggacgccgccgacggcggccugcugaacagcgugagaagacugcugagcgacaucuucauccccgcccugagagccaccagccacggcuggggcgagcuggagggccugcaggacgccgccaacaucagacaggaguuccugagcagccuggagggcuucgugaacgugcugagcggcgcccaggagagccugaaggagaaggugaaccugagaaagugcgacauccuggagcugaagacccugaaggagcccaccgacuaccugacccuggccaacaaccccgagacccugggcaagaucgaggacugcaugaagguguggaucaagcagaccgagcaggugcuggccgagaacaaccagcugcugaaggaggccgacgacgugggccccagagccgagcuggagcacuggaagaagagacugagcaaguucaacuaccugcuggagcagcugaagagccccgacgugaaggccgugcuggccgugcuggccgccgccaagagcaagcugcugaagaccuggagagagauggacaucagaaucaccgacgccaccaacgaggccaaggacaacgugaaguaccuguacacccuggagaagugcugcgacccccuguacagcagcgacccccugagcaugauggacgccauccccacccugaucaacgccaucaagaugaucuacagcaucagccacuacuacaacaccagcgagaagaucaccagccuguucgugaaggugaccaaccagaucaucagcgccugcaaggccuacaucaccaacaacggcaccgccagcaucuggaaccagccccaggacgugguggaggagaagauccugagcgccaucaagcugaagcaggaguaccagcugugcuuccacaagaccaagcagaagcugaagcagaaccccaacgccaagcaguucgacuucagcgagauguacaucuucggcaaguucgagaccuuccacagaagacuggccaagaucaucgacaucuucaccacccugaagaccuacagcgugcugcaggacagcaccaucgagggccuggaggacauggccaccaaguaccagggcaucguggccaccaucaagaagaaggaguacaacuuccuggaccagagaaagauggacuucgaccaggacuacgaggaguucugcaagcagaccaacgaccugcacaacgagcugagaaaguucauggacgugaccuucgccaagauccagaacaccaaccaggcccugagaaugcugaagaaguucgagagacugaacauccccaaccugggcaucgacgacaaguaccagcugauccuggagaacuacggcgccgacaucgacaugaucagcaagcuguacaccaagcagaaguacgaccccccccuggccagaaaccagccccccaucgccggcaagauccugugggccagacagcuguuccacagaauccagcagcccaugcagcuguuccagcagcaccccgccgugcugagcaccgccgaggccaagcccaucaucagaagcuacaacagaauggccaaggugcugcuggaguucgaggugcuguuccacagagccuggcugagacagaucgaggagauccacgugggccuggaggccagccugcuggugaaggcccccggcaccggcgagcuguucgugaacuucgacccccagauccugauccuguucagagagaccgagugcauggcccagaugggccuggaggugagcccccuggccaccagccuguuccagaagagagacagauacaagagaaacuucagcaacaugaagaugaugcuggccgaguaccagagagugaagagcaagauccccgccgccaucgagcagcugaucgugccccaccuggccaagguggacgaggcccugcagcccggccuggccgcccugaccuggaccagccugaacaucgaggccuaccuggagaacaccuucgccaagaucaaggaccuggagcugcugcuggacagagugaacgaccugaucgaguucagaaucgacgccauccuggaggagaugagcagcaccccccugugccagcugccccaggaggagccccugaccugcgaggaguuccugcagaugaccaaggaccugugcgugaacggcgcccagauccugcacuucaagagcagccugguggaggaggccgugaacgagcuggugaacaugcugcuggacguggaggugcugagcgaggaggagagcgagaagaucagcaacgagaacagcgugaacuacaagaacgagagcagcgccaagagagaggagggcaacuucgacacccugaccagcagcaucaacgccagagccaacgcccugcugcugaccaccgugaccagaaagaagaaggagaccgagaugcugggcgaggaggccagagagcugcugagccacuucaaccaccagaacauggacgcccugcugaaggugaccagaaacacccuggaggccaucagaaagagaauccacagcagccacaccaucaacuucagagacagcaacagcgccagcaacaugaagcagaacagccugcccaucuucagagccagcgugacccuggccauccccaacaucgugauggcccccgcccuggaggacgugcagcagacccugaacaaggccguggagugcaucaucagcgugcccaagggcgugagacaguggagcagcgagcugcugagcaagaagaagauccaggagagaaagauggccgcccugcagagcaacgaggacagcgacagcgacguggagaugggcgagaacgagcugcaggacacccuggagaucgccagcgugaaccugcccauccccgugcagaccaagaacuacuacaagaacgugagcgagaacaaggagaucgugaagcuggugagcgugcugagcaccaucaucaacagcaccaagaaggaggugaucaccagcauggacugcuucaagagauacaaccacaucuggcagaagggcaaggaggaggccaucaagaccuucaucacccagagcccccugcugagcgaguucgagagccagauccuguacuuccagaaccuggagcaggagaucaacgccgagcccgaguacgugugcgugggcagcaucgcccuguacaccgccgaccugaaguucgcccugaccgccgagaccaaggccuggaugguggugaucggcagacacugcaacaagaaguacagaagcgagauggagaacaucuucaugcugaucgaggaguucaacaagaagcugaacagacccaucaaggaccuggacgacaucagaaucgccauggccgcccugaaggagaucagagaggagcagaucagcaucgacuuccaggugggccccaucgaggagagcuacgcccugcugaacagauacggccugcugaucgccagagaggagaucgacaagguggacacccugcacuacgccugggagaagcugcuggccagagccggcgaggugcagaacaagcuggugagccugcagcccagcuucaagaaggagcugaucagcgccguggagguguuccugcaggacugccaccaguucuaccuggacuacgaccugaacggccccauggccagcggccugaagccccaggaggccagcgacagacugaucauguuccagaaccaguucgacaacaucuacagaaaguacaucaccuacaccggcggcgaggagcuguucggccugcccgccacccaguacccccagcugcuggagaucaagaagcagcugaaccugcugcagaagaucuacacccuguacaacagcgugaucgagaccgugaacagcuacuacgacauccuguggagcgaggugaacaucgagaagaucaacaacgagcugcuggaguuccagaacagaugcagaaagcugcccagagcccugaaggacuggcaggccuuccuggaccugaagaagaucaucgacgacuucagcgagugcugcccccugcuggaguacauggccagcaaggccaugauggagagacacugggagagaaucaccacccugaccggccacagccuggacgugggcaacgagagcuucaagcugagaaacaucauggaggccccccugcugaaguacaaggaggagaucgaggacaucugcaucagcgccgugaaggagagagacaucgagcagaagcugaagcaggugaucaacgagugggacaacaagaccuucaccuucggcagcuucaagaccagaggcgagcugcugcugagaggcgacagcaccagcgagaucaucgccaacauggaggacagccugaugcugcugggcagccugcugagcaacagauacaacaugcccuucaaggcccagauccagaagugggugcaguaccugagcaacagcaccgacaucaucgagagcuggaugaccgugcagaaccuguggaucuaccuggaggccguguucgugggcggcgacaucgccaagcagcugcccaaggaggccaagagauucagcaacaucgacaagagcugggugaagaucaugaccagagcccacgaggugcccagcguggugcagugcugcgugggcgacgagacccugggccagcugcugccccaccugcuggaccagcuggagaucugccagaagagccugaccggcuaccuggagaagaagagacugugcuuccccagauucuucuucgugagcgaccccgcccugcuggagauccugggccaggccagcgacagccacaccauccaggcccaccugcugaacguguucgacaacaucaagagcgugaaguuccacgagaagaucuacgacagaauccugagcaucagcagccaggagggcgagaccaucgagcuggacaagcccgugauggccgagggcaacguggagguguggcugaacagccugcuggaggagagccagagcagccugcaccuggugaucagacaggccgccgccaacauccaggagaccggcuuccagcugaccgaguuccugagcagcuuccccgcccaggugggccugcugggcauccagaugaucuggaccagagacagcgaggaggcccugagaaacgccaaguucgacaagaagaucaugcagaagaccaaccaggccuuccuggagcugcugaacacccugaucgacgugaccaccagagaccugagcagcaccgagagagugaaguacgagacccugaucaccauccacgugcaccagagagacaucuucgacgaccugugccacaugcacaucaagagccccauggacuucgaguggcugaagcagugcagauucuacuucaacgaggacagcgacaagaugaugauccacaucaccgacguggccuucaucuaccagaacgaguuccugggcugcaccgacagacuggugaucaccccccugaccgacagaugcuacaucacccuggcccaggcccugggcaugagcaugggcggcgcccccgccggccccgccggcaccggcaagaccgagaccaccaaggacaugggcagaugccugggcaaguacguggugguguucaacugcagcgaccagauggacuucagaggccugggcagaaucuucaagggccuggcccagagcggcagcuggggcugcuucgacgaguucaacagaaucgaccugcccgugcugagcguggccgcccagcagaucagcaucauccugaccugcaagaaggagcacaagaagagcuucaucuucaccgacggcgacaacgugaccaugaaccccgaguucggccuguuccugaccaugaaccccggcuacgccggcagacaggagcugcccgagaaccugaagaucaacuucagaagcguggccaugauggugcccgacagacagaucaucaucagagugaagcuggccagcugcggcuucaucgacaacguggugcuggccagaaaguucuucacccuguacaagcugugcgaggagcagcugagcaagcaggugcacuacgacuucggccugagaaacauccugagcgugcugagaacccugggcgccgccaagagagccaaccccauggacaccgagagcaccaucgugaugagagugcugagagacaugaaccugagcaagcugaucgacgaggacgagccccuguuccugagccugaucgaggaccuguuccccaacauccugcuggacaaggccggcuaccccgagcuggaggccgccaucagcagacagguggaggaggccggccugaucaaccacccccccuggaagcugaaggugauccagcuguucgagacccagagagugagacacggcaugaugacccugggccccagcggcgccggcaagaccaccugcauccacacccugaugagagccaugaccgacugcggcaagccccacagagagaugagaaugaaccccaaggccaucaccgccccccagauguucggcagacuggacguggccaccaacgacuggaccgacggcaucuucagcacccuguggagaaagacccugagagccaagaagggcgagcacaucuggaucauccuggacggccccguggacgccaucuggaucgagaaccugaacagcgugcuggacgacaacaagacccugacccuggccaacggcgacagaauccccauggcccccaacugcaagaucaucuucgagccccacaacaucgacaacgccagccccgccaccgugagcagaaacggcaugguguucaugagcagcagcauccuggacuggagccccauccuggagggcuuccugaagaagagaagcccccaggaggccgagauccugagacagcuguacaccgagagcuuccccgaccuguacagauucugcauccagaaccuggaguacaagauggaggugcuggaggccuucgugaucacccagagcaucaacaugcugcagggccugaucccccugaaggagcagggcggcgaggugagccaggcccaccugggcagacuguucguguucgcccugcuguggagcgccggcgccgcccuggagcuggacggcagaagaagacuggagcuguggcugagaagcagacccaccggcacccuggagcugcccccccccgccggccccggcgacaccgccuucgacuacuacguggcccccgacggcaccuggacccacuggaacaccagaacccaggaguaccuguaccccagcgacaccacccccgaguacggcagcauccuggugcccaacguggacaacgugagaaccgacuuccugauccagaccaucgccaagcagggcaaggccgugcugcugaucggcgagcagggcaccgccaagaccgugaucaucaagggcuucaugagcaaguacgaccccgagugccacaugaucaagagccugaacuucagcagcgccaccaccccccugauguuccagagaaccaucgagagcuacguggacaagagaaugggcaccaccuacggcccccccgccggcaagaagaugaccguguucaucgacgacgugaacaugcccaucaucaacgaguggggcgaccaggugaccaacgagaucgugagacagcugauggagcagaacggcuucuacaaccuggagaagcccggcgaguucaccagcaucguggacauccaguuccuggccgccaugauccaccccggcggcggcagaaacgacaucccccagagacugaagagacaguucagcaucuucaacugcacccugcccagcgaggccagcguggacaagaucuucggcgugaucggcgugggccacuacugcacccagagaggcuucagcgaggaggugagagacagcgugaccaagcuggugccccugaccagaagacuguggcagaugaccaagaucaagaugcugcccacccccgccaaguuccacuacguguucaaccugagagaccugagcagaguguggcagggcaugcugaacaccaccagcgaggugaucaaggagcccaacgaccugcugaagcuguggaagcacgagugcaagagagugaucgccgacagauucaccgugagcagcgacgugaccugguucgacaaggcccuggugagccugguggaggaggaguucggcgaggagaagaagcugcugguggacugcggcaucgacaccuacuucguggacuuccugagagacgcccccgaggccgccggcgagaccagcgaggaggccgacgccgagacccccaagaucuacgagcccaucgagagcuucagccaccugaaggagagacugaacauguuccugcagcuguacaacgagagcaucagaggcgccggcauggacaugguguucuucgccgacgccauggugcaccuggugaagaucagcagagugaucagaaccccccagggcaacgcccugcuggugggcgugggcggcagcggcaagcagagccugaccagacuggccagcuucaucgccggcuacgugagcuuccagaucacccugaccagaagcuacaacaccagcaaccugauggaggaccugaaggugcuguacagaaccgccggccagcagggcaagggcaucaccuucaucuucaccgacaacgagaucaaggacgagagcuuccuggaguacaugaacaacgugcugagcagcggcgaggugagcaaccuguucgccagagacgagaucgacgagaucaacagcgaccuggccagcgugaugaagaaggaguuccccagaugccugcccaccaacgagaaccugcacgacuacuucaugagcagagugagacagaaccugcacaucgugcugugcuucagccccgugggcgagaaguucagaaacagagcccugaaguuccccgcccugaucagcggcugcaccaucgacugguucagcagauggcccaaggacgcccugguggccgugagcgagcacuuccugaccagcuacgacaucgacugcagccuggagaucaagaaggagguggugcagugcaugggcagcuuccaggacggcguggccgagaagugcguggacuacuuccagagauucagaagaagcacccacgugacccccaagagcuaccugagcuucauccagggcuacaaguucaucuacggcgagaagcacguggaggugagaacccuggccaacagaaugaacaccggccuggagaagcugaaggaggccagcgagagcguggccgcccugagcaaggagcuggaggccaaggagaaggagcugcagguggccaacgacaaggccgacauggugcugaaggaggugaccaugaaggcccaggccgccgagaaggugaaggccgaggugcagaaggugaaggacagagcccaggccaucguggacagcaucagcaaggacaaggccaucgccgaggagaagcuggaggccgccaagcccgcccuggaggaggccgaggccgcccugcagaccaucagacccagcgacaucgccaccgugagaacccugggcagacccccccaccugaucaugagaaucauggacugcgugcugcugcuguuccagagaaaggugagcgccgugaagaucgaccuggagaagagcugcaccaugcccagcuggcaggagagccugaagcugaugaccgccggcaacuuccugcagaaccugcagcaguuccccaaggacaccaucaacgaggaggugaucgaguuccugagccccuacuucgagaugcccgacuacaacaucgagaccgccaagagagugugcggcaacguggccggccugugcagcuggaccaaggccauggccagcuucuucagcaucaacaaggaggugcugccccugaaggccaaccugguggugcaggagaacagacaccugcuggccaugcaggaccugcagaaggcccaggccgagcuggacgacaagcaggccgagcuggacguggugcaggccgaguacgagcaggccaugaccgagaagcagacccugcuggaggacgccgagagaugcagacacaagaugcagaccgccagcacccugaucagcggccuggccggcgagaaggagagauggaccgagcagagccaggaguucgccgcccagaccaagagacuggugggcgacgugcugcuggccaccgccuuccugagcuacagcggccccuucaaccaggaguucagagaccugcugcugaacgacuggagaaaggagaugaaggccagaaagauccccuucggcaagaaccugaaccugagcgagaugcugaucgacgcccccaccaucagcgaguggaaccugcagggccugcccaacgacgaccugagcauccagaacggcaucaucgugaccaaggccagcagauacccccugcugaucgacccccagacccagggcaagaucuggaucaagaacaaggagagcagaaacgagcugcagaucaccagccugaaccacaaguacuucagaaaccaccuggaggacagccugagccugggcagaccccugcugaucgaggacgugggcgaggagcuggaccccgcccuggacaacgugcuggagagaaacuucaucaagaccggcagcaccuucaaggugaaggugggcgacaaggagguggacgugcuggacggcuucagacuguacaucaccaccaagcugcccaaccccgccuacacccccgagaucagcgccagaaccagcaucaucgacuucaccgugaccaugaagggccuggaggaccagcugcugggcagagugauccugaccgagaagcaggagcuggagaaggagagaacccaccugauggaggacgugaccgccaacaagagaagaaugaaggagcuggaggacaaccugcuguacagacugaccagcacccagggcagccugguggaggacgagagccugaucguggugcugagcaacaccaagagaaccgccgaggaggugacccagaagcuggagaucagcgccgagaccgaggugcagaucaacagcgccagagaggaguacagacccguggccaccagaggcagcauccuguacuuccugaucaccgagaugagacuggugaacgagauguaccagaccagccugagacaguuccugggccuguucgaccugagccuggccagaagcgugaagagccccaucaccagcaagagaaucgccaacaucaucgagcacaugaccuacgagguguacaaguacgccgccagaggccuguacgaggagcacaaguuccuguucacccugcugcugacccugaagaucgacauccagagaaacagagugaagcacgaggaguuccugacccugaucaagggcggcgccagccuggaccugaaggccugcccccccaagcccagcaaguggauccuggacaucaccuggcugaaccugguggagcugagcaagcugagacaguucagcgacgugcuggaccagaucagcagaaacgagaagauguggaagaucugguucgacaaggagaaccccgaggaggagccccugcccaacgccuacgacaagagccuggacugcuucagaagacugcugcugaucagaagcuggugccccgacagaaccaucgcccaggccagaaaguacaucguggacagcaugggcgagaaguacgccgagggcgugauccuggaccuggagaagaccugggaggagagcgaccccagaaccccccugaucugccugcugagcaugggcagcgaccccaccgacagcaucaucgcccugggcaagagacugaagaucgagaccagauacgugagcaugggccagggccaggaggugcacgccagaaagcugcugcagcagaccauggccaacggcggcugggcccugcugcagaacugccaccugggccuggacuucauggacgagcugauggacaucaucaucgagaccgagcuggugcacgacgccuucagacuguggaugaccaccgaggcccacaagcaguuccccaucacccugcugcagaugagcaucaaguucgccaacgaccccccccagggccugagagccggccugaagagaaccuacagcggcgugagccaggaccugcuggacgugagcagcggcagccaguggaagcccaugcuguacgccguggccuuccugcacagcaccgugcaggagagaagaaaguucggcgcccugggcuggaacauccccuacgaguucaaccaggccgacuucaacgccaccgugcaguucauccagaaccaccuggacgacauggacgugaagaagggcgugagcuggaccaccaucagauacaugaucggcgagauccaguacggcggcagagugaccgacgacuacgacaagagacugcugaacaccuucgccaaggugugguucagcgagaacauguucggccccgacuucagcuucuaccagggcuacaacauccccaagugcagcaccguggacaacuaccugcaguacauccagagccugcccgccuacgacagccccgagguguucggccugcaccccaacgccgacaucaccuaccagagcaagcuggccaaggacgugcuggacaccauccugggcauccagcccaaggacaccagcggcggcggcgacgagaccagagaggccgugguggccagacuggccgacgacaugcuggagaagcugccccccgacuacgugcccuucgaggugaaggagagacugcagaagaugggccccuuccagcccaugaacaucuuccugagacaggagaucgacagaaugcagagagugcugagccuggugagaagcacccugaccgagcugaagcuggccaucgacggcaccaucaucaugagcgagaaccugagagacgcccuggacugcauguucgacgccagaauccccgccugguggaagaaggccagcuggaucagcagcacccugggcuucugguucaccgagcugaucgagagaaacagccaguucaccagcuggguguucaacggcagaccccacugcuucuggaugaccggcuucuucaacccccagggcuuccugaccgccaugagacaggagaucaccagagccaacaagggcugggcccuggacaacauggugcugugcaacgaggugaccaaguggaugaaggacgacaucagcgccccccccaccgagggcguguacguguacggccuguaccuggagggcgccggcugggacaagagaaacaugaagcugaucgagagcaagcccaaggugcuguucgagcugaugcccgugaucagaaucuacgccgagaacaacacccugagagaccccagauucuacagcugccccaucuacaagaagcccgugagaaccgaccugaacuacaucgccgccguggaccugagaaccgcccagacccccgagcacugggugcugagaggcguggcccugcugugcgacgugaaguaa

SEQ ID NO: 16202 - RNA, 12477 nt, Artificial Sequence
  DNAH6__Homo_sapiens__NP_001361
augaccuucagagccaccgacagcgaguucgaccugaccaacaucgaggaguacgccgagaacagcgcccugagcagacugaacaacaucaaggccaagcagagagugagcuacgugaccagcaccgagaacgagagcgacacccagauccugaccuucagacacaucaccaaggcccaggagaagaccagaaagagacagcagcccaucaagcuggagccccugcccgugcugaagguguaccaggaccacaagcagcccgaguacauccacgagcagaacagauuccagcugaugaccgccggcaucaucaagagacccgugagcaucgccaagaagagcuucgccaccagcagcacccaguuccuggagcaccaggacgccgugaagaagaugcagauccacagacccuacguggagguguucagccccagcccccccaagcugccccacaccggcaucggcaagagaggccuguucggcaccagaagcagcgccuaccccaaguacaccuuccacgacagagaggagguggugaaggccaacaucagagacccccugcagaucaucaagaucaucagagagaacgagcaccugggcuuccuguacaugauccccgccgugcccagaagcagcaucgaguacgacaccuacaaccugaagguggugagcuacgagaacaucaacaagaacgacuacuacaccaucagccagagagccgugacccacaucuacaacgaggacaucgaguucaucgagaucgacagaugggagcaggaguaccuguaccacagagagcugaccaagauccccaucuucagccuguucagaaaguggaaggccuucagcguguggagaaagaacgugagaagcaagaagaucaccggcugccagaagagccugcagaagaaccuguucaucgugaacccccaccugagacccgcccugcugaagaucaacgagcugugcuaccaccugagcuucaugggccugugcuacaucgagaagugccacaccuacacccugcaggaguucaaggccgcccaggugaucagacuggccgaggugaccgagagacugggcgaguucagaaacgaggccaaguacguggugagaagagccugcagauucgcccugagagccgccggcuucgugcccgacgacugcgccuucggccccuucgaggacuaccacaaggugcagagcagcggcagcuucaucaacaccccccacgagcugcccaccuacggcgacagcgagaagaugaccuacaccgagcaggccagcaagagacacuacugcaugagacugaccugcuucaucagacugaacgacuaccugaucgagaacaccaugcacauccugaccgugaacgccgugaacagccugcugaaccaccugaccgacaagcugaagagaacccccagcgccgacgugauccagaaguggaucaccgaggagaagcccgaggugcccgacaagaagggcacccugaugguggagaagcaggaggaggacgagagccugauccccauguuccugaccgagcugaugcugaccgugcagagccugcuguucgagcccagccuggaggacuuccuggacggcauccugggcgccgugaaccacugccagaacaccgugcugagcgugcccaaccuggugcccgacagcuacuucgacgccuucaccagccccuacaucaacaacaagcuggagggcaagaccugcggcaccggccccagccuggccgccguguucgaggacgacaagaacuuccacaccaucaucagccagaucaaggagaccauccaggccgccuucgagagcgccagaaucuacgccgccaccuucgagaaguuccagaucuucuucaaggagaacgagagccuggaccugcaggcccugaagcugcaggagcccgacaucaacuucuucagcgagcagcuggagaaguaccacaagcagcacaaggacgccguggcccugagacccaccagaaacgugggccugcugcugaucgacaccagacugcugagagagaagcugauccccagcccccugagaugccuggaggugcugaacuucaugcugcccagacagagcaagaagaagguggacgccaucaucuucgaggcccaggacgccgaguacaagcuggaguucgugcccaccaccaccaccgaguacgugcacagccugcuguuccuggacgagauccaggagagaaucgagagccuggaggacgagggcaacaucgugacccagauguacaagcugauggagcaguaccaggugcccaccccccccgaggacuucgccguguucgccaccaugaagcccagcaucguggccgugagaaacgccaucgacaagagcgugggcgacagagagagcagcaucaagcaguucugcgugcaccugggcagcgaccuggaggagcugaacaacgaggugaacgaggugaagcugcaggcccaggacccccagauccuggacaucagcgccgaccaggacaagaucagacugauccugaacaaccugcagagcgugcuggccgaccugcagaagagagccuuccaguacaagagcuaccagaagaacuucaagguggaggugagcaaguucgaggcccuggaggaggugagcgccgagcugaagcugaagcagcugcugugggacagcuucagcgagugggacaagcugcagcaggaguggcugaagagcaaguucgacugccuggaccccgaggugcugaacggccaggugagcaaguacgccaaguucgugacccagcuggagaagggccugccccccaacagcguggugccccagcugaaguacaagguggagaagaugaaggagaagcugcccgugaucaucgaccugagaaaccccacccugaaggccagacacugggccgccaucgagcagaccguggacgccacccugguggacgccgagaucccccugacccuggagagacugagccagcugcacguguucgacuucggccaggagauccaggacaucagcggccaggccagcggcgaggccgcccuggaggccauccugaagaagguggaggacagcuggaagaccaccgaguucgugauccugccccacagagacagcaaggacguguucauccugggcggcaccgacgacauccaggugcugcuggacgacagcaccaucaacguggccacccuggccagcagcagauaccugggcccccugaagaccagaguggacgaguggcagaagcagcuggcccuguucaaccagacccuggaggaguggcugaccugccagagaaacuggcuguaccuggagagcaucuucaacgcccccgacauccagagacagcugcccgccgaggccaagauguuccugcagguggacaagagcuggaaggagaucaugagaaaggugaacagacugcccaacgcccugagagccgccacccagcccggccugcuggagaccuuccagaacaacaacgcccugcuggaccagauccagaagugccuggaggccuaccuggagagcaagagagugaucuuccccagauucuacuuccugagcaacgacgagcugcuggagauccuggcccagaccagaaacccccaggccgugcagccccaccugagaaagugcuucgacagcaucagcaagcuggaguucgcccugaugccccccgccgagggcaagauccccggcaucgacggcgagcccgagaagguguacaccaacgacauccuggccaugcugagccccgagggcgagagagugagccugggcaagggccugaaggccagaggcaacguggaggaguggcugggcaagguggaggaggccauguucaccagccugagaagacugugcaaggccgccaucgccgacuaccagggcaagcugagaaccgacugggugguggccggccaccccagccaggugauccugaccgugagccagaucauguggugcagagaccugaccgagugccuggagaccgagcacagcaaccacauccaggcccugaagaacuucgagaaggugaacuucgagagacugaacgcccuggccgccaucgugcagggcagccugcccaagcugcacagaaacauccugaccgcccugaucaccaucgacgugcacgccagagacaucgugaccgagcuggugcagagcaagguggagaccguggagagcuucgacuggcagagacagcugagauacuacugggacaucgaccuggacaacugcguggccagaauggcccugagccaguacaccuacggcuacgaguaccugggcgccugccccagacuggugaucaccccccugaccgacagaugcuaccugugccugaugggcgcccugcagcuggaccugggcggcgcccccgccggccccgccggcaccggcaagaccgagaccaccaaggaccuggccaaggcccuggccauccagugcgugguguucaacugcagcgacggccuggacuacaagaugaugggcagauucuucagcggccuggcccagagcggcgccuggugcugcuucgacgaguucaacagaaucgacaucgaggugcugagcgugaucgcccagcagcugaucaccaucagaaacgccaaggccgccaagcugagcagauucauguucgagggcagagagaucaagcuggugaugaccugcgccgccuucaucaccaugaaccccggcuacgccggcagaaccgagcugcccgacaaccugaaggcccuguucagacccuucgccaugauggugcccaacuacgcccugaucgccgaggugauccuguacagcgagggcuucgagagcagcaagauccuggccagaaagaugacccagauguacaagcugugcagcgagcagcugagccagcaggaccacuacgacuucggcaugagagccgugaagagcgugcuggugauggccggcagccugaagagagagaaccccgaccugaacgaggacguggugcugaucagagcccugcaggacagcaaccugcccaaguuccugaccgacgacgcccugcuguucagcggcaucaucagcgaccuguuccccggcgugcagauccccgagcacgacuacggcauccugcagagcaccaucguggacgugaugaacagacagaaccugcagcccgagaugugcauggugagaaaggugauccaguucuacgagaccaugcuggugagacacggcgugaugcuggugggccccaccggcggcggcaagaccaccguguacagaauccuggccgagacccugggcaaccugcagaagcugggcaucgagaacagcuucuaccaggccgugaagaccuacgugcugaaccccaagagcaucaccaugggcgagcuguacggcgaggugaacaaccugacccuggaguggaaggacggccugauggcccugagcgugagagccgccgugaacgacaccagcgaggaccacaaguggaucaucagcgacggccccguggacgcccuguggaucgagaacaugaacaccgugcuggacgacaacaagaugcugugccuggccaacagcgagagaaucaagcugaccccccagauccacaugcuguucgaggugcaggaccugagaguggccagccccgccaccgugagcagaugcggcaugguguucguggaccccgaggagcugaaguggaugcccuacgugaagaccuggaugaagggcaucagcaagaagcugaccgaggagacccaggaguacauccugaaccuguuccagagauacguggacgagggccugcacuucaucaacaagaagugcagccaggccaucccccagguggacaucagcaaggugaccacccugugcugccugcuggagagccugauccugggcaaggacggcgugaaccuggccauggagcagaccaagcugaacaccauccugugccagaccuucguguucugcuaccuguggagccugggcggcaaccugaccgagaacuacuacgacagcuucgacaccuucaucagaacccaguucgacgacaaccccgacgccagacugcccaacagcggcgaccuguggagcauccacauggacuucgacaccaagagacuggaccccugggagagaaucauccccaccuucaaguacaacagagacgugcccuucuucgagaugcuggugcccaccaccgacaccgugagauacggcuaccugauggagaagcugcuggccgugaagcacagcgugcuguucaccggcaucaccggcgugggcaagagcgugaucgccaagggccugcugaacaagauccaggagagcgccggcuacgugcccguguaccugaacuucagcgcccagaccagcagcgccagaacccaggagaucaucgagagcaagcuggagagaaagagaaagaacauccugggcgcccccggcaacaagagaaucgugaucuucguggacgaccugaacaugcccagacuggacagauacggcagccagccccccaucgagcugcugagacaguaccaggacuucggcggcuucuacgacagaaacaagcuguucuggaaggagauccaggacgugaccaucaucagcgccugcgccccccccggcggcggcagaaaccccgugacccccagauucaucagacacuucagcaugcugugccugcccaugcccagcgagcacagccugaagcagaucuuccaggccauccugaacggcuuccugagcgacuucccccccgccgugaagcagaccgccagcagcaucguggaggccagcguggagaucuacaacaagaugagcguggaccugcugcccacccccgccaagagccacuacguguucaaccugagagaccugagcaagugcgugcagggcauccugcagugcgaccccggcaccaucagagaggagauccagaucuucagacuguucugccacgagugccagagaguguuccacgacagacugaucaacaacgaggacaagcacuacuuccacgugauccugaccgagauggccaacaagcacuucggcaucgccaucgaccuggaguacuuccugaacaagcccaucaucuucggcgacuucaucaaguucggcgccgacaaggccgacagaaucuacgacgacaugcccgacaucgagaagaccgccaacgugcugcaggacuaccuggacgacuacaaccugaccaaccccaaggaggugaagcugguguucuuccaggacgccaucgagcacgugagcagaaucgccagaaugaucagacaggagagaggcaacgcccugcuggugggcgugggcggcaccggcaagcagagccugaccagacuggccgcccacaucugcggcuacaagugccugcagaucgagcugagcagaggcuacaacuacgacagcuuccacgaggaccugagaaagcuguacaagauggccggcguggaggacaagaacaugguguuccuguucaccgacacccagaucgugguggaggaguuccuggaggacaucaacaacauccugaacagcggcgaggugcccaaccuguucgagaaggacgagcuggagcaggugcuggccgccaccagacccagagccaaggaggugggcaucagcgagggcaacagagacgagguguuccaguacuucaucagcaaggugagacagaagcugcacaucgugcugugcaugagccccgugggcgaggccuucagaagcagaugcagaauguuccccagccuggugaacugcugcaccaucgacugguucgugcaguggcccagagaggcccugcugagcgugagcaagaccuucuucagccagguggacgccggcaacgaggagcugaaggagaagcugccccugaugugcgugaacgugcaccugagcgugagcagcauggccgagagauacuacaacgagcugagaagaagauacuacaccacccccaccagcuaccuggagcugaucaaccuguaccugagcaugcugagcgagaagagaaagcagaucaucagcgccagagacagagugaagaacggccugaccaagcugcuggagaccaacauccugguggacaagaugaagcuggaccugagcgcccuggagcccgugcugcuggccaagagcgaggacguggaggcccugauggagaagcuggccguggaccaggagagcgccgaccaggugagaaacaccgugcaggaggacgaggccaccgccaaggugaaggccgaggagacccaggccaucgccgacgacgcccagagagaccuggacgaggcccugcccgcccuggacgccgccaacaaggcccuggacagccuggacaaggccgacaucagcgagaucagaguguucaccaagccccccgaccuggugaugaccgugauggaggccaucagcauccugcugaacgccaagcccgacuggcccagcgccaagcagcugcugggcgacagcaacuuccugaagagacugcuggaguacgacaaggagaacaucaagccccagauccuggccaagcugcagaaguacaucaacaaccccgacuucgugcccgagaagguggagaaggugagcaaggccugcaagagcaugugcaugugggugagagccauggaccuguacagcagaguggugaaggugguggagcccaagagacagaagcugagagccgcccaggccgagcuggacaucaccauggccacccugagagagaagcaggcccugcugagacagguggaggaccagauccaggcccugcaggacgaguacgacaagggcgugaacgagaaggagagccuggccaagaccauggcccugaccaaggccagacuggugagagccggcaagcugaccgccgcccuggaggacgagcaggugagaugggaggagagcauccagaaguucgaggaggagaucagcaacaucaccggcaacguguucaucgccgccgccugcguggccuacuacggcgccuucaccgcccaguacagacagagccugaucgagugcuggauccaggacugccagagccuggagauccccaucgaccccagcuucagccugaucaacauccugggcgaccccuacgagaucagacaguggaacaccgacggccugcccagagaccugaucagcaccgagaacggcauccuggugacccagggcagaagauggccccugaugaucgacccccaggaccaggccaacagauggaucagaaacaaggagagcaagagcggccugaagaucaucaagcugaccgacagcaacuuccugagaauccuggagaacagcaucagacugggccugcccgugcugcuggaggagcugaaggagacccuggaccccgcccuggagcccauccugcugaagcagaucuucaucagcggcggcagacugcugaucagacugggcgacagcgacaucgacuacgacaagaacuucagauucuacaugaccaccaagaugcccaacccccacuaccugcccgaggugugcaucaaggugaccaucaucaacuucaccgugaccaagagcggccuggaggaccagcugcugagcgacguggugagacuggagaagcccagacuggaggagcagagaaucaagcugaucgugagaaucaacaccgacaagaaccagcugaagaccaucgaggagaagauccugagaaugcuguucaccagcgagggcaacauccuggacaacgaggagcugaucgacacccugcaggacagcaagaucaccagcggcgccaucaagaccagacuggaggaggccgagagcaccgagcagaugaucaacguggccagagagaaguacagacccguggccacccagggcagcgugauguacuucgugaucgccagccugagcgagaucgaccccauguaccaguacagccugaaguacuucaagcagcuguucaacaccaccaucgagaccagcgugaagaccgagaaccugcagcagagacuggacgugcugcuggagcagacccugcugaccgccuacgugaacgugagcagaggccuguucgagcagcacaagcugaucuacagcuucaugcugugcguggagaugaugagacagcagggcacccugagcgacgccgaguggaacuucuuccugagaggcagcgccggccuggagaaggagagaccccccaagcccgaggcccccuggcugcccaccgccaccugguucgccugcugcgaccuggaggagagcuuccccguguuccacggccugacccagaacauccugagccaccccaucagcaucagacugggcagcuucgagaccuacaucaacccccagaagugggagggcuacagcaagaugaagcacgaggacaagcacaugagacaggagaaggaggccgcccaccaggaccccuggagcgccggccugagcagcuuccacaagcugauccugaucaagugcugcaaggaggagaaggugguguucgcccugaccgacuucgugaucgagaaccugggcaagcaguucaucgagaccccccccguggaccugcccacccuguaccaggacaugagcugcaacaccccccugguguucauccugagcaccggcagcgaccccaugggcgccuuccagagauucgccagagagagcggcuacagcgagagagugcagagcaucagccugggccagggccagggccccaucgccgagaagauggugaaggacgccaugaagagcggcaacuggguguuccugcagaacugccaccuggccgugagcuggaugcuggccauggaggagcugaucaagaccuucaccgaccccgacagcgccaucaaggacaccuucagacuguuccugagcagcaugcccagcaacaccuuccccgugaccgugcugcagaacagcgugaaggugaccaacgagccccccaagggccugagagccaacaucagaagagccuucaccgagaugacccccagcuucuucgaggagaacauccugggcaagaaguggagacagaucaucuucggcaucugcuucuuccacgccaucauccaggagagaaagaaguucggcccccugggcuggaacaucugcuacgaguucaacgacagcgacagagagugcgcccugcugaaccugaagcuguacugcaaggagggcaagauccccugggacgcccugaucuacaucaccggcgagaucaccuacggcggcagagugaccgacagcugggaccagagaugccugagaaccauccugaagagauucuucagccccgagacccuggaggaggacuacaaguacagcgagagcggcaucuacuucgcccccauggccgacagccugcaggaguucaaggacuacaucgagaaccugccccugaucgacgaccccgagaucuucggcaugcacgagaacgccaaccugguguuccaguacaaggagaccagcacccugaucaacaccauccuggaggugcagcccagaagcagcaccggcggcgagggcaagagcaacgacgagaucgugcaggagcugguggccagcgugcagaccagagugcccgagaagcuggagauggagggcgccagcgagagccuguucgugaaggaccugcagggcagacugaacagccugaccaccgugcugggccaggagguggacagauucaacaaccugcugaagcugauccacaccagccuggagacccugaacaaggccaucgccggcuucguggugaugagcgaggagauggagaagguguacaacagcuuccugaacaaccaggugcccgcccuguggagcaacaccgccuaccccagccugaagccccugggcagcugggugaaggaccugauccugagaaccagcuucguggaccuguggcugaagagaggccagcccaagagcuacuggaucagcggcuucuucuucccccagggcuuccugaccggcacccugcagaaccacgccagaaaguacaaccugcccaucgacgagcugagcuucaaguacagcgugauccccaccuacagagaccaggccgccgugaucgaggccgccaagaccgugcaguucggccaggagcugcccauggacauggagcugcccagccccgaggacggcgugcuggugcacggcauguucauggacgccagcagaugggacgacaaggagauggugaucgaggacgcccugcccggccagaugaaccccgugcugcccguggugcacuucgagccccagcagaacuacaagcccagccccacccuguaccacugcccccuguacaagaccggcgccagagccggcacccugagcaccaccggccacagcaccaacuucguggugaccgugcugcugcccagcaagagaagcaaggacuacuggaucgccaagggcagcgcccugcugugccagcugagcgaguaa

SEQ ID NO: 16203 - RNA, 12075 nt, Artificial Sequence
  DNAH7__Homo_sapiens__NP_061720
augagcagcgagcaggacaagagcgccagcaaggagaagagcaagaagcccgugagauuccugccccagcugagcauggagaagcuggccagcaaggagaaguucaaggcccccgccagagcccugccccagcugagcauggugagcaccaagccccacuggcagcaggccgcccccagcuuccaccugagcgugaagcaggacgacgagagccccgagcccuucagcgugaagaacgagcagagccacgccgaguacauggagagauucggcaagaagggcaagcugccccaccagguggacgacagcuacgugggccccagcaccagcaagagcaagggcaagagcccccacaaggagagagagaacuucagaagcacccuggugaacgugaucaugcagcaggacgccgaccuggacagcgccgugcccgacggcagcaccauccccaagcccaccgccagcgccaucgagaaggacauccugagauacuacuacuacauccaccacggcaucgacaccgaccacguggcccccauggaggacagcuggcuggagcacgugcuggaccuggugccccagcaccugaagguguucaccgacagcaucgugacccugagcgacgagaugagagaggacuaccugcugagcgugagaaagagcaucguggacuucgugcugaaggaccccagagagaagggcgacgacaagaagaccgacgagcugcccgcccacagagccgagauggagauccugcccaagcccuggagaaagagcuuccuggccgccagcagcuacaucagagaccaccugaacgccaugaaccccaccaugcuggccgugcuggaccuguggcacaccaacuucaagaagcugagacugguggacaucaaggaguuccacaacugccaggacgcccuggagcugagcagcuuccagaacaucaucaugagacacauggacagcgccaaggagacccugcugaagaugugguuccccgaggugcagaacaucuacuaccagggcaacaagaagaagcagcugcccaccggcgacagcagcgccaagcuggagagcuucuucaacugcgccgccgcccugaugacccugcagcugcaggaccugacccuggugagcaugcaggacuucaccgaccugaucgcccagccccccgacagcgugagagccuucgagcaccccggcuucaucaugagacugauccuggacaacgacaccaucaaguucgagcccgagcugagcgacuacaucgacaucuuccugaacguguacgacgugaugaucaaggccgugagcuucgugcccagaguggagaccaagcuguacagcaagugggagagcaagagcaagcccaccacccugaagcccaucauccugaacgagaucguggacgcccacaaggagaagaucaaggaggugaucaugaaggagagcguggcccccaccgagcaccugagacuguacgacaaguacgacuuccugaucaccagaaaggccgagagagacguggacaacuuccuggccgagaaccacagcuacgagaagaucaucgacgagaucugcaaguaccagaagcugaucgaggagauccaguacaccagcaucaagaccaucagacugggcauguucgagaugcacugcgaggagcugaucagagcccuggugaagagagccgacaucaucugcggcaagcugcuggccaagauguucagagaccaccaggaggugaacaccagacugugcgacgaguucgagagaaucgccgagaaggcccugagcaccccccccaacaccgccgagcugauggagaugaaggccuacauccagaagguggaggugaccgacaugaucgagcuggagcagagacugguggacagcaagaacugccuggccuuccugaucgaguacgugaacuucagccccgccgacaugagacugaacaacagcguguuccagugguacggcagaaugggcgagaucuucgaggagcacagaaagaucaucaaggagaagaucgagcaguaccaggagggccugaagcugagaugcgagagauucguggaggagcuggagagcuacgccaagcagagcgaggaguucuacagcuucggcgaccugcaggacgugcagagauaccugaagaaggcccagauccugaacggcaagcuggaccuggccgccgacaagaucgagcaguucaacgccgaggaggaggccuucggcuggcugcccagcguguacccccagagaaagaagauccaggacggccugaaccccuaccugagacuguacgagaccgccguggaguucagcagcaacuacagagccuggaccgagggccccuaccacaaggugaaccccgaccagguggaggccgacaucggcaacuacuggagaggccuguacaagcuggagaagaccuuccacgacagccccuacgcccuggccaugaccaagaaggugagaagcaagguggaggacuucaagcagcacaucccccugauccaggugaucugcaaccccggccugagacccagacacugggaggccaugagcgccaucgugggcuacccccugcagcccagcgacgacagcaccgugagcagcuuccuggacaugaaccuggagcccuacaucgacagauucgagggcaucagcgaggccgccagcaaggaguacagccuggagaaggccauggagaagaugaucaccgagugggacgccguggaguucgugauccacagcuacagagagaccggcaccuucauccuggccagcguggacgagauccagaugcugcuggacgaccacaucaucaagacccagaccaugagaggcagccccuucaucaagcccuacgagaagcagaugagagagugggagggcaagcugcugcugcugcaggagauccuggacgaguggcugaaggugcaggccaccuggcuguaccuggagcccaucuucagcagccccgacaucaugagccagaugcccgaggagggcagaagauucaccgccguggacaagaccuggagagacaucaugagaagcgugaugcaggacaagcacgugcugaccguggugaccaucgacagaaugcuggagagacugaagaagagcaacgagcugcuggagcugauccugaagggccugaacgaguaccuggagaagaagagacuguucuuccccagauucuucuuccugagcaacgacgagcugcuggagauccugagcgagaccaaggaccccaccagagugcagccccaccugaagaagugcuucgagggcaucgccaagguggaguucaccgagacccuggacaucacccacaugaagagcagcgagggcgaggugguggagcugaucgagaucaucagcaccgccaaggccagaggccagguggagaaguggcugguggagcuggagagagugaugaucaacagcauccacaaggugaccggcgacgccaccuucgccuacaccaaguacgagagaaucaacugggugagagacuggcccggccagaccgugcugugcgugagccagaucuucuggaccaaggaggugcagaccgccauccccaugggcaucaaggcccuggagcaguaccugaagaccugcaacagacagaucgacgacaucgugacccuggugagaggcaagcugagcaugcagaacagagugacccugggcgcccugguggugcuggacgugcacgccagagacgugcugagcagccuggugaagaagaacaucagcgacgacagcgacuucgaguggcugagccagcugagauacuacuggcaggagaaccaccuggagaccaagaugaucaacgccggccugagauacggcuacgaguaccugggcaacagccccagacuggugaucaccccccugaccgacagaugcuacagaacccuguucggcgcccugcaccugcaccugggcggcgcccccgagggccccgccggcaccggcaagaccgagaccaccaaggaccuggccaaggccguggccaagcagugcgugguguucaacugcagcgacggccuggacuaccuggcccugggcaaguucuucaagggccugcugagcugcggcgccugggccugcuucgacgaguucaacagaaucgaccuggaggugcugagcgugguggcccagcagauccugaccauccagagaggcaucaacgccggcgccgacauccugauguucgagggcaccgagcugaagcuggaccccaccugcgccguguucaucaccaugaaccccggcuacgccggcagaagcgagcugcccgacaaccugaaggcccuguucagaaccguggccaugauggugcccgacuacgccaugaucgccgagaucgugcuguacagcugcggcuucgugaccgccagaccccugagcgugaagaucguggccaccuacagacugugcagcgagcagcugagcagccagcaccacuacgacuacggcaugagagccgugaagagcgugcugaccgccgccggcaaccugaagcugaaguaccccaacgagaacgaggagauccugcugcugagaagcaucaucgacgugaaccugcccaaguuccugagccacgaccugccccuguucgagggcaucaccagcgaccuguuccccggcgugaagcugcccaagcccgacuacaacgaccugcuggccgccaucaaggacaacugcgccagcaugaaccugcagaugaccgccuucuucagcgagaagauccugcagguguacgagaugaugaucgugagacacggcuucaugaucgugggcgagcccuucggcggcaagaccagcgccuacagagugcuggccggcgcccugaacgacaucugcgagaagggccugauggaggagaacaaggugcagaucaccgugcugaaccccaagagcgugaccaugggccagcuguacggccaguucgacagcgugagccacgaguggagcgacggcgugcuggccgugagcuucagagccuucgccagcagcgugacccccgacagaaaguggcugaucuucgacggccccguggacgccguguggaucgagaacaugaacaccgugcuggacgacaacaagaagcugugccugaugagcggcgagaucauccagaugagcccccagaugaaccugaucuucgagcccauggaccuggagguggccagccccgccaccgugagcagaugcggcaugaucuacauggagccccacaugcugggcuggagaccccugaugcugagcugggugaaccugcugcccgccagcgugagcgugauccagaaggaguucaucaugggccuguucgacagaauggugcccgugagcguggaguucaucagaaagcacaccaaggagcugagccccaccagcgacaccaaccuggugagaagccugaugaaccugaucgacugcuucauggacgacuucgccgacgaggugaagcugaaggagagaaacgacagagagaccuacagccugcuggagggcaucuuccuguucagccugaucuggagcgugggcgccagcugcaccgacgacgacagacugaaguucaacaagauccugagagagcugauggagagccccaucagcgacagaaccagaaacaccuucaagcugcagagcggcaccgagcagaccagcagcaaggcccugaccgugcccuuccccgagaagggcaccaucuacgacuaccaguucgugaccgagggcaucggcaagugggagcccuggaucaagaagcugaaggaggccccccccauccccaaggacgugauguucaacgagaucaucgugcccacccuggacaccaucagauacagcgcccugauggagcugcugaccacccaccagaagcccagcaucuucgugggccccaccggcaccggcaagagcguguacaucaccaacuuccugcugaaccagcugaacaaggagaucuacaagccccugcugaucaacuucagcgcccagaccaccgccgcccagacccagaacaucgugaugagcaagcuggacaagagaagaaagggcguguucggccccccccugggcaagagaauggugguguucguggacgacgugaacaugcccgccagagagguguacggcgcccagccccccaucgagcugcugagacaguggcuggaccacuggaacugguacgaccugaaggacugcagcaugaucaagcugguggacauccagaucaugugcgccaugggcccccccggcggcggcagaaaccccgugacccccagauacaugagacacuucaacaucaucaccaucaacgaguucagcgacaagagcauguacaccaucuucagcagaauccugaccuggcaccuggagaucugcuacaaguuccccgacgaguuccuggaccugaccacccagaucgugaacggcaccaugacccuguacaaggaggccaugaagaaccugcugcccacccccgccaagagccacuaccuguucaaccugagagacuucagcagagugauccagggcgugugccugagcagacccgagaccaccgagaccaccgaggugaucaagagacugugggugcacgaggugcugagaguguacuacgacagacugcuggacaacaccgacagaagcuggcugaucaacuacauccaggagauccugagaaacuacauguacgaggacuuccacgagcuguuccagagacuggacuucgacaacgacggcaugguggaggccgacgaccugagaagccugauguucugcgacuuccacgaccccaagagagaggacaccaacuacagagagaucgccgacguggacaaccugagaaugaucguggagauccaccuggaggaguacaacaacaucagcaagaagcccaugaaccuggugcuguucagauucgccaucgagcacaucagcagaaucagcagaauccugaagcagcccagaagccacgcccugcuggugggcgugggcggcagcggcagacagagcgugaccagacuggccgcccacauggccgacuacagcguguuccagguggagaucagcaagggcuacgacaccaccgaguggcacgaggaccugaaggugauccugagaaagugcgccgagggcgagaugcagggcguguuccuguucaccgacacccagaucaaggaggagagcuuccuggaggacgugagcaaccugcugaacgccggcgagauccccaaccuguucgcccuggacgagaagcaggagaucugcgacaagaugagacagcuggacagacagagagacaagaccaagcagaccgacggcagccccaucgcccuguucaacauguucaucgaccacugcagaagccagcugcacguggugcuggccaugagccccaucggcgacgccuucagaaacagacugagaaaguuccccgcccuggugaacugcugcaccaucgacugguuccagagcuggcccgaggacgcccugcaggccguggccagcagauuccuggaggagaucgagaugagcgaggagaucagagacggcugcaucgacaugugcaagagcuuccacaccagcaccaucgaccugagcaagagcuucuucguggagcugcagagauacaacuacgugacccccaccagcuaccuggagcugaucagcaccuucaagcugcugcuggagaagaagagaagcgaggugaugaagaugaagaagagauacgaggugggccuggagaagcuggacagcgccagcagccagguggccaccaugcagauggagcuggaggcccugcacccccagcugaagguggccagcaaggagguggacgagaugaugaucaugaucgagaaggagagcguggagguggccaagaccgagaagaucgugaaggccgacgagaccaucgccaacgagcaggccauggccagcaaggccaucaaggacgagugcgacgccgaccuggccggcgcccugcccauccuggagagcgcccuggccgcccuggacacccugaccgcccaggacaucaccguggugaagagcaugaagagcccccccgccggcgugaagcuggugauggaggccaucugcauccugaagggcaucaaggccgacaagauccccgaccccaccggcagcggcaagaagaucgaggacuucuggggccccgccaagagacugcugggcgacaugagauuccugcagagccugcacgaguacgacaaggacaacaucccccccgccuacaugaacaucaucagaaagaacuacauccccaaccccgacuucgugcccgagaagaucagaaacgccagcaccgccgccgagggccugugcaagugggugaucgccauggacagcuacgacaagguggccaagaucguggcccccaagaagaucaagcuggccgccgccgagggcgagcugaagaucgccauggacggccugagaaagaagcaggccgcccugaaggaggugcaggacaagcuggccagacugcaggacacccuggagcugaacaagcagaagaaggccgaccuggagaaccagguggaccugugcagcaagaagcuggagagagccgagcagcugaucggcggccugggcggcgagaagaccagauggagccacaccgcccuggagcugggccagcuguacaucaaccugaccggcgacauccugaucagcagcggcgugguggccuaccugggcgccuucaccagcaccuacagacagaaccagaccaaggaguggaccacccugugcaagggcagagacauccccugcagcgacgacugcagccugaugggcacccugggcgaggccgugaccaucagaaccuggaacaucgccggccugcccagcgacagcuucagcaucgacaacggcaucaucaucaugaacgccagaagauggccccugaugaucgacccccagagccaggccaacaaguggaucaagaacauggagaaggccaacagccuguacgugaucaagcugagcgagcccgacuacgugagaacccuggagaacugcauccaguucggcacccccgugcugcuggagaacgugggcgaggagcuggaccccauccuggagccccugcugcugaagcagaccuucaagcagggcggcagcaccugcaucagacugggcgacagcaccaucgaguacgcccccgacuucagauucuacaucaccaccaagcugagaaacccccacuaccugcccgagaccagcgugaaggugacccugcugaacuucaugaucacccccgagggcaugcaggaccagcugcugggcaucgugguggcccaggagagacccgaccuggaggaggagaagcaggcccugauccugcagggcgccgagaacaagagacagcugaaggagaucgaggacaagauccuggaggugcugagcagcagcgagggcaacauccuggaggacgagaccgccaucaagauccugagcagcagcaaggcccuggccaacgagaucagccagaagcaggagguggccgaggagaccgagaagaagaucgacaccaccagaaugggcuacagacccaucgccauccacagcagcauccuguucuucagccuggccgaccuggccaacaucgagcccauguaccaguacagccugaccugguucaucaaccuguucauccugagcaucgagaacagcgagaagagcgagauccuggccaagagacugcagauccugaaggaccacuucaccuacagccuguacgugaacgugugcagaagccuguucgagaaggacaagcugcuguucagcuucugccugaccaucaaccugcugcugcacgagagagccaucaacaaggccgaguggagauuccugcugaccggcggcaucggccuggacaaccccuacgccaaccugugcaccuggcugccccagaagagcugggacgagaucugcagacuggacgaccugcccgccuucaagaccaucagaagagaguucaugagacugaaggacggcuggaagaagguguacgacagccuggagccccaccacgagguguuccccgaggagugggaggacaaggccaacgaguuccagagaaugcugaucaucagaugccugagacccgacaaggugauccccaugcugcaggaguucaucaucaacagacugggcagagccuucaucgagcccccccccuucgaccuggccaaggccuucggcgacagcaacugcugcgccccccugaucuucgugcugagccccggcgccgaccccauggccgcccugcugaaguucgccgacgaccagggcuacggcggcagcaagcugagcagccugagccugggccagggccagggccccaucgccaugaagaugcuggagaaggccgugaaggagggcaccuggguggugcugcagaacugccaccuggccaccagcuggaugcccacccuggagaaggugugcgaggagcugagccccgagagcacccaccccgacuucagaauguggcugaccagcuaccccagccccaacuuccccgugagcgugcugcagaacggcgugaagaugaccaacgaggcccccaagggccugagagccaacaucaucagaagcuaccugauggaccccaucagcgaccccgaguucuucggcagcugcaagaagcccgaggaguucaagaagcugcuguacggccugugcuucuuccacgcccuggugcaggagagaagaaaguucggcccccugggcuggaacauccccuacgaguucaacgagaccgaccugagaaucagcgugcagcagcugcacauguuccugaaccaguacgaggagcugcccuacgaggcccugagauacaugaccggcgagugcaacuacggcggcagagugaccgacgacugggacagaagaacccugagaagcauccugaacaaguucuucaaccccgagcugguggagaacagcgacuacaaguucgacagcagcggcaucuacuucgugccccccagcggcgaccacaagagcuacaucgaguacaccaagacccugccccugacccccgcccccgagaucuucggcaugaacgccaacgccgacaucaccaaggaccagagcgagacccagcugcuguucgacaacauccugcugacccagagcagaagcgccggcgccggcgccaagagcagcgacgagguggugaacgagguggccagcgacauccugggcaagcugcccaacaacuucgacaucgaggccgccaugagaagauaccccaccaccuacacccagagcaugaacaccgugcuggugcaggagaugggcagauucaacaagcugcugaagaccaucagagacagcugcgugaacauccagaaggccaucaagggccuggccgugaugagcaccgaccuggaggagguggugagcagcauccugaacgugaagauccccgagauguggaugggcaagagcuaccccagccugaagccccugggcagcuacgugaacgacuuccuggccagacugaaguuccugcagcagugguacgaggugggccccccccccguguucuggcugagcggcuucuucuucacccaggccuuccugaccggcgcccagcagaacuacgccagaaaguacaccauccccaucgaccugcugggcuucgacuacgaggugauggaggacaaggaguacaagcacccccccgaggacggcguguucauccacggccuguuccuggacggcgccagcuggaacagaaagaucaagaagcuggccgagagccaccccaagauccuguacgacaccgugcccgugauguggcugaagcccugcaagagagccgacauccccaagagacccagcuacguggccccccuguacaagaccagcgagagaagaggcgugcugagcaccaccggccacagcaccaacuucgugaucgccaugacccugcccagcgaccagcccaaggagcacuggaucggcagaggcguggcccugcugugccagcugaacagcuaa

SEQ ID NO: 16204 - RNA, 14124 nt, Artificial Sequence
  DNAH8__Homo_sapiens__NP_001193856
auggagaaggacgccgaggacggcgcccccagcgagggcgccgaggccccccccagcaccgaggaggccgccccccccagaagcgaggaggaggaggcccccagaccccccaccguggaggcccccgccgaggacggcuucagccccagcgccgaggacgccgugagcagcgugguggacuacagagaccugauccccagcgaggagggcaucgugcugcccgacgaccacgaggccgaccugaacagagugagacagagacuggcccccagacccgugcagagcgugaucagcgaggugcugagccugcccagcagcagaagaagcagcagauacagaagaagcaugagcggccugcccaaccugcaggagacccugaaggagagacaggccagauucagagaggccagagagagcagaagacugaagaucgaccccagcuacaaguacaucuucgagauccuggccgagaaccugggccuggacaucgugaccguggaggagcugauccuggacugccccagccuggaggccuucaccaacuucuucgccaaggacggcugcaagacccugaaguuccuguaccaggagggcgacgugcccggcaucgagugcggcagaaccaucgccggcgccaccaagggcgccaagaugaugaagcuguacaucgacaacgccgcccccgacaagcugaagggccugugcaucuucuucgugagaugcagaaacgacguggccaucaacgugaagaccauccaggaggaggcccuguucaccgugcuggacgccagcaagggccugcugaacggcaucagagacaugcuggccaacaucuuccugcccgccgugcuggccaccaacaacuggggcgcccugaaccagagcaagcagggcgagagcgagaagcacaucuucaccgagaccaucaacagauaccugagcuuccuggacggcgccagaaucagcaucgagggcaccgugaagcugaagaccaucgacaacgugaacuucagcaagcugcacaccuucgaggaggugaccgccgccgccagcaacagcgagaccgugcaccagcuggaggaggugcugauggugugguacaagcagaucgagcaggugcugaucgagagcgagcagaugagaaaggaggccggcgacagcggcccccugaccgagcuggagcacuggaagagaaugagcgccaaguucaacuacaucaucgagcagaucaagggccccagcugcaaggccgugaucaacgugcugaacguggcccacagcaagcugcugaagaacuggagagaccuggacgccagaaucaccgacaccgccaacgagagcaaggacaacgugagauaccuguacacccuggagaaggugugccagccccuguacaaccacgaccuggugagcauggcccacggcauccagaaccugaucaacgccaucagaaugauccacggcgugagcagauacuacaacaccagcgagagaaugaccagccuguucaucaaggugaccaaccagauggugaccgccugcaaggccuacaucaccgacggcggccugaaccacgugugggaccaggagacccccguggugcugaagaagauccaggacugcaucuuccuguucaaggaguaccaggccagcuuccacaagaccagaaagcugaucagcgagagcagcggcgagaagagcuucgaggugagcgagauguacaucuucggcaaguucgaggccuucugcaagagacuggagaagaucaccgagaugaucaccguggugcagaccuacagcacccugagcaacagcaccaucgagggcaucgacaucauggccaucaaguucagaaacaucuaccagggcgugaagaagaagcaguacgacauccuggaccccagaagaaccgaguucgacaccgacuuccuggacuucaugaccaagaucaacggccuggaggugcagauccaggccuucaugaacagcagcuucggcaagauccugagcagccagcaggcccugcagcugcugcagagauuccagaagcugaacauccccugccugggccuggagaucaaccacaccaucgagagaauccugcaguacuacguggccgagcuggacgccaccaagaagcuguaccacagccagaaggacgaccccccccuggccagaaacaugccccccaucgccggcaagauccugugggugagacagcuguacagaagaaucagcgagcccaucaacuacuucuucaagaacagcgacauccugagcagccccgacggcaaggccgugaucagacaguacaacaagaucagcuacgugcugguggaguucgaggugguguaccacaccgccuggaucagagagaucagccagcugcacuacgcccugcaggccacccuguucgugagacaccccgagaccggcaagcugcuggugaacuucgaccccaagauccuggagguggugagagagaccaagugcaugaucaagaugaagcuggacgugcccgagcaggccaagagacugcugaagcuggagagcaagcugaaggccgacaagcuguaccugcagggccugcugcaguacuacgacgagcugugccaggaggugcccagcguguucgugaaccugaugacccccaagaugaagaagguggagagcgugcugagacagggccugaccgugcugaccuggagcagccugacccuggagagcuucuuccaggagguggagcuggugcuggacauguucaaccagcugcugaagaagaucagcgaccugugcgagaugcacaucgacaccgugcugaaggagaucgccaagaccgugcugaucagccugcccgagagcggcgccaccaagguggaggacaugcugacccugaacgagaccuacaccaaggagugggccgacauccugaaccacaagagcaagcacguggaggaggccgugagagagcugaucagcaucuucgagcagaucuacgaggugaaguacaccggcaaggugggcaagcagagcgagcagagaaagcacgugguguucggcagcgagaccggcgagggcgagaacaacgacuacgaggccaacaucgugaacgaguucgacacccacgacaaggaggacgaguucaagaaggagugcaaggagguguucgccuucuucagccaccagcugcuggacagccugcagaaggccaccagacugagccuggacaccaugaagagaagaaucuucguggccagccuguacggcagaaagcagagcgaggacaucaucagcuucaucaagagcgaggugcaccuggccauccccaacguggugaugauccccagccuggacgacauccagcaggccaucaacagaaugauccagcugacccuggaggugagcagaggcguggcccacuggggccagcagcagaucagacccaucaagagcgugauccccagccccaccaccaccgacgugacccaccagaacaccggcaagcugcugaagaaggaggagagaagcuucgaggaggccauccccgccagaaagcugaagaacuucuaccccggcguggccgagcacaaggacaucagcaagcuggugcugcugcugagcagcagcgugaacagccugagaaaggccgcccacgaggcccugcaggacuuccagaaguacaagacccuguggaccgaggacagagacgugaaggugaaggaguuccuggccaacaaccccagccugaccgagaucagaagcgagauccugcacuacgccaccuucgagcaggagaucgacgagcugaagcccaucaucguggugggcgcccuggagcugcacaccgagcccaugaagcuggcccugagcaucgaggccaaggccuggaagaugcugcugugcagauaccugaacgaggaguacaagaagaagaugagcuacaugaucgccuucaucaacgaguaccugaagaagcugagcagacccaucagagaccuggacgacgugagauucgccauggaggcccugagcugcaucagagacaacgagauccagauggacaugacccugggccccaucgaggaggccuacgccauccugaacagauucgagguggaggugaccaaggaggagagcgaggccguggacacccugagauacagcuucaacaagcugcagagcaaggccgugagcgugcaggaggaccuggugcaggugcagcccaaguucaagagcaaccugcuggagagcguggagguguucagagaggacgugaucaacuucgccgaggccuacgagcuggagggccccauggugcccaacauccccccccaggaggccagcaacagacugcagaucuuccaggccagcuucgacgaccuguggagaaaguucgugaccuacagcagcggcgagcagcuguucggccugcccgugaccgacuacgaggugcugcacaagaccagaaaggagcugaaccugcugcagaagcuguacggccuguacgacaccgugaugagcagcaucagcggcuacuacgagauccuguggggcgacguggacaucgagaagaucaacgccgagcugcuggaguuccagaacagaugcagaaagcugcccaagggccugaaggacuggcaggccuuccuggaccugaagaagagaaucgacgacuucagcgagagcugcccccugcuggagaugaugaccaacaaggccaugaagcagagacacugggacagaaucagcgagcugaccggcacccccuucgacguggagagcgacagcuucugccugagaaacaucauggaggccccccugcugaagcacaaggacgacaucgaggacaucugcaucagcgccaucaaggagaaggacaucgaggccaagcugacccaggugaucgagaacuggaccaaccagaaccugagcuucgccgccuucaagggcaagggcgagcugcugcugaagggcaccgagagcggcgagaucaucacccugauggaggacagccugauggugcugggcagccugcugagcaacagauacaacgcccccuucaagaagaacauccagaacuggguguacaagcugagcaccagcagcgacaucaucgaggaguggcugguggugcagaaccuguggguguaccuggaggccguguucgugggcggcgacaucgccaagcagcugccccaggaggccaagagauuccagaacaucgacaagagcuggaucaagaucaugcagagagcccacgagaaccccaacgugaucaacugcugcgugggcgacgagaccaugggccagcugcugccccaccugcacgagcagcuggaggugugccagaagagccugaccggcuaccuggagaagaagagacugcuguuccccagauucuucuucgugagcgaccccgugcugcuggagauccugggccaggccagcgacagccacaccauccagccccaccugcccgccgugagcgacaacaucaacgaggugaccuuccacgccaaggacuacgacagaaucauggccgugaucagcagagagggcgagaagaucgugcuggacaacagcgugauggccaagggccccguggagaucuggcugcuggaccugcugaagaugcagaugagcagccugcacaacaucaucagaagcgccuucuaccagaucagcgacagcggcuuccagcugcugcccuuccugagccacuuccccgcccaggugggccugcugggcauccagaugcuguggacccacgacagcgaggaggcccugagaaacgccaaggacgacagaaagaucaugcaggugaccaaccagaaguuccuggacauccugaacacccugaucagccagaccacccacgaccugagcaaguucgacagagugaaguucgagacccugaucaccauccacgugcaccagagagacaucuucgacgaccuggugaagaugcacaucaagagccccaccgacuucgaguggcugaagcagagcagauucuacuucaaggaggaccuggaccagaccguggugagcaucaccgacguggacuucaucuaccagaacgaguuccugggcugcaccgacagacuggugaucaccccccugaccgacagaugcuacaucacccuggcccaggcccugggcaugaacaugggcggcgcccccgccggccccgccggcaccggcaagaccgagaccaccaaggacaugggcagaugccugggcaaguacguggugguguucaacugcagcgaccagauggacuucagaggccugggcagaaucuucaagggccuggcccagagcggcagcuggggcugcuucgacgaguucaacagaaucgagcugcccgugcugagcguggccgcccagcagaucuacaucgugcugaccgccagaaaggagagaaagaagcaguucaucuucagcgacggcgacugcguggaccugaaccccgaguucggcaucuuccugaccaugaaccccggcuacgccggcagacaggagcugcccgagaaccugaagauccaguucagaaccguggccaugauggugcccgacagacagaucaucaugagagugaagcuggccagcugcggcuuccuggagaacgugauccuggcccagaaguucuacgugcuguacaagcugugcgaggagcagcugaccaagcaggugcacuacgacuucggccugagaaacauccugagcgugcugagaacccugggcagccagaagagagccagacccgaggacagcgagcugagcaucgugaugagaggccugagagacaugaaccugagcaagcugguggacgaggacgagccccuguuccugagccugaucaacgaccuguuccccggccugcagcuggacagcaacaccuacgccgagcugcagaacgccguggcccaccaggugcagaucgagggccugaucaaccacccccccuggaaccugaagcuggugcagcuguacgagaccagccuggugagacacggccugaugacccugggccccagcggcagcggcaagaccaccgugaucaccauccugaugaaggcccagaccgagugcggcagaccccacagagagaugagaaugaaccccaaggccaucaccgccccccagauguucggcagacuggacaccgccaccaacgacuggaccgacggcaucuucagcacccuguggagaaagacccugaaggccaagaagggcgagaacaucuuccugauccuggacggccccguggacgccaucuggaucgagaaccugaacagcgugcuggacgacaacaagacccugacccuggccaacggcgacagaauccccauggcccccagcugcaagcugcuguucgaggugcacaacaucgagaacgccagccccgccaccgugagcagaaugggcaugguguacaucagcagcagcgcccugagcuggagacccauccugcaggccuggcugaagaagagaaccgcccaggaggccgccguguuccugacccuguacgagaagguguucgaggacaccuacaccuacaugaagcugaaccugaaccccaagaugcagcugcuggagugcaacuacaucgugcagagccugaaccugcuggagggccugauccccagcaaggaggagggcggcgugagcugcguggagcaccugcacaagcuguucguguucggccugauguggagccugggcgcccugcuggagcuggagagcagagagaagcuggaggccuuccugagacagcacgagagcaagcuggaccugcccgagauccccaagggcagcaaccagaccauguacgaguucuacgugaccgacuacggcgacugggagcacuggaacaagaagcugcagcccuacuacuaccccaccgacagcauccccgaguacagcagcauccuggugcccaacguggacaacaucagaaccaacuuccugaucgacaccaucgccaagcagcacaaggccgugcugcugaccggcgagcagggcaccgccaagaccgugauggugaaggccuaccugaagaaguacgaccccgaggugcagcugagcaagagccugaacuucagcagcgccaccgagcccaugauguuccagagaaccaucgagagcuacguggacaagagaaucggcagcaccuacggcccccccggcggcagaaagaugaccguguucaucgacgacaucaacaugcccgugaucaacgaguggggcgaccagaucaccaacgagaucgugagacagaugauggagauggagggcauguacagccuggacaagcccggcgacuucaccaccaucguggacgugcagcugaucgccgccaugauccaccccggcggcggcagaaacgacaucccccagagacugaagagacaguucaccguguucaacugcacccugcccagcaacgccagcaucgacaagaucuucggcaucaucggcugcggcuacuucgaccccugcagaagcuucaagccccagaucugcgagaugaucgugaaccuggugagcgugggcagagugcuguggcaguggaccaaggugaagaugcugcccacccccagcaaguuccacuacaucuucaaccugagagaccugagcagaaucuggcagggcaugcugaccaucaaggccgaggagugcgccagcauccccacccugcugagccuguucaagcacgagugcagcagagugaucgccgacagauucaucacccccgaggacgagcagugguucaacgcccaccugaccagagccguggaggagaacaucggcagcgacgccgccagcugcauccugcccgagcccuacuucguggacuuccugagagagaugcccgagcccaccggcgacgagcccgaggacagcguguucgaggugcccaagaucuacgagcugaugcccagcuucgacuuccuggccgagaagcugcaguucuaccagagacaguucaacgagaucaucagaggcaccagccuggaccugguguucuucaaggacgccaugacccaccugaucaagaucagcagaaucaucagaaccagcugcggcaacgcccugcuggugggcgugggcggcagcggcaagcagagccugagcagacuggccagcuucaucgccggcuaccagaucuuccagaucacccugaccagaagcuacaacgugaccaaccugaccgacgaccugaaggcccuguacaagguggccggcgccgacggcaagggcaucaccuucaucuucaccgacagcgagaucaaggacgaggccuuccuggaguaccugaacaaccugcugagcagcggcgagaucagcaaccuguucgccagagacgagauggacgagaucacccagggccugaucagcgugaugaagagagagcugcccagacacccccccaccuucgacaaccuguacgaguacuucaucagcagaagcagaaagaaccugcacguggugcugugcuucagccccgugggcgagaaguucagagccagaagccugaaguuccccggccugaucagcggcugcaccauggacugguucagcagauggcccagagaggcccugaucgccguggccagcuacuuccugagcgacuacaacaucgugugcagcagcgagaucaagagacaggugguggagaccaugggccuguuccacgacauggugagcgagagcugcgagagcuacuuccagagauacagaagaagagcccacgugacccccaagagcuaccugagcuucaucaacggcuacaagaacaucuacgccgagaaggugaaguucaucaacgagcaggccgagagaaugaacaucggccuggacaagcugauggaggccagcgagagcguggccaagcugagccaggaccuggccgugaaggagaaggagcuggccguggccagcaucaaggccgacgaggugcuggccgaggugaccgugagcgcccaggccagcgccaagaucaagaacgaggugcaggaggugaaggacaaggcccagaagaucguggacgagaucgacagcgagaaggugaaggccgagagcaagcuggaggccgccaagcccgcccuggaggaggccgaggccgcccugaacaccaucaagcccaacgacaucgccaccgugagaaagcuggccaagcccccccaccugaucaugagaaucauggacugcgugcugcugcuguuccagaagaagaucgaccccgugaccauggaccccgagaagagcugcugcaagcccagcuggggcgagagccugaagcugaugagcgccaccggcuuccuguggagccugcagcaguuccccaaggacaccaucaacgaggagaccguggagcugcugcagcccuacuucaacauggacgacuacaccuucgagagcgccaagaaggugugcggcaacguggccggccugcugagcuggacccuggccauggccaucuucuacggcaucaacagagaggugcugccccugaaggccaaccuggccaagcaggagggcagacuggccguggccaacgccgagcugggcaaggcccaggcccugcuggacgagaagcaggccgagcuggacaaggugcaggccaaguucgacgccgccaugaacgagaagauggaccugcugaacgacgccgacaccugcagaaagaagaugcaggccgccagcacccugaucgacggccugagcggcgagaagaucagauggacccagcagagcaaggaguucaaggcccagaucaacagacuggugggcgacauccugcugugcaccggcuuccugagcuaccugggccccuucaaccagaucuucagaaacuaccugcugaaggaccagugggagauggagcugagagccagaaagauccccuucaccgagaaccugaaccugaucagcaugcugguggacccccccaccaucggcgaguggggccugcagggccugcccggcgacgaccugagcauccagaacggcaucaucgugaccaaggccaccagauacccccugcugaucgacccccagacccagggcaagaccuggaucaagagcaaggagaaggagaacgaccugcaggugaccagccugaaccacaaguacuucagaacccaccuggaggacagccugagccugggcagaccccugcugaucgaggacauccacgaggagcuggaccccgcccuggacaacgugcuggagaagaacuucaucaagagcggcaccaccuucaaggugaaggugggcgacaaggagugcgacaucauggacaccuucaagcuguacaucaccaccaagcugcccaaccccgccuucacccccgagaucaacgccaagaccagcgugaucgacuucaccgugaccaugaagggccuggagaaccagcugcugagaagagugauccugaccgagaagcaggagcuggaggccgagagagugaagcugcuggaggacgugaccuucaacaagagaaagaugaaggagcuggaggacaaccugcuguacaagcugagcgccaccaagggcagccugguggacgacgagagccugaucggcgugcugagaaccaccaagcagaccgccgccgaggugagcgagaagcugcacguggccgccgagaccgagaucaagaucaacgccgcccaggaggaguucagacccgccgccaccagaggcagcauccuguacuuccugaucaccgagaugagcauggugaacaucauguaccagaccagccuggcccaguuccugaagcuguucgaccagagcauggccagaagcgagaagagcccccugccccagaagagaaucaccaacaucaucgaguaccugaccuacgagguguucaccuacagcgugagaggccuguacgagaaccacaaguuccuguucgugcugcugaugacccugaagaucgaccugcagagaggcaccgugaagcacagagaguuccaggcccugaucaagggcggcgccgcccuggaccugaaggccugcccccccaagcccuacagauggauccuggacaugaccuggcugaaccugguggagcugagcaagcugccccaguucgccgagaucaugaaccagaucagcagaaacgagaagggcuggaagagcugguucgacaaggacgcccccgaggaggagaucauccccgacggcuacaacgacagccuggacaccugccacaagcugcugcugaucagaagcuggugccccgacagaaccguguuccaggccagaaaguacaucgccgacagccuggaggagaaguacaccgagcccgugauccugaaccuggagaagaccugggaggagagcgacaccagaaccccccugaucugcuuccugagcaugggcagcgaccccaccaaccagaucgacgcccuggccaagaagcugaagcuggagugcagaaccaucagcaugggccagggccaggaggugcacgccagaaagcugauccagaugagcaugcagcagggcggcugggugcugcugcagaacugccaccugggccuggaguucauggaggagcugcuggagacccugaucaccaccgaggccagcgacgacagcuucagaguguggaucaccaccgagccccacgacagauuccccaucacccugcugcagaccagccugaaguucaccaacgagcccccccagggcgugagagccggccugaagagaaccuucgccggcaucaaccaggaccugcuggacaucagcaaccugcccauguggaagcccaugcuguacaccguggccuuccugcacagcaccgugcaggagagaagaaaguucggcccccugggcuggaacauccccuacgaguucaacagcgccgacuucagcgccagcgugcaguucauccagaaccaccuggacgagugcgacaucaagaagggcgugagcuggaacaccgugagauacaugaucggcgaggugcaguacggcggcagagugaccgacgacuucgacaagagacugcugaacugcuucgccagagugugguucagcgagaagauguucgagcccagcuucugcuucuacaccggcuacaagaucccccugugcaagacccuggaccaguacuucgaguacauccagagccugcccagccuggacaaccccgagguguucggccugcaccccaacgccgacaucaccuaccagagcaacaccgccagcgccgugcuggagaccaucaccaacauccagcccaaggagagcggcggcggcgugggcgagaccagagaggccaucguguacagacugagcgaggacaugcugagcaagcugccccccgacuacaucccccacgaggugaagagcagacugaucaagaugggccaccugaacagcaugaacaucuuccugagacaggagaucgacagaaugcagagagugaucagcauccugagaagcagccugagcgaccugaagcuggccaucgagggcaccaucaucaugagcgagaaccugagagacgcccuggacaacauguacgacgccagaaucccccagcuguggaagagagugagcugggacagcagcacccugggcuucugguucaccgagcugcuggagagaaacgcccaguucagcaccuggaucuucgagggcagacccaacguguucuggaugaccggcuucuucaacccccagggcuuccugaccgccaugagacaggaggugaccagagcccacaagggcugggcccuggacaccgugaccauccacaacgaggugcugagacagaccaaggaggagaucaccagcccccccggcgagggcguguacaucuacggccuguacauggacggcgccgccugggacagaagaaacggcaagcugauggagagcacccccaaggugcuguucacccagcugcccgugcugcacaucuucgccaucaacagcaccgcccccaaggaccccaagcuguacgugugccccaucuacaagaagcccagaagaaccgaccugaccuucaucaccgugguguaccugagaaccgugcugagccccgaccacuggauccugagaggcguggcccugcugugcgacaucaaguaa

SEQ ID NO: 16205 - RNA, 13461 nt, Artificial Sequence
  DNAH9__Homo_sapiens__NP_001363
augagacuggccgaggagagagccgcccuggccgccgagaacgccgacggcgagcccggcgccgacagaagacugagacugcugggcaccuacguggccaugagccugagacccgccgccggcgccugggagagaugcgccggcagcgccgaggccgagcagcugcugcaggccuuccugggcagagacgccgccgagggccccagaccccugcugguggugagacccggccccagaggccuggccaucagacccggccuggaggugggccccgagagcggccuggccggcgccaaggcccuguucuuccugagaaccggccccgagccccccggccccgacagcuucagaggcgccguggugugcggcgaccugcccgccgccccccuggagcaccuggccgcccuguucagcgagguggugcugcccgugcuggccaacgagaagaacagacugaacuggccccacaugaucugcgaggacgugagaagacacgcccacagccugcagugcgaccugagcgugauccuggagcaggugaagggcaagacccugcugccccugcccgccggcagcgagaagauggaguucgccgacagcaagagcgagaccgugcuggacagcaucgacaagagcgugaucuacgccaucgagagcgccgugaucaaguggagcuaccaggugcagguggugcugaagagagagagcagccagccccugcugcagggcgagaaccccacccccaagguggagcuggaguucuggaagagcagauacgaggaccugaaguacaucuacaaccagcugagaaccaucaccgugagaggcauggccaagcugcuggacaagcugcagagcagcuacuuccccgccuucaaggccauguacagagacgugguggccgcccuggccgaggcccaggacauccacgugcaccugaucccccugcagagacaccuggaggcccuggagaacgccgaguuccccgaggugaagccccagcugagaccccugcugcacguggugugccugaucugggccaccugcaagagcuacagaagccccggcagacugaccgugcugcugcaggagaucugcaaccugcugauccagcaggccagcaacuaccugagccccgaggaccugcugagaagcgagguggaggagagccagagaaagcugcagguggugagcgacacccugagcuucuucaagcaggaguuccaggacagaagagagaaccugcacaccuacuucaaggagaaccaggaggugaaggagugggacuuccagagcagccugguguucgugagacuggacggcuuccugggccagcugcacgugguggagggccugcugaagaccgcccuggacuuccacaagcugggcaagguggaguucagcggcgugagaggcaacgcccugagccagcaggugcagcagaugcacgaggaguuccaggagauguacagacugcugagcggcagcagcagcgacugccuguaccugcagagcaccgacuucgagaacgacgugagcgaguucaaccagaagguggaggaccuggacagaagacugggcaccaucuucauccaggccuucgacgacgcccccggccuggagcacgccuucaagcugcuggacaucgccggcaaccugcuggagagaccccugguggccagagacaccagcgacaaguaccuggugcugauccagauguucaacaaggaccuggacgccgugagaaugaucuacagccagcacgugcaggaggaggccgagcugggcuucagccccgugcacaagaacaugcccaccguggccggcggccugagaugggcccaggagcugagacagagaauccagggccccuucagcaacuucggcagaaucacccaccccugcauggagagcgccgagggcaagagaaugcagcagaaguacgaggacaugcugagccugcuggagaaguacgagaccagacuguacgaggacuggugcagaaccgugagcgagaagagccaguacaaccugagccagccccugcugaagagagaccccgagaccaaggagaucaccaucaacuucaacccccagcugaucagcgugcugaaggagaugagcuaccuggagcccagagagaugaagcacaugcccgagaccgccgccgccauguucagcagcagagacuucuacagacagcugguggccaaccuggagcugauggccaacugguacaacaaggugaugaagacccugcuggagguggaguucccccugguggaggaggagcugcagaacaucgaccugagacugagagccgccgaggagacccugaacuggaagaccgagggcaucugcgacuacgugaccgagaucaccagcagcauccacgaccuggagcagagaauccagaagaccaaggacaacguggaggagauccagaacaucaugaagaccugggugacccccaucuucaagaccaaggacggcaagagagagagccugcugagccuggacgacagacacgacagaauggagaaguacuacaaccugaucaaggagagcggccugaagauccacgcccuggugcaggagaaccugggccuguucagcgccgaccccaccagcaacaucuggaagaccuacgugaacagcaucgacaaccugcugcugaacggcuucuuccuggccaucgagugcagccugaaguaccugcuggagaacaccgagugcaaggccggccugacccccaucuucgaggcccagcugagccuggccauccccgagcugguguucuaccccagccuggagagcggcgugaagggcggcuucugcgacaucguggagggccugaucaccagcaucuucagaauccccagccuggugcccagacugagcccccagaacggcagcccccacuaccagguggaccuggacggcauccccgaccuggccaacaugagaagaacccugauggagagagugcagagaaugaugggccugugcugcggcuaccagagcaccuucagccaguacagcuaccuguacguggaggacagaaaggaggugcugggccaguuccugcuguacggccacauccugacccccgaggagaucgaggaccacguggaggacggcauccccgagaaccccccccugcugagccaguucaaggugcagaucgacagcuacgagacccuguacgaggaggugugcagacuggagcccaucaagguguucgacggcuggaugaagaucgacaucagacccuucaaggccagccugcugaacaucaucaagagauggagccugcuguucaagcagcaccugguggaccacgugacccacagccuggccaaccuggacgccuucaucaagaagagcgagagcggccugcugaagaagguggagaagggcgacuuccagggccugguggagaucaugggccaccugauggccgugaaggagagacagagcaacaccgacgagauguucgagccccugaagcagaccaucgagcugcugaagaccuacgagcaggagcugcccgagaccguguucaagcagcuggaggagcugcccgagaaguggaacaacaucaagaagguggccaucaccgugaagcagcagguggccccccugcaggccaacgaggugacccugcugagacagagaugcaccgccuucgacgccgagcagcagcaguucugggagcaguuccacaaggaggcccccuucagauucgacagcauccacccccaccagaugcuggacgccagacacaucgagauccagcagauggagagcaccauggccagcaucagcgagagcgccagccuguucgaggugaacgugcccgacuacaagcagcugagacagugcagaaaggaggugugccagcugaaggagcugugggacaccaucggcauggugaccagcagcauccacgccugggagaccacccccuggagaaacaucaacguggaggccauggagcuggagugcaagcaguucgccagacacaucagaaaccuggacaaggaggugagagccugggacgccuucaccggccuggagagcaccguguggaacacccugagcagccugagagccguggccgagcugcagaaccccgccaucagagagagacacuggagacagcugaugcaggccaccggcgugagcuucaccauggaccaggacaccacccuggcccaccugcugcagcugcagcugcaccacuacgaggacgaggugagaggcaucguggacaaggccgccaaggagaugggcauggagaagacccugaaggagcugcagaccaccugggccggcauggaguuccaguacgagccccaccccagaaccaacgugccccugcugugcagcgacgaggaccugaucgaggugcuggaggacaaccaggugcagcugcagaaccuggugaugagcaaguacguggccuucuuccuggaggaggugagcggcuggcagaagaagcugagcaccguggacgccgugaucagcaucugguucgaggugcagagaaccuggacccaccuggagagcaucuucaccggcagcgaggacaucagagcccagcugccccaggacagcaagagauucgagggcaucgacaucgacuucaaggagcuggccuacgacgcccagaagauccccaacguggugcagaccaccaacaagcccggccuguacgagaagcuggaggacauccagggcagacugugccugugcgagaaggcccuggccgaguaccuggacaccaagagacuggccuuccccagauucuacuuccugagcagcagcgaccugcuggacauccugagcaacggcaccgccccccagcaggugcagagacaccugagcaagcuguucgacaacauggccaagaugagauuccagcuggacgccagcggcgagcccaccaagaccagccugggcauguacagcaaggaggaggaguacguggccuucagcgagcccugcgacugcagcggccagguggagaucuggcugaaccacgugcugggccacaugaaggccaccgugagacacgagaugaccgagggcgugaccgccuacgaggagaagcccagagagcaguggcuguucgaccaccccgcccagguggcccugaccugcacccagaucugguggaccaccgaggugggcauggccuucgccagacuggaggagggcuacgagagcgccaugaaggacuacuacaagaagcagguggcccagcugaagacccugaucaccaugcugaucggccagcugagcaagggcgacagacagaagaucaugaccaucugcaccaucgacgugcacgccagagacgugguggccaagaugaucgcccagaagguggacaacgcccaggccuuccuguggcugagccagcugagacacagaugggacgacgaggugaagcacugcuucgccaacaucugcgacgcccaguuccuguacagcuacgaguaccugggcaacacccccagacuggugaucaccccccugaccgacagaugcuacaucacccugacccagagccugcaccugaccaugagcggcgcccccgccggccccgccggcaccggcaagaccgagaccaccaaggaccugggcagagcccugggcauccugguguacguguucaacugcagcgagcagauggacuacaagagcugcggcaacaucuacaagggccuggcccagaccggcgccuggggcugcuucgacgaguucaacagaaucagcguggaggugcugagcgugguggccgugcaggugaagagcauccaggacgccaucagagacaagaagcagugguucagcuuccugggcgaggagaucagccugaaccccagcgugggcaucuucaucaccaugaaccccggcuacgccggcagaaccgagcugcccgagaaccugaagagccuguucagacccugcgccaugguggugcccgacuucgagcugaucugcgagaucaugcugguggccgagggcuucaucgaggcccagagccuggccagaaaguucaucacccuguaccagcugugcaaggagcugcugagcaagcaggaccacuacgacuggggccugagagccaucaagagcgugcuggugguggccggcagccugaagagaggcgaccccgacagacccgaggaccaggugcugaugagaagccugagagacuucaacauccccaagaucgugaccgacgacaugcccaucuucaugggccugaucggcgaccuguuccccgcccuggacgugcccagaagaagagaccccaacuucgaggcccuggugagaaaggccaucguggaccugaagcugcaggccgaggacaacuucgugcugaagguggugcagcuggaggagcugcuggccgugagacacagcguguucguggugggcggcgccggcaccggcaagagccaggugcugagaagccugcacaagaccuaccagaucaugaagagaagacccguguggaccgaccugaaccccaaggccgugaccaacgacgagcuguucggcaucaucaaccccgccaccggcgaguggaaggacggccuguucagcagcaucaugagagagcuggccaacaucacccacgacggccccaaguggauccugcuggacggcgacaucgaccccauguggaucgagagccugaacaccgugauggacgacaacaaggugcugacccuggccagcaacgagagaaucccccugaaccccaccaugaagcugcuguucgagaucagccaccugagaaccgccacccccgccaccgugagcagagccggcauccuguacaucaaccccgccgaccugggcuggaacccccccgugagcagcuggaucgagaagagagagauccagaccgagagagccaaccugaccauccuguucgacaaguaccugcccaccugccuggacacccugagaaccagauucaagaagaucauccccauccccgagcagagcauggugcagauggugugccaccugcuggagugccugcugaccaccgaggacauccccgccgacugccccaaggagaucuacgagcacuacuucguguucgccgccaucugggccuucggcggcgccauggugcaggaccagcugguggacuacagagccgaguucagcaagugguggcugaccgaguucaagaccgugaaguuccccagccagggcaccaucuucgacuacuacaucgaccccgagaccaagaaguucgagcccuggagcaagcuggugccccaguucgaguucgaccccgagaugccccugcaggccugccuggugcacaccagcgagaccaucagagugugcuacuucauggagagacugauggccagacagagacccgugaugcuggugggcaccgccggcaccggcaagagcgugcuggugggcgccaagcuggccagccuggaccccgaggccuaccuggugaagaacgugcccuucaacuacuacaccaccagcgccaugcugcaggccgugcuggagaagccccuggagaagaaggccggcagaaacuacggcccccccggcaacaagaagcugaucuacuucaucgacgacaugaacaugcccgagguggacgccuacggcaccgugcagccccacaccaucaucagacagcaccuggacuacggccacugguacgacagaagcaagcugagccugaaggagaucaccaacgugcaguacgugagcugcaugaaccccaccgccggcagcuucaccaucaaccccagacugcagagacacuucagcguguucgugcugagcuuccccggcgccgacgcccugagcagcaucuacagcaucauccugacccagcaccugaagcugggcaacuuccccgccagccugcagaagagcauccccccccugaucgaccuggcccuggccuuccaccagaagaucgccaccaccuuccugcccaccggcaucaaguuccacuacaucuucaaccugagagacuucgccaacaucuuccagggcauccuguucagcagcguggagugcgugaagagcaccugggaccugaucagacuguaccugcacgagagcaacagaguguacagagacaagaugguggaggagaaggacuucgaccuguucgacaagauccagaccgaggugcugaagaagaccuucgacgacaucgaggaccccguggagcagacccagagccccaaccuguacugccacuucgccaacggcaucggcgagcccaaguacaugcccgugcagagcugggagcugcugacccagacccugguggaggcccuggagaaccacaacgaggugaacaccgugauggaccuggugcuguucgaggacgccaugagacacgugugccacaucaacagaauccuggagagccccagaggcaacgcccugcuggugggcgugggcggcagcggcaagcagagccugaccagacuggccgccuucaucagcagcauggacguguuccagaucacccugagaaagggcuaccagauccaggacuucaagauggaccuggccagccugugccugaaggccggcgugaagaaccugaacaccguguuccugaugaccgacgcccagguggccgacgagagauuccuggugcugaucaacgaccugcuggccagcggcgagauccccgaccuguacagcgacgacgagguggagaacaucaucagcaacgugagaaacgaggugaagagccagggccugguggacaacagagagaacugcuggaaguucuucaucgacagaaucagaagacagcugaaggugacccugugcuucagccccgugggcaacaagcugagagugagaagcagaaaguuccccgccaucgugaacugcaccgccauccacugguuccacgaguggccccagcaggcccuggagagcgugagccugagauuccugcagaacaccgagggcaucgagcccaccgugaagcagagcaucagcaaguucauggccuucgugcacaccagcgugaaccagaccagccagagcuaccugagcaacgagcagagauacaacuacaccacccccaagagcuuccuggaguucaucagacuguaccagagccugcugcacagacacagaaaggagcugaagugcaagaccgagagacuggagaacggccugcugaagcugcacagcaccagcgcccagguggacgaccugaaggccaagcuggccgcccaggagguggagcugaagcagaagaacgaggacgccgacaagcugauccagguggugggcguggagaccgacaaggugagcagagagaaggccauggccgacgaggaggagcagaagguggccgugaucaugcuggaggugaagcagaagcagaaggacugcgaggaggaccuggccaaggccgagcccgcccugaccgccgcccaggccgcccugaacacccugaacaagaccaaccugaccgagcugaagagcuucggcagccccccccuggccgugagcaacgugagcgccgccgugauggugcugauggcccccagaggcagagugcccaaggacagaagcuggaaggccgccaaggugaccauggccaagguggacggcuuccuggacagccugaucaacuucaacaaggagaacauccacgagaacugccugaaggccaucagacccuaccugcaggaccccgaguucaaccccgaguucguggccaccaagagcuacgccgccgccggccugugcagcugggugaucaacaucgugagauucuacgagguguucugcgacguggagcccaagagacaggcccugaacaaggccaccgccgaccugaccgccgcccaggagaagcuggccgccaucaaggccaagaucgcccaccugaacgagaaccuggccaagcugaccgccagauucgagaaggccaccgccgacaagcugaagugccagcaggaggccgaggugaccgccgugaccaucagccuggccaacagacuggugggcggccuggccagcgagaacgugagaugggccgacgccgugcagaacuucaagcagcaggagagaacccugugcggcgacauccugcugaucaccgccuucaucagcuaccugggcuucuucaccaagaaguacagacagagccugcuggacagaaccuggagacccuaccugagccagcugaagacccccauccccgugacccccgcccuggacccccugagaaugcugauggacgacgccgacguggccgccuggcagaacgagggccugcccgccgacagaaugagcguggagaacgccaccauccugaucaacugcgagagauggccccugaugguggacccccagcugcagggcaucaaguggaucaagaacaaguacggcgaggaccugagagugacccagaucggccagaagggcuaccugcagaucaucgagcaggcccuggaggccggcgccguggugcugaucgagaaccuggaggagagcaucgaccccgugcugggcccccugcugggcagagaggugaucaagaagggcagauucaucaagaucggcgacaaggagugcgaguacaaccccaaguucagacugauccugcacaccaagcuggccaacccccacuaccagcccgagcugcaggcccaggccacccugaucaacuucaccgugaccagagacggccuggaggaccagcugcuggccgccguggugagcauggagagacccgaccuggagcagcugaagagcgaccugaccaagcagcagaacggcuucaagaucacccugaagacccuggaggacagccugcugagcagacugagcagcgccagcggcaacuuccugggcgagaccgugcugguggagaaccuggagaucaccaagcagaccgccgccgagguggagaagaaggugcaggaggccaaggugaccgaggugaagaucaacgaggccagagagcacuacagacccgccgccgccagagccagccugcuguacuucaucaugaacgaccugagcaagauccaccccauguaccaguucagccugaaggccuucagcaucguguuccagaaggccguggagagagccgcccccgacgagagccugagagagagaguggccaaccugaucgacagcaucaccuucagcguguaccaguacaccaucagaggccuguucgagugcgacaagcugaccuaccuggcccagcugaccuuccagauccugcugaugaacagagaggugaacgccguggagcuggacuuccugcugagaagccccgugcagaccggcaccgccagccccguggaguuccugagccaccaggccuggggcgccgugaaggugcugagcagcauggaggaguucagcaaccuggacagagacaucgagggcagcgccaagagcuggaagaaguucguggagagcgagugccccgagaaggagaagcugccccaggaguggaagaacaagaccgcccugcagagacugugcaugcugagagccaugagacccgacagaaugaccuacgcccugagagacuucguggaggagaagcugggcagcaaguacguggugggcagagcccuggacuucgccaccagcuucgaggagagcggccccgccacccccauguucuucauccugagccccggcguggacccccugaaggacguggagagccagggcagaaagcugggcuacaccuucaacaaccagaacuuccacaacgugagccugggccagggccaggaggugguggccgaggccgcccuggaccuggccgccaagaagggccacugggugauccugcagaacauccaccugguggccaaguggcugagcacccuggagaagaagcuggaggagcacagcgagaacagccaccccgaguucagaguguucaugagcgccgagcccgcccccagccccgagggccacaucaucccccagggcauccuggagaacagcaucaagaucaccaacgagccccccaccggcaugcacgccaaccugcacaaggcccuggacaacuucacccaggacacccuggagaugugcagcagagagaccgaguucaagagcauccuguucgcccugugcuacuuccacgccgugguggccgagagaagaaaguucggcccccagggcuggaacagaagcuaccccuucaacaccggcgaccugaccaucagcgugaacgugcuguacaacuuccuggaggccaacgccaaggugcccuacgacgaccugagauaccuguucggcgagaucauguacggcggccacaucaccgacgacugggacagaagacugugcagaaccuaccugggcgaguucaucagacccgagaugcuggagggcgagcugagccuggcccccggcuucccccugcccggcaacauggacuacaacggcuaccaccaguacaucgacgccgagcugccccccgagagccccuaccuguacggccugcaccccaacgccgagaucggcuuccugacccagaccagcgagaagcuguucagaaccgugcuggagcugcagcccagagacagccaggccagagacggcgccggcgccaccagagaggagaaggugaaggcccugcuggaggagauccuggagagagugaccgacgaguucaacauccccgagcugauggccaagguggaggagagaacccccuacaucgugguggccuuccaggagugcggcagaaugaacauccugaccagagagauccagagaagccugagagagcuggagcugggccugaagggcgagcugaccaugaccagccacauggagaaccugcagaacgcccuguacuucgacauggugcccgagagcugggccagaagagccuaccccagcaccgccggccuggccgccugguuccccgaccugcugaacagaaucaaggagcuggaggccuggaccggcgacuucaccaugcccagcaccguguggcugaccggcuucuucaacccccagagcuuccugaccgccaucaugcagagcaccgccagaaagaacgaguggccccuggaccagauggcccugcagugcgacaugaccaagaagaacagagaggaguucagaagcccccccagagagggcgccuacauccacggccuguucauggagggcgccugcugggacacccaggccggcaucaucaccgaggccaagcugaaggaccugaccccccccaugcccgugauguucaucaaggccauccccgccgacaagcaggacugcagaagcguguacagcugccccguguacaagaccagccagagaggccccaccuacguguggaccuucaaccugaagaccaaggagaaccccagcaagugggugcuggccggcguggcccugcugcugcagaucuaa

SEQ ID NO: 16206 - RNA, 2100 nt, Artificial Sequence
  DNAI1__Homo_sapiens__NP_036276
augauccccgccagcgccaaggccccccacaagcagccccacaagcagagcaucagcaucggcagaggcaccagaaagagagacgaggacagcggcaccgaggugggcgagggcaccgacgagugggcccagagcaaggccaccgugagaccccccgaccagcuggagcugaccgacgccgagcugaaggaggaguucaccagaauccugaccgccaacaacccccacgccccccagaacaucgugagauacagcuucaaggagggcaccuacaagcccaucggcuucgugaaccagcuggccgugcacuacacccaggugggcaaccugauccccaaggacagcgacgagggcagaagacagcacuacagagacgagcugguggccggcagccaggagagcgugaaggugaucagcgagaccggcaaccuggaggaggacgaggagcccaaggagcuggagaccgagcccggcagccagaccgacgugcccgccgccggcgccgccgagaaggugaccgaggaggagcugaugacccccaagcagcccaaggagagaaagcugaccaaccaguucaacuucagcgagagagccagccagaccuacaacaaccccgugagagacagagagugccagaccgagcccccccccagaaccaacuucagcgccaccgccaaccagugggagaucuacgacgccuacguggaggagcuggagaagcaggagaagaccaaggagaaggagaaggccaagacccccguggccaagaagagcggcaagauggccaugagaaagcugaccagcauggagagccagaccgacgaccugaucaagcugagccaggccgccaagaucauggagagaauggugaaccagaacaccuacgacgacaucgcccaggacuucaaguacuacgacgacgccgccgacgaguacagagaccaggugggcacccugcugccccuguggaaguuccagaacgacaaggccaagagacugagcgugaccgcccugugcuggaaccccaaguacagagaccuguucgccgugggcuacggcagcuacgacuucaugaagcagagcagaggcaugcugcugcuguacagccugaagaaccccagcuuccccgaguacauguucagcagcaacagcggcgugaugugccuggacauccacguggaccaccccuaccugguggccgugggccacuacgacggcaacguggccaucuacaaccugaagaagccccacagccagcccagcuucugcagcagcgccaagagcggcaagcacagcgaccccguguggcaggugaaguggcagaaggacgacauggaccagaaccugaacuucuucagcgugagcagcgacggcagaaucgugagcuggacccuggugaagagaaagcuggugcacaucgacgugaucaagcugaagguggagggcagcaccaccgaggugcccgagggccugcagcugcaccccgugggcugcggcaccgccuucgacuuccacaaggagaucgacuacauguuccuggugggcaccgaggagggcaagaucuacaagugcagcaagagcuacagcagccaguuccuggacaccuacgacgcccacaacaugagcguggacaccgugagcuggaaccccuaccacaccaagguguucaugagcugcagcagcgacuggaccgugaagaucugggaccacaccaucaagacccccauguucaucuacgaccugaacagcgccgugggcgacguggccugggcccccuacagcagcaccguguucgccgccgugaccaccgacggcaaggcccacaucuucgaccuggccaucaacaaguacgaggccaucugcaaccagcccguggccgccaagaagaacagacugacccacgugcaguucaaccugauccaccccaucaucaucgugggcgacgacagaggccacaucaucagccugaagcugagccccaaccugagaaagaugcccaaggagaagaagggccaggaggugcagaagggccccgccguggagaucgccaagcuggacaagcugcugaaccuggugagagaggugaagaucaagaccuaa

SEQ ID NO: 16207 - RNA, 1782 nt, Artificial Sequence
  DNAI2__Homo_sapiens__NP_001166281
auggagaucguguacguguacgugaagaagagaagcgaguucggcaagcagugcaacuucagcgacagacaggccgagcugaacaucgacaucaugcccaaccccgagcuggccgagcaguucguggagagaaaccccguggacaccggcauccagugcagcaucagcaugagcgagcacgaggccaacagcgagagauucgagauggagaccagaggcgugaaccacguggagggcggcuggcccaaggacgugaacccccuggagcuggagcagaccaucagauucagaaagaagguggagaaggacgagaacuacgugaacgccaucaugcagcugggcagcaucauggagcacugcaucaagcagaacaacgccaucgacaucuacgaggaguacuucaacgacgaggaggccauggaggugauggaggaggaccccagcgccaagaccaucaacguguucagagacccccaggagaucaagagagccgccacccaccugagcuggcaccccgacggcaacagaaagcuggccguggccuacagcugccuggacuuccagagagcccccgugggcaugagcagcgacagcuacaucugggaccuggagaaccccaacaagcccgagcuggcccugaagcccagcagcccccuggugacccuggaguucaaccccaaggacagccacgugcugcugggcggcugcuacaacggccagaucgccugcugggacaccagaaagggcagccugguggccgagcugagcaccaucgagagcagccacagagaccccguguacggcaccaucuggcugcagagcaagaccggcaccgagugcuucagcgccagcaccgacggccaggugauguggugggacaucagaaagaugagcgagcccaccgagguggugauccuggacaucaccaagaaggagcagcuggagaacgcccugggcgccaucagccuggaguucgagagcacccugcccaccaaguucauggugggcaccgagcagggcaucgugaucagcugcaacagaaaggccaagaccagcgccgagaagaucgugugcaccuuccccggccaccacggccccaucuacgcccugcagagaaaccccuucuaccccaagaacuuccugaccgugggcgacuggaccgccagaaucuggagcgaggacagcagagagagcagcaucauguggaccaaguaccacauggccuaccugaccgacgccgccuggagccccgugagacccaccguguucuucaccaccagaauggacggcacccuggacaucugggacuucauguucgagcagugcgaccccacccugagccugaaggacaacggcugccugaucgccugcggcagccagcugggcaccaccacccugcuggaggugagccccggccugagcacccugcagagaaacgagaagaacguggccagcagcauguucgagagagagaccagaagagagaagauccuggaggccagacacagagagaugagacugaaggagaagggcaaggccgagggcagagacgaggagcagaccgacgaggagcuggccguggaccuggaggcccuggugagcaaggccgaggaggaguucuucgacaucaucuucgccgagcugaagaagaaggaggccgacgccaucaagcugacccccgugccccagcagcccagccccgaggaggaccaggugguggaggagggcgaggaggccgccggcgaggagggcgacgaggagguggaggaggaccuggccuaa

SEQ ID NO: 16208 - RNA, 1194 nt, Artificial Sequence
  DNAJA1__Homo_sapiens__NP_001530
auggugaaggagaccaccuacuacgacgugcugggcgugaagcccaacgccacccaggaggagcugaagaaggccuacagaaagcuggcccugaaguaccaccccgacaagaaccccaacgagggcgagaaguucaagcagaucagccaggccuacgaggugcugagcgacgccaagaagagagagcuguacgacaagggcggcgagcaggccaucaaggagggcggcgccggcggcggcuucggcagccccauggacaucuucgacauguucuucggcggcggcggcagaaugcagagagagagaagaggcaagaacguggugcaccagcugagcgugacccuggaggaccuguacaacggcgccaccagaaagcuggcccugcagaagaacgugaucugcgacaagugcgagggcagaggcggcaagaagggcgccguggagugcugccccaacugcagaggcaccggcaugcagaucagaauccaccagaucggccccggcauggugcagcagauccagagcgugugcauggagugccagggccacggcgagagaaucagccccaaggacagaugcaagagcugcaacggcagaaagaucgugagagagaagaagauccuggaggugcacaucgacaagggcaugaaggacggccagaagaucaccuuccacggcgagggcgaccaggagcccggccuggagcccggcgacaucaucaucgugcuggaccagaaggaccacgccguguucaccagaagaggcgaggaccuguucaugugcauggacauccagcugguggaggcccugugcggcuuccagaagcccaucagcacccuggacaacagaaccaucgugaucaccagccaccccggccagaucgugaagcacggcgacaucaagugcgugcugaacgagggcaugcccaucuacagaagacccuacgagaagggcagacugaucaucgaguucaaggugaacuuccccgagaacggcuuccugagccccgacaagcugagccugcuggagaagcugcugcccgagagaaaggagguggaggagaccgacgagauggaccagguggagcugguggacuucgaccccaaccaggagagaagaagacacuacaacggcgaggccuacgaggacgacgagcaccaccccagaggcggcgugcagugccagaccagcuaa

SEQ ID NO: 16209 - RNA, 1239 nt, Artificial Sequence
  DNAJA2__Homo_sapiens__NP_005871
auggccaacguggccgacaccaagcuguacgacauccugggcgugccccccggcgccagcgagaacgagcugaagaaggccuacagaaagcuggccaaggaguaccaccccgacaagaaccccaacgccggcgacaaguucaaggagaucagcuucgccuacgaggugcugagcaaccccgagaagagagagcuguacgacagauacggcgagcagggccugagagagggcagcggcggcggcggcggcauggacgacaucuucagccacaucuucggcggcggccuguucggcuucaugggcaaccagagcagaagcagaaacggcagaagaagaggcgaggacaugaugcacccccugaaggugagccuggaggaccuguacaacggcaagaccaccaagcugcagcugagcaagaacgugcugugcagcgccugcagcggccagggcggcaagagcggcgccgugcagaagugcagcgccugcagaggcagaggcgugagaaucaugaucagacagcuggcccccggcauggugcagcagaugcagagcgugugcagcgacugcaacggcgagggcgaggugaucaacgagaaggacagaugcaagaagugcgagggcaagaaggugaucaaggaggugaagauccuggaggugcacguggacaagggcaugaagcacggccagagaaucaccuucaccggcgaggccgaccaggcccccggcguggagcccggcgacaucgugcugcugcugcaggagaaggagcacgagguguuccagagagacggcaacgaccugcacaugaccuacaagaucggccugguggaggcccugugcggcuuccaguucaccuucaagcaccuggacggcagacagaucguggugaaguacccccccggcaaggugaucgagcccggcugcgugagaguggugagaggcgagggcaugccccaguacagaaaccccuucgagaagggcgaccuguacaucaaguucgacgugcaguuccccgagaacaacuggaucaaccccgacaagcugagcgagcuggaggaccugcugcccagcagacccgaggugcccaacaucaucggcgagaccgaggagguggagcugcaggaguucgacagcaccagaggcagcggcggcggccagagaagagaggccuacaacgacagcagcgacgaggagagcagcagccaccacggccccggcgugcagugcgcccaccaguaa

SEQ ID NO: 16210 - RNA, 1362 nt, Artificial Sequence
  DNAJA3__Homo_sapiens__NP_001128582
auggccgccagaugcagcaccagauggcugcuggugguggugggcacccccagacugcccgccaucagcggcagaggcgccagaccccccagagagggcguggugggcgccuggcugagcagaaagcugagcgugcccgccuucgccagcagccugaccagcugcggccccagagcccugcugacccugagacccggcgugagccugaccggcaccaagcacaaccccuucaucugcaccgccagcuuccacaccagcgccccccuggccaaggaggacuacuaccagauccugggcgugcccagaaacgccagccagaaggagaucaagaaggccuacuaccagcuggccaagaaguaccaccccgacaccaacaaggacgaccccaaggccaaggagaaguucagccagcuggccgaggccuacgaggugcugagcgacgaggugaagagaaagcaguacgacgccuacggcagcgccggcuucgaccccggcgccagcggcagccagcacagcuacuggaagggcggccccaccguggaccccgaggagcuguucagaaagaucuucggcgaguucagcagcagcagcuucggcgacuuccagaccguguucgaccagccccaggaguacuucauggagcugaccuucaaccaggccgccaagggcgugaacaaggaguucaccgugaacaucauggacaccugcgagagaugcaacggcaagggcaacgagcccggcaccaaggugcagcacugccacuacugcggcggcagcggcauggagaccaucaacaccggccccuucgugaugagaagcaccugcagaagaugcggcggcagaggcagcaucaucaucagccccugcguggugugcagaggcgccggccaggccaagcagaagaagagagugaugauccccgugcccgccggcguggaggacggccagaccgugagaaugcccgugggcaagagagagaucuucaucaccuucagagugcagaagagccccguguucagaagagacggcgccgacauccacagcgaccuguucaucagcaucgcccaggcccugcugggcggcaccgccagagcccagggccuguacgagaccaucaacgugaccaucccccccggcacccagaccgaccagaagaucagaaugggcggcaagggcauccccagaaucaacagcuacggcuacggcgaccacuacauccacaucaagaucagagugcccaagagacugaccagcagacagcagagccugauccugagcuacgccgaggacgagaccgacguggagggcaccgugaacggcgugacccugaccagcagcggcaagagaagcaccggcaacuaa

SEQ ID NO: 16211 - RNA, 1077 nt, Artificial Sequence
  DNAJB11__Homo_sapiens__NP_057390
auggccccccagaaccugagcaccuucugccugcugcugcuguaccugaucggcgccgugaucgccggcagagacuucuacaagauccugggcgugcccagaagcgccagcaucaaggacaucaagaaggccuacagaaagcuggcccugcagcugcaccccgacagaaaccccgacgacccccaggcccaggagaaguuccaggaccugggcgccgccuacgaggugcugagcgacagcgagaagagaaagcaguacgacaccuacggcgaggagggccugaaggacggccaccagagcagccacggcgacaucuucagccacuucuucggcgacuucggcuucauguucggcggcacccccagacagcaggacagaaacauccccagaggcagcgacaucaucguggaccuggaggugacccuggaggagguguacgccggcaacuucguggagguggugagaaacaagcccguggccagacaggcccccggcaagagaaagugcaacugcagacaggagaugagaaccacccagcugggccccggcagauuccagaugacccaggagguggugugcgacgagugccccaacgugaagcuggugaacgaggagagaacccuggagguggagaucgagcccggcgugagagacggcauggaguaccccuucaucggcgagggcgagccccacguggacggcgagcccggcgaccugagauucagaaucaagguggugaagcaccccaucuucgagagaagaggcgacgaccuguacaccaacgugaccaucagccugguggagagccuggugggcuucgagauggacaucacccaccuggacggccacaaggugcacaucagcagagacaagaucaccagacccggcgccaagcuguggaagaagggcgagggccugcccaacuucgacaacaacaacaucaagggcagccugaucaucaccuucgacguggacuuccccaaggagcagcugaccgaggaggccagagagggcaucaagcagcugcugaagcagggcagcgugcagaagguguacaacggccugcagggcuacuaa

SEQ ID NO: 16212 - RNA, 951 nt, Artificial Sequence
  DNAJB13__Homo_sapiens__NP_705842
augggccaggacuacuacagcgugcugggcaucaccagaaacagcgaggacgcccagaucaagcaggccuacagaagacuggcccugaagcaccacccccugaagagcaacgagcccagcagcgccgagaucuucagacagaucgccgaggccuacgacgugcugagcgaccccaugaagagaggcaucuacgacaaguucggcgaggagggccugaagggcggcaucccccuggaguucggcagccagacccccuggaccaccggcuacguguuccacggcaagcccgagaagguguuccacgaguucuucggcggcaacaaccccuucagcgaguucuucgacgccgagggcagcgagguggaccugaacuucggcggccugcagggcagaggcgugaagaagcaggacccccagguggagagagaccuguaccugagccuggaggaccuguucuucggcugcaccaagaagaucaagaucagcagaagagugcugaacgaggacggcuacagcagcaccaucaaggacaagauccugaccaucgacgugaagcccggcuggagacagggcaccagaaucaccuucgagaaggagggcgaccagggccccaacaucauccccgccgacaucaucuucaucgugaaggagaagcugcaccccagauucagaagagagaacgacaaccuguucuucgugaaccccaucccccugggcaaggcccugaccugcugcaccguggaggugagaacccuggacgacagacugcugaacauccccaucaacgacaucauccaccccaaguacuucaagaaggugcccggcgagggcaugccccugcccgaggaccccaccaagaagggcgaccuguucaucuucuucgacauccaguuccccaccagacugaccccccagaagaagcagaugcugagacaggcccugcugaccuaa

SEQ ID NO: 16213 - RNA, 723 nt, Artificial Sequence
  DNAJB1__Homo_sapiens__NP_001287843
auguucgccgaguucuucggcggcagaaaccccuucgacaccuucuucggccagagaaacggcgaggagggcauggacaucgacgaccccuucagcggcuuccccaugggcaugggcggcuucaccaacgugaacuucggcagaagcagaagcgcccaggagcccgccagaaagaagcaggacccccccgugacccacgaccugagagugagccuggaggagaucuacagcggcugcaccaagaagaugaagaucagccacaagagacugaaccccgacggcaagagcaucagaaacgaggacaagauccugaccaucgaggugaagaagggcuggaaggagggcaccaagaucaccuuccccaaggagggcgaccagaccagcaacaacauccccgccgacaucguguucgugcugaaggacaagccccacaacaucuucaagagagacggcagcgacgugaucuaccccgccagaaucagccugagagaggcccugugcggcugcaccgugaacgugcccacccuggacggcagaaccauccccgugguguucaaggacgugaucagacccggcaugagaagaaaggugcccggcgagggccugccccugcccaagacccccgagaagagaggcgaccugaucaucgaguucgaggugaucuuccccgagagaaucccccagaccagcagaaccgugcuggagcaggugcugcccaucuaa

SEQ ID NO: 16214 - RNA, 834 nt, Artificial Sequence
  DNAJB2__Homo_sapiens__NP_001034639
auggccagcuacuacgagauccuggacgugcccagaagcgccagcgccgacgacaucaagaaggccuacagaagaaaggcccugcaguggcaccccgacaagaaccccgacaacaaggaguucgccgagaagaaguucaaggagguggccgaggccuacgaggugcugagcgacaagcacaagagagagaucuacgacagauacggcagagagggccugaccggcaccggcaccggccccagcagagccgaggccggcagcggcggccccggcuucaccuucaccuucagaagccccgaggagguguucagagaguucuucggcagcggcgaccccuucgccgagcuguucgacgaccugggccccuucagcgagcugcagaacagaggcagcagacacagcggccccuucuucaccuucagcagcagcuuccccggccacagcgacuucagcagcagcagcuucagcuucagccccggcgccggcgccuucagaagcgugagcaccagcaccaccuucgugcagggcagaagaaucaccaccagaagaaucauggagaacggccaggagagaguggagguggaggaggacggccagcugaagagcgugaccaucaacggcgugcccgacgaccuggcccugggccuggagcugagcagaagagagcagcagcccagcgugaccagcagaagcggcggcacccaggugcagcagacccccgccagcugcccccuggacagcgaccugagcgaggacgaggaccugcagcuggccauggccuacagccugagcgagauggaggccgccggcaagaagcccgccgacguguucuaa

SEQ ID NO: 16215 - RNA, 1389 nt, Artificial Sequence
  DNAJB5__Homo_sapiens__NP_001128476
augggcggcgccgaggccgagcccuggggcagagcccccggccccgccaucggcggcagaagagccggcgacagcugccccggcuggagaagaagaagcagaagcagaggcagaggccagagacugagccacggccccagaagaagaccccagcugcugaccgccgcccccccccugcaggccagaggcgccuucagaagcuucccccacagcuggggcgaggacuuccuggccagccugauguucaagauccagcuggagccccugaagcugagagccuggacccugaacggcuucgugaaguucagaaacaaggagaccagcgccggccccguggccgugaugggcaaggacuacuacaagauccugggcauccccagcggcgccaacgaggacgagaucaagaaggccuacagaaagauggcccugaaguaccaccccgacaagaacaaggagcccaacgccgaggagaaguucaaggagaucgccgaggccuacgacgugcugagcgaccccaagaagagaggccuguacgaccaguacggcgaggagggccugaagaccggcggcggcaccagcggcggcagcagcggcagcuuccacuacaccuuccacggcgacccccacgccaccuucgccagcuucuucggcggcagcaaccccuucgacaucuucuucgccagcagcagaagcaccagacccuucagcggcuucgaccccgacgacauggacguggacgaggacgaggaccccuucggcgccuucggcagauucggcuucaacggccugagcagaggccccagaagagcccccgagccccuguaccccagaagaaaggugcaggacccccccguggugcacgagcugagagugagccuggaggagaucuaccacggcagcaccaagagaaugaagaucaccagaagaagacugaaccccgacggcagaaccgugagaaccgaggacaagauccugcacaucgugaucaagagaggcuggaaggagggcaccaagaucaccuuccccaaggagggcgacgccacccccgacaacauccccgccgacaucguguucgugcugaaggacaagccccacgcccacuucagaagagacggcaccaacgugcuguacagcgcccugaucagccugaaggaggcccugugcggcugcaccgugaacauccccaccaucgacggcagagugaucccccugcccugcaacgacgugaucaagcccggcaccgugaagagacugagaggcgagggccugcccuuccccaaggugcccacccagagaggcgaccugaucguggaguucaaggugagauuccccgacagacugaccccccagaccagacagauccugaagcagcaccugcccugcagcuaa

SEQ ID NO: 16216 - RNA, 726 nt, Artificial Sequence
  DNAJB6__Homo_sapiens__NP_005485
augguggacuacuacgaggugcugggcgugcagagacacgccagccccgaggacaucaagaaggccuacagaaagcuggcccugaaguggcaccccgacaagaaccccgagaacaaggaggaggccgagagaaaguucaagcagguggccgaggccuacgaggugcugagcgacgccaagaagagagacaucuacgacaaguacggcaaggagggccugaacggcggcggcggcggcggcagccacuucgacagccccuucgaguucggcuucaccuucagaaaccccgacgacguguucagagaguucuucggcggcagagaccccuucagcuucgacuucuucgaggaccccuucgaggacuucuucggcaacagaagaggccccagaggcagcagaagcagaggcaccggcagcuucuucagcgccuucagcggcuuccccagcuucggcagcggcuucagcagcuucgacaccggcuucaccagcuucggcagccugggccacggcggccugaccagcuucagcagcaccagcuucggcggcagcggcaugggcaacuucaagagcaucagcaccagcaccaagauggugaacggcagaaagaucaccaccaagagaaucguggagaacggccaggagagaguggagguggaggaggacggccagcugaagagccugaccaucaacggcaaggagcagcugcugagacuggacaacaaguaa

SEQ ID NO: 16217 - RNA, 930 nt, Artificial Sequence
  DNAJB7__Homo_sapiens__NP_660157
augguggacuacuacgaggugcugggccugcagagauacgccagccccgaggacaucaagaaggccuaccacaagguggcccugaaguggcaccccgacaagaaccccgagaacaaggaggaggccgagagaaaguucaaggagguggccgaggccuacgaggugcugagcaacgacgagaagagagacaucuacgacaaguacggcaccgagggccugaacggcggcggcagccacuucgacgacgagugcgaguacggcuucaccuuccacaagcccgacgacguguucaaggagaucuuccacgagagagaccccuucagcuuccacuucuucgaggacagccuggaggaccugcugaacagacccggcagcagcuacggcaacagaaacagagacgccggcuacuucuucagcaccgccagcgaguaccccaucuucgagaaguucagcagcuacgacaccggcuacaccagccagggcagccugggccacgagggccugaccagcuucagcagccuggccuucgacaacagcggcauggacaacuacaucagcgugaccaccagcgacaagaucgugaacggcagaaacaucaacaccaagaagaucaucgagagcgaccaggagagagaggccgaggacaacggcgagcugaccuucuuccuggugaacagcguggccaacgaggagggcuucgccaaggagugcagcuggagaacccagagcuucaacaacuacagccccaacagccacagcagcaagcacgugagccaguacaccuucguggacaacgacgagggcggcaucagcugggugaccagcaacagagacccccccaucuucagcgccggcgugaaggagggcggcaagagaaagaagaagaagagaaaggaggugcagaagaagagcaccaagagaaacugcuaa

SEQ ID NO: 16218 - RNA, 699 nt, Artificial Sequence
  DNAJB8__Homo_sapiens__NP_699161
auggccaacuacuacgaggugcugggcgugcaggccagcgccagccccgaggacaucaagaaggccuacagaaagcuggcccugagauggcaccccgacaagaaccccgacaacaaggaggaggccgagaagaaguucaagcuggugagcgaggccuacgaggugcugagcgacagcaagaagagaagccuguacgacagagccggcugcgacagcuggagagccggcggcggcgccagcacccccuaccacagccccuucgacaccggcuacaccuucagaaaccccgaggacaucuucagagaguucuucggcggccuggaccccuucagcuucgaguucugggacagccccuucaacagcgacagaggcggcagaggccacggccugagaggcgccuucagcgccggcuucggcgaguuccccgccuucauggaggccuucagcagcuucaacaugcugggcugcagcggcggcagccacaccaccuucagcagcaccagcuucggcggcagcagcagcggcagcagcggcuucaagagcgugaugagcagcaccgagaugaucaacggccacaaggugaccaccaagagaaucguggagaacggccaggagagaguggagguggaggaggacggccagcugaagagcgugaccgugaacggcaaggagcagcugaaguggauggacagcaaguaa

SEQ ID NO: 16219 - RNA, 672 nt, Artificial Sequence
  DNAJB9__Homo_sapiens__NP_036460
auggccaccccccagagcaucuucaucuucgccaucugcauccugaugaucaccgagcugauccuggccagcaagagcuacuacgacauccugggcgugcccaagagcgccagcgagagacagaucaagaaggccuuccacaagcuggccaugaaguaccaccccgacaagaacaagagccccgacgccgaggccaaguucagagagaucgccgaggccuacgagacccugagcgacgccaacagaagaaaggaguacgacacccugggccacagcgccuucaccagcggcaagggccagagaggcagcggcagcagcuucgagcagagcuucaacuucaacuucgacgaccuguucaaggacuucggcuucuucggccagaaccagaacaccggcagcaagaagagauucgagaaccacuuccagaccagacaggacggcggcagcagcagacagagacaccacuuccaggaguucagcuucggcggcggccuguucgacgacauguucgaggacauggagaagauguucagcuucagcggcuucgacagcaccaaccagcacaccgugcagaccgagaacagauuccacggcagcagcaagcacugcagaaccgugacccagagaagaggcaacauggugaccaccuacaccgacugcagcggccaguaa

SEQ ID NO: 16220 - RNA, 2244 nt, Artificial Sequence
  DNAJC10__Homo_sapiens__NP_001258510
augggcguguggcugaacaaggacgacuacaucagagaccugaagagaaucauccugugcuuccugaucguguacauggccauccuggugggcaccgaccaggacuucuacagccugcugggcgugagcaagaccgccagcagcagagagaucagacaggccuucaagaagcuggcccugaagcugcaccccgacaagaaccccaacaaccccaacgcccacggcgacuuccugaagaucaacagagccuacgaggugcugaaggacgaggaccugagaaagaaguacgacaaguacggcgagaagggccuggaggacaaccagggcggccaguacgagagcuggaacuacuacagauacgacuucggcaucuacgacgacgaccccgagaucaucacccuggagagaagagaguucgacgccgccgugaacagcggcgagcugugguucgugaacuucuacagccccggcugcagccacugccacgaccuggcccccaccuggagagacuucgccaaggagguggacggccugcugagaaucggcgccgugaacugcggcgacgacagaaugcugugcagaaugaagggcgugaacagcuaccccagccuguucaucuucagaagcggcauggcccccgugaaguaccacggcgacagaagcaaggagagccuggugagcuucgccaugcagcacgugagaagcaccgugaccgagcuguggaccggcaacuucgugaacagcauccagaccgccuucgccgccggcaucggcuggcugaucaccuucugcagcaagggcggcgacugccugaccagccagaccagacugagacugagcggcaugcuguuccugaacagccuggacgccaaggagaucuaccuggaggugauccacaaccugcccgacuucgagcugcugagcgccaacacccuggaggacagacuggcccaccacagauggcugcuguucuuccacuucggcaagaacgagaacagcaacgaccccgagcugaagaagcugaagacccugcugaagaacgaccacauccaggugggcagauucgacugcagcagcgcccccgacaucugcagcaaccuguacguguuccagcccagccuggccguguucaagggccagggcaccaaggaguacgagauccaccacggcaagaagauccuguacgacauccuggccuucgccaaggagagcgugaacagccacgugaccacccugggcccccagaacuuccccgccaacgacaaggagcccuggcugguggacuucuucgcccccuggugcccccccugcagagcccugcugcccgagcugagaagagccagcaaccugcuguacggccagcugaaguucggcacccuggacugcaccgugcacgagggccugugcaacauguacaacauccaggccuaccccaccaccgugguguucaaccagagcaacauccacgaguacgagggccaccacagcgccgagcagauccuggaguucaucgaggaccugaugaaccccagcguggugagccugacccccaccaccuucaacgagcuggugacccagagaaagcacaacgagguguggaugguggacuucuacagccccuggugccaccccugccaggugcugaugcccgaguggaagagaauggccagaacccugaccggccugaucaacgugggcagcaucgacugccagcaguaccacagcuucugcgcccaggagaacgugcagagauaccccgagaucagauucuucccccccaagagcaacaaggccuaccacuaccacagcuacaacggcuggaacagagacgccuacagccugagaaucuggggccugggcuuccugccccaggugagcaccgaccugaccccccagaccuucagcgagaaggugcugcagggcaagaaccacugggugaucgacuucuacgcccccuggugcggccccugccagaacuucgcccccgaguucgagcugcuggccagaaugaucaagggcaaggugaaggccggcaagguggacugccaggccuacgcccagaccugccagaaggccggcaucagagccuaccccaccgugaaguucuacuucuacgagagagccaagagaaacuuccaggaggagcagaucaacaccagagacgccaaggccaucgccgcccugaucagcgagaagcuggagacccugagaaaccagggcaagagaaacaaggacgagcuguaa

SEQ ID NO: 16221 - RNA, 597 nt, Artificial Sequence
  DNAJC12__Homo_sapiens__NP_068572
auggacgccauccugaacuacagaagcgaggacaccgaggacuacuacacccugcugggcugcgacgagcugagcagcguggagcagauccuggccgaguucaaggugagagcccuggagugccaccccgacaagcaccccgagaaccccaaggccguggagaccuuccagaagcugcagaaggccaaggagauccugaccaacgaggagagcagagccagauacgaccacuggagaagaagccagaugagcaugcccuuccagcagugggaggcccugaacgacagcgugaagaccagcaugcacuggguggugagaggcaagaaggaccugaugcuggaggagagcgacaagacccacaccaccaagauggagaacgaggagugcaacgagcagagagagagaaagaaggaggagcuggccagcaccgccgagaagaccgagcagaaggagcccaagccccuggagaagagcgugagcccccagaacagcgacagcagcggcuucgccgacgugaacggcuggcaccugagauucagauggagcaaggacgcccccagcgagcugcugagaaaguucagaaacuacgagaucuaa

SEQ ID NO: 16222 - RNA, 6732 nt, Artificial Sequence
  DNAJC13__Homo_sapiens__NP_056083
augaacaucaucagagagaacaaggaccuggccugcuucuacaccaccaagcacagcuggagaggcaaguacaagagaguguucagcgugggcacccacgccaucaccaccuacaaccccaacacccuggaggugaccaaccaguggcccuacggcgacaucugcagcaucagccccgugggcaagggccagggcaccgaguucaaccugaccuucagaaagggcagcggcaagaagagcgagacccugaaguucagcaccgagcacagaaccgagcugcugaccgaggcccugagauucagaaccgacuucagcgagggcaagaucaccggcagaagauacaacugcuacaagcaccacuggagcgacagcagaaagcccgugauccuggaggugacccccggcggcuucgaccagaucaaccccgccaccaacagagugcugugcagcuacgacuacagaaacaucgagggcuucguggaccugagcgacuaccagggcggcuucugcauccuguacggcggcuucagcagacugcaccuguucgccagcgagcagagagaggagaucaucaagagcgccaucgaccacgccggcaacuacaucggcaucagccugagaaucagaaaggagccccuggaguucgagcaguaccugaaccugagauucggcaaguacagcaccgacgagagcaucaccagccuggccgaguucguggugcagaagaucagccccagacacagcgagcccgugaagagagugcuggcccugaccgagaccugccugguggagagagaccccgccaccuacaacaucgccacccugaagccccugggcgagguguucgcccuggugugcgacagcgagaacccccagcuguucaccaucgaguucaucaagggccaggugagaaaguacagcagcaccgagagagacagccugcuggccagccugcuggacggcgugagagccagcggcaacagagacgugugcgugaagaugacccccacccacaagggccagagauggggccugcugagcaugcccguggacgaggagguggagagccugcaccugagauuccuggccaccccccccaacggcaacuucgccgacgccguguucagauucaacgccaacaucagcuacagcggcgugcugcacgccgugacccaggacggccuguucagcgagaacaaggagaagcugaucaacaacgccaucaccgcccugcugagccaggagggcgacgugguggccagcaacgccgagcuggagagccaguuccaggccgugagaagacugguggccagcaaggccggcuuccuggccuucacccagcugcccaaguucagagagagacugggcgugaagguggugaaggcccugaagagaagcaacaacggcaucauccacgccgccguggacaugcugugcgcccugaugugccccaugcacgacgacuacgaccugagacaggagcagcugaacaaggccagccugcugagcagcaagaaguuccuggagaaccugcuggagaaguucaacagccacguggaccacggcaccggcgcccuggugaucagcagccugcuggacuuccugaccuucgcccugugcgcccccuacagcgagaccaccgagggccagcaguucgacaugcugcuggagaugguggccagcaacggcagaacccuguucaagcuguuccagcaccccagcauggccaucaucaagggcgccggccuggugaugaaggccaucaucgaggagggcgacaaggagaucgccaccaagaugcaggagcuggcccugagcgagggcgcccugcccagacaccugcacaccgccauguucaccaucagcagcgaccagagaaugcugaccaacagacagcugagcagacaccuggugggccuguggaccgccgacaacgccaccgccaccaaccugcugaagagaauccugccccccggccugcuggccuaccuggagagcagcgaccuggugcccgagaaggacgccgacagaaugcacgugagagacaacgugaagaucgccauggaccaguacggcaaguucaacaaggugcccgaguggcagagacuggccggcaaggccgccaaggagguggagaaguucgccaaggagaagguggaccuggugcugaugcacuggagagacagaaugggcaucgcccagaaggagaacaucaaccagaagcccguggugcugagaaagagaagacagagaaucaagaucgaggccaacugggaccuguucuacuacagauucggccaggaccacgccagaagcaaccugaucuggaacuucaagaccagagaggagcugaaggacacccuggagagcgagaugagagccuucaacaucgacagagagcugggcagcgccaacgugaucagcuggaaccaccacgaguucgaggugaaguacgagugccuggccgaggagaucaagaucggcgacuacuaccugagacugcugcuggaggaggacgagaacgaggagagcggcagcaucaagagaagcuacgaguucuucaacgagcuguaccacagauuccugcugacccccaaggugaacaugaagugccugugccugcaggcccuggccaucguguacggcagaugccacgaggagaucggccccuucaccgacaccagauacaucaucggcaugcuggagagaugcaccgacaagcuggagagagacagacugauccuguuccugaacaagcugauccugaacaagaagaacgugaaggaccugauggacagcaacggcaucagaauccugguggaccugcugacccuggcccaccugcacgugagcagagccaccgugccccugcagagcaacgugaucgaggccgcccccgacaugaagagagagagcgagaaggagugguacuucggcaacgccgacaaggagagaagcggccccuacggcuuccacgagaugcaggagcuguggaccaagggcaugcugaacgccaagaccagaugcugggcccagggcauggacggcuggagaccccugcagagcaucccccagcugaaguggugccugcuggccagcggccaggccgugcugaacgagaccgaccuggccacccugauccugaacaugcugaucaccaugugcggcuacuuccccagcagagaccaggacaacgccaucaucagaccccugcccaaggugaagagacugcugagcgacagcaccugccugccccacaucauccagcugcugcugaccuucgaccccauccugguggagaagguggccauccugcuguaccacaucaugcaggacaacccccagcugcccagacuguaccugagcggcguguucuucuucaucaugauguacaccggcagcaacgugcugcccguggccagauuccugaaguacacccacaccaagcaggccuucaagagcgaggagaccaagggccaggacaucuuccagagaagcauccugggccacauccugcccgaggccauggugugcuaccuggagaacuacgagcccgagaaguucagcgagaucuuccugggcgaguucgacacccccgaggccaucuggagcagcgagaugagaagacugaugaucgagaagaucgccgcccaccuggccgacuucacccccagacugcagagcaacaccagagcccuguaccaguacugccccauccccaucaucaacuacccccagcuggagaacgagcuguucugcaacaucuacuaccugaagcagcugugcgacacccugagauuccccgacuggcccaucaaggaccccgugaagcugcugaaggacacccuggacgccuggaagaaggagguggagaagaagccccccaugaugagcaucgacgacgccuacgaggugcugaaccugccccagggccagggcccccacgacgagagcaagaucagaaaggccuacuucagacuggcccagaaguaccaccccgacaagaaccccgagggcagagacauguucgagaaggugaacaaggccuacgaguuccugugcaccaagagcgccaagaucguggacggccccgaccccgagaacaucauccugauccugaagacccagagcauccuguucaacagacacaaggaggaccugcagcccuacaaguacgccggcuaccccaugcugaucagaaccaucaccauggagaccagcgacgaccugcuguucagcaaggagagcccccugcugcccgccgccaccgagcuggccuuccacaccgugaacugcagcgcccugaacgccgaggagcugagaagagagaacggccuggaggugcugcaggaggccuucagcagaugcguggccgugcugaccagagccagcaagcccagcgacaugagcgugcaggugugcggcuacaucagcaagugcuacagcguggccgcccaguucgaggagugcagagagaagaucaccgagaugcccagcaucaucaaggaccugugcagagugcuguacuucggcaagagcauccccagaguggccgcccugggcguggagugcgugagcagcuucgccguggacuucuggcugcagacccaccuguuccaggccggcauccugugguaccugcugggcuuccuguucaacuacgacuacacccuggaggagagcggcauccagaagagcgaggagaccaaccagcaggagguggccaacagccuggccaagcugagcgugcacgcccugagcagacugggcggcuaccuggccgaggagcaggccacccccgagaaccccaccaucagaaagagccuggccggcaugcugacccccuacguggccagaaagcuggccguggccagcgugaccgagauccugaagaugcugaacagcaacaccgagagccccuaccugaucuggaacaacagcaccagagccgagcugcuggaguuccuggagagccagcaggagaacaugaucaagaagggcgacugcgacaagaccuacggcagcgaguucguguacagcgaccacgccaaggagcugaucgugggcgagaucuucgugagaguguacaacgaggugcccaccuuccagcuggaggugcccaaggccuucgccgccagccugcuggacuacaucggcagccaggcccaguaccugcacaccuucauggccaucacccacgccgccaagguggagagcgagcagcacggcgacagacugcccagaguggagauggcccuggaggcccugagaaacgugaucaaguacaaccccggcagcgagagcgagugcaucggccacuucaagcugaucuucagccugcugagagugcacggcgccggccaggugcagcagcuggcccuggagguggugaacaucgugaccagcaaccaggacugcgugaacaacaucgccgagagcauggugcugagcagccugcuggcccugcugcacagccugcccagcagcagacagcuggugcuggagacccuguacgcccugaccagcagcaccaagaucaucaaggaggccauggccaagggcgcccugaucuaccugcuggacauguucugcaacagcacccacccccaggugagagcccagaccgccgagcuguucgccaagaugaccgccgacaagcugaucggccccaaggugagaaucacccugaugaaguuccugcccagcguguucauggacgccaugagagacaaccccgaggccgccgugcacaucuucgagggcacccacgagaaccccgagcugaucuggaacgacaacagcagagacaaggugagcaccaccgugagagagaugaugcuggagcacuucaagaaccagcaggacaaccccgaggccaacuggaagcugcccgaggacuucgccgugguguucggcgaggccgagggcgagcuggccgugggcggcguguuccugagaaucuucaucgcccagcccgccugggugcugagaaagcccagagaguuccugaucgcccugcuggagaagcugaccgagcugcuggagaagaacaacccccacggcgagacccuggagacccugaccauggccaccgugugccuguucagcgcccagccccagcuggccgaccaggugcccccccugggccaccugcccaaggugauccaggccaugaaccacagaaacaacgccauccccaagagcgccaucagagugauccacgcccugagcgagaacgagcugugcgugagagccauggccagccuggagaccaucggcccccugaugaacggcaugaagaagagagccgacaccgugggccuggccugcgaggccaucaacagaauguuccagaaggagcagagcgagcugguggcccaggcccugaaggccgaccuggugcccuaccugcugaagcugcuggagggcaucggccuggagaaccuggacagccccgccgccaccaaggcccagaucgugaaggcccugaaggccaugaccagaagccugcaguacggcgagcaggugaacgagauccugugcagaagcagcguguggagcgccuucaaggaccagaagcacgaccuguucaucagcgagagccagaccgccggcuaccugaccggccccggcguggccggcuaccugaccgccggcaccagcaccagcgugaugagcaaccugcccccccccguggaccacgaggccggcgaccugggcuaccagaccuaa

SEQ ID NO: 16223 - RNA, 2109 nt, Artificial Sequence
  DNAJC14__Homo_sapiens__NP_115740
auggcccagaagcaccccggcgagagaggccuguacggcgcccaccacagcggcggcgccagccugagaacccugggccccagcguggaccccgagauccccagcuucagcggccugagagacagcgccggcaccgcccccaacggcaccagaugccugaccgagcacagcggccccaagcacacccagcaccccaaccccgcccacuggcuggaccccagccacggcccccccggcggccccggcccccccagagacgccgaggaccccgaccagagcgagaccagcagcgaggaggagagcggcguggaccaggagcugagcaaggagaacgagaccggcaaccagaaggacggcaacagcuuccugagcauccccagcgccugcaacugccagggcacccccggcauccccgagggccccuacagcgagggcggcaacggcagcagcagcaacuucugccaccacugcaccagccccgcccugggcgaggacgagcuggaggaggaguacgacgacgaggagagccugaaguuccccagcgacuucagcagagugagcagcggcaagaagccccccagcagaagacagagacacagauuccccaccaaggaggacaccagagagggcggcagaagagaccccagaagccccggcagacacagacugggcagaaagagaagccaggccgacaagagaaagggccugggccuguggggcgccgaggagcugugccagcugggccaggccggcuucugguggcugaucgagcugcuggugcuggugggcgaguacguggagaccugcggccaccugaucuacgccugcagacagcugaagagcagcgaccuggaccuguucagaguguggaugggcguguggaccggcagacugggcggcugggcccaggugauguuccaguuccugagccagggcuucuacugcggcgugggccuguucaccagauuccugaagcugcugggcgcccugcugcugcuggcccuggcccuguuccugggcuuccugcagcugggcuggagauuccuggugggccugggcgacagacugggcuggagagacaaggccaccuggcuguucagcuggcuggacagccccgcccugcagagaugccugacccugcugagagacagcagacccuggcagagacuggugagaaucgugcaguggggcuggcuggagcugcccugggugaagcagaacaucaacagacagggcaacgcccccguggccagcggcagauacugccagcccgaggaggagguggccagacugcugaccauggccggcgugcccgaggacgagcugaaccccuuccacgugcugggcguggaggccaccgccagcgacguggagcugaagaaggccuacagacagcuggccgugauggugcaccccgacaagaaccaccaccccagagccgaggaggccuucaaggugcugagagccgccugggacaucgugagcaacgccgagaagagaaaggaguacgagaugaagagaauggccgagaacgagcugagcagaagcgugaacgaguuccugagcaagcugcaggacgaccugaaggaggccaugaacaccaugaugugcagcagaugccagggcaagcacagaagauucgagauggacagagagcccaagagcgccagauacugcgccgagugcaacagacugcaccccgccgaggagggcgacuucugggccgagagcagcaugcugggccugaagaucaccuacuucgcccugauggacggcaagguguacgacaucaccgagugggccggcugccagagagugggcaucagccccgacacccacagagugcccuaccacaucagcuucggcagcagaauccccggcaccagaggcagacagagagccacccccgacgccccccccgccgaccugcaggacuuccugagcagaaucuuccaggugccccccggccagaugcccaacggcaacuucuucgccgccccccagcccgcccccggcgccgccgccgccagcaagcccaacagcaccgugcccaagggcgaggccaagcccaagagaagaaagaaggugagaagacccuuccagagauaa

SEQ ID NO: 16224 - RNA, 453 nt, Artificial Sequence
  DNAJC15__Homo_sapiens__NP_037370
auggccgccagaggcgugaucgcccccgugggcgagagccugagauacgccgaguaccugcagcccagcgccaagagacccgacgccgacguggaccagcagagacuggugagaagccugaucgccgugggccugggcguggccgcccuggccuucgccggcagauacgccuucagaaucuggaagccccuggagcaggugaucaccgagaccgccaagaagaucagcacccccagcuucagcagcuacuacaagggcggcuucgagcagaagaugagcagaagagaggccggccugauccugggcgugagccccagcgccggcaaggccaagaucagaaccgcccacagaagagugaugauccugaaccaccccgacaagggcggcagccccuacguggccgccaagaucaacgaggccaaggaccugcuggagaccaccaccaagcacuaa

SEQ ID NO: 16225 - RNA, 1077 nt, Artificial Sequence
  DNAJC18__Homo_sapiens__NP_689899
auggccgccacccugggcagcggcgagagauggaccgaggccuacaucgacgccgugagaagaaacaaguaccccgaggacaccccccccgagagccacgaccccugcggcugcugcaacugcaugaaggcccagaaggagaagaagagcgagaacgaguggacccagaccagacagggcgagggcaacagcaccuacagcgaggagcagcugcugggcgugcagagaaucaagaagugcagaaacuacuacgagauccugggcgugagcagagacgccagcgacgaggagcugaagaaggccuacagaaagcuggcccugaaguuccaccccgacaagaacugcgcccccggcgccaccgacgccuucaaggccaucggcaacgccuucgccgugcugagcaaccccgacaagagacugagauacgacgaguacggcgacgagcaggugaccuucaccgcccccagagccagacccuacaacuacuacagagacuucgaggccgacaucacccccgaggagcuguucaacguguucuucggcggccacuuccccaccggcaacauccacauguucagcaacgugaccgacgacaccuacuacuacagaagaagacacagacacgagagaacccagacccagaaggaggaggaggaggagaagccccagaccaccuacagcgccuucauccagcugcugcccgugcuggugaucgugaucaucagcgugaucacccagcugcuggccaccaacccccccuacagccuguucuacaagagcacccugggcuacaccaucagcagagagacccagaaccugcaggugcccuacuucguggacaagaacuucgacaaggccuacagaggcgccagccugcacgaccuggagaagaccaucgagaaggacuacaucgacuacauccagaccagcugcuggaaggagaagcagcagaagagcgagcugaccaaccuggccggccuguacagagacgagagacugaagcagaaggccgagagccugaagcuggagaacugcgagaagcugagcaagcugaucggccugagaagaggcggcuaa

SEQ ID NO: 16226 - RNA, 351 nt, Artificial Sequence
  DNAJC19__Homo_sapiens__NP_660304
auggccagcaccgugguggccgugggccugaccaucgccgccgccggcuucgccggcagauacgugcugcaggccaugaagcacauggagccccaggugaagcagguguuccagagccugcccaagagcgccuucagcggcggcuacuacagaggcggcuucgagcccaagaugaccaagagagaggccgcccugauccugggcgugagccccaccgccaacaagggcaagaucagagacgcccacagaagaaucaugcugcugaaccaccccgacaagggcggcagccccuacaucgccgccaagaucaacgaggccaaggaccugcuggagggccaggccaagaaguaa

SEQ ID NO: 16227 - RNA, 1665 nt, Artificial Sequence
  DNAJC1__Homo_sapiens__NP_071760
augaccgcccccugcagccagcccgcccagcugcccggcagaagacagcugggccuggugcccuuccccccccccccccccagaaccccccugcuguggcugcugcugcugcugcuggccgccguggcccccgccagaggcugggagagcggcgaccuggagcuguucgaccugguggaggaggugcagcugaacuucuaccaguuccugggcgugcagcaggacgccagcagcgccgacaucagaaaggccuacagaaagcugagccugacccugcaccccgacaagaacaaggacgagaacgccgagacccaguucagacagcugguggccaucuacgaggugcugaaggacgacgagagaagacagagauacgacgacauccugaucaacggccugcccgacuggagacagcccguguucuacuacagaagagugagaaagaugagcaacgccgagcuggcccugcugcuguucaucauccugaccgugggccacuacgccgugguguggagcaucuaccuggagaagcagcuggacgagcugcugagcagaaagaagagagagaagaagaagaagaccggcagcaagagcguggacgugagcaagcugggcgccagcgagaagaacgagagacugcugaugaagccccaguggcacgaccugcugcccugcaagcugggcaucugguucugccugacccugaaggcccugccccaccugauccaggacgccggccaguucuacgccaaguacaaggagaccagacugaaggagaaggaggacgcccugaccagaaccgagcuggagacccugcagaagcagaagaaggugaagaagcccaagcccgaguuccccguguacaccccccuggagaccaccuacauccagagcuacgaccacggcaccagcaucgaggagaucgaggagcagauggacgacuggcuggagaacagaaacagaacccagaagaagcaggcccccgaguggaccgaggaggaccugagccagcugaccagaagcauggugaaguuccccggcggcacccccggcagaugggagaagaucgcccacgagcugggcagaagcgugaccgacgugaccaccaaggccaagcagcugaaggacagcgugaccugcagccccggcauggugagacugagcgagcugaagagcaccgugcagaacagcagacccaucaagaccgccaccacccugcccgacgacaugaucacccagagagaggacgccgagggcguggccgccgaggaggagcaggagggcgacagcggcgagcaggagaccggcgccaccgacgccagacccagaagaagaaagcccgccagacugcuggaggccaccgccaagcccgagcccgaggagaagagcagagccaagagacagaaggacuucgacaucgccgagcagaacgagagcagcgacgaggagagccugagaaaggagagagccagaagcgccgaggagcccuggacccagaaccagcagaagcugcuggagcuggcccugcagcaguaccccagaggcagcagcgacagaugggacaagaucgccagaugcgugcccagcaagagcaaggaggacugcaucgccagauacaagcugcugguggagcuggugcagaagaagaagcaggccaagagcuaa

SEQ ID NO: 16228 - RNA, 822 nt, Artificial Sequence
  DNAJC27__Homo_sapiens__NP_057628
auggaggccaacaugcccaagagaaaggagcccggcagaagccugagaaucaaggugaucagcaugggcaacgccgaggugggcaagagcugcaucaucaagagauacugcgagaagagauucgugagcaaguaccuggccaccaucggcaucgacuacggcgugaccaaggugcacgugagagacagagagaucaaggugaacaucuucgacauggccggccaccccuucuucuacgaggugagaaacgaguucuacaaggacacccagggcgugauccugguguacgacgugggccagaaggacagcuucgacgcccuggacgccuggcuggccgagaugaagcaggagcugggcccccacggcaacauggagaacaucaucuucguggugugcgccaacaagaucgacugcaccaagcacagaugcguggacgagagcgagggcagacugugggccgagagcaagggcuuccuguacuucgagaccagcgcccagaccggcgagggcaucaacgagauguuccagaccuucuacaucagcaucguggaccugugcgagaacggcggcaagagacccaccaccaacagcagcgccagcuucaccaaggagcaggccgacgccaucagaagaaucagaaacagcaaggacagcugggacaugcugggcgugaagcccggcgccagcagagacgaggugaacaaggccuacagaaagcuggccgugcugcugcaccccgacaagugcguggcccccggcagcgaggacgccuucaaggccguggugaacgccagaaccgcccugcugaagaacaucaaguaa

SEQ ID NO: 16229 - RNA, 1167 nt, Artificial Sequence
  DNAJC28__Homo_sapiens__NP_060303
augaacaccauguacgugaugauggcccagauccugagaagccaccugaucaaggccaccgugauccccaacagagugaagaugcugcccuacuucggcaucaucagaaacagaaugaugagcacccacaagagcaagaagaagaucagagaguacuacagacugcugaacguggaggagggcugcagcgccgacgaggugagagagagcuuccacaagcuggccaagcaguaccaccccgacagcggcagcaacaccgccgacagcgccaccuucaucagaaucgagaaggccuacagaaaggugcugagccacgugaucgagcagaccaacgccagccagagcaagggcgaggaggaggaggacguggagaaguucaaguacaagaccccccagcacagacacuaccugagcuucgagggcaucggcuucggcacccccacccagagagagaagcacuacagacaguucagagccgacagagccgccgagcaggugauggaguaccagaagcagaagcugcagagccaguacuuccccgacagcgugaucgugaagaacaucagacagagcaagcagcagaagaucacccaggccaucgagagacugguggaggaccugauccaggagagcauggccaagggcgacuucgacaaccugagcggcaagggcaagccccugaagaaguucagcgacugcagcuacaucgaccccaugacccacaaccugaacagaauccugaucgacaacggcuaccagcccgaguggauccugaagcagaaggagaucagcgacaccaucgagcagcugagagaggccauccuggugagcagaaagaagcugggcaaccccaugacccccaccgagaagaagcaguggaaccacgugugcgagcaguuccaggagaacaucagaaagcugaacaagagaaucaacgacuucaaccugaucgugcccauccugaccagacagaaggugcacuucgacgcccagaaggagaucgugagagcccagaagaucuacgagacccugaucaagaccaaggaggugaccgacagaaaccccaacaaccuggaccagggcgagggcgagaagacccccgagaucaagaagggcuuccugaacuggaugaaccuguggaaguucaucaagaucagaagcuucuaa

SEQ ID NO: 16230 - RNA, 1707 nt, Artificial Sequence
  DNAJC2__Homo_sapiens__NP_001123359
augcugcugcugcccagcgccgccgacggcagaggcaccgccaucacccacgcccugaccagcgccagcacccugugccagguggagcccgugggcagaugguucgaggccuucgugaagagaagaaacagaaacgccagcgccagcuuccaggagcuggaggacaagaaggagcugagcgaggagagcgaggacgaggagcugcagcuggaggaguuccccaugcugaagacccuggaccccaaggacuggaagaaccaggaccacuacgccgugcugggccugggccacgugagauacaaggccacccagagacagaucaaggccgcccacaaggccauggugcugaagcaccaccccgacaagagaaaggccgccggcgagcccaucaaggagggcgacaacgacuacuucaccugcaucaccaaggccuacgagaugcugagcgaccccgugaagagaagagccuucaacagcguggaccccaccuucgacaacagcgugcccagcaagagcgaggccaaggacaacuucuucgagguguucacccccguguucgagagaaacagcagauggagcaacaagaagaacgugcccaagcugggcgacaugaacagcagcuucgaggacguggacaucuucuacagcuucugguacaacuucgacagcuggagagaguucagcuaccuggacgaggaggagaaggagaaggccgagugcagagacgagagaagauggaucgagaagcagaacagagccaccagagcccagagaaagaaggaggagaugaacagaaucagaacccugguggacaacgccuacagcugcgaccccagaaucaagaaguucaaggaggaggagaaggccaagaaggaggccgagaagaaggccaaggccgaggccaagagaaaggagcaggaggccaaggagaagcagagacaggccgagcuggaggccgccagacuggccaaggagaaggaggaggaggaggugagacagcaggcccugcuggccaagaaggagaaggacauccagaagaaggccaucaagaaggagagacagaagcugagaaacagcugcaagaucgaggagaucaacgagcagaucagaaaggagaaggaggaggccgaggccagaaugagacaggccagcaagaacaccgagaagagcaccggcggcggcggcaacggcagcaagaacuggagcgaggacgaccugcagcugcugaucaaggccgugaaccuguuccccgccggcaccaacagcagaugggaggugaucgccaacuacaugaacauccacagcagcagcggcgugaagagaaccgccaaggacgugaucggcaaggccaagagccugcagaagcuggacccccaccagaaggacgacaucaacaagaaggccuucgacaaguucaagaaggagcacggcguggugccccaggccgacaacgccacccccagcgagagauucgagggccccuacaccgacuucacccccuggaccaccgaggagcagaagcugcuggagcaggcccugaagaccuaccccgugaacacccccgagagaugggagaagaucgccgaggccgugcccggcagaaccaagaaggacugcaugaagagauacaaggagcugguggagauggugaaggccaagaaggccgcccaggagcaggugcugaacgccagcagagccaagaaguaa

SEQ ID NO: 16231 - RNA, 1515 nt, Artificial Sequence
  DNAJC3__Homo_sapiens__NP_006251
augguggcccccggcagcgugaccagcagacugggcagcguguuccccuuccugcuggugcugguggaccugcaguacgagggcgccgagugcggcgugaacgccgacguggagaagcaccuggagcugggcaagaagcugcuggccgccggccagcuggccgacgcccugagccaguuccacgccgccguggacggcgaccccgacaacuacaucgccuacuacagaagagccaccguguuccuggccaugggcaagagcaaggccgcccugcccgaccugaccaaggugauccagcugaagauggacuucaccgccgccagacugcagagaggccaccugcugcugaagcagggcaagcuggacgaggccgaggacgacuucaagaaggugcugaagagcaaccccagcgagaacgaggagaaggaggcccagagccagcugaucaagagcgacgagaugcagagacugagaagccaggcccugaacgccuucggcagcggcgacuacaccgccgccaucgccuuccuggacaagauccuggaggugugcgugugggacgccgagcugagagagcugagagccgagugcuucaucaaggagggcgagcccagaaaggccaucagcgaccugaaggccgccagcaagcugaagaacgacaacaccgaggccuucuacaagaucagcacccuguacuaccagcugggcgaccacgagcugagccugagcgaggugagagagugccugaagcuggaccaggaccacaagagaugcuucgcccacuacaagcaggugaagaagcugaacaagcugaucgagagcgccgaggagcugaucagagacggcagauacaccgacgccaccagcaaguacgagagcgugaugaagaccgagcccagcaucgccgaguacaccgugagaagcaaggagagaaucugccacugcuucagcaaggacgagaagcccguggaggccaucagagugugcagcgaggugcugcagauggagcccgacaacgugaacgcccugaaggacagagccgaggccuaccugaucgaggagauguacgacgaggccauccaggacuacgagaccgcccaggagcacaacgagaacgaccagcagaucagagagggccuggagaaggcccagagacugcugaagcagagccagaagagagacuacuacaagauccugggcgugaagagaaacgccaagaagcaggagaucaucaaggccuacagaaagcuggcccugcaguggcaccccgacaacuuccagaacgaggaggagaagaagaaggccgagaagaaguucaucgacaucgccgccgccaaggaggugcugagcgaccccgagaugagaaagaaguucgacgacggcgaggacccccuggacgccgagagccagcagggcggcggcggcaaccccuuccacagaagcuggaacagcuggcagggcuucaaccccuucagcagcggcggccccuucagauucaaguuccacuucaacuaa

SEQ ID NO: 16232 - RNA, 597 nt, Artificial Sequence
  DNAJC5__Homo_sapiens__NP_079495
auggccgaccagagacagagaagccugagcaccagcggcgagagccuguaccacgugcugggccuggacaagaacgccaccagcgacgacaucaagaagagcuacagaaagcuggcccugaaguaccaccccgacaagaaccccgacaaccccgaggccgccgacaaguucaaggagaucaacaacgcccacgccauccugaccgacgccaccaagagaaacaucuacgacaaguacggcagccugggccuguacguggccgagcaguucggcgaggagaacgugaacaccuacuucgugcugagcagcuggugggccaaggcccuguucguguucugcggccugcugaccugcugcuacugcugcugcugccugugcugcugcuucaacugcugcugcggcaagugcaagcccaaggcccccgagggcgaggagaccgaguucuacgugagccccgaggaccuggaggcccagcugcagagcgacgagagagaggccaccgacacccccaucgugauccagcccgccagcgccaccgagaccacccagcugaccgccgacagccaccccagcuaccacaccgacggcuucaacuaa

SEQ ID NO: 16233 - RNA, 1317 nt, Artificial Sequence
  DNAJC7__Homo_sapiens__NP_001138238
augugccccaagaacgccagcuacuacggcaacagagccgccacccugaugaugcugggcagauucagagaggcccugggcgacgcccagcagagcgugagacuggacgacagcuucgugagaggccaccugagagagggcaagugccaccugagccugggcaacgccauggccgccugcagaagcuuccagagagcccuggagcuggaccacaagaacgcccaggcccagcaggaguucaagaacgccaacgccgugauggaguacgagaagaucgccgagaccgacuucgagaagagagacuucagaaaggugguguucugcauggacagagcccuggaguucgcccccgccugccacagauucaagauccugaaggccgagugccuggccaugcugggcagauaccccgaggcccagagcguggccagcgacauccugagaauggacagcaccaacgccgacgcccuguacgugagaggccugugccuguacuacgaggacugcaucgagaaggccgugcaguucuucgugcaggcccugagaauggcccccgaccacgagaaggccugcaucgccugcagaaacgccaaggcccugaaggccaagaaggaggacggcaacaaggccuucaaggagggcaacuacaagcuggccuacgagcuguacaccgaggcccugggcaucgaccccaacaacaucaagaccaacgccaagcuguacugcaacagaggcaccgugaacagcaagcugagaaagcuggacgacgccaucgaggacugcaccaacgccgugaagcuggacgacaccuacaucaaggccuaccugagaagagcccagugcuacauggacaccgagcaguacgaggaggccgugagagacuacgagaagguguaccagaccgagaagaccaaggagcacaagcagcugcugaagaacgcccagcuggagcugaagaagagcaagagaaaggacuacuacaagauccugggcguggacaagaacgccagcgaggacgagaucaagaaggccuacagaaagagagcccugaugcaccaccccgacagacacagcggcgccagcgccgaggugcagaaggaggaggagaagaaguucaaggaggugggcgaggccuucaccauccugagcgaccccaagaagaagaccagauacgacagcggccaggaccuggacgaggagggcaugaacaugggcgacuucgaccccaacaacaucuucaaggccuucuucggcggccccggcggcuucagcuucgaggccagcggccccggcaacuucuucuuccaguucggcuaa

SEQ ID NO: 16234 - RNA, 573 nt, Artificial Sequence
  DNAL1__Homo_sapiens__NP_113615
auggccaaggccaccaccaucaaggaggcccuggccagaugggaggagaagaccggccagagacccagcgaggccaaggagaucaagcuguacgcccagaucccccccaucgagaagauggacgccagccugagcaugcuggccaacugcgagaagcugagccugagcaccaacugcaucgagaagaucgccaaccugaacggccugaagaaccugagaauccugagccugggcagaaacaacaucaagaaccugaacggccuggaggccgugggcgacacccuggaggagcuguggaucagcuacaacuucaucgagaagcugaagggcauccacaucaugaagaagcugaagauccuguacaugagcaacaaccuggugaaggacugggccgaguucgugaagcuggccgagcugcccugccuggaggaccugguguucgugggcaacccccuggaggagaagcacagcgccgagaacaacuggaucgaggaggccaccaagagagugcccaagcugaagaagcuggacggcacccccgugaucaagggcgacgaggaggaggacaacuaa

SEQ ID NO: 16235 - RNA, 849 nt, Artificial Sequence
  DNASE1__Homo_sapiens__XP_011520696
augagaggcaugaagcugcugggcgcccugcuggcccuggccgcccugcugcagggcgccgugagccugaagaucgccgccuucaacauccagaccuucggcgagaccaagaugagcaacgccacccuggugagcuacaucgugcagauccugagcagauacgacaucgcccuggugcaggaggugagagacagccaccugaccgccgugggcaagcugcuggacaaccugaaccaggacgcccccgacaccuaccacuacguggugagcgagccccugggcagaaacagcuacaaggagagauaccuguucguguacagacccgaccaggugagcgccguggacagcuacuacuacgacgacggcugcgagcccugcggcaacgacaccuucaacagagagcccgccaucgugagauucuucagcagauucaccgaggugagagaguucgccaucgugccccugcacgccgcccccggcgacgccguggccgagaucgacgcccuguacgacguguaccuggacgugcaggagaaguggggccuggaggacgugaugcugaugggcgacuucaacgccggcugcagcuacgugagacccagccaguggagcagcaucagacuguggaccagccccaccuuccaguggcugauccccgacagcgccgacaccaccgccacccccacccacugcgccuacgacagaaucgugguggccggcaugcugcugagaggcgccguggugcccgacagcgcccugcccuucaacuuccaggccgccuacggccugagcgaccagcuggcccaggccaucagcgaccacuaccccguggaggugaugcugaaguaa

SEQ ID NO: 16236 - RNA, 900 nt, Artificial Sequence
  DNASE1L2__Homo_sapiens__NP_001288609
augggcggccccagagcccugcuggccgcccugugggcccuggaggccgccggcaccgccgcccugagaaucggcgccuucaacauccagagcuucggcgacagcaaggugagcgaccccgccugcggcagcaucaucgccaagauccuggccggcuacgaccuggcccuggugcaggaggugagagaccccgaccugagcgccgugagcgcccugauggagcagaucaacagcgugagcgagcacgaguacagcuucgugagcagccagccccugggcagagaccaguacaaggagauguaccuguucguguacagaaaggacgccgugagcgugguggacaccuaccuguaccccgaccccgaggacguguucagcagagagcccuucguggugaaguucagcgcccccggcaccggcgagagagcccccccccugcccagcagaagagcccugaccccccccccccugcccgccgccgcccagaaccuggugcugaucccccugcacgccgccccccaccaggccguggccgagaucgacgcccuguacgacguguaccuggacgugaucgacaaguggggcaccgacgacaugcuguuccugggcgacuucaacgccgacugcagcuacgugagagcccaggacugggccgccaucagacugagaagcagcgagguguucaaguggcugauccccgacagcgccgacaccaccgugggcaacagcgacugcgccuacgacagaaucguggccugcggcgccagacugagaagaagccugaagccccagagcgccaccgugcacgacuuccaggaggaguucggccuggaccagacccaggcccuggccaucagcgaccacuuccccguggaggugacccugaaguuccacagauaa

SEQ ID NO: 16237 - RNA, 828 nt, Artificial Sequence
  DNASE1L3__Homo_sapiens__NP_001243489
augagcagagagcuggccccccugcugcugcugcugcugagcauccacagcgcccuggccaugagaaucugcagcuucaacgugagaagcuucggcgagagcaagcaggaggacaagaacgccauggacgugaucgugaaggugaucaagagaugcgacaucauccuggugauggagaucaaggacagcaacaacagaaucugccccauccugauggagaagcugaacagagagaagcuggugagcgugaagagaagcuaccacuaccacgacuaccaggacggcgacgccgacguguucagcagagagcccuucguggugugguuccagagcccccacaccgccgugaaggacuucgugaucaucccccugcacaccacccccgagaccagcgugaaggagaucgacgagcugguggagguguacaccgacgugaagcacagauggaaggccgagaacuucaucuucaugggcgacuucaacgccggcugcagcuacgugcccaagaaggccuggaagaacaucagacugagaaccgaccccagauucguguggcugaucggcgaccaggaggacaccaccgugaagaagagcaccaacugcgccuacgacagaaucgugcugagaggccaggagaucgugagcagcguggugcccaagagcaacagcguguucgacuuccagaaggccuacaagcugaccgaggaggaggcccuggacgugagcgaccacuuccccguggaguucaagcugcagagcagcagagccuucaccaacagcaagaagagcgugacccugagaaagaagaccaagagcaagagaagcuaa

SEQ ID NO: 16238 - RNA, 462 nt, Artificial Sequence
  DNASE2B__Homo_sapiens__XP_011540180
augccccagcugugcaccagagccagcagcagcgagauccccggcagacugcugaccacccugcagagcgcccagggccagaaguuccugcacuucgccaagagcgacagcuuccuggacgacaucuucgccgccuggauggcccagagacugaagacccaccugcugaccgagaccuggcagagaaagagacaggagcugcccagcaacugcagccugcccuaccacguguacaacaucaaggccaucaagcugagcagacacagcuacuucagcagcuaccaggaccacgccaaguggugcaucagccagaagggcaccaagaacagauggaccugcaucggcgaccugaacagaagcccccaccaggccuucagaagcggcggcuucaucugcacccagaacuggcagaucuaccaggccuuccagggccuggugcuguacuacgagagcugcaaguaa

SEQ ID NO: 16239 - RNA, 1083 nt, Artificial Sequence
  DNASE2__Homo_sapiens__NP_001366
augaucccccugcugcuggccgcccugcugugcgugcccgccggcgcccugaccugcuacggcgacagcggccagcccguggacugguucgugguguacaagcugcccgcccugagaggcagcggcgaggccgcccagagaggccugcaguacaaguaccuggacgagagcagcggcggcuggagagacggcagagcccugaucaacagccccgagggcgccgugggcagaagccugcagccccuguacagaagcaacaccagccagcuggccuuccugcuguacaacgaccagcccccccagcccagcaaggcccaggacagcagcaugagaggccacaccaagggcgugcugcugcuggaccacgacggcggcuucuggcuggugcacagcgugcccaacuuccccccccccgccagcagcgccgccuacagcuggccccacagcgccugcaccuacggccagacccugcugugcgugagcuuccccuucgcccaguucagcaagaugggcaagcagcugaccuacaccuaccccuggguguacaacuaccagcuggagggcaucuucgcccaggaguuccccgaccuggagaacguggugaagggccaccacgugagccaggagcccuggaacagcagcaucacccugaccagccaggccggcgccguguuccagagcuucgccaaguucagcaaguucggcgacgaccuguacagcggcuggcuggccgccgcccugggcaccaaccugcaggugcaguucuggcacaagaccgugggcauccugcccagcaacugcagcgacaucuggcaggugcugaacgugaaccagaucgccuuccccggccccgccggccccagcuucaacagcaccgaggaccacagcaaguggugcgugagccccaagggccccuggaccugcgugggcgacaugaacagaaaccagggcgaggagcagagaggcggcggcacccugugcgcccagcugcccgcccuguggaaggccuuccagccccuggugaagaacuaccagcccugcaacggcauggccagaaagcccagcagagccuacaagaucuaa

SEQ ID NO: 16240 - RNA, 1062 nt, Artificial Sequence
  DND1__Homo_sapiens__NP_919225
augcagagcaagagagacugcgagcuguggugcgagagagugaaccccgagaacaaggccgcccuggaggccugggugagagagaccggcaucagacuggugcaggugaacggccagagaaaguacggcggccccccccccggcugggugggcagccccccccccgccggcagcgagguguucaucggcagacugccccaggacguguacgagcaccagcugaucccccuguuccagagagugggcagacuguacgaguucagacugaugaugaccuucagcggccugaacagaggcuucgccuacgccagauacagcagcagaagaggcgcccaggccgccaucgccacccugcacaaccacccccugagacccagcugcccccugcuggugugcagaagcaccgagaagugcgagcugagcguggacggccugccccccaaccugaccagaagcgcccugcugcuggcccugcagccccugggccccggccugcaggaggccagacugcugcccagccccggccccgcccccggccagaucgcccugcugaaguucagcagccacagagccgccgccauggccaagaaggcccugguggagggccagagccaccugugcggcgagcagguggccguggaguggcugaagcccgaccugaagcagagacugagacagcagcuggugggccccuuccugagaagcccccagcccgagggcagccagcuggcccuggccagagacaagcugggcuuccagggcgccagagccacccugcagcugcugugccagagaaugaagcugggcagccccguguuccugaccaagugccugggcaucggccccgccggcuggcacagauucugguaccagguggugauccccggccaccccgugcccuucagcggccugaucuggguggugcugacccuggacggcagagacggccacgagguggccaaggacgccgugagcgugagacugcugcaggcccugagcgagagcggcgccaaccugcuguggagcgccggcgccgaggccggcaccauggugaagcaguaa

SEQ ID NO: 16241 - RNA, 2214 nt, Artificial Sequence
  DNER__Homo_sapiens__NP_620711
augcagcccagaagagcccaggcccccggcgcccagcugcugcccgcccuggcccugcugcugcugcugcugggcgccggccccagaggcagcagccuggccaaccccgugcccgccgccccccugagcgcccccggccccugcgccgcccagcccugcagaaacggcggcgugugcaccagcagacccgagcccgacccccagcaccccgcccccgccggcgagcccggcuacagcugcaccugccccgccggcaucagcggcgccaacugccagcugguggccgaccccugcgccagcaaccccugccaccacggcaacugcagcagcagcagcagcagcagcagcgacggcuaccugugcaucugcaacgagggcuacgagggccccaacugcgagcaggcccugcccagccugcccgccaccggcuggaccgagagcauggcccccagacagcugcagcccgugcccgccacccaggagcccgacaagauccugcccagaagccaggccaccgugacccugcccaccuggcagcccaagaccggccagaaggugguggagaugaagugggaccagguggaggugauccccgacaucgccugcggcaacgccagcagcaacagcagcgccggcggcagacuggugagcuucgaggugccccagaacaccagcgugaagaucagacaggacgccaccgccagccugauccugcuguggaaggugaccgccaccggcuuccagcagugcagccugaucgacggcagaagcgugaccccccugcaggccagcggcggccuggugcugcuggaggagaugcuggcccugggcaacaaccacuucaucggcuucgugaacgacagcgugaccaagagcaucguggcccugagacugacccugguggugaaggugagcaccugcgugcccggcgagagccacgccaacgaccuggagugcagcggcaagggcaagugcaccaccaagcccagcgaggccaccuucagcugcaccugcgaggagcaguacgugggcaccuucugcgaggaguacgacgccugccagagaaagcccugccagaacaacgccagcugcaucgacgccaacgagaagcaggacggcagcaacuucaccugcgugugccugcccggcuacaccggcgagcugugccagagcaagaucgacuacugcauccuggaccccugcagaaacggcgccaccugcaucagcagccugagcggcuucaccugccagugccccgagggcuacuucggcagcgccugcgaggagaagguggaccccugcgccagcagccccugccagaacaacggcaccugcuacguggacggcgugcacuucaccugcaacugcagccccggcuucaccggccccaccugcgcccagcugaucgacuucugcgcccugagccccugcgcccacggcaccugcagaagcgugggcaccagcuacaagugccugugcgaccccggcuaccacggccuguacugcgaggaggaguacaacgagugccugagcgcccccugccugaacgccgccaccugcagagaccuggugaacggcuacgagugcgugugccuggccgaguacaagggcacccacugcgagcuguacaaggaccccugcgccaacgugagcugccugaacggcgccaccugcgacagcgacggccugaacggcaccugcaucugcgcccccggcuucaccggcgaggagugcgacaucgacaucaacgagugcgacagcaaccccugccaccacggcggcagcugccuggaccagcccaacggcuacaacugccacugcccccacggcugggugggcgccaacugcgagauccaccugcaguggaagagcggccacauggccgagagccugaccaacaugcccagacacagccuguacaucaucaucggcgcccugugcguggccuucauccugaugcugaucauccugaucgugggcaucugcagaaucagcagaaucgaguaccagggcagcagcagacccgccuacgaggaguucuacaacugcagaagcaucgacagcgaguucagcaacgccaucgccagcaucagacacgccagauucggcaagaagagcagacccgccauguacgacgugagccccaucgccuacgaggacuacagccccgacgacaagccccuggugacccugaucaagaccaaggaccuguaa

SEQ ID NO: 16242 - RNA, 14262 nt, Artificial Sequence
  DNHD1__Homo_sapiens__NP_653267
auggugcccgaggagagaagagugggccugagcagcgacgagaccagcagcgacagccugaagagcuggcacagcaucugcgugcuggacagcaaggagcagccccuggccugccagcagaagcagagacaguucgugaagcccgugaccgagagcgagcagcccaccgugcuggagcugcugcuggccgagcugagaacccuguucagcgccgugcugcaggacagcagccccgccgccuggagauaccugcacgccgugcugggccugcugccccccuacagagagcugcuggugggccaccuggaccugcugcccuuccuggagcagcuguacugcugggcccccugggugcagacccaccugcaccuggaccugcugggcgccaucgugcaggccuucccccccgacagcagccugcuggacagcgccagccacgccgacugcugcccccagaagagaagacugcaccacagaccccccugccccgccugccccuucgugcaggcccaguggagcagacagcaggugaaggaggagcuggccaccuggcugagaccccugacccugcccgagcugcagagaugccugggcaucgugggcgcccagguggcccuggaggaggccguguggcuggacggccugagccugcugccccuggcccuggccgccgacauccccgugagauacgagagcagcgacaccgacaacgccgagguggagcccgugggcagaaaggagaccagaagccagcuggacuacgaggugcccagagagaaggccuuccagaagagcagcaccggcuucagccccgagaccagcuuccuggacagccaggugaugaccgcccugaagauggagagauaccugaagaagauccacuuccuguaccugaacguggcccccagcagauacuucagacccuacagccugaugguggugccccccgacaaggugaaccccgagcacuacaucuucagccccuucggcauccugcacgugcaccccguggagggcagcgagaccaugacccugggcaccuggcaccaccacugcgugcuguggcagcagcugcaguucauccccuucuucaaguacugccugcugagaaagagcuucaccugcuggaagaagaacgugagacugcagggccugcacagacugcagaaguuccuggagaaccaccugcugcuggccgugccccacuucggcgccggccugcugcacaucagcagacugcugcaggagcugcacagcgugagcuggcugccccaggagcuggacagaugcuacgagcugcuggaccugcagaccgcccuggccgaggagaagcacaaggcccugagacugcugcacagaugccugaaccugugcaccagcauccugagacuggugcacgaggacaccuaccacaugcagcagugccugcaggagagagugcagaacugcgacagaaucagaaccggccagggcagcaucuaccugcagagagugcagcacaagcagcuggagcagaagcugaagcaggccgaggccugguggcugcagcugggcaaguucgccagacugguggacuacaugaucugccagagccugaucagcgugcuggaggagcagaucaccagcuucguggccaacauccugcaggcccccagacagaagcccuuccugagcagccagcugguguucgacgaccacggccagcugagccacgugcccugcguggagaacaugauccagacccugaccggcggccugcagagcgugaagaccagcgcccugcagguggugcagagcgccgaccugaagaccagcagcgacagccuguacagcgaggaggaggacgaggaggaggacagcaaggacgaguuccugaugcccaaguuccagggccagcccagcgacgccgugagcaucuucugcggccccaacgugggccugguguggcccuggaagagccaccccaucgccggcauccuggaggugagaggcugcagacugagaggccaguacuucccccacaacuacaagcagcuggaggaggaccuggacaacaaccccaagauccagcaggcccugaacauccagcaggugcugcuggagggcgugcugugcaaggugcaggaguucugcagagagcaccacuggaucaccggcaucuacgaguuccugcagagcuggggcccccagaagcuggaggacaugagaggcggccccaucaagaacuacgugacccuggugagcagacugaacguguggcaggccagagugagcagcaugcccaucgagcugcugaccaagggcggccugcugcugcugagcugccacgacgugcaggccgagauggagagcaagcugaacagcaucagaaaggacauccuggcccacgugcagaacgagugcuggaaccugagccagcagcugaugaccgagcugaccgacuucaugcacaucuucagaaccaucaacagcgacauccacgccaucgcccagugcacccagaagcugaacgaggccaacgagcaguacguggagcuggaggagagaauggaguacgugagagcccugcacgagcugaucagaaaccacuucagccuguucagcgccgagaacgaggcccuggacaucagcgugagaagacaguucggcgagagccccaucccccccugccccccccccccccagccccaccugcugcacugcccccugcuggccccccagcugcuggacaugugggaggccuuccaguucgagaagagccaggccagcgaguuccugcugagcaagagacacgccaucaugcccaagcugcagcagcugauggccgccgcccuggccgagcuggagggccugcuggccaaggcccugagcggccccuucauggaccccacccaggaccagagaagcaccgagcaccagcuggugagccuggagagacaguuccagaacaccgugagcgaccugagcgagcugcaccacgccuacgccaucuucaccgaggacgagacccccgugccccugcccaucugcggcaccagacccaucgugcagcagcagagaaucuggcaccuguacagagugaucagcgagaacaucagcgaguggaagugcauggccuucgccaaguucagccccgccauggcccaggagaagaccgagggcuggcugaccgaggccgccagaaugagcaccacccuggagcugcacagccccgugcugcagcacugcaugagaauccugggcgaguucagaagcuaccugccccugcugaccaagcugggcagccugcacccccagagccugaacugccagugccugcugagagcccugggccugggcagccugcagaccaucgagcugcugacccugggccagcugcugaccuacccccugcuggaguucgccgacagaaucaaccagguguggcagaacgagaacgagagaauccacgcccaggagaccaucagaagacugcagagauacugggaggccagacagcugagacugcugaacuucauccugcacgugcccuacgagccccccgccagcgagagaagcaagagacaggugcugagaagcccccagugggaggugguggacaaggacagcggcaccuucauccugagcgacuacagcaaccugcaggacagcauccaggagagccugcaggugcugagcaagauccuggccaucgagaagagcggcgaccugaacaagaucgcccuggaguggguggccaucaugcacggccugggcgcccugcuggagguguggcugaccuuccagcagaaguggaucuuccugaacaaggugcugcacgagaugaagauccaguuccccaacgccgaccugaacagcagauucaaggugauggacgaccaguacagaacccugaugagaaucagcguggccgaccccauggugcugagccugguggugcccagcgccgagagaagccccuacuuccagggccagcagcugcagcagcugcugcaggccggcagcguggagcuggagggcaucaucaugagccuggagagcgugcuguacggcgugugcgcccacuuccccagacuguucuuccugagcgacagcgagcugguggcccugcuggccgccagacuggagagcugcgaggcccagcugugggugagaagaugcuucccccacgugcacgccgugagcuucagaagcugccccaccggcgagaagaacaccgacgacugggagagcagccccaacacccagacccagguggaggcccuggccgugcugggcgccggcggcgaggaggugaagcugcagggcccccugccccugcaccccgaccugcccaaguggcuggccagccuggagaagugccugagacuggcccuggugcacaugcugcagggcugcguggccgccagacuggccagaggccccagccugggcgaggcccugaagcagcugcccaagcagaacaagcuguaccugcagcuguacgugcagcacuggaucgaccuggugcaggccuuccccuggcagugcgugcugguggccgaggaggugguguggagagccgagauggaggaggcccugcuggaguggggcacccuggccauggugagcaugcacaugagaaagcuggaggugcuggugaacuucaugagagcccagagagccagccagggcggccagagccugcccagcgugagacagaccagccugcugagcgcccugcuggugauggccgugacccacagagacaucgcccagcugcuggagcagcaccaggugagcgaccugaccgacuuccacugggugagacagcugaaguaccaccugggcagcccccacaucauccccaagagcccccugcagagccugaagaccaucgccagcagcgagcccagccugagccccgccgccugcuggaucgacgugcugggcagaagcuuccuguacaacuacgaguaccugggccccagacugggcccccugcccagccugcugcccgagagacccgcccuggugcugcugcuggcccuggaggagguggccugcggcaccgugcugggccccaacggcgugggcaagagagccaucgugaacagccuggcccaggcccugggcagacagcuggugaugcugcccugcagcccccagaucgaggcccagugccugagcaacuaccugaacggcgcccugcagggcggcgccuggcugcugcuggagaaggugcaccagcugccccccggccugcugagcgcccugggccagagacugggcgagcugcaccaccuguacgccccccuguaccaggaggccagcagaaacaccagcaccaucgaccccacccagccccagcugcugggcagcagcuucuucgagaagcaccacgugagcgugagacugggcuacggcugccugcuggugcugagagcccugagcagcgccgugcccgccaaccugcaccugcugcugagacccguggcccuggcccugcccgaccugagacagguggccgagcugacccugcugggcgccggcaugagagacgccuuccagauggccaccagacugagcaaguucuucagccuggagagagagcuggugagcggcccccugcccugcagacugccccugcugaagcagauccuggaggacaccaucagaacccugaacgugaccaaggaggagcccaagugccagaagcccagaagccuggccgccaucgaggaggccgcccugcugagaagcccccuguucagcauccugaacggccugcaccugcacaaccugagaggccugcugugcgcccuguuccccagcgccagccaggugcuggccgagcccaugaccuacaagcugaugaagccccuggugguggaggagcugcagcaggugggccuggaccccagccccgacauccugggcagccuggagcagcugagccaggcccugagcagagccagcggcauccugcugcugggccccgccggcagcggcaagaccaccugcuggcacagccuguucaagauccagaacagacuggccgccauggaggacaccagcacccagggcugccagcccguggagaucacccaccuguaccccagcggccugagcccccaggaguuccugggcuggcuggagggcagcugcuggcaccacggcaucuuccccaaggugcugagagccgccggccagugcaacaacaugggccagaagagacagaccgaggagagcaucggcauccagcacuggaucaucugcgacggcgccagcaacggcgccuggcuggacagcaucaccugccugcugagcgagcugccccagcugagccugcccagcggccagcagaucgccagaccccccggcaccuuccugcugauggagguggccgacaccaccggcaucagccccaccguggugggcugcugcgcccugguguggugcggcggcgagcagaccuggcagugcauccugagcgcccugauggccagccugcccuacgaguacagacugcagcacagaaccguggccgagcugaaccacauggccgaggugcuggugcccgccacccugagauuccugaccugccagggcgugagcagccugcugcaggugcacggccagcaggccgugugcgccggcguggccgaggugaccagcauggccagaauccugcacagccugcuggaccugcaccugagacugaaggaggagaaggcccccggccccgaggaccugagcuacagcgaccccguggcccagagcuucagaagcagcaagagcagcuuccugaacagaagccagguggacagcgacgacgugcccgacaagugcagagagcaccugcuggccgugagcagcuuccuguucgcccugaucuggggcuucggcgcccaccugcccagcagauucuggcccaucuucgacaccuucaucagagacagcaucagcagacugagcaacuaccccgagcccccccccagcgcccugguguucgaccugcacgugagccccgaggacggcacccuggugcccuucaccggccaguaccugagcagccacaucaagggcacccugggcaccuuccaccccagcauccagaccgagagacugcuguacgugguggaccugcugcugagcggcggccagcccgugcugcuggccggcgaggccgccaccggcaagagcgccuucguggaggugcugguggagccccaccaccccuacaucuacagccccauccaccccgccuucagcagcagccaccugagacugcugcugagcagaggcauccagggccagacccaggccagcccccagcccggccaccaccaggacagcaagcccagccugcuguuccugcuggaggaccugcaccuggccaccagcgaccccgagaagagcugccagcccgugcuggagacccugagacaggccauggacggcaccguguacgcccacagcacccuggagcugcagacccugcagcccaccgugaacuuccuggccaccgugaccgugcccggcuacugcgagagaccccugugccccagacuguucagacuguucaccgugcuggcccuggagagcaugacccaggccacccugcuggagagacacgugcccaucauccaggccuggcuggagagauuccccagcguggagagagagagagcccuggccagaggccuggugagagccagcguggaggccugggaggccgugugcaacugcuucaugcccagcccccugcacccccacuaccacuucagccugcacagcgugagccaccugcugagcagccugcagcugcugcccaacagaaccggcagcagaggcuucguggacuaccccaaccaccaggagcaccugagaagagugagcggccugagaggcaccugccugaccgugaugauggccaccagaaacguggugagacuguggcugcacgaggcccagagaaccuucugcgacagacuggacagccccagagagagaagcuacugcgccaagcugcugcuggugguggcccagagcguguucugcugcggccccggcccccagcaccugggcaaggaccaccaggagagcgaggaggaggaggaggaggagagagugcccgagguggagagcgagggcgagcuggcccagugggaggacuucagcaacagcaacagcgagaccgaggaggaggaggagcccuacggccugcagguggccagagugagcaacagcagagaccccagccugacccccagcaucggccccgugagcagaggcaugaaggagagcaucagccacaagaucagacaggagaagggcaccagagccagcaacuacagacugcaggugagaagaagcuucaagaccugguggcagaagaagccccagauggaccugaucagcccccugcugcugcccgugcugcugcugcacccccaggagaagcccagcgaccugguguucagccaggagcugauccugggccccaacagcgagacccccaaccuguaccuggagagacagugggagaagcuggaggagcagcuggccaccagcgccgcccagcugaagcugagcccccaccuggccagaugccacagcauggcccagcacguggccagacuggugagagugcuggccagacccagacagcacggccugcugcugagcggcgcccugggcaccggcagacacaccgccaucacccuggccagcagcaucugccaggcccacuucuuccaccugcccagcggcagcgaggaggccauccugcagugccugagagacgccagcuggcacgccggcaugcugagccagcccguggcccugcuggugcccagcggcguggaccugaccacccugcacagacugcuggcccuggccaccagcggcagcuuccccggccaguacaccgaggccgaccuggacagaaucggcgagcaccugcccagagagaaccugggcgugaagcagaacaucaagaaggagauggugcugcagagauuccaccagcaggugugcagccaccugcaccuguucuuccugaucggcgacaagcaggcccacaagcagcugcccagcacccuguuccugagacugcugcagcuggccaccgccagcaucgacagauacgagcccugggaccaggccgcccuggccaagguggcccagcaccaccuggagggcgcccagagcgugccccuggacgacggcagcuggaaguaccccgaccugcaggccagcauccccagcguggccaaggccauggcccugauccaccugagcgccacccacuaccacgagcaccugugccccgcccugccccuggugacccccaagaccuuccuggacuuccuggacaccuuccugaugcugcagcagcagaccauccugaagaucaagaacaaggcccagagagugcagaacgcccuggagaaccugagaaugcugaucaaggagcacggcacccacgccaaccugaucuucgaccuggagcagcagcugaaggacagcggcaagagccugagcauguuccagcagcagcuggagcagagcaagcugcuguacaagcagcagcuggaggagugcagacaccaggagaaccugaucgagaaccuggccagacagagagacgcccugcaggcccagagagaggccuuccuggagcagaugagcaaggccuuccuggagccccugagccagcugcagguggccgacuucgaggagaucagaagcuacagagccccccccgagagcguggugagagugaccgacgccaugugcgaccuguuccaccacgagaccggcugggccagcgccaagcagcugcugugcaccgaggacuucuaccaggagcugguguucuuccccaaggagaagaucaccgacagcgagcugaucaagcugcaccugauccugaaggcccccggcauggacgacgccgcccugagagccgugagcagacccgccgccagccuggccgccuggcugugggccgugcugcacuacggccuggcccacugcagaggccugcccaccgaccugcugcugcagcagguggaggccacccugaccagagagcaggccagacugggcuacuaccaguuccaggcccaggagacccuggagcacaaccuggcccuggccaagaugguggaggacgcccaggccagccacaacugcguggccaagacccugagccaggcccagugcggccaguaccacaaguggcccaugaaggccgcccugcugacccccaugagagccuggaccacccagcugcagaagcugaagggcagaugcaugaccguguucggcgacacccugcugugcagcgccgccaucaucuaccugggccccuuccccccccugagaagacaggagcugcuggacgaguggcuggcccugugcagaggcuuccaggaggcccugggccccgacgacguggcccaggcccugaagagaaagcagaagagcgugagcaucccccccaagaacccccugcuggccacccacagccccuucagcauccugagccugcugagcagcgagagcgagcaguaccagugggacggcaaccugaagccccaggccaagagcgcccaccuggccggccugcugcugagaagccccacccacuacagcagcugcagauggccccugcugcuggaccccagcaacgaggcccugaucuggcuggacccccugccccuggaggagaacagaagcuucgcccccgcccugaccgagggcagaggcaagggccugaugagaaaccagaagagagagagcaagaccgacaugaaggaggaggacgacgagagcgaggagagcaacgaggccgaggaccagaccaaggagcagaaggccgaggagagaaagaacgagcaggagaaggagcaggaggagaacgaggagaaggaggaggagaagaccgagagccagggcagcaagcccgccuacgagacccagcugcccagccugcccuaccugagcgugcugagcggcgccgaccccgagcugggcagccagcugcaggaggccgccgccugcggccugcccgugcugcugaccaacguggagcugggccugggcugcgaggagcugcaguggcugcugcagagagagcagcugagccccccccaggugcagcccggcuucugccuguaccugagcaccacccugagccugugcgccauggagaaggugcugggcugcgagcugcugaagggccugaacgugcuggaccugggccugaacauggagauccuggaggagcagaugcugcacgagauccugugcagagaguaccccgagcuggagaccagauggcaggaccugaagaucagagcccuggacaccugcaaggccguggaggccgccgaggagagacugcugaccaugcugcuguuccagaaccccaagagacagaagcccgccaaguuccugagaaacaucgugagagcccagggcaagcugugccagcugagagcccacugcgaggagcuggagggccagaagcugcaggagauggugcugugggcccccuacagacccgugguguggcacggcauggccauggugaaggcccugagccagcugcagaaccugcugccccuguucugcaugagccccgagaacuggcuggccgugaccaagcaggcccuggacagcaugaagcccagagagaucaaccacggcgaggaccuggccagccaccugcugcagcugagagcccaccugaccagacagcugcugggcagcaccgugaccgcccugggccugacccaggugccccuggugggcgcccugggcgcccuggcccugcugcaggccaccggcaaggccagcgagcuggagagacuggcccuguggcccggccuggccgccagccccagcaccgugcacagcaagcccgugagcgacguggccagacccgccuggcugggccccaaggccuggcacgagugcgagaugcuggagcugcugccccccuucgugggccugugcgccagccuggccggccacagcagcgccuggcaggccuaccugagccugagcagcaccgugcugggccccgcccccggccccggccccgagccccugagccugcugcagaagcugauccuguggagagugcugagacccgagugccuggccggcgcccuggccgacuucaccaccagccugcugggcagaccccuggacgagaacaccuacgcccccaccaugcccuucaagcacagccaggccacccagcccaugcugauccugcugcccccccccggccaccccagcgccacccugcacccccugaccgugauccagaagcuggccgccaaguaccagcagggccagaagcagcugcaggugaucgcccugggcagcgaggccugggaccccgugagcgugguggugagcacccugagccaggccauguacgagggccacuggcuggugcuggacaacugccaccugaugccccacuggcccaaggagcugcugcagcugcugcuggagcugcugggcagagccaaggugguggccgaccuggagagcgagcagcugcuggaccagcccgagagcagaaacgugagcaccgugcacagagacuucagacuguggcugaucgugcccgccgagagcagcgccagccugcccgccgugcugacccagcacagcaugcccguguucuggaaccagagccuggagcugggccacgugcugaucgacagcguggagcuggcccagcaggugcuguacaugcagccccccacccaggcccugccccugcugcugcugcacggccugcugcugcacagacagcuguacggcaccagacugcaggcccacagaggcagauggagccaggugacccugacccaggugcugcagacccaggaccagcugugggccagccugagcaaccccagagccgccaugcaggagcuggccgccagcguguucuacggcggcccccugggcgacaccgaggacagagaggcccugaucagccugacccaggccugccugagccccagcagcggcagcugggugcagccccacaccccccagagccugcuggccacccugaugccccugcccgagcugagagagcuggacgccauggccgagugcaaggcccagaugcaccugcugcccagcccccccgagcccagacugugcggccugagcgagggcccccaggccuggcugcugagaagacagagcagagcccugcugagcgcccugcagagaagcagccccgugugggugcccgagagcagaagaggcgcccagcuggccgagagaagacugagacagagacuggugcaggugaacagaagacuggagagccugcaggaccugcugacccacgugaucagacaggacgagagcgacgcccccuggagcgugcugggccccaacgccagaagaccccuggagggcgugcuggagaccgaggcccuggagcugagccagcuggugggcacccugcagagagaccuggacugccugcugcagcagcugaagggcgccccccccugccccagcagaagaugcgccgccguggcccacgcccuguggaccggcagacugccccugcccuggagaccccacgcccccgccggcccccagccccccuggcacuggcugagacagcugagcagaagaggccagcugcuggugagauaccugggcgugggcgccgacgccagcagcgacgugcccgagagaguguuccaccugagcgccuucagacaccccagaagacugcugcuggcccugagaggcgaggccgcccuggaccagaacgugcccagcagcaacuuccccggcagcagaggcagcgugagcagccagcugcaguacaagagacuggagaugaacagcaacccccugcacuucagaguggagaacggccccaaccccaccgugcccgagagaggccugcugcugaucggccugcaggugcugcacgccgagugggaccccaucgccggcgcccugcaggacagccccagcagccagcccagcccccugccccccgugagcaucagcacccaggcccccggcaccagcgaccugcccgcccccgccgaccugaccguguacagcugccccguguacaugggcggcccccugggcaccgccaagcugcagagcagaaacaucgugaugcaccugccccugcccaccaagcugacccccaacaccugcgugcagagaagagugcacgugugcagccccccccugagcuaa

SEQ ID NO: 16243 - RNA, 537 nt, Artificial Sequence
  DNLZ__Homo_sapiens__NP_001074318
augcugagaaccgcccugagaggcgcccccagacugcugagcagagugcagcccagagcccccugccugagaagacuguggggcagaggcgccagacccgagguggccggcagaagaagagccugggccuggggcuggagaagaagcagcagcgagcagggccccggccccgccgccgcccugggcagaguggaggccgcccacuaccagcugguguacaccugcaaggugugcggcaccagaagcagcaagagaaucagcaagcuggccuaccaccagggcguggugaucgugaccugccccggcugccagaaccaccacaucaucgccgacaaccugggcugguucagcgaccugaacggcaagagaaacaucgaggagauccugaccgccagaggcgagcaggugcacagaguggccggcgagggcgcccuggagcuggugcuggaggccgccggcgcccccaccagcaccgccgcccccgaggccggcgaggacgagggcccccccagccccggcaagaccgagcccagcuaa

SEQ ID NO: 16244 - RNA, 2556 nt, Artificial Sequence
  DNM1__Homo_sapiens__NP_001005336
augggcaacagaggcauggaggaccugaucccccuggugaacagacugcaggacgccuucagcgccaucggccagaacgccgaccuggaccugccccagaucgccguggugggcggccagagcgccggcaagagcagcgugcuggagaacuucgugggcagagacuuccugcccagaggcagcggcaucgugaccagaagaccccuggugcugcagcuggugaacgccaccaccgaguacgccgaguuccugcacugcaagggcaagaaguucaccgacuucgaggaggugagacuggagaucgaggccgagaccgacagagugaccggcaccaacaagggcaucagccccgugcccaucaaccugagaguguacagcccccacgugcugaaccugacccugguggaccugcccggcaugaccaaggugcccgugggcgaccagccccccgacaucgaguuccagaucagagacaugcugaugcaguucgugaccaaggagaacugccugauccuggccgugagccccgccaacagcgaccuggccaacagcgacgcccugaagguggccaaggagguggacccccagggccagagaaccaucggcgugaucaccaagcuggaccugauggacgagggcaccgacgccagagacgugcuggagaacaagcugcugccccugagaagaggcuacaucggcguggugaacagaagccagaaggacaucgacggcaagaaggacaucaccgccgcccuggccgccgagagaaaguucuuccugagccaccccagcuacagacaccuggccgacagaaugggcacccccuaccugcagaaggugcugaaccagcagcugaccaaccacaucagagacacccugcccggccugagaaacaagcugcagagccagcugcugagcaucgagaaggagguggaggaguacaagaacuucagacccgacgaccccgccagaaagaccaaggcccugcugcagauggugcagcaguucgccguggacuucgagaagagaaucgagggcagcggcgaccagaucgacaccuacgagcugagcggcggcgccagaaucaacagaaucuuccacgagagauuccccuucgagcuggugaagauggaguucgacgagaaggagcugagaagagagaucagcuacgccaucaagaacauccacggcaucagaaccggccuguucacccccgacauggccuucgagaccaucgugaagaagcaggugaagaagaucagagagcccugccugaagugcguggacauggugaucagcgagcugaucagcaccgugagacagugcaccaagaagcugcagcaguaccccagacugagagaggagauggagagaaucgugaccacccacaucagagagagagagggcagaaccaaggagcaggugaugcugcugaucgacaucgagcuggccuacaugaacaccaaccacgaggacuucaucggcuucgccaacgcccagcagagaagcaaccagaugaacaagaagaagaccagcggcaaccaggacgagauccuggugaucagaaagggcuggcugaccaucaacaacaucggcaucaugaagggcggcagcaaggaguacugguucgugcugaccgccgagaaccugagcugguacaaggacgacgaggagaaggagaagaaguacaugcugagcguggacaaccugaagcugagagacguggagaagggcuucaugagcagcaagcacaucuucgcccuguucaacaccgagcagagaaacguguacaaggacuacagacagcuggagcuggccugcgagacccaggaggagguggacagcuggaaggccagcuuccugagagccggcguguaccccgagagagugggcgacaaggagaaggccagcgagaccgaggagaacggcagcgacagcuucaugcacagcauggacccccagcuggagagacagguggagaccaucagaaaccugguggacagcuacauggccaucgugaacaagaccgugagagaccugaugcccaagaccaucaugcaccugaugaucaacaacaccaaggaguucaucuucagcgagcugcuggccaaccuguacagcugcggcgaccagaacacccugauggaggagagcgccgagcaggcccagagaagagacgagaugcugagaauguaccacgcccugaaggaggcccugagcaucaucggcgacaucaacaccaccaccgugagcacccccaugcccccccccguggacgacagcuggcugcaggugcagagcgugcccgccggcagaagaagccccaccagcagccccaccccccagagaagagcccccgccgugccccccgccagacccggcagcagaggccccgcccccggccccccccccgccggcagcgcccugggcggcgccccccccgugcccagcagacccggcgccagccccgaccccuucggcccccccccccaggugcccagcagacccaacagagccccccccggcgugcccagaaucaccaucagcgaccccuaa

SEQ ID NO: 16245 - RNA, 2178 nt, Artificial Sequence
  DNM1L__Homo_sapiens__NP_001265392
auggaggcccugauccccgugaucaacaagcugcaggacguguucaacaccgugggcgccgacaucauccagcugccccagaucgugguggugggcacccagagcagcggcaagagcagcgugcuggagagccuggugggcagagaccugcugcccagaggcaccggcaucgugaccagaagaccccugauccugcagcuggugcacgugagccaggaggacaagagaaagaccaccggcgaggagaacggcguggaggccgaggaguggggcaaguuccugcacaccaagaacaagcuguacaccgacuucgacgagaucagacaggagaucgagaacgagaccgagagaaucagcggcaacaacaagggcgugagccccgagcccauccaccugaagaucuucagccccaacguggugaaccugacccugguggaccugcccggcaugaccaaggugcccgugggcgaccagcccaaggacaucgagcugcagaucagagagcugauccugagauucaucagcaaccccaacagcaucauccuggccgugaccgccgccaacaccgacauggccaccagcgaggcccugaagaucagcagagagguggaccccgacggcagaagaacccuggccgugaucaccaagcuggaccugauggacgccggcaccgacgccauggacgugcugaugggcagagugauccccgugaagcugggcaucaucggcguggugaacagaagccagcuggacaucaacaacaagaagagcgugaccgacagcaucagagacgaguacgccuuccugcagaagaaguaccccagccuggccaacagaaacggcaccaaguaccuggccagaacccugaacagacugcugaugcaccacaucagagacugccugcccgagcugaagaccagaaucaacgugcuggccgcccaguaccagagccugcugaacagcuacggcgagcccguggacgacaagagcgccacccugcugcagcugaucaccaaguucgccaccgaguacugcaacaccaucgagggcaccgccaaguacaucgagaccagcgagcugugcggcggcgccagaaucugcuacaucuuccacgagaccuucggcagaacccuggagagcguggacccccugggcggccugaacaccaucgacauccugaccgccaucagaaacgccaccggccccagacccgcccuguucgugcccgaggugagcuucgagcugcuggugaagagacagaucaagagacuggaggagcccagccugagaugcguggagcuggugcacgaggagaugcagagaaucauccagcacugcagcaacuacagcacccaggagcugcugagauuccccaagcugcacgacgccaucguggagguggugaccugccugcugagaaagagacugcccgugaccaacgagauggugcacaaccugguggccaucgagcuggccuacaucaacaccaagcaccccgacuucgccgacgccugcggccugaugaacaacaacaucgaggagcagagaagaaacagacuggccagagagcugcccagcgccgugagcagagacaagagcagcaaggugcccagcgcccuggcccccgccagccaggagcccagccccgccgccagcgccgaggccgacggcaagguggccagcggcggcggcggcgugggcgacggcgugcaggagcccaccaccggcaacuggagaggcaugcugaagaccagcaaggccgaggagcugcuggccgaggagaagagcaagcccauccccaucaugcccgccagcccccagaagggccacgccgugaaccugcuggacgugcccgugcccguggccagaaagcugagcgccagagagcagagagacugcgaggugaucgagagacugaucaagagcuacuuccugaucgugagaaagaacauccaggacagcgugcccaaggccgugaugcacuuccuggugaaccacgugaaggacacccugcagagcgagcuggugggccagcuguacaagagcagccugcuggacgaccugcugaccgagagcgaggacauggcccagagaagaaaggaggccgccgacaugcugaaggcccugcagggcgccagccagaucaucgccgagaucagagagacccaccugugguaa

SEQ ID NO: 16246 - RNA, 2613 nt, Artificial Sequence
  DNM2__Homo_sapiens__NP_001005360
augggcaacagaggcauggaggagcugaucccccuggugaacaagcugcaggacgccuucagcagcaucggccagagcugccaccuggaccugccccagaucgccguggugggcggccagagcgccggcaagagcagcgugcuggagaacuucgugggcagagacuuccugcccagaggcagcggcaucgugaccagaagaccccugauccugcagcugaucuucagcaagaccgagcacgccgaguuccugcacugcaagagcaagaaguucaccgacuucgacgaggugagacaggagaucgaggccgagaccgacagagugaccggcaccaacaagggcaucagccccgugcccaucaaccugagaguguacagcccccacgugcugaaccugacccugaucgaccugcccggcaucaccaaggugcccgugggcgaccagccccccgacaucgaguaccagaucaaggacaugauccugcaguucaucagcagagagagcagccugauccuggccgugacccccgccaacauggaccuggccaacagcgacgcccugaagcuggccaaggagguggacccccagggccugagaaccaucggcgugaucaccaagcuggaccugauggacgagggcaccgacgccagagacgugcuggagaacaagcugcugccccugagaagaggcuacaucggcguggugaacagaagccagaaggacaucgagggcaagaaggacaucagagccgcccuggccgccgagagaaaguucuuccugagccaccccgccuacagacacauggccgacagaaugggcaccccccaccugcagaagacccugaaccagcagcugaccaaccacaucagagagagccugcccgcccugagaagcaagcugcagagccagcugcugagccuggagaaggagguggaggaguacaagaacuucagacccgacgaccccaccagaaagaccaaggcccugcugcagauggugcagcaguucggcguggacuucgagaagagaaucgagggcagcggcgaccagguggacacccuggagcugagcggcggcgccagaaucaacagaaucuuccacgagagauuccccuucgagcuggugaagauggaguucgacgagaaggaccugagaagagagaucagcuacgccaucaagaacauccacggcgugagaaccggccuguucacccccgaccuggccuucgaggccaucgugaagaagcagguggugaagcugaaggagcccugccugaagugcguggaccuggugauccaggagcugaucaacaccgugagacagugcaccagcaagcugagcagcuaccccagacugagagaggagaccgagagaaucgugaccaccuacaucagagagagagagggcagaaccaaggaccagauccugcugcugaucgacaucgagcagagcuacaucaacaccaaccacgaggacuucaucggcuucgccaacgcccagcagagaagcacccagcugaacaagaagagagccauccccaaccagggcgagauccuggugaucagaagaggcuggcugaccaucaacaacaucagccugaugaagggcggcagcaaggaguacugguucgugcugaccgccgagagccugagcugguacaaggacgaggaggagaaggagaagaaguacaugcugccccuggacaaccugaagaucagagacguggagaagggcuucaugagcaacaagcacguguucgccaucuucaacaccgagcagagaaacguguacaaggaccugagacagaucgagcuggccugcgacagccaggaggacguggacagcuggaaggccagcuuccugagagccggcguguaccccgagaaggaccaggccgagaacgaggacggcgcccaggagaacaccuucagcauggacccccagcuggagagacagguggagaccaucagaaaccugguggacagcuacguggccaucaucaacaagagcaucagagaccugaugcccaagaccaucaugcaccugaugaucaacaacaccaaggccuucauccaccacgagcugcuggccuaccuguacagcagcgccgaccagagcagccugauggaggagagcgccgaccaggcccagagaagagacgacaugcugagaauguaccacgcccugaaggaggcccugaacaucaucggcgacaucagcaccagcaccgugagcacccccgugcccccccccguggacgacaccuggcugcagagcgccagcagccacagccccaccccccagagaagacccgugagcagcauccacccccccggcagaccccccgccgugagaggccccacccccggccccccccugauccccgugcccgugggcgccgccgccagcuucagcgccccccccauccccagcagacccggcccccagagcguguucgccaacagcgaccuguuccccgcccccccccagauccccagcagacccgugagaaucccccccggcaucccccccggcgugcccagcagaagaccccccgccgcccccagcagacccaccaucaucagacccgccgagcccagccugcuggacuaa

SEQ ID NO: 16247 - RNA, 2580 nt, Artificial Sequence
  DNM3__Homo_sapiens__NP_001129599
augggcaacagagagauggaggagcugaucccccuggugaacagacugcaggacgccuucagcgcccugggccagagcugccugcuggagcugccccagaucgccguggugggcggccagagcgccggcaagagcagcgugcuggagaacuucgugggcagagacuuccugcccagaggcagcggcaucgugaccagaagaccccuggugcugcagcuggugaccagcaaggccgaguacgccgaguuccugcacugcaagggcaagaaguucaccgacuucgacgaggugagacuggagaucgaggccgagaccgacagagugaccggcaugaacaagggcaucagcagcauccccaucaaccugagaguguacagcccccacgugcugaaccugacccugaucgaccugcccggcaucaccaaggugcccgugggcgaccagccccccgacaucgaguaccagaucagagagaugaucaugcaguucaucaccagagagaacugccugauccuggccgugacccccgccaacaccgaccuggccaacagcgacgcccugaagcuggccaaggagguggacccccagggccugagaaccaucggcgugaucaccaagcuggaccugauggacgagggcaccgacgccagagacgugcuggagaacaagcugcugccccugagaagaggcuacgugggcguggugaacagaagccagaaggacaucgacggcaagaaggacaucaaggccgccaugcuggccgagagaaaguucuuccugagccaccccgccuacagacacaucgccgacagaaugggcaccccccaccugcagaaggugcugaaccagcagcugaccaaccacaucagagacacccugcccaacuucagaaacaagcugcagggccagcugcugagcaucgagcacgagguggaggccuacaagaacuucaagcccgaggaccccaccagaaagaccaaggcccugcugcagauggugcagcaguucgccguggacuucgagaagagaaucgagggcagcggcgaccagguggacacccuggagcugagcggcggcgccaagaucaacagaaucuuccacgagagauuccccuucgagaucgugaagauggaguucaacgagaaggagcugagaagagagaucagcuacgccaucaagaacauccacggcaucagaaccggccuguucacccccgacauggccuucgaggccaucgugaagaagcagaucgugaagcugaagggccccagccugaagagcguggaccuggugauccaggagcugaucaacaccgugaagaagugcaccaagaagcuggccaacuuccccagacugugcgaggagaccgagagaaucguggccaaccacaucagagagagagagggcaagaccaaggaccaggugcugcugcugaucgacauccaggugagcuacaucaacaccaaccacgaggacuucaucggcuucgccaacgcccagcagagaagcagccaggugcacaagaagaccaccgugggcaaccaggugaucagaaagggcuggcugaccaucagcaacaucggcaucaugaagggcggcagcaagggcuacugguucgugcugaccgccgagagccugagcugguacaaggacgacgaggagaaggagaagaaguacaugcugccccuggacaaccugaaggugagagacguggagaagagcuucaugagcagcaagcacaucuucgcccuguucaacaccgagcagagaaacguguacaaggacuacagauuccuggagcuggccugcgacagccaggaggacguggacagcuggaaggccagccugcugagagccggcguguaccccgacaagagcguggccgagaacgacgagaacggccaggccgagaacuucagcauggacccccagcuggagagacagguggagaccaucagaaaccugguggacagcuacaugagcaucaucaacaagugcaucagagaccugauccccaagaccaucaugcaccugaugaucaacaacgugaaggacuucaucaacagcgagcugcuggcccagcuguacagcagcgaggaccagaacacccugauggaggagagcgccgagcaggcccagagaagagacgagaugcugagaauguaccaggcccugaaggaggcccugggcaucaucggcgacaucagcaccgccaccgugagcacccccgcccccccccccguggacgacagcuggauccagcacagcagaagaagccccccccccagccccaccacccagagaagacccacccugagcgccccccuggccagacccaccagcggcagaggccccgcccccgccauccccagccccggcccccacagcggcgccccccccgugcccuucagacccggcccccugccccccuuccccagcagcagcgacagcuucggcgcccccccccaggugcccagcagacccaccagagccccccccagcgugcccagcagaagacccccccccagccccaccagacccaccaucaucagaccccuggagagcagccugcuggacuaa

SEQ ID NO: 16248 - RNA, 4734 nt, Artificial Sequence
  DNMBP__Homo_sapiens__NP_056036
auggaggccggcagcguggugagagccaucuucgacuucugccccagcgugagcgaggagcugccccuguucgugggcgacaucaucgaggugcuggccgugguggacgaguucuggcugcugggcaagaaggaggacgugaccggccaguuccccagcagcuucguggagaucgugaccauccccagccugaaggagggcgagagacuguucgugugcaucugcgaguucaccagccaggagcuggacaaccugccccugcacagaggcgaccuggugauccuggacggcauccccaccgccggcuggcugcagggcagaagcugcuggggcgccagaggcuucuuccccagcagcugcgugagagagcugugccugagcagccagagcagacaguggcacagccagagcgcccuguuccagauccccgaguacagcaugggccaggccagagcccugaugggccugagcgcccagcuggacgaggagcuggacuucagagagggcgacgugaucaccaucaucggcgugcccgagcccggcugguucgagggcgagcuggagggcagaagaggcaucuuccccgagggcuucguggagcugcugggcccccugagaaccguggacgagagcgugagcagcggcaaccaggacgacugcaucgugaacggcgagguggacacccccgugggcgaggaggagaucggccccgacgaggacgaggaggagcccggcaccuacggcguggcccuguacagauuccaggcccuggagcccaacgagcuggacuucgaggugggcgacaagaucagaauccuggccacccuggaggacggcuggcuggagggcagccugaagggcagaaccggcaucuuccccuacagauucgugaagcugugccccgacaccagaguggaggagaccauggcccugccccaggagggcagccuggccagaauccccgagaccagccuggacugccuggagaacacccugggcguggaggagcagagacacgagaccagcgaccacgaggccgaggagcccgacugcaucaucagcgaggcccccaccagcccccugggccaccugaccagcgaguacgacaccgacagaaacagcuaccaggacgaggacaccgccggcggcccccccagaagccccggcguggagugggagaugccccuggccaccgacagccccaccagcgaccccaccgagguggugaacggcaucagcagccagccccaggugcccuuccaccccaaccugcagaagagccaguacuacagcaccgugggcggcagccacccccacagcgagcaguaccccgaccugcugccccuggaggccagaaccagagacuacgccagccugccccccaagagaauguacagccagcugaagacccugcagaagcccgugcugccccuguacagaggcagcagcgugagcgccagcagaguggugaagcccagacagagcagcccccagcugcacaaccuggccagcuacaccaagaagcaccacaccagcagcguguacagcaucagcgagagacuggagaugaagcccggcccccaggcccagggccuggugauggaggccgccacccacagccagggcgacggcagcaccgaccuggacagcaagcugacccagcagcugaucgaguucgagaagagccuggccggccccggcaccgagcccgacaagauccugagacacuucagcaucauggacuucaacagcgagaaggacaucgugagaggcagcagcaagcugaucaccgagcaggagcugcccgagagaagaaaggcccugagaccccccccccccagacccugcacccccgugagcaccagcccccaccugcugguggaccagaaccugaagcccgcccccccccugguggugagacccagcagacccgccccccugccccccagcgcccagcagagaaccaacgccgugagccccaagcugcugagcagacacagacccaccugcgagacccuggagaaggagggccccggccacaugggcagaagccuggaccagaccagccccugcccccuggugcuggugagaaucgaggagauggagagagaccuggacauguacagcagagcccaggaggagcugaaccugaugcuggaggagaagcaggacgagagcagcagagccgagacccuggaggaccugaaguucugcgagagcaacaucgagagccugaacauggagcugcagcagcugagagagaugacccugcugagcagccagagcagcagccugguggcccccagcggcagcgugagcgccgagaaccccgagcagagaaugcuggagaagagagccaaggugaucgaggagcugcugcagaccgagagagacuacaucagagaccuggagaugugcaucgagagaaucauggugcccaugcagcaggcccaggugcccaacaucgacuucgagggccuguucggcaacaugcagauggugaucaaggugagcaagcagcugcuggccgcccuggagaucagcgacgccgugggccccguguuccugggccacagagacgagcuggagggcaccuacaagaucuacugccagaaccacgacgaggccaucgcccugcuggagaucuacgagaaggacgagaagauccagaagcaccugcaggacagccuggccgaccugaagagccuguacaacgaguggggcugcaccaacuacaucaaccugggcagcuuccugaucaagcccgugcagagagugaugagauacccccugcugcugauggagcugcugaacagcacccccgagagccaccccgacaaggugccccugaccaacgccgugcuggccgugaaggagaucaacgugaacaucaacgaguacaagagaagaaaggaccuggugcugaaguacagaaagggcgacgaggacagccugauggagaagaucagcaagcugaacauccacagcaucaucaagaagagcaacagagugagcagccaccugaagcaccugaccggcuucgccccccagaucaaggacgagguguucgaggagaccgagaagaacuucagaaugcaggagagacugaucaagagcuucaucagagaccugagccuguaccugcagcacaucagagagagcgccugcgugaaggugguggccgccgugagcaugugggacgugugcauggagagaggccacagagaccuggagcaguucgagagagugcacagauacaucagcgaccagcuguucaccaacuucaaggagagaaccgagagacuggugaucagcccccugaaccagcugcugagcauguucaccggcccccacaagcuggugcagaagagauucgacaagcugcuggacuucuacaacugcaccgagagagccgagaagcugaaggacaagaagacccuggaggagcugcagagcgccagaaacaacuacgaggcccugaacgcccagcugcuggacgagcugcccaaguuccaccaguacgcccagggccuguucaccaacugcgugcacggcuacgccgaggcccacugcgacuucgugcaccaggcccuggagcagcugaagccccugcugagccugcugaagguggccggcagagagggcaaccugaucgccaucuuccacgaggagcacagcagagugcugcagcagcugcagguguucaccuucuuccccgagagccugcccgccaccaagaagcccuucgagagaaagaccaucgacagacagagcgccagaaagccccugcugggccugcccagcuacaugcugcagagcgaggagcugagagccagccugcuggccagauacccccccgagaagcuguuccaggccgagagaaacuucaacgccgcccaggaccuggacgugagccugcuggagggcgaccuggugggcgugaucaagaagaaggaccccaugggcagccagaacagauggcugaucgacaacggcgugaccaagggcuucguguacagcagcuuccugaagcccuacaaccccagaagaagccacagcgacgccagcgugggcagccacagcagcaccgagagcgagcacggcagcagcagccccagauuccccagacagaacagcggcagcacccugaccuucaaccccagcagcauggccgugagcuucaccagcggcagcugccagaagcagccccaggacgccagccccccccccaaggagugcgaccagggcacccugagcgccagccugaaccccagcaacagcgagagcagccccagcagaugccccagcgaccccgacagcaccagccagcccagaagcggcgacagcgccgacguggccagagacgugaagcagcccaccgccacccccagaagcuacagaaacuucagacaccccgagaucgugggcuacagcgugcccggcagaaacggccagagccaggaccuggugaagggcugcgccagaaccgcccaggcccccgaggacagaagcaccgagcccgacggcagcgaggccgagggcaaccagguguacuucgccguguacaccuucaaggccagaaaccccaacgagcugagcgugagcgccaaccagaagcugaagauccuggaguucaaggacgugaccggcaacaccgagugguggcuggccgaggugaacggcaagaagggcuacgugcccagcaacuacaucagaaagaccgaguacaccuaa

SEQ ID NO: 16249 - RNA, 4899 nt, Artificial Sequence
  DNMT1__Homo_sapiens__NP_001124295
augcccgccagaaccgcccccgccagagugcccacccuggccgugcccgccaucagccugcccgacgacgugagaagaagacugaaggaccuggagagagacagccugaccgagaaggagugcgugaaggagaagcugaaccugcugcacgaguuccugcagaccgagaucaagaaccagcugugcgaccuggagaccaagcugagaaaggaggagcugagcgaggagggcuaccuggccaaggugaagagccugcugaacaaggaccugagccuggagaacggcgcccacgccuacaacagagaggugaacggcagacuggagaacggcaaccaggccagaagcgaggccagaagagugggcauggccgacgccaacagcccccccaagccccugagcaagcccagaacccccagaagaagcaagagcgacggcgaggccaagagaagcagagacccccccgccagcgccagccaggugaccggcaucagagccgagcccagccccagccccagaaucaccagaaagagcaccagacagaccaccaucaccagccacuucgccaagggccccgccaagagaaagccccaggaggagagcgagagagccaagagcgacgagagcaucaaggaggaggacaaggaccaggacgagaagagaagaagagugaccagcagagagagaguggccagaccccugcccgccgaggagcccgagagagccaagagcggcaccagaaccgagaaggaggaggagagagacgagaaggaggagaagagacugagaagccagaccaaggagcccacccccaagcagaagcugaaggaggagcccgacagagaggccagagccggcgugcaggccgacgaggacgaggacggcgacgagaaggacgagaagaagcacagaagccagcccaaggaccuggccgccaagagaagacccgaggagaaggagcccgagaaggugaacccccagaucagcgacgagaaggacgaggacgagaaggaggagaagagaagaaagaccacccccaaggagcccaccgagaagaagauggccagagccaagaccgugaugaacagcaagacccacccccccaagugcauccagugcggccaguaccuggacgaccccgaccugaaguacggccagcacccccccgacgccguggacgagccccagaugcugaccaacgagaagcugagcaucuucgacgccaacgagagcggcuucgagagcuacgaggcccugccccagcacaagcugaccugcuucagcguguacugcaagcacggccaccugugccccaucgacaccggccugaucgagaagaacaucgagcuguucuucagcggcagcgccaagcccaucuacgacgacgaccccagccuggagggcggcgugaacggcaagaaccugggccccaucaacgagugguggaucaccggcuucgacggcggcgagaaggcccugaucggcuucagcaccagcuucgccgaguacauccugauggaccccagccccgaguacgcccccaucuucggccugaugcaggagaagaucuacaucagcaagaucgugguggaguuccugcagagcaacagcgacagcaccuacgaggaccugaucaacaagaucgagaccaccgugccccccagcggccugaaccugaacagauucaccgaggacagccugcugagacacgcccaguucgugguggagcagguggagagcuacgacgaggccggcgacagcgacgagcagcccaucuuccugacccccugcaugagagaccugaucaagcuggccggcgugacccugggccagagaagagcccaggccagaagacagaccaucagacacagcaccagagagaaggacagaggccccaccaaggccaccaccaccaagcugguguaccagaucuucgacaccuucuucgccgagcagaucgagaaggacgacagagaggacaaggagaacgccuucaagagaagaagaugcggcgugugcgaggugugccagcagcccgagugcggcaagugcaaggccugcaaggacauggugaaguucggcggcagcggcagaagcaagcaggccugccaggagagaagaugccccaacauggccaugaaggaggccgacgacgacgaggagguggacgacaacauccccgagaugcccagccccaagaagaugcaccagggcaagaagaagaagcagaacaagaacagaaucagcugggugggcgaggccgugaagaccgacggcaagaagagcuacuacaagaaggugugcaucgacgccgagacccuggaggugggcgacugcgugagcgugauccccgacgacagcagcaagccccuguaccuggccagagugaccgcccugugggaggacagcagcaacggccagauguuccacgcccacugguucugcgccggcaccgacaccgugcugggcgccaccagcgacccccuggagcuguuccugguggacgagugcgaggacaugcagcugagcuacauccacagcaaggugaaggugaucuacaaggcccccagcgagaacugggccauggagggcggcauggaccccgagagccugcuggagggcgacgacggcaagaccuacuucuaccagcugugguacgaccaggacuacgccagauucgagagcccccccaagacccagcccaccgaggacaacaaguucaaguucugcgugagcugcgccagacuggccgagaugagacagaaggagauccccagagugcuggagcagcuggaggaccuggacagcagagugcuguacuacagcgccaccaagaacggcauccuguacagagugggcgacggcguguaccugccccccgaggccuucaccuucaacaucaagcugagcagccccgugaagagacccagaaaggagcccguggacgaggaccuguaccccgagcacuacagaaaguacagcgacuacaucaagggcagcaaccuggacgcccccgagcccuacagaaucggcagaaucaaggagaucuucugccccaagaagagcaacggcagacccaacgagaccgacaucaagaucagagugaacaaguucuacagacccgagaacacccacaagagcacccccgccagcuaccacgccgacaucaaccugcuguacuggagcgacgaggaggccgugguggacuucaaggccgugcagggcagaugcaccguggaguacggcgaggaccugcccgagugcgugcagguguacagcaugggcggccccaacagauucuacuuccuggaggccuacaacgccaagagcaagagcuucgaggacccccccaaccacgccagaagccccggcaacaagggcaagggcaagggcaagggcaagggcaagcccaagagccaggccugcgagcccagcgagcccgagaucgagaucaagcugcccaagcugagaacccuggacguguucagcggcugcggcggccugagcgagggcuuccaccaggccggcaucagcgacacccugugggccaucgagaugugggaccccgccgcccaggccuucagacugaacaaccccggcagcaccguguucaccgaggacugcaacauccugcugaagcuggugauggccggcgagaccaccaacagcagaggccagagacugccccagaagggcgacguggagaugcugugcggcggcccccccugccagggcuucagcggcaugaacagauucaacagcagaaccuacagcaaguucaagaacagccugguggugagcuuccugagcuacugcgacuacuacagacccagauucuuccugcuggagaacgugagaaacuucgugagcuucaagagaagcauggugcugaagcugacccugagaugccuggugagaaugggcuaccagugcaccuucggcgugcugcaggccggccaguacggcguggcccagaccagaagaagagccaucauccuggccgccgcccccggcgagaagcugccccuguuccccgagccccugcacguguucgcccccagagccugccagcugagcguggugguggacgacaagaaguucgugagcaacaucaccagacugagcagcggccccuucagaaccaucaccgugagagacaccaugagcgaccugcccgaggugagaaacggcgccagcgcccuggagaucagcuacaacggcgagccccagagcugguuccagagacagcugagaggcgcccaguaccagcccauccugagagaccacaucugcaaggacaugagcgcccugguggccgccagaaugagacacaucccccuggcccccggcagcgacuggagagaccugcccaacaucgaggugagacugagcgacggcaccauggccagaaagcugagauacacccaccacgacagaaagaacggcagaagcagcagcggcgcccugagaggcgugugcagcugcguggaggccggcaaggccugcgaccccgccgccagacaguucaacacccugauccccuggugccugccccacaccggcaacagacacaaccacugggccggccuguacggcagacuggagugggacggcuucuucagcaccaccgugaccaaccccgagcccaugggcaagcagggcagagugcugcaccccgagcagcacagaguggugagcgugagagagugcgccagaagccagggcuuccccgacaccuacagacuguucggcaacauccuggacaagcacagacaggugggcaacgccgugccccccccccuggccaaggccaucggccuggagaucaagcugugcaugcuggccaaggccagagagagcgccagcgccaagaucaaggaggaggaggccgccaaggacuaa

SEQ ID NO: 16250 - RNA, 2172 nt, Artificial Sequence
  DNMT3A__Homo_sapiens__NP_715640
augggcauccuggagagaguggugagaagaaacggcagaguggacagaagccugaaggacgagugcgacaccgccgagaagaaggccaaggugaucgccggcaugaacgccguggaggagaaccagggccccggcgagagccagaagguggaggaggccagcccccccgccgugcagcagcccaccgaccccgccagccccaccguggccaccacccccgagcccgugggcagcgacgccggcgacaagaacgccaccaaggccggcgacgacgagcccgaguacgaggacggcagaggcuucggcaucggcgagcugguguggggcaagcugagaggcuucagcugguggcccggcagaaucgugagcugguggaugaccggcagaagcagagccgccgagggcaccagaugggugaugugguucggcgacggcaaguucagcguggugugcguggagaagcugaugccccugagcagcuucugcagcgccuuccaccaggccaccuacaacaagcagcccauguacagaaaggccaucuacgaggugcugcagguggccagcagcagagccggcaagcuguuccccgugugccacgacagcgacgagagcgacaccgccaaggccguggaggugcagaacaagcccaugaucgagugggcccugggcggcuuccagcccagcggccccaagggccuggagccccccgaggaggagaagaaccccuacaaggagguguacaccgacauguggguggagcccgaggccgccgccuacgccccccccccccccgccaagaagcccagaaagagcaccgccgagaagcccaaggugaaggagaucaucgacgagagaaccagagagagacugguguacgaggugagacagaagugcagaaacaucgaggacaucugcaucagcugcggcagccugaacgugacccuggagcacccccuguucgugggcggcaugugccagaacugcaagaacugcuuccuggagugcgccuaccaguacgacgacgacggcuaccagagcuacugcaccaucugcugcggcggcagagaggugcugaugugcggcaacaacaacugcugcagaugcuucugcguggagugcguggaccugcuggugggccccggcgccgcccaggccgccaucaaggaggaccccuggaacugcuacaugugcggccacaagggcaccuacggccugcugagaagaagagaggacuggcccagcagacugcagauguucuucgccaacaaccacgaccaggaguucgacccccccaagguguacccccccgugcccgccgagaagagaaagcccaucagagugcugagccuguucgacggcaucgccaccggccugcuggugcugaaggaccugggcauccagguggacagauacaucgccagcgaggugugcgaggacagcaucaccgugggcauggugagacaccagggcaagaucauguacgugggcgacgugagaagcgugacccagaagcacauccaggaguggggccccuucgaccuggugaucggcggcagccccugcaacgaccugagcaucgugaaccccgccagaaagggccuguacgagggcaccggcagacuguucuucgaguucuacagacugcugcacgacgccagacccaaggagggcgacgacagacccuucuucuggcuguucgagaacgugguggccaugggcgugagcgacaagagagacaucagcagauuccuggagagcaaccccgugaugaucgacgccaaggaggugagcgccgcccacagagccagauacuucuggggcaaccugcccggcaugaacagaccccuggccagcaccgugaacgacaagcuggagcugcaggagugccuggagcacggcagaaucgccaaguucagcaaggugagaaccaucaccaccagaagcaacagcaucaagcagggcaaggaccagcacuuccccguguucaugaacgagaaggaggacauccuguggugcaccgagauggagagaguguucggcuuccccgugcacuacaccgacgugagcaacaugagcagacuggccagacagagacugcugggcagaagcuggagcgugcccgugaucagacaccuguucgccccccugaaggaguacuucgccugcguguaa

SEQ ID NO: 16251 - RNA, 2187 nt, Artificial Sequence
  DNMT3B__Homo_sapiens__NP_001193984
augaagggcgacaccagacaccugaacggcgaggaggacgccggcggcagagaggacagcauccuggugaacggcgccugcagcgaccagagcagcgacagcccccccauccuggaggccaucagaacccccgagaucagaggcagaagaagcagcagcagacugagcaagagagaggugagcagccugcugagcuacacccaggaccugaccggcgacggcgacggcgaggacggcgacggcagcgacacccccgugaugcccaagcuguucagagagaccagaaccagaagcgagagccccgccagccugagaagaagagccaccgccagcgccggcacccccuggcccagcccccccagcagcuaccugaccaucgaccugaccgacgacaccgaggacacccacggcaccccccagagcagcagcacccccuacgccagacuggcccaggacagccagcagggcggcauggagagcccccagguggaggccgacagcggcgacggcgacagcagcgaguaccaggacggcaaggaguucggcaucggcgaccugguguggggcaagaucaagggcuucagcugguggcccgccaugguggugagcuggaaggccaccagcaagagacaggccaugagcggcaugagaugggugcagugguucggcgacggcaaguucagcgaggugagcgccgacaagcugguggcccugggccuguucagccagcacuucaaccuggccaccuucaacaagcuggugagcuacagaaaggccauguaccacgcccuggagaaggccagagugagagccggcaagaccuuccccagcagccccggcgacagccuggaggaccagcugaagcccaugcuggagugggcccacggcggcuucaagcccaccggcaucgagggccugaagcccaacaacacccagcccgagaacaagaccagaagaagaaccgccgacgacagcgccaccagcgacuacugccccgcccccaagagacugaagaccaacugcuacaacaacggcaaggacagaggcgacgaggaccagagcagagagcagauggccagcgacguggccaacaacaagagcagccuggaggacggcugccugagcugcggcagaaagaaccccgugagcuuccacccccuguucgagggcggccugugccagaccugcagagacagauuccuggagcuguucuacauguacgacgacgacggcuaccagagcuacugcaccgugugcugcgagggcagagagcugcugcugugcagcaacaccagcugcugcagaugcuucugcguggagugccuggaggugcuggugggcaccggcaccgccgccgaggccaagcugcaggagcccuggagcugcuacaugugccugccccagagaugccacggcgugcugagaagaagaaaggacuggaacgugagacugcaggccuucuucaccagcgacaccggccuggaguacgaggcccccaagcuguaccccgccauccccgccgccagaagaagacccaucagagugcugagccuguucgacggcaucgccaccggcuaccuggugcugaaggagcugggcaucaaggugggcaaguacguggccagcgaggugugcgaggagagcaucgccgugggcaccgugaagcacgagggcaacaucaaguacgugaacgacgugagaaacaucaccaagaagaacaucgaggaguggggccccuucgaccuggugaucggcggcagccccugcaacgaccugagcaacgugaaccccgccagaaagggccuguacgagggcaccggcagacuguucuucgaguucuaccaccugcugaacuacagcagacccaaggagggcgacgacagacccuucuucuggauguucgagaacgugguggccaugaaggugggcgacaagagagacaucagcagauuccuggagugcaaccccgugaugaucgacgccaucaaggugagcgccgcccacagagccagauacuucuggggcaaccugcccggcaugaacagaaucuucggcuuccccgugcacuacaccgacgugagcaacaugggcagaggcgccagacagaagcugcugggcagaagcuggagcgugcccgugaucagacaccuguucgccccccugaaggacuacuucgccugcgaguaa

SEQ ID NO: 16252 - RNA, 1161 nt, Artificial Sequence
  DNMT3L__Homo_sapiens__NP_787063
auggccgccauccccgcccuggaccccgaggccgagcccagcauggacgugauccuggugggcagcagcgagcugagcagcagcgugagccccggcaccggcagagaccugaucgccuacgaggugaaggccaaccagagaaacaucgaggacaucugcaucugcugcggcagccugcaggugcacacccagcacccccuguucgagggcggcaucugcgcccccugcaaggacaaguuccuggacgcccuguuccuguacgacgacgacggcuaccagagcuacugcagcaucugcugcagcggcgagacccugcugaucugcggcaaccccgacugcaccagaugcuacugcuucgagugcguggacagccuggugggccccggcaccagcggcaaggugcacgccaugagcaacugggugugcuaccugugccugcccagcagcagaagcggccugcugcagagaagaagaaaguggagaagccagcugaaggccuucuacgacagagagagcgagaacccccuggagauguucgagaccgugcccguguggagaagacagcccgugagagugcugagccuguucgaggacaucaagaaggagcugaccagccugggcuuccuggagagcggcagcgaccccggccagcugaagcacgugguggacgugaccgacaccgugagaaaggacguggaggaguggggccccuucgaccugguguacggcgccacccccccccugggccacaccugcgacagaccccccagcugguaccuguuccaguuccacagacugcugcaguacgccagacccaagcccggcagccccagacccuucuucuggauguucguggacaaccuggugcugaacaaggaggaccuggacguggccagcagauuccuggagauggagcccgugaccauccccgacgugcacggcggcagccugcagaacgccgugagaguguggagcaacauccccgccaucagaagcagacacugggcccuggugagcgaggaggagcugagccugcuggcccagaacaagcagagcagcaagcuggccgccaaguggcccaccaagcuggugaagaacugcuuccugccccugagagaguacuucaaguacuucagcaccgagcugaccagcagccuguaa

SEQ ID NO: 16253 - RNA, 1458 nt, Artificial Sequence
  DNPEP__Homo_sapiens__NP_036232
augagcggccacagccccaccagaggcgccaugcagguggccaugaacggcaaggccagaaaggaggccgugcagaccgccgccaaggagcugcugaaguucgugaacagaagccccagccccuuccacgccguggccgagugcagaaacagacugcugcaggccggcuucagcgagcugaaggagaccgagaaguggaacaucaagcccgagagcaaguacuucaugaccagaaacagcagcaccaucaucgccuucgccgugggcggccaguacgugcccggcaacggcuucagccugaucggcgcccacaccgacagccccugccugagagugaagagaagaagcagaagaagccaggugggcuuccagcaggugggcguggagaccuacggcggcggcaucuggagcaccugguucgacagagaccugacccuggccggcagagugaucgugaagugccccaccagcggcagacuggagcagcagcuggugcacguggagagacccauccugagaaucccccaccuggccauccaccugcagagaaacaucaacgagaacuucggccccaacaccgagaugcaccuggugcccauccuggccaccgccauccaggaggagcuggagaagggcacccccgagcccggcccccugaacgccguggacgagagacaccacagcgugcugaugagccugcugugcgcccaccugggccugagccccaaggacaucguggagauggagcugugccuggccgacacccagcccgccgugcugggcggcgccuacgacgaguucaucuucgcccccagacuggacaaccugcacagcugcuucugcgcccugcaggcccugaucgacagcugcgccggccccggcagccuggccaccgagccccacgugagaauggugacccuguacgacaacgaggaggugggcagcgagagcgcccagggcgcccagagccugcugaccgagcuggugcugagaagaaucagcgccagcugccagcaccccaccgccuucgaggaggccauccccaagagcuucaugaucagcgccgacauggcccacgccgugcaccccaacuaccuggacaagcacgaggagaaccacagaccccuguuccacaagggccccgugaucaaggugaacagcaagcagagauacgccagcaacgccgugagcgaggcccugaucagagagguggccaacaaggugaaggugccccugcaggaccugauggugagaaacgacacccccugcggcaccaccaucggccccauccuggccagcagacugggccugagagugcuggaccugggcagcccccagcuggccaugcacagcaucagagagauggccugcaccaccggcgugcugcagacccugacccuguucaagggcuucuucgagcuguuccccagccugagccacaaccugcugguggacuaa

SEQ ID NO: 16254 - RNA, 1527 nt, Artificial Sequence
  DNTT__Homo_sapiens__NP_001017520
auggacccccccagagccagccaccugagccccagaaagaagagacccagacagaccggcgcccugauggccagcagcccccaggacaucaaguuccaggaccuggugguguucauccuggagaagaagaugggcaccaccagaagagccuuccugauggagcuggccagaagaaagggcuucagaguggagaacgagcugagcgacagcgugacccacaucguggccgagaacaacagcggcagcgacgugcuggaguggcugcaggcccagaaggugcaggugagcagccagcccgagcugcuggacgugagcuggcugaucgagugcaucagagccggcaagcccguggagaugaccggcaagcaccagcugguggugagaagagacuacagcgacagcaccaaccccggcccccccaagaccccccccaucgccgugcagaagaucagccaguacgccugccagagaagaaccacccugaacaacugcaaccagaucuucaccgacgccuucgacauccuggccgagaacugcgaguucagagagaacgaggacagcugcgugaccuucaugagagccgccagcgugcugaagagccugcccuucaccaucaucagcaugaaggacaccgagggcauccccugccugggcagcaaggugaagggcaucaucgaggagaucaucgaggacggcgagagcagcgaggugaaggccgugcugaacgacgagagauaccagagcuucaagcuguucaccagcguguucggcgugggccugaagaccagcgagaagugguucagaaugggcuucagaacccugagcaaggugagaagcgacaagagccugaaguucaccagaaugcagaaggccggcuuccuguacuacgaggaccuggugagcugcgugaccagagccgaggccgaggccgugagcgugcuggugaaggaggccgugugggccuuccugcccgacgccuucgugaccaugaccggcggcuucagaagaggcaagaagaugggccacgacguggacuuccugaucaccagccccggcagcaccgaggacgaggagcagcugcugcagaaggugaugaaccugugggagaagaagggccugcugcuguacuacgaccugguggagagcaccuucgagaagcugagacugcccagcagaaagguggacgcccuggaccacuuccagaagugcuuccugaucuucaagcugcccagacagagaguggacagcgaccagagcagcuggcaggagggcaagaccuggaaggccaucagaguggaccuggugcugugccccuacgagagaagagccuucgcccugcugggcuggaccggcagcagauucgagagagaccugagaagauacgccacccacgagagaaagaugauccuggacaaccacgcccuguacgacaagaccaagagaaucuuccugaaggccgagagcgaggaggagaucuucgcccaccugggccuggacuacaucgagcccugggagagaaacgccuaa

SEQ ID NO: 16255 - RNA, 1203 nt, Artificial Sequence
  DOC2A__Homo_sapiens__XP_011544277
augagaggcagaagaggcgacagaaugaccaucaacauccaggagcacauggccaucaacgugugccccggccccaucagacccaucagacagaucagcgacuacuuccccagaggccccggccccgagggcggcggcggcggcggcggcgaggcccccgcccaccuggugccccuggcccuggccccccccgccgcccugcugggcgccaccacccccgaggacggcgccgagguggacagcuacgacagcgacgacgccaccgcccugggcacccuggaguucgaccugcuguacgacagagccagcugcacccugcacugcagcauccugagagccaagggccugaagcccauggacuucaacggccuggccgaccccuacgugaagcugcaccugcugcccggcgccugcaaggccaacaagcugaagaccaagacccagagaaacacccugaaccccguguggaacgaggaccugaccuacagcggcaucaccgacgacgacaucacccacaaggugcugagaaucgccgugugcgacgaggacaagcugagccacaacgaguucaucggcgagaucagagugccccugagaagacugaagcccagccagaagaagcacuucaacaucugccuggagagacaggugccccuggccagccccagcagcaugagcgccgcccugagaggcaucagcugcuaccugaaggagcuggagcaggccgagcagggccagggccugcuggaggagagaggcagaauccugcugagccugagcuacagcagcagaagaagaggccugcuggugggcauccugagaugcgcccaccuggccgccauggacgugaacggcuacagcgaccccuacgugaagaccuaccugagacccgacguggacaagaagagcaagcacaagaccugcgugaagaagaagacccugaaccccgaguucaacgaggaguucuucuacgagaucgagcugagcacccuggccaccaagacccuggaggugaccgugugggacuacgacaucggcaagagcaacgacuucaucggcggcgugagccugggccccggcgccagaggcgaggccagaaagcacuggagcgacugccugcagcagcccgacgccgcccuggagagauggcacacccugaccagcgagcugccccccgccgccggcgcccugagcagcgccuaa

SEQ ID NO: 16256 - RNA, 1239 nt, Artificial Sequence
  DOC2B__Homo_sapiens__NP_003576
augacccugagaagaagaggcgagaaggccaccaucagcauccaggagcacauggccaucgacgugugccccggccccaucagacccaucaagcagaucagcgacuacuuccccagauuccccagaggccugccccccgacgccggccccagagccgccgccccccccgacgcccccgccagacccgccguggccggcgccggcagaagaagccccagcgacggcgccagagaggacgacgaggacguggaccagcuguucggcgccuacggcagcagccccggccccagccccggccccagccccgccagaccccccgccaagccccccgaggacgagcccgacgccgacggcuacgagagcgacgacugcaccgcccugggcacccuggacuucagccugcuguacgaccaggagaacaacgcccugcacugcaccaucaccaaggccaagggccugaagcccauggaccacaacggccuggccgaccccuacgugaagcugcaccugcugcccggcgccagcaaggccaacaagcugagaaccaagacccugagaaacacccugaaccccaccuggaacgagacccugaccuacuacggcaucaccgacgaggacaugaucagaaagacccugagaaucagcgugugcgacgaggacaaguucagacacaacgaguucaucggcgagaccagagugccccugaagaagcugaagcccaaccacaccaagaccuucagcaucugccuggagaagcagcugcccguggacaagaccgaggacaagagccuggaggagagaggcagaauccugaucagccugaaguacagcagccagaagcagggccugcuggugggcaucgugagaugcgcccaccuggccgccauggacgccaacggcuacagcgaccccuacgugaagaccuaccugagacccgacguggacaagaagagcaagcacaagaccgccgugaagaagaagacccugaaccccgaguucaacgaggaguucugcuacgagaucaagcacggcgaccuggccaagaagagccuggaggugaccgugugggacuacgacaucggcaagagcaacgacuucaucggcggcguggugcugggcauccacgccaagggcgagagacugaagcacugguucgacugccugaagaacaaggacaagagaaucgagagauggcacacccugaccagcgagcugcccggcgccgugcugagcgacuaa

SEQ ID NO: 16257 - RNA, 6543 nt, Artificial Sequence
  DOCK10__Homo_sapiens__NP_001277192
augagcuucagaggcaagguguucaagagagagcccagcgaguucuggaagaagagaagaaccgugagaagagugaaccaggaggagauccacagauucagcagccaggagaagcccagacugcuggagccccuggacuacgagaccgugaucgaggagcuggagaagaccuacagaaacgacccccugcaggaccugcuguucuuccccagcgacgacuucagcgccgccaccgugagcugggacaucagaacccuguacagcaccgugcccgaggacgccgagcacaaggccgagaaccugcuggugaaggaggccugcaaguucuacagcagccaguggcacguggugaacuacaaguacgagcaguacagcggcgacaucagacagcugcccagagccgaguacaagcccgagaagcugcccagccacagcuucgagaucgaccacgaggacgccgacaaggacgaggacaccaccagccacagcagcagcaagggcggcggcggcgccggcggcaccggcguguucaagagcggcuggcuguacaagggcaacuucaacagcaccgugaacaacaccgugaccgugagaagcuucaagaagagauacuuccagcugacccagcugcccgacaacagcuacaucaugaacuucuacaaggacgagaagaucagcaaggagcccaagggcugcaucuuccuggacagcugcaccggcguggugcagaacaacagacugagaaaguacgccuucgagcugaagaugaacgaccugaccuacuucgugcuggccgccgagaccgagagcgacauggacgaguggauccacacccugaacagaauccugcagaucagccccgagggcccccugcagggcagaagaagcaccgagcugaccgaccugggccuggacagccuggacaacagcgugaccugcgagugcacccccgaggagaccgacagcagcgagaacaaccugcacgccgacuucgccaaguaccugaccgagaccgaggacaccgugaagaccaccagaaacauggagagacugaaccuguucagccuggaccccgacaucgacacccugaagcugcagaagaaggaccugcuggagcccgagagcgugaucaagcccuucgaggagaaggccgccaagagaaucaugaucaucugcaaggcccugaacagcaaccugcagggcugcgugaccgagaacgagaacgaccccaucaccaacaucgagcccuucuucgugagcguggcccuguacgaccugagagacagcagaaagaucagcgccgacuuccacguggaccugaaccacgccgccgugagacagaugcugcugggcgccagcguggcccuggagaacggcaacaucgacaccaucacccccagacagagcgaggagccccacaucaagggccugcccgaggaguggcugaaguuccccaagcaggccguguucagcgugagcaacccccacagcgagaucgugcugguggccaagaucgagaaggugcugaugggcaacaucgccagcggcgccgagcccuacaucaagaaccccgacagcaacaaguacgcccagaagauccugaagagcaacagacaguucugcagcaagcugggcaaguacagaaugcccuucgccugggccgugagaagcguguucaaggacaaccagggcaacguggacagagacagcagauucagcccccuguucagacaggagagcagcaagaucagcaccgaggaccuggugaagcuggugagcgacuacagaagagccgacagaaucagcaagaugcagaccauccccggcagccuggacaucgccguggacaacgugccccuggagcaccccaacugcgugaccagcagcuucauccccgugaagcccuucaacaugauggcccagaccgagcccaccguggagguggaggaguucguguacgacagcaccaaguacugcagacccuacagaguguacaagaaccagaucuacaucuaccccaagcaccugaaguacgacagccagaagugcuucaacaaggccagaaacaucaccgugugcaucgaguucaagaacagcgacgaggagagcgccaagccccugaagugcaucuacggcaagcccggcggcccccuguucaccagcgccgccuacaccgccgugcugcaccacagccagaaccccgacuucagcgacgaggugaagaucgagcugcccacccagcugcacgagaagcaccacauccuguucagcuucuaccacgugaccugcgacaucaacgccaaggccaacgccaagaagaaggaggcccuggagaccagcgugggcuacgccuggcugccccugaugaagcacgaccagaucgccagccaggaguacaacauccccaucgccaccagccugccccccaacuaccugagcuuccaggacagcgccagcggcaagcacggcggcagcgacaucaaguggguggacggcggcaagccccuguucaaggugagcaccuucguggugagcaccgugaacacccaggacccccacgugaacgccuucuuccaggagugccagaagagagagaaggacaugagccagagccccaccagcaacuucaucagaagcugcaagaaccugcugaacguggagaagauccacgccaucaugagcuuccugcccaucauccugaaccagcuguucaaggugcuggugcagaacgaggaggacgagaucaccaccaccgugaccagagugcugaccgacaucguggccaagugccacgaggagcagcuggaccacagcgugcagagcuacaucaaguucguguucaagaccagagccugcaaggagagaaccgugcacgaggagcuggccaagaacgugaccggccugcugaagagcaacgacagcaccaccgugaagcacgugcugaagcacagcugguucuucuucgccaucauccugaagagcauggcccagcaccugaucgacaccaacaagauccagcugcccagaccccagagauuccccgagagcuaccagaacgagcuggacaaccuggugauggugcugagcgaccacgugaucuggaaguacaaggacgcccuggaggagaccagaagagccaaccacagcguggccagauuccugaagagaugcuucaccuucauggacagaggcuacguguucaagauggugaacaacuacaucagcauguucagcagcggcgaccugaagacccugugccaguacaaguucgacuuccugcaggaggugugccagcacgagcacuucaucccccugugccugcccaucagaagcgccaacauccccgacccccugacccccagcgagagcacccaggagcugcacgccagcgacaugcccgaguacagcgugaccaacgaguucugcagaaagcacuuccugaucggcauccugcugagagaggugggcuucgcccugcaggaggaccaggacgugagacaccuggcccuggccgugcugaagaaccugauggccaagcacagcuucgacgacagauacagagagcccagaaagcaggcccagaucgccagccuguacaugccccuguacggcaugcugcuggacaacaugcccagaaucuaccugaaggaccuguaccccuucaccgugaacaccagcaaccagggcagcagagacgaccugagcaccaacggcggcuuccagagccagaccgccaucaagcacgccaacagcguggacaccagcuucagcaaggacgugcugaacagcaucgccgccuucagcagcaucgccaucagcaccgugaaccacgccgacagcagagccagccuggccagccuggacagcaaccccagcaccaacgagaagagcagcgagaagaccgacaacugcgagaagauccccagaccccugagccugaucggcagcacccugagauucgacaagcuggaccaggccgagaccagaagccugcugaugugcuuccugcacaucaugaagaccaucagcuacgagacccugaucgccuacuggcagagagcccccagccccgaggugagcgacuucuucagcauccuggacgugugccugcagaacuucagauaccugggcaagagaaacaucaucagaaagaucgccgccgccuucaaguucgugcagagcacccagaacaacggcacccugaagggcagcaaccccagcugccagaccagcggccugcugagccaguggaugcacagcaccagcagccacgagggccacaagcagcacagaagccagacccugcccaucaucagaggcaagaacgcccugagcaaccccaagcugcugcagaugcuggacaacaccaugaccagcaacagcaacgagaucgacaucgugcaccacguggacaccgaggccaacaucgccaccgaggugugccugaccauccuggaccugcugagccuguucacccagacccaccagagacagcugcagcagugcgacugccagaacagccugaugaagagaguguucgacaccuacaugcuguucuuccaggugaaccagagcgccaccgcccugaagcacguguucgccagccugagacuguucgugugcaaguuccccagcgccuucuuccagggccccgccgaccugugcggcagcuucugcuacgaggugcugaagugcugcaaccacagaagcagaagcacccagaccgaggccagcgcccugcuguacuucuucaugagaaagaacuucgaguucaacaagcagaagagcaucgugagaagccaccugcagcugaucaaggccgugagccagcugaucgccgacgccggcaucggcggcagcagauuccagcacagccuggccaucaccaacaacuucgccaacggcgacaagcagaugaagaacagcaacuuccccgccgaggugaaggaccugaccaagagaaucagaaccgugcugauggccaccgcccagaugaaggagcacgagaaggaccccgagaugcugguggaccugcaguacagccuggccaacagcuacgccagcacccccgagcugagaagaaccuggcuggagagcauggccaagauccacgccagaaacggcgaccugagcgaggccgccaugugcuacauccacaucgccgcccugaucgccgaguaccugaagagaaagggcuacuggaagguggagaagaucugcaccgccagccugcugagcgaggacacccaccccugcgacagcaacagccugcugaccacccccagcggcggcagcauguucagcaugggcuggcccgccuuccugagcaucacccccaacaucaaggaggagggcgccaugaaggaggacagcggcaugcaggacacccccuacaacgagaacauccugguggagcagcuguacaugugcguggaguuccuguggaagagcgagagauacgagcugaucgccgacgugaacaagcccaucaucgccguguucgagaagcagagagacuucaagaagcugagcgaccuguacuacgacauccacagaagcuaccugaagguggccgagguggugaacagcgagaagagacuguucggcagauacuacagaguggccuucuacggccagggcuucuucgaggaggaggagggcaaggaguacaucuacaaggagcccaagcugaccggccugagcgagaucagccagagacugcugaagcuguacgccgacaaguucggcgccgacaacgugaagaucauccaggacagcaacaaggugaaccccaaggaccuggaccccaaguacgccuacauccaggugaccuacgugacccccuucuucgaggagaaggagaucgaggacagaaagaccgacuucgagaugcaccacaacaucaacagauucguguucgagacccccuucacccugagcggcaagaagcacggcggcguggccgagcagugcaagagaagaaccauccugaccaccagccaccuguuccccuacgugaagaagagaauccaggugaucagccagagcagcaccgagcugaaccccaucgagguggccaucgacgagaugagcaagaaggugagcgagcugaaccagcugugcaccauggaggagguggacaugaucagacugcagcugaagcugcagggcagcgugagcgugaaggugaacgccggccccauggccuacgccagagccuuccuggaggagaccaacgccaagaaguaccccgacaaccaggugaagcugcugaaggagaucuucagacaguucgccgacgccugcggccaggcccuggacgugaacgagagacugaucaaggaggaccagcuggaguaccaggaggagcugagaagccacuacaaggacaugcugagcgagcugagcaccgugaugaacgagcagaucaccggcagagacgaccugagcaagagaggcguggaccagaccugcaccagagugaucagcaaggccacccccgcccugcccaccgugagcaucagcagcagcgccgagguguaa

SEQ ID NO: 16258 - RNA, 6222 nt, Artificial Sequence
  DOCK11__Homo_sapiens__NP_653259
auggccgaggugagaaaguucaccaagagacugagcaagcccggcaccgccgccgagcugagacagagcgugagcgaggccgugagaggcagcguggugcuggagaaggccaaggugguggagccccuggacuacgagaacgugaucgcccagagaaagacccagaucuacagcgacccccugagagaccugcugauguuccccauggaggacaucagcaucagcgugaucggcagacagagaagaaccgugcagagcaccgugcccgaggacgccgagaagagagcccagagccuguucgugaaggagugcaucaagaccuacagcaccgacuggcacguggugaacuacaaguacgaggacuucagcggcgacuucagaaugcugcccugcaagagccugagacccgagaagauccccaaccacguguucgagaucgacgaggacugcgagaaggacgaggacagcagcagccugugcagccagaagggcggcgugaucaagcagggcuggcugcacaaggccaacgugaacagcaccaucaccgugaccaugaagguguucaagagaagauacuucuaccugacccagcugcccgacggcagcuacauccugaacagcuacaaggacgagaagaacagcaaggagagcaagggcugcaucuaccuggacgccugcaucgacguggugcagugccccaagaugagaagacacgccuucgagcugaagaugcuggacaaguacagccacuaccuggccgccgagaccgagcaggagauggaggaguggcugaucacccugaagaagaucauccagaucaacaccgacagccuggugcaggagaagaaggagaccguggagaccgcccaggacgacgagaccagcagccagggcaaggccgagaacaucauggccagccuggagagaagcaugcaccccgagcugaugaaguacggcagagagaccgagcagcugaacaagcugagcagaggcgacggcagacagaaccuguucagcuucgacagcgaggugcagagacuggacuucagcggcaucgagcccgacaucaagcccuucgaggagaagugcaacaagagauuccuggugaacugccacgaccugaccuucaacauccugggccagaucggcgacaacgccaagggcccccccaccaacguggagcccuucuucaucaaccuggcccuguucgacgugaagaacaacugcaagaucagcgccgacuuccacguggaccugaacccccccagcgugagagagaugcuguggggcagcagcacccagcuggccagcgacggcagccccaagggcagcagccccgagagcuacauccacggcaucgccgagagccagcugagauacauccagcagggcaucuucagcgugaccaacccccaccccgagaucuuccugguggccagaaucgagaaggugcugcagggcaacaucacccacugcgccgagcccuacaucaagaacagcgaccccgugaagaccgcccagaaggugcacagaaccgccaagcaggugugcagcagacugggccaguacagaaugcccuucgccugggccgccagacccaucuucaaggacacccagggcagccuggaccuggacggcagauucagcccccuguacaagcaggacagcagcaagcugagcagcgaggacauccugaagcugcugagcgaguacaagaagcccgagaagaccaagcugcagaucauccccggccagcugaacaucaccguggagugcgugcccguggaccugagcaacugcaucaccagcagcuacgugccccugaagcccuucgagaagaacugccagaacaucaccguggagguggaggaguucgugcccgagaugaccaaguacugcuaccccuucaccaucuacaagaaccaccuguacguguacccccugcagcugaaguacgacagccagaagaccuucgccaaggccagaaacaucgccgugugcguggaguucagagacagcgacgagagcgacgccagcgcccugaagugcaucuacggcaagcccgccggcagcguguucaccaccaacgccuacgccguggugagccaccacaaccagaaccccgaguucuacgacgagaucaagaucgagcugcccauccaccugcaccagaagcaccaccugcuguucaccuucuaccacgugagcugcgagaucaacaccaagggcaccaccaagaagcaggacaccguggagacccccgugggcuucgccugggugccccugcugaaggacggcagaaucaucaccuucgagcagcagcugcccgugagcgccaaccugccccccggcuaccugaaccugaacgacgccgagagcagaagacagugcaacguggacaucaaguggguggacggcgccaagccccugcugaagaucaagagccaccuggagagcaccaucuacacccaggaccugcacgugcacaaguucuuccaccacugccagcugauccagagcggcagcaaggaggugcccggcgagcugaucaaguaccugaagugccugcacgccauggagauccaggugaugauccaguuccugcccgugauccugaugcagcuguucagagugcugaccaacaugacccacgaggacgacgugcccaucaacugcaccauggugcugcugcacaucgugagcaagugccacgaggagggccuggacagcuaccugagaagcuucaucaaguacagcuucagacccgagaagcccagcgccccccaggcccagcugauccacgagacccuggccaccaccaugaucgccauccugaagcagagcgccgacuuccugagcaucaacaagcugcugaaguacagcugguucuucuucgagaucaucgccaagagcauggccaccuaccugcuggaggagaacaagaucaagcugcccagaggccagagauuccccgagaccuaccaccacgugcugcacagccugcugcuggccaucaucccccacgugaccaucagauacgccgagauccccgacgagagcagaaacgugaacuacagccuggccagcuuccugaagagaugccugacccugauggacagaggcuucaucuucaaccugaucaacgacuacaucagcggcuucagccccaaggaccccaaggugcuggccgaguacaaguucgaguuccugcagaccaucugcaaccacgagcacuacaucccccugaaccugcccauggccuucgccaagcccaagcugcagagagugcaggacagcaaccuggaguacagccugagcgacgaguacugcaagcaccacuuccuggugggccugcugcugagagagaccagcaucgcccugcaggacaacuacgagaucagauacaccgccaucagcgugaucaagaaccugcugaucaagcacgccuucgacaccagauaccagcacaagaaccagcaggccaagaucgcccagcuguaccugcccuucgugggccugcugcuggagaacauccagagacuggccggcagagacacccuguacagcugcgccgccaugcccaacagcgccagcagagacgaguuccccugcggcuucaccagccccgccaacagaggcagccugagcaccgacaaggacaccgccuacggcagcuuccagaacggccacggcaucaagagagaggacagcagaggcagccugauccccgagggcgccaccggcuuccccgaccagggcaacaccggcgagaacaccagacagagcagcaccagaagcagcgugagccaguacaacagacuggaccaguacgagaucagaagccugcugaugugcuaccuguacaucgugaagaugaucagcgaggacacccugcugaccuacuggaacaaggugagcccccaggagcugaucaacauccugauccugcuggaggugugccuguuccacuucagauacaugggcaagagaaacaucgccagagugcacgacgccuggcugagcaagcacuucggcaucgacagaaagagccagaccaugcccgcccugagaaacagaagcggcgugaugcaggccagacugcagcaccugagcagccuggagagcagcuucacccugaaccacagcagcaccaccaccgaggccgacaucuuccaccaggcccugcuggagggcaacaccgccaccgaggugagccugaccgugcuggacaccaucagcuucuucacccagugcuucaagacccagcugcugaacaacgacggccacaacccccugaugaagaagguguucgacauccaccuggccuuccugaagaacggccagagcgaggugagccugaagcacguguucgccagccugagagccuucaucagcaaguuccccagcgccuucuucaagggcagagugaacaugugcgccgccuucugcuacgaggugcugaagugcugcaccagcaagaucagcagcaccagaaacgaggccagcgcccugcuguaccugcugaugagaaacaacuucgaguacaccaagagaaagaccuuccugagaacccaccugcagaucaucaucgccgugagccagcugaucgccgacguggcccugagcggcggcagcagauuccaggagagccuguucaucaucaacaacuucgccaacagcgacagacccaugaaggccaccgccuuccccgccgaggugaaggaccugaccaagagaaucagaaccgugcugauggccaccgcccagaugaaggagcacgagaaggaccccgagaugcugaucgaccugcaguacagccuggccaagagcuacgccagcacccccgagcugagaaagaccuggcuggacagcauggccaagauccacgugaagaacggcgacuucagcgaggccgccaugugcuacgugcacguggccgcccugguggccgaguuccugcacagaaagaagcuguuccccaacggcugcagcgccuucaagaagaucacccccaacaucgacgaggagggcgccaugaaggaggacgccggcaugauggacgugcacuacagcgaggaggugcugcuggagcugcuggagcagugcguggacggccuguggaaggccgagagauacgagaucaucagcgagaucagcaagcugaucgugcccaucuacgagaagagaagagaguucgagaagcugacccagguguacagaacccugcacggcgccuacaccaagauccuggaggugaugcacaccaagaagagacugcugggcaccuucuucagaguggccuucuacggccagagcuucuucgaggaggaggacggcaaggaguacaucuacaaggagcccaagcugaccggccugagcgagaucagccugagacuggugaagcuguacggcgagaaguucggcaccgagaacgugaagaucauccaggacagcgacaaggugaacgccaaggagcuggaccccaaguacgcccacauccaggugaccuacgugaagcccuacuucgacgacaaggagcugaccgagagaaagaccgaguucgagagaaaccacaacaucagcagauucguguucgaggcccccuacacccugagcggcaagaagcagggcugcaucgaggagcagugcaagagaagaaccauccugaccaccagcaacagcuuccccuacgugaagaagagaauccccaucaacugcgagcagcagaucaaccugaagcccaucgacguggccaccgacgagaucaaggacaagaccgccgagcugcagaagcugugcagcagcaccgacguggacaugauccagcugcagcugaagcugcagggcugcgugagcgugcaggugaacgccggcccccuggccuacgccagagccuuccugaacgacagccaggccagcaaguacccccccaagaaggugagcgagcugaaggacauguucagaaaguucauccaggccugcagcaucgcccuggagcugaacgagagacugaucaaggaggaccagguggaguaccacgagggccugaagagcaacuucagagacauggugaaggagcugagcgacaucauccacgagcagauccugcaggaggacaccaugcacagccccuggaugagcaacacccugcacguguucugcgccaucagcggcaccagcagcgacagaggcuacggcagccccagauacgccgagguguaa

SEQ ID NO: 16259 - RNA, 5598 nt, Artificial Sequence
  DOCK1__Homo_sapiens__NP_001371
augaccagaugggugcccaccaagagagaggagaaguacggcguggccuucuacaacuacgacgccagaggcgccgacgagcugagccugcagaucggcgacaccgugcacauccuggagaccuacgagggcugguacagaggcuacacccugagaaagaagagcaagaagggcaucuuccccgccagcuacauccaccugaaggaggccaucguggagggcaagggccagcacgagaccgugauccccggcgaccugccccugauccaggaggugaccaccacccugagagaguggagcaccaucuggagacagcuguacgugcaggacaacagagagauguucagaagcgugagacacaugaucuacgaccugaucgaguggagaagccagauccugagcggcacccugccccaggacgagcugaaggagcugaagaagaaggugaccgccaagaucgacuacggcaacagaauccuggaccuggaccugguggugagagacgaggacggcaacauccuggaccccgagcugaccagcaccaucagccuguucagagcccacgagaucgccagcaagcagguggaggagagacugcaggaggagaagagccagaagcagaacaucgacaucaacagacaggccaaguucgccgccacccccagccuggcccuguucgugaaccugaagaacguggugugcaagaucggcgaggacgccgaggugcugaugagccuguacgaccccguggagagcaaguucaucagcgagaacuaccuggugagauggagcagcagcggccugcccaaggacaucgacagacugcacaaccugagagccguguucaccgaccugggcagcaaggaccugaagagagagaagaucagcuucgugugccagaucgugagagugggcagaauggagcugagagacaacaacaccagaaagcugaccagcggccugagaagacccuucggcguggccgugauggacgugaccgacaucaucaacggcaagguggacgacgaggacaagcagcacuucauccccuuccagcccguggccggcgagaacgacuuccugcagaccgugaucaacaaggugaucgccgccaaggaggugaaccacaagggccagggccugugggugacccugaagcugcugcccggcgacauccaccagaucagaaaggaguucccccaccugguggacagaaccaccgccguggccagaaagaccggcuuccccgagaucaucaugcccggcgacgugagaaacgacaucuacgugacccuggugcagggcgacuucgacaagggcagcaagaccaccgccaagaacguggaggugaccgugagcguguacgacgaggacggcaagagacuggagcacgugaucuuccccggcgccggcgacgaggccaucagcgaguacaagagcgugaucuacuaccaggugaagcagcccagaugguucgagaccgugaagguggccauccccaucgaggacgugaacagaagccaccugagauucaccuucagacacagaagcagccaggacagcaaggacaagagcgagaagaucuucgcccuggccuucgugaagcugaugagauacgacggcaccacccugagagacggcgagcacgaccugaucguguacaaggccgaggccaagaagcuggaggacgccgccaccuaccugagccugcccagcaccaaggccgagcuggaggagaagggccacagcgccaccggcaagagcaugcagagccugggcagcugcaccaucagcaaggacagcuuccagaucagcacccuggugugcagcaccaagcugacccagaacguggaccugcugggccugcugaaguggagaagcaacaccagccugcugcagcagaaccugagacagcugaugaagguggacggcggcgagguggugaaguuccugcaggacacccuggacgcccuguucaacaucaugauggagaacagcgagagcgagaccuucgacacccugguguucgacgcccugguguucaucaucggccugaucgccgacagaaaguuccagcacuucaaccccgugcuggagaccuacaucaagaagcacuucagcgccacccuggccuacaccaagcugaccaaggugcugaagaacuacguggacggcgccgagaagcccggcgugaacgagcagcuguacaaggccaugaaggcccuggagagcaucuucaaguucaucgugagaagcagaauccuguucaaccagcuguacgagaacaagggcgaggccgacuucguggagagccugcugcagcuguucagaagcaucaacgacaugaugagcagcaugagcgaccagaccgugagagugaagggcgccgcccugaaguaccugcccaccaucgugaacgacgugaagcugguguucgaccccaaggagcugagcaagauguucaccgaguucauccugaacgugcccaugggccugcugaccauccagaagcuguacugccugaucgagaucgugcacagcgaccuguucacccagcacgacugcagagagauccugcugcccaugaugaccgaccagcugaaguaccaccuggagagacaggaggaccuggaggccugcugccagcugcugagccacauccuggaggugcuguacagaaaggacgugggccccacccagagacacgugcagaucaucauggagaagcugcugagaaccgugaacagaaccgugaucagcaugggcagagacagcgagcugaucggcaacuucguggccugcaugaccgccauccugagacagauggaggacuaccacuacgcccaccugaucaagaccuucggcaagaugagaaccgacgugguggacuuccugauggagaccuucaucauguucaagaaccugaucggcaagaacguguaccccuucgacugggugaucaugaacauggugcagaacaagguguuccugagagccaucaaccaguacgccgacaugcugaacaagaaguuccuggaccaggccaacuucgagcugcagcuguggaacaacuacuuccaccuggccguggccuuccugacccaggagagccugcagcuggagaacuucagcagcgccaagagagccaagauccugaacaaguacggcgacaugagaagacagaucggcuucgagaucagagacaugugguacaaccugggccagcacaagaucaaguucauccccgagauggugggccccauccuggagaugacccugauccccgagaccgagcugagaaaggccaccauccccaucuucuucgacaugaugcagugcgaguuccacagcaccagaagcuuccagauguucgagaacgagaucaucaccaagcuggaccacgagguggagggcggcagaggcgacgagcaguacaaggugcuguucgacaagauccugcuggagcacugcagaaagcacaaguaccuggccaagaccggcgagaccuucgugaagcugguggugagacugauggagagacugcuggacuacagaaccaucaugcacgacgagaacaaggagaacagaaugagcugcaccgugaacgugcugaacuucuacaaggagaucgagagagaggagauguacaucagauaccuguacaagcugugcgaccugcacaaggagugcgacaacuacaccgaggccgccuacacccugcugcugcacgccaagcugcugaaguggagcgaggacgugugcguggcccaccugacccagagagacggcuaccaggccaccacccagggccagcugaaggagcagcuguaccaggagaucauccacuacuucgacaagggcaagaugugggaggaggccaucgcccugggcaaggagcuggccgagcaguacgagaacgagauguucgacuacgagcagcugagcgagcugcugaagaagcaggcccaguucuacgagaacaucgugaaggugaucagacccaagcccgacuacuucgccgugggcuacuacggccagggcuuccccaccuuccugagaggcaagguguucaucuacagaggcaaggaguacgagagaagagaggacuucgaggccagacugcugacccaguuccccaacgccgagaagaugaagaccaccagcccccccggcgacgacaucaagaacagccccggccaguacauccagugcuucaccgugaagcccaagcuggaccugccccccaaguuccacagacccgugagcgagcagaucgugagcuucuacagagugaacgaggugcagagauucgaguacagcagacccaucagaaagggcgagaagaaccccgacaacgaguucgccaacauguggaucgagagaaccaucuacaccaccgccuacaagcugcccggcauccugagaugguucgaggugaagagcguguucaugguggagaucagcccccuggagaacgccaucgagaccaugcagcugaccaacgacaagaucaacagcauggugcagcagcaccuggacgaccccagccugcccaucaacccccugagcaugcugcugaacggcaucguggaccccgccgugaugggcggcuucgccaacuacgagaaggccuucuucaccgacagauaccugcaggagcaccccgaggcccacgagaagaucgagaagcugaaggaccugaucgccuggcagauccccuuccuggccgagggcaucagaauccacggcgacaaggugaccgaggcccugagacccuuccacgagagaauggaggccugcuucaagcagcugaaggagaagguggagaaggaguacggcgugagaaucaugcccagcagccuggacgacagaagaggcagcagacccagaagcauggugagaagcuucaccaugcccagcagcagcagaccccugagcguggccagcgugagcagccugagcagcgacagcacccccagcagacccggcagcgacggcuucgcccuggagccccugcugcccaagaagaugcacagcagaagccaggacaagcuggacaaggacgaccuggagaaggagaagaaggacaagaagaaggagaagagaaacagcaagcaccaggagaucuucgagaaggaguucaagcccaccgacaucagccugcagcagagcgaggccgugauccugagcgagaccaucagcccccugagaccccagagacccaagagccaggugaugaacgugaucggcagcgagagaagauucagcgugagccccagcagccccagcagccagcagacccccccccccgugacccccagagccaagcugagcuucagcaugcagagcagccuggagcugaacggcaugaccggcgccgacguggccgacgugccccccccccugccccugaagggcagcguggccgacuacggcaaccugauggagaaccaggaccugcugggcagccccacccccccccccccccccccccaccagagacaccugccccccccccugcccagcaagaccccccccccccccccccccaagaccaccagaaagcagaccagcguggacagcggcaucgugcaguaa

SEQ ID NO: 16260 - RNA, 5493 nt, Artificial Sequence
  DOCK2__Homo_sapiens__NP_004937
auggcccccuggagaaaggccgacaaggagagacacggcguggccaucuacaacuuccagggcagcggcgccccccagcugagccugcagaucggcgacguggugagaauccaggagaccugcggcgacugguacagaggcuaccugaucaagcacaagaugcugcagggcaucuuccccaagagcuucauccacaucaaggaggugaccguggagaagagaagaaacaccgagaacaucauccccgccgagaucccccuggcccaggaggugaccaccacccugugggaguggggcagcaucuggaagcagcuguacguggccagcaagaaggagagauuccugcaggugcagagcaugauguacgaccugauggaguggagaagccagcugcugagcggcacccugcccaaggacgagcugaaggagcugaagcagaaggugaccagcaagaucgacuacggcaacaagauccuggagcuggaccugaucgugagagacgaggacggcaacauccuggaccccgacaacaccagcgugaucagccuguuccacgcccacgaggaggccaccgacaagaucaccgagagaaucaaggaggagaugagcaaggaccagcccgacuacgccauguacagcagaaucagcagcagccccacccacagccuguacguguucgugagaaacuucgugugcagaaucggcgaggacgccgagcuguucaugagccuguacgaccccaacaagcagaccgugaucagcgagaacuaccuggugagauggggcagcagaggcuuccccaaggagaucgagaugcugaacaaccugaaggugguguucaccgaccugggcaacaaggaccugaacagagacaagaucuaccugaucugccagaucgugagagugggcaagauggaccugaaggacaccggcgccaagaagugcacccagggccugagaagacccuucggcguggccgugauggacaucaccgacaucaucaagggcaaggccgagagcgacgaggagaagcagcacuucauccccuuccaccccgugaccgccgagaacgacuuccugcacagccugcugggcaaggugaucgccagcaagggcgacagcggcggccagggccugugggugaccaugaagaugcuggugggcgacaucauccagaucagaaaggacuacccccaccugguggacagaaccaccgugguggccagaaagcugggcuuccccgagaucaucaugcccggcgacgugagaaacgacaucuacaucacccugcugcagggcgacuucgacaaguacaacaagaccacccagagaaacguggaggugaucaugugcgugugcgccgaggacggcaagacccugcccaacgccaucugcgugggcgccggcgacaagcccaugaacgaguacagaagcgugguguacuaccaggugaagcagcccagauggauggagaccgugaagguggccgugcccaucgaggacaugcagagaauccaccugagauucauguucagacacagaagcagccuggagagcaaggacaagggcgagaagaacuucgccaugagcuacgugaagcugaugaaggaggacggcaccacccugcacgacggcuuccacgaccugguggugcugaagggcgacagcaagaagauggaggacgccagcgccuaccugacccugcccagcuacagacaccacguggagaacaagggcgccacccugagcagaagcagcagcagcgugggcggccugagcgugagcagcagagacguguucagcaucagcacccuggugugcagcaccaagcugacccagaacgugggccugcugggccugcugaaguggagaaugaagccccagcugcugcaggagaaccuggagaagcugaagaucguggacggcgaggagguggugaaguuccugcaggacacccuggacgcccuguucaacaucaugauggagcacagccagagcgacgaguacgacauccugguguucgacgcccugaucuacaucaucggccugaucgccgacagaaaguuccagcacuucaacaccgugcuggaggccuacauccagcagcacuucagcgccacccuggccuacaagaagcugaugaccgugcugaagaccuaccuggacaccagcagcagaggcgagcagugcgagcccauccugagaacccugaaggcccuggaguacguguucaaguucaucgugagaagcagaacccuguucagccagcuguacgagggcaaggagcagauggaguucgaggagagcaugagaagacuguucgagagcaucaacaaccugaugaagagccaguacaagaccaccauccugcugcagguggccgcccugaaguacauccccagcgugcugcacgacguggagaugguguucgacgccaagcugcugagccagcugcuguacgaguucuacaccugcaucccccccgugaagcugcagaagcagaaggugcagagcaugaacgagaucgugcagagcaaccuguucaagaagcaggagugcagagacauccugcugcccgugaucaccaaggagcugaaggagcugcuggagcagaaggacgacaugcagcaccaggugcuggagagaaaguacugcguggagcugcugaacagcauccuggaggugcugagcuaccaggacgccgccuucaccuaccaccacauccaggagaucauggugcagcugcugagaaccgugaacagaaccgugaucaccaugggcagagaccacauccugaucagccacuucguggccugcaugaccgccauccugaaccagaugggcgaccagcacuacagcuucuacaucgagaccuuccagaccagcagcgagcugguggacuuccugauggagaccuucaucauguucaaggaccugaucggcaagaacguguaccccggcgacuggauggccaugagcauggugcagaacagaguguuccugagagccaucaacaaguucgccgagaccaugaaccagaaguuccuggagcacaccaacuucgaguuccagcuguggaacaacuacuuccaccuggccguggccuucaucacccaggacagccugcagcuggagcaguucagccacgccaaguacaacaagauccugaacaaguacggcgacaugagaagacugaucggcuucagcaucagagacaugugguacaagcugggccagaacaagaucugcuucauccccggcauggugggccccauccuggagaugacccugauccccgaggccgagcugagaaaggccaccauccccaucuucuucgacaugaugcugugcgaguaccagagaagcggcgacuucaagaaguucgagaacgagaucauccugaagcuggaccacgagguggagggcggcagaggcgacgagcaguacaugcagcugcuggagagcauccugauggagugcgccgccgagcaccccaccaucgccaagagcguggagaacuucgugaaccuggugaagggccugcuggagaagcugcuggacuacagaggcgugaugaccgacgagagcaaggacaacagaaugagcugcaccgugaaccugcugaacuucuacaaggacaacaacagagaggagauguacaucagauaccuguacaagcugagagaccugcaccuggacugcgacaacuacaccgaggccgccuacacccugcugcugcacaccuggcugcugaaguggagcgacgagcagugcgccagccaggugaugcagaccggccagcagcacccccagacccacagacagcugaaggagacccuguacgagaccaucaucggcuacuucgacaagggcaagaugugggaggaggccaucagccugugcaaggagcuggccgagcaguacgagauggagaucuucgacuacgagcugcugagccagaaccugauccagcaggccaaguucuacgagagcaucaugaagauccugagacccaagcccgacuacuucgccgugggcuacuacggccagggcuuccccagcuuccugagaaacaagguguucaucuacagaggcaaggaguacgagagaagagaggacuuccagaugcagcugaugacccaguuccccaacgccgagaagaugaacaccaccagcgcccccggcgacgacgugaagaacgcccccggccaguacauccagugcuucaccgugcagcccgugcuggacgagcaccccagauucaagaacaagcccgugcccgaccagaucaucaacuucuacaagagcaacuacgugcagagauuccacuacagcagacccgugagaagaggcaccguggaccccgagaacgaguucgccagcauguggaucgagagaaccagcuucgugaccgccuacaagcugcccggcauccugagaugguucgagguggugcacaugagccagaccaccaucagcccccuggagaacgccaucgagaccaugagcaccgccaacgagaagauccugaugaugaucaaccaguaccagagcgacgagacccugcccaucaacccccugagcaugcugcugaacggcaucguggaccccgccgugaugggcggcuucgccaaguacgagaaggccuucuucaccgaggaguacgugagagaccaccccgaggaccaggacaagcugacccaccugaaggaccugaucgccuggcagauccccuuccugggcgccggcaucaagauccacgagaagagagugagcgacaaccugagacccuuccacgacagaauggaggagugcuucaagaaccugaagaugaagguggagaaggaguacggcgugagagagaugcccgacuucgacgacagaagagugggcagacccagaagcaugcugagaagcuacagacagaugagcaucaucagccuggccagcaugaacagcgacugcagcacccccagcaagcccaccagcgagagcuucgaccuggagcuggccagccccaagacccccagaguggagcaggaggagcccaucagccccggcagcacccugcccgaggugaagcugagaagaagcaagaagagaaccaagagaagcagcgugguguucgccgacgagaaggccgccgccgagagcgaccugaagagacugagcagaaagcacgaguucaugagcgacaccaaccugagcgagcacgccgccaucccccugaaggccagcgugcugagccagaugagcuucgccagccagagcaugcccaccauccccgcccuggcccugagcguggccggcauccccggccuggacgaggccaacaccagccccagacugagccagaccuuccugcagcugagcgacggcgacaagaagacccugaccagaaagaaggugaaccaguucuucaagaccaugcuggccagcaagagcgccgaggagggcaagcagauccccgacagccugagcaccgaccuguaa

SEQ ID NO: 16261 - RNA, 6093 nt, Artificial Sequence
  DOCK3__Homo_sapiens__NP_004938
auguggacccccaccgaggaggagaaguacggcguggugaucugcagcuucagaggcagcgugccccagggccuggugcuggagaucggcgagaccgugcagauccuggagaagugcgagggcugguacagaggcgugagcaccaagaagcccaacgugaagggcaucuuccccgccaacuacauccaccugaagaaggccaucgugagcaacagaggccaguacgagaccguggugccccuggaggacagcaucgugaccgaggugaccgccacccugcaggagugggccagccuguggaagcagcuguacgugaagcacaagguggaccuguucuacaagcugagacacgugaugaacgagcugaucgaccugagaagacagcugcugagcggccaccugacccaggaccaggugagagaggugaagagacacaucaccgugagacuggacuggggcaacgagcaccugggccuggaccuggugcccagaaaggacuucgaggugguggacagcgaccagaucagcgugagcgaccuguacaagaugcaccugagcagcagacagagcgugcagcagagcaccagccagguggacaccaugagacccagacacggcgagaccugcagaaugcccgugccccaccacuucuuccugagccugaagagcuucaccuacaacaccaucggcgaggacaccgacguguucuucagccuguacgacaugagagagggcaagcagaucagcgagagauuccuggugagacugaacaagaacggcggccccagaaaccccgagaagaucgagagaaugugcgcccuguucaccgaccugagcagcaaggacaugaagagagaccuguacaucguggcccacgugaucagaaucggcagaaugcugcugaacgacagcaagaagggccccccccaccugcacuacagaagacccuacggcugcgccgugcugagcauccuggacgugcugcagagccugaccgaggugaaggaggagaaggacuucgugcugaagguguacaccugcaacaacgagagcgaguggagccagauccacgagaacaucaucagaaagagcagcgccaaguacagcgcccccagcgccagccacggccugaucaucagccugcagcugcugagaggcgacauggagcagaucagaagagagaaccccaugaucuucaacagaggccuggccaucaccagaaagcugggcuuccccgacgugaucaugcccggcgacaucagaaacgaccuguaccugacccuggagaagggcgacuucgagagaggcggcaagagcgugcagaagaacaucgaggugaccauguacgugcuguacgccgacggcgagauccugaaggacugcaucagccugggcagcggcgagcccaacagaagcagcuaccacagcuucgugcuguaccacagcaacagccccagauggggcgagaucaucaagcugcccauccccaucgacagauucagaggcagccaccugagauucgaguucagacacugcagcaccaaggacaagggcgagaagaagcuguucggcuucgccuucagcacccugaugagagacgacggcaccacccugagcgacgacauccacgagcuguacguguacaagugcgacgagaacagcaccuucaacaaccacgcccuguaccugggccugcccugcugcaaggaggacuacaacggcugccccaacauccccagcagccugaucuuccagagaagcaccaaggagagcuucuucaucagcacccagcugagcagcaccaagcugacccagaacguggaccugcuggcccugcugaaguggaaggccuuccccgacagaaucauggacgugcugggcagacugagacacgugagcggcgaggagaucgugaaguuccugcaggacauccuggacacccuguucgugauccuggacgacaacaccgagaaguacggccugcugguguuccagagccugguguucaucaucaaccugcugagagacaucaaguacuuccacuucagacccgugauggacaccuacauccagaagcacuucgccggcgcccuggccuacaaggagcugaucagaugccugaagugguacauggacugcagcgccgagcugaucagacaggaccacauccaggaggccaugagagcccuggaguaccuguucaaguucaucgugcagagcagaauccuguacagcagagccaccugcggcauggaggaggagcaguucagaagcagcauccaggagcuguuccagagcaucagauucgugcugagccuggacagcagaaacagcgagacccugcuguucacccaggccgcccugcugaacagcuuccccaccaucuucgacgagcugcugcagauguucaccgugcaggagguggccgaguucgugagaggcacccugggcagcaugcccagcaccgugcacaucggccagagcauggacguggugaagcugcagagcaucgccagaaccguggacagcagacuguucagcuucagcgagagcagaagaauccugcugcccguggugcugcaccacauccaccugcaccugagacagcagaaggagcugcugaucugcagcggcauccugggcagcaucuucagcaucgugaagaccagcagccuggaggccgacgugauggaggagguggagaugaugguggagagccugcuggacgugcugcugcagacccugcugaccaucaugagcaagagccacgcccaggaggccgugagaggccagagaugcccccagugcaccgccgagaucaccggcgaguacgugagcugccugcugagccugcugagacagaugugcgacacccacuuccagcaccugcuggacaacuuccagagcaaggacgagcugaaggaguuccugcugaagaucuucugcguguucagaaaccugaugaagaugagcguguuccccagagacuggauggugaugagacugcugaccagcaacaucaucgugaccaccgugcaguaccugagcagcgcccugcacaagaacuucaccgagaccgacuucgacuucaagguguggaacagcuacuucagccuggccgugcuguucaucaaccagcccagccugcagcuggagaucaucaccagcgccaagagaaagaagauccuggacaaguacggcgacaugagagugaugauggccuacgagcuguucagcauguggcagaaccugggcgagcacaagauccacuucauccccggcaugaucggccccuuccugggcgugacccuggugccccagcccgaggugagaaacaucaugauccccaucuuccacgacaugauggacugggagcagagaaagaacggcaacuucaagcagguggaggccgagcugaucgacaagcuggacagcauggugagcgagggcaagggcgacgagagcuacagagagcuguucagccugcugacccagcuguucggccccuaccccagccugcuggagaagguggagcaggagaccuggagagagaccggcaucagcuucgugaccagcgugaccagacugauggagagacugcuggacuacagagacugcaugaagggcgaggagaccgagaacaagaagaucggcugcaccgugaaccugaugaacuucuacaagagcgagaucaacaaggaggagauguacaucagauacauccacaagcugugcgacaugcaccugcaggccgagaacuacaccgaggccgccuucacccugcugcuguacugcgagcugcugcagugggaggacagaccccugagagaguuccugcacuaccccagccagaccgaguggcagagaaaggagggccugugcagaaagaucauccacuacuucaacaagggcaagagcugggaguucggcaucccccugugcagagagcuggccugccaguacgagagccuguacgacuaccagagccugagcuggaucagaaagauggaggccagcuacuacgacaacaucauggagcagcagagacuggagcccgaguucuucagagugggcuucuacggcagaaaguuccccuucuuccugagaaacaaggaguacgugugcagaggccacgacuacgagagacuggaggccuuccagcagagaaugcugagcgaguucccccaggccguggccaugcagcaccccaaccaccccgacgacgccauccugcagugcgacgcccaguaccugcagaucuacgccgugacccccauccccgacuacguggacgugcugcagauggacagagugcccgacagagugaagagcuucuacagagugaacaacgugagaaaguucagauacgacagacccuuccacaagggccccaaggacaaggagaacgaguucaagagccuguggaucgagagaaccacccugacccugacccacagccugcccggcaucagcagaugguucgagguggagagaagagagcugguggaggugagcccccuggagaacgccauccaggugguggagaacaagaaccaggagcugagaagccugaucagccaguaccagcacaagcaggugcacggcaacaucaaccugcugagcaugugccugaacggcgugaucgacgccgccgugaacggcggcaucgccagauaccaggaggccuucuucgacaaggacuacaucaacaagcaccccggcgacgccgagaagaucacccagcugaaggagcugaugcaggagcaggugcacgugcugggcgugggccuggccgugcacgagaaguucgugcaccccgagaugagaccccugcacaagaagcugaucgaccaguuccagaugaugagagccagccuguaccacgaguuccccggccuggacaagcugagccccgccugcagcggcaccagcacccccagaggcaacgugcuggccagccacagccccaugagccccgagagcaucaagaugacccacagacacagccccaugaaccugaugggcaccggcagacacagcagcagcagccugagcagccacgccagcagcgaggccggcaacauggugaugcugggcgacggcagcaugggcgacgcccccgaggaccuguaccaccacaugcagcuggccuaccccaaccccagauaccagggcagcgugaccaacgugagcgugcugagcagcagccaggccagccccagcagcagcagccugagcagcacccacagcgcccccagccagaugaucaccagcgcccccagcagcgccagaggcagccccagccugcccgacaaguacagacacgccagagagaugaugcugcugcugcccaccuacagagacagacccagcagcgccauguaccccgccgccauccuggagaacggccagccccccaacuuccagagagcccuguuccagcagguggugggcgccugcaagcccugcagcgaccccaaccugagcguggccgagaagggccacuacagccugcacuucgacgccuuccaccacccccugggcgacaccccccccgcccugcccgccagaacccugagaaagagcccccugcaccccauccccgccagccccaccagcccccagagcggccuggacggcagcaacagcacccugagcggcagcgccagcagcggcgugagcagccugagcgagagcaacuucggccacagcagcgaggccccccccagaaccgacaccauggacagcaugcccagccaggccuggaacgccgacgaggaccuggagccccccuaccugcccgugcacuacagccugagcgagagcgccgugcuggacagcaucaaggcccagcccugcagaagccacagcgcccccggcugcgugaucccccaggaccccauggacccccccgcccugccccccaagcccuaccaccccagacugcccgcccuggagcacgacgagggcgugcugcugagagaggagaccgagagacccagaggccugcacagaaaggccccccugccccccggcagcgccaaggaggagcaggccagaauggccugggagcacggcagaggcgagcaguaa

SEQ ID NO: 16262 - RNA, 5901 nt, Artificial Sequence
  DOCK4__Homo_sapiens__NP_055520
auguggauccccaccgagcacgagaaguacggcguggugaucgccagcuucagaggcaccgugcccuacggccugagccuggagaucggcgacaccgugcagauccuggagaagugcgacggcugguacagaggcuucgcccugaagaaccccaacaucaagggcaucuuccccagcagcuacgugcaccugaagaacgccugcgugaagaacaagggccaguucgagauggugauccccaccgaggacagcgugaucaccgagaugaccagcacccugagagacuggggcaccauguggaagcagcuguacgugagaaacgagggcgaccuguuccacagacuguggcacaucaugaacgagauccuggaccugagaagacaggugcuggugggccaccugacccacgacagaaugaaggacgugaagagacacaucaccgccagacuggacuggggcaacgagcagcugggccuggaccuggugcccagaaaggaguacgccaugguggaccccgaggacaucagcaucaccgagcuguacagacugauggagcacagacacagaaagaaggacacccccgugcaggccagcagccaccaccuguucgugcagaugaagagccugaugugcagcaaccugggcgaggagcuggaggugaucuucagccuguucgacagcaaggagaacagacccaucagcgagagauucuuccugagacugaacagaaacggccugcccaaggcccccgacaagcccgagagacacugcagccuguucguggaccugggcagcagcgagcugagaaaggacaucuacaucaccgugcacaucaucagaaucggcagaaugggcgccggcgagaagaagaacgccugcagcgugcaguacagaagacccuucggcugcgccgugcugagcaucgccgaccugcugaccggcgagaccaaggacgaccugauccugaagguguacaugugcaacaccgagagcgagugguaccagauccacgagaacaucaucaagaagcugaacgccagauacaaccugaccggcagcaacgccggccuggccgugagccugcagcugcugcacggcgacaucgagcagaucagaagagaguacagcagcguguucagccacggcgugagcaucaccagaaagcugggcuucagcaacaucaucaugcccggcgagaugagaaacgaccuguacaucaccaucgagagaggcgaguucgagaagggcggcaagagcguggccagaaacguggaggugaccauguucaucguggacagcagcggccagacccugaaggacuucaucagcuucggcagcggcgagccccccgccagcgaguaccacagcuucgugcuguaccacaacaacagccccagauggagcgagcugcugaagcugcccauccccguggacaaguucagaggcgcccacaucagauucgaguucagacacugcagcaccaaggagaagggcgagaagaagcuguucggcuucagcuucgugccccugaugcaggaggacggcagaacccugcccgacggcacccacgagcugaucgugcacaagugcgaggagaacaccaaccugcaggacaccaccagauaccugaagcugcccuucagcaagggcaucuuccugggcaacaacaaccaggccaugaaggccaccaaggagagcuucugcaucaccagcuuccugugcagcaccaagcugacccagaacggcgacaugcuggaccugcugaaguggagaacccaccccgacaagaucaccggcugccugagcaagcugaaggagaucgacggcagcgagaucgugaaguuccugcaggacacccuggacacccuguucggcauccuggacgagaacagccagaaguacggcagcaagguguucgacagccuggugcacaucaucaaccugcugcaggacagcaaguuccaccacuucaagcccgugauggacaccuacaucgagagccacuucgccggcgcccuggccuacagagaccugaucaaggugcugaagugguacguggacagaaucaccgaggccgagagacaggagcacauccaggaggugcugaaggcccaggaguacaucuucaaguacaucgugcagagcagaagacuguucagccuggccaccggcggccagaacgaggaggaguucagaugcugcauccaggagcugcugaugagcgugagauucuuccugagccaggagagcaagggcagcggcgcccugagccagagccaggccguguuccugagcagcuuccccgccguguacagcgagcugcugaagcuguucgacgugagagagguggccaaccuggugcaggacacccugggcagccugcccaccauccugcacguggacgacagccugcaggccaucaagcugcagugcaucggcaagaccguggagagccagcuguacaccaaccccgacagcagauacauccugcugcccguggugcugcaccaccugcacauccaccugcaggagcagaaggaccugaucaugugcgccagaauccugagcaacguguucugccugaucaagaagaacagcagcgagaagagcgugcuggaggagaucgacgugaucguggccagccugcuggacauccugcugagaaccauccuggagaucaccagcagaccccagcccagcagcagcgccaugagauuccaguuccaggacgugaccggcgaguucguggccugccugcugagccugcugagacagaugaccgacagacacuaccagcagcugcuggacagcuucaacaccaaggaggagcugagagacuuccugcugcagaucuucaccguguucagaauccugaucagacccgagauguuccccaaggacuggaccgugaugagacugguggccaacaacgugaucaucaccaccgugcuguaccugagcgacgcccugagaaagaacuuccugaacgagaacuucgacuacaagaucugggacagcuacuucuaccuggccgugaucuucaucaaccagcugugccugcagcuggagauguucacccccagcaagaagaagaaggugcuggagaaguacggcgacaugagagugaccaugggcugcgagaucuucagcauguggcagaaccugggcgagcacaagcugcacuucauccccgcccugaucggccccuuccuggaggugacccugaucccccagcccgaccugagaaacgugaugauccccaucuuccacgacaugauggacugggagcagagaagaagcggcaacuucaagcagguggaggccaagcugaucgacaagcuggacagccugaugagcgagggcaagggcgacgagaccuacagagagcuguucaacagcauccugcugaagaagaucgagagagagaccuggagagagagcggcgugagccugaucgccaccgugaccagacugauggagagacugcuggacuacagagacugcaugaagaugggcgagguggacggcaagaagaucggcugcaccgugagccugcugaacuucuacaagaccgagcugaacaaggaggagauguacaucagauacauccacaagcuguacgaccugcaccugaaggcccagaacuucaccgaggccgccuacacccugcugcuguacgacgagcugcuggaguggagcgacagaccccugagagaguuccugaccuaccccaugcagaccgaguggcagagaaaggagcaccugcaccugaccaucauccagaacuucgacagaggcaagugcugggagaacggcaucauccugugcagaaagaucgccgagcaguacgagagcuacuacgacuacagaaaccugagcaagaugagaaugauggaggccagccuguacgacaagaucauggaccagcagagacuggagcccgaguucuucagagugggcuucuacggcaagaaguuccccuucuuccugagaaacaaggaguucgugugcagaggccacgacuacgagagacuggaggccuuccagcagagaaugcugaacgaguucccccacgccaucgccaugcagcacgccaaccagcccgacgagaccaucuuccaggccgaggcccaguaccugcagaucuacgccgugacccccauccccgagagccaggaggugcugcagagagagggcgugcccgacaacaucaagagcuucuacaaggugaaccacaucuggaaguucagauacgacagacccuuccacaagggcaccaaggacaaggagaacgaguucaagagccuguggguggagagaaccagccuguaccuggugcagagccugcccggcaucagcagaugguucgagguggagaagagagaggugguggagaugagcccccuggagaacgccaucgaggugcuggagaacaagaaccagcagcugaagacccugaucagccagugccagaccagacagaugcagaacaucaacccccugaccaugugccugaacggcgugaucgacgccgccgugaacggcggcgugagcagauaccaggaggccuucuucgugaaggaguacauccugagccaccccgaggacggcgagaagaucgccagacugagagagcugaugcuggagcaggcccagauccuggaguucggccuggccgugcacgagaaguucgugccccaggacaugagaccccugcacaagaagcugguggaccaguucuucgugaugaagagcagccugggcauccaggaguucagcgccugcaugcaggccagccccgugcacuuccccaacggcagccccagagugugcagaaacagcgcccccgccagcgugagccccgacggcaccagagugauccccagaagaagcccccugagcuaccccgccgugaacagauacagcagcagcagccugagcagccaggccagcgccgaggugagcaacaucaccggccagagcgagagcagcgacgagguguucaacaugcagcccagccccagcaccagcagccugagcagcacccacagcgccagccccaacgugaccagcagcgcccccagcagcgccagagccagcccccugcugagcgacaagcacaagcacagcagagagaacagcugccugagccccagagagagacccugcagcgccaucuaccccacccccguggagcccagccagagaaugcuguucaaccacaucggcgacggcgcccugcccagaagcgaccccaaccugagcgcccccgagaaggccgugaaccccacccccagcagcuggagccuggacagcggcaaggaggccaagaacaugagcgacagcggcaagcugaucagcccccccgugccccccagacccacccagaccgccagccccgccagacacaccaccagcgugagccccagccccgccggcagaagcccccugaagggcagcgugcagagcuucacccccagccccguggaguaccacagccccggccugaucagcaacagccccgugcugagcggcagcuacagcagcggcaucagcagccugagcagaugcagcaccagcgagaccagcggcuucgagaaccaggugaacgagcagagcgccccccugcccgugcccgugcccgugcccgugcccagcuacggcggcgaggagcccgugagaaaggagagcaagacccccccccccuacagcguguacgagagaacccugagaagacccgugccccugccccacagccugagcauccccgugaccagcgagccccccgcccugccccccaagccccuggccgccagaagcagccaccuggagaacggcgccagaagaaccgaccccggccccagacccagaccccugcccagaaaggugagccagcuguaa

SEQ ID NO: 16263 - RNA, 5613 nt, Artificial Sequence
  DOCK5__Homo_sapiens__NP_079216
auggccagauggauccccaccaagagacagaaguacggcguggccaucuacaacuacaacgccagccaggacguggagcugagccugcagaucggcgacaccgugcacauccuggagauguacgagggcugguacagaggcuacacccugcagaacaagagcaagaagggcaucuuccccgagaccuacauccaccugaaggaggccaccguggaggaccugggccagcacgagaccgugauccccggcgagcugccccuggugcaggagcugaccagcacccugagagagugggccgugaucuggagaaagcuguacgugaacaacaagcugacccuguucagacagcugcagcagaugaccuacagccugaucgaguggagaagccagauccugagcggcacccugcccaaggacgagcuggccgagcugaagaagaaggugaccgccaagaucgaccacggcaacagaaugcugggccuggaccugguggugagagacgacaacggcaacauccuggaccccgacgagaccagcaccaucgcccuguucaaggcccacgagguggccagcaagagaaucgaggagaagauccaggaggagaagagcauccugcagaaccuggaccugagaggccagagcaucuucagcaccauccacaccuacggccuguacgugaacuucaagaacuucgugugcaacaucggcgaggacgccgagcuguucauggcccuguacgaccccgaccagagcaccuucaucagcgagaacuaccugaucagauggggcagcaacggcaugcccaaggagaucgagaagcugaacaaccugcaggccguguucaccgaccugagcagcauggaccugaucagacccagagugagccuggugugccagaucgugagagugggccacauggagcugaaggagggcaagaagcacaccugcggccugagaagacccuucggcguggccgugauggacaucaccgacaucauccacggcaagguggacgacgaggagaagcagcacuucauccccuuccagcagaucgccauggagaccuacaucagacagagacagcugaucaugagcccccugaucaccagccacgugaucggcgagaacgagccccugaccagcgugcugaacaaggugaucgccgccaaggaggugaaccacaagggccagggccugugggugagccugaagcugcugcccggcgaccugacccaggugcagaagaacuucagccaccugguggacagaagcaccgccaucgccagaaagaugggcuuccccgagaucauccugcccggcgacgugagaaacgacaucuacgugacccugauccacggcgaguucgacaagggcaagaagaagacccccaagaacguggaggugaccaugagcgugcacgacgaggagggcaagcugcuggagaaggccauccaccccggcgccggcuacgagggcaucagcgaguacaagagcgugguguacuaccaggugaagcagcccugcugguacgagaccgugaaggugagcaucgccaucgaggaggugaccagaugccacaucagauucaccuucagacacagaagcagccaggagaccagagacaagagcgagagagccuucggcguggccuucgugaagcugaugaaccccgacggcaccacccugcaggacggcagacacgaccuggugguguacaagggcgacaacaagaagauggaggacgccaaguucuaccugacccugcccggcaccaagauggagauggaggagaaggagcugcaggccagcaagaaccuggugaccuucacccccagcaaggacagcaccaaggacagcuuccagaucgccacccugaucugcagcaccaagcugacccagaacguggaccugcugggccugcugaacuggagaagcaacagccagaacaucaagcacaaccugaagaagcugauggagguggacggcggcgagaucgugaaguuccugcaggacacccuggacgcccuguucaacaucaugauggagaugagcgacagcgagaccuacgacuuccugguguucgacgcccugguguucaucaucagccugaucggcgacaucaaguuccagcacuucaaccccgugcuggagaccuacaucuacaagcacuucagcgccacccuggccuacgugaagcugagcaaggugcugaacuucuacguggccaacgccgacgacagcagcaagaccgagcugcuguucgccgcccugaaggcccugaaguaccuguucagauucaucauccagagcagagugcuguaccugagauucuacggccagagcaaggacggcgacgaguucaacaacagcaucagacagcuguuccuggccuucaacaugcugauggacagaccccuggaggaggccgugaagaucaagggcgccgcccugaaguaccugcccagcaucaucaacgacgugaagcugguguucgaccccguggagcugagcgugcuguucugcaaguucauccagagcauccccgacaaccagcuggugagacagaagcugaacugcaugaccaagaucguggagagcacccuguucagacagagcgagugcagagaggugcugcugccccugcugaccgaccagcugagcggccagcuggacgacaacagcaacaagcccgaccacgaggccagcagccagcugcugagcaacauccuggaggugcuggacagaaaggacgugggcgccaccgccgugcacauccagcugaucauggagagacugcugagaagaaucaacagaaccgugaucggcaugaacagacagagcccccacaucggcagcuucguggccugcaugaucgcccugcugcagcagauggacgacagccacuacagccacuacaucagcaccuucaagaccagacaggacaucaucgacuuccugauggagaccuucaucauguucaaggaccugaucggcaagaacguguacgccaaggacuggauggugaugaacaugacccagaacagaguguuccugagagccaucaaccaguucgccgaggugcugaccagauucuucauggaccaggccagcuucgagcugcagcuguggaacaacuacuuccaccuggccguggccuuccugacccacgagagccugcagcuggagaccuucagccaggccaagagaaacaagaucgugaagaaguacggcgacaugagaaaggagaucggcuucagaaucagagacaugugguacaaccugggcccccacaagaucaaguucauccccagcauggugggccccauccuggaggugacccugacccccgagguggagcugagaaaggccaccauccccaucuucuucgacaugaugcagugcgaguucaacuucagcggcaacggcaacuuccacauguucgagaacgagcugaucaccaagcuggaccaggagguggagggcggcagaggcgacgagcaguacaaggugcugcuggagaagcugcugcuggagcacugcagaaagcacaaguaccugagcagcagcggcgagguguucgcccugcuggugagcagccugcuggagaaccugcuggacuacagaaccaucaucaugcaggacgagagcaaggagaacagaaugagcugcaccgugaacgugcugaacuucuacaaggagaagaagagagaggacaucuacaucagauaccuguacaagcugagagaccugcacagagacugcgagaacuacaccgaggccgccuacacccugcugcugcacgccgagcugcugcaguggagcgacaagcccugcgugccccaccugcugcagaaggacagcuacuacguguacacccagcaggagcugaaggagaagcuguaccaggagaucaucagcuacuucgacaagggcaagaugugggagaaggccaucaagcugagcaaggagcuggccgagaccuacgagagcaagguguucgacuacgagggccugggcaaccugcugaagaagagagccagcuucuacgagaacaucaucaaggccaugagaccccagcccgaguacuucgccgugggcuacuacggccagggcuuccccagcuuccugagaaacaagaucuucaucuacagaggcaaggaguacgagagaagagaggacuucagccugagacugcugacccaguuccccaacgccgagaagaugaccagcaccaccccccccggcgaggacaucaagagcagccccaagcaguacaugcagugcuucaccgugaagcccgugaugagccugccccccagcuacaaggacaagcccgugcccgagcagauccugaacuacuacagagccaacgaggugcagcaguucagauacagcagacccuucagaaagggcgagaaggaccccgacaacgaguucgccaccauguggaucgagagaaccaccuacaccaccgccuacaccuuccccggcauccugaagugguucgaggugaagcagaucagcaccgaggagaucagcccccuggagaacgccaucgagaccauggagcugaccaacgagagaaucagcaacugcgugcagcagcacgccugggacagaagccugagcgugcacccccugagcaugcugcugagcggcaucguggaccccgccgugaugggcggcuucagcaacuacgagaaggccuucuucaccgagaaguaccugcaggagcaccccgaggaccaggagaagguggagcugcugaagagacugaucgcccugcagaugccccugcugaccgagggcaucagaauccacggcgagaagcugaccgagcagcugaagccccugcacgagagacugagcagcugcuucagagagcugaaggagaagguggagaagcacuacggcgugaucacccugccccccaaccugaccgagagaaagcagagcagaaccggcagcaucgugcugcccuacaucaugagcagcacccugagaagacugagcaucaccagcgugaccagcagcguggugagcaccagcagcaacagcagcgacaacgcccccagcagacccggcagcgacggcagcauccuggagccccugcuggagagaagagccagcagcggcgccagaguggaggaccugagccugagagaggagaacagcgagaacagaaucagcaaguucaagagaaaggacuggagccugagcaagagccaggugaucgccgagaaggcccccgagcccgaccugaugagccccaccagaaaggcccagagacccaagagccugcagcugauggacaacagacugagccccuuccacggcagcagccccccccagagcaccccccugagcccccccccccugacccccaaggccaccagaacccugagcagccccagccugcagaccgacggcaucgccgccacccccgugccccccccccccccccccaagagcaagcccuacgagggcagccagagaaacagcaccgagcuggcccccccccugcccgugagaagagaggccaaggccccccccccccccccccccaaggccagaaagagcggcauccccaccagcgagcccggcagccaguaa

SEQ ID NO: 16264 - RNA, 6144 nt, Artificial Sequence
  DOCK6__Homo_sapiens__NP_065863
auggccgccagcgagagaagagccuucgcccacaagaucaacagaaccguggccgccgaggugagaaagcaggugagcagagagagaagcggcagcccccacagcagcagaagaugcagcagcagccugggcgugccccugaccgaggugguggagccccuggacuucgaggacgugcugcugagcagaccccccgacgccgagcccggcccccugagagaccugguggaguuccccgccgacgaccuggagcugcugcugcagcccagagagugcagaaccaccgagcccggcauccccaaggacgagaagcuggacgcccaggugagagccgccguggagauguacaucgaggacugggugaucgugcacagaagauaccaguaccugagcgccgccuacagccccgugaccaccgacacccagagagagagacagaagggccugcccagacagguguucgagcaggacgccagcggcgacgagagaagcggccccgaggacagcaacgacagcagaagaggcagcggcagccccgaggacacccccagaagcagcggcgccagcagcaucuucgaccugagaaaccuggccgccgacagccugcugcccagccugcuggagagagccgcccccgaggacguggacagaagaaacgagacccugagaagacagcacagaccccccgcccugcugacccuguaccccgcccccgacgaggacgaggccguggagagaugcagcagacccgagccccccagagagcacuucggccagagaauccuggugaagugccugagccugaaguucgagaucgagaucgagcccaucuucggcauccuggcccuguacgacgugagagagaagaagaagaucagcgagaacuucuacuucgaccugaacagcgacagcaugaagggccugcugagagcccacggcacccaccccgccaucagcacccuggccagaagcgccaucuucagcgugaccuaccccagccccgacaucuuccuggugaucaagcuggagaaggugcugcagcagggcgacaucagcgagugcugcgagcccuacauggugcugaaggagguggacaccgccaagaacaaggagaagcuggagaagcugagacuggccgccgagcaguucugcaccagacugggcagauacagaaugcccuucgccuggaccgccgugcaccuggccaacaucgugagcagcgccggccagcuggacagagacagcgacagcgagggcgagagaagacccgccuggaccgacagaagaagaagaggcccccaggacagagccagcagcggcgacgacgccugcagcuucagcggcuucagacccgccacccugaccgugaccaacuucuucaagcaggaggccgagagacugagcgacgaggaccuguucaaguuccuggccgacaugagaagacccagcagccugcugagaagacugagacccgugaccgcccagcugaagaucgacaucagccccgcccccgagaacccccacuucugccugagccccgagcugcugcacaucaagcccuaccccgaccccagaggcagacccaccaaggagauccuggaguuccccgccagagagguguacgccccccacaccagcuacagaaaccugcuguacguguacccccacagccugaacuucagcagcagacagggcagcgugagaaaccuggccgugagagugcaguacaugaccggcgaggaccccagccaggcccugcccgugaucuucggcaagagcagcugcagcgaguucaccagagaggccuucacccccgugguguaccacaacaagagccccgaguucuacgaggaguucaagcugcaccugcccgccugcgugaccgagaaccaccaccugcuguucaccuucuaccacgugagcugccagcccagacccggcaccgcccuggagacccccgugggcuucaccuggaucccccugcugcagcacggcagacugagaaccggccccuucugccugcccgugagcguggaccagcccccccccagcuacagcgugcugacccccgacguggcccugcccggcaugagauggguggacggccacaagggcguguucagcguggagcugaccgccgugagcagcgugcacccccaggaccccuaccuggacaaguucuucacccuggugcacgugcuggaggagggcgccuuccccuucagacugaaggacaccgugcugagcgagggcaacguggagcaggagcugagagccagccuggccgcccugagacuggccagccccgagccccugguggccuucagccaccacgugcuggacaagcuggugagacuggugaucagaccccccaucaucagcggccagaucgugaaccugggcagaggcgccuucgaggccauggcccacguggugagccuggugcacagaagccuggaggccgcccaggacgccagaggccacugcccccagcuggccgccuacgugcacuacgccuucagacugcccggcaccgagcccagccugcccgacggcgccccccccgugaccgugcaggccgccacccuggccagaggcagcggcagacccgccagccuguaccuggccagaagcaagagcaucagcagcagcaaccccgaccuggccguggcccccggcagcguggacgacgaggugagcagaauccuggccagcaagcugcugcacgaggagcuggcccugcaguggguggugagcagcagcgccgugagagaggccauccugcagcacgccugguucuucuuccagcugauggugaagagcauggcccugcaccugcugcugggccagagacuggacacccccagaaagcugagauuccccggcagauuccuggacgacaucaccgcccuggugggcagcgugggccuggaggugaucaccagagugcacaaggacguggagcuggccgagcaccugaacgccagccuggccuucuuccugagcgaccugcugagccugguggacagaggcuucguguucagccuggugagagcccacuacaagcagguggccaccagacugcagagcagccccaaccccgccgcccugcugacccugagaauggaguucaccagaauccugugcagccacgagcacuacgugacccugaaccugcccugcugcccccugagcccccccgccagccccagccccagcgugagcagcaccaccagccagagcagcaccuucagcagccaggcccccgaccccaaggugaccagcauguucgagcugagcggccccuucagacagcagcacuuccuggccggccugcugcugaccgagcuggcccuggcccuggagcccgaggccgagggcgccuuccugcugcacaagaaggccaucagcgccgugcacagccugcugugcggccacgacaccgaccccagauacgccgaggccaccgugaaggccagaguggccgagcuguaccugccccugcugagcaucgccagagacacccugcccagacugcacgacuucgccgagggccccggccagagaagcagacuggccagcaugcuggacagcgacaccgagggcgagggcgacaucgccggcaccaucaaccccagcguggccauggccaucgccggcggcccccuggcccccggcagcagagccagcaucagccagggcccccccaccgccagcagagccggcugcgcccugagcgccgagagcagcagaacccugcuggccugcgugcugugggugcugaagaacaccgagcccgcccugcugcagagaugggccaccgaccugacccugccccagcugggcagacugcuggaccugcuguaccugugccuggccgccuucgaguacaagggcaagaaggccuucgagagaaucaacagccugaccuucaagaagagccuggacaugaaggccagacuggaggaggccauccugggcaccaucggcgccagacaggagauggugagaagaagcagagagagaagccccuucggcaaccccgagaacgugagauggagaaagagcgugacccacuggaagcagaccagcgacagaguggacaagaccaaggacgagauggagcacgaggcccugguggagggcaaccuggccaccgaggccagccugguggugcuggacacccuggagaucaucgugcagaccgugaugcugagcgaggccagagagagcgugcugggcgccgugcugaagguggugcuguacagccugggcagcgcccagagcgcccuguuccugcagcacggccuggccacccagagagcccuggugagcaaguuccccgagcugcuguucgaggaggacaccgagcugugcgccgaccugugccugagacugcugagacacugcggcagcagaaucagcaccaucagaacccacgccagcgccagccuguaccugcugaugagacagaacuucgagaucggccacaacuucgccagagugaagaugcaggugaccaugagccugagcagccuggugggcaccacccagaacuucagcgaggagcaccugagaagaagccugaagaccauccugaccuacgccgaggaggacaugggccugagagacagcaccuucgccgagcaggugcaggaccugauguucaaccugcacaugauccugaccgacaccgugaagaugaaggagcaccaggaggaccccgagaugcugaucgaccugauguacagaaucgccagaggcuaccagggcagccccgaccugagacugaccuggcugcagaacauggccggcaagcacgccgagcugggcaaccacgccgaggccgcccagugcauggugcacgccgccgcccugguggccgaguaccuggcccugcuggaggaccacagacaccugcccgugggcugcgugagcuuccagaacaucagcagcaacgugcuggaggagagcgccaucagcgacgacauccugagccccgacgaggagggcuucugcagcggcaagcacuucaccgagcugggccuggugggccugcuggagcaggccgccggcuacuucaccaugggcggccuguacgaggccgugaacgagguguacaagaaccugauccccauccuggaggcccacagagacuacaagaagcuggccgccgugcacggcaagcugcaggaggccuucaccaagaucaugcaccagagcagcggcugggagagaguguucggcaccuacuucagagugggcuucuacggcgcccacuucggcgaccuggacgagcaggaguucguguacaaggagcccagcaucaccaagcuggccgagaucagccacagacuggaggaguucuacaccgagagauucggcgacgacgugguggagaucaucaaggacagcaaccccguggacaagagcaagcuggacagccagaaggccuacauccagaucaccuacguggagcccuacuucgacaccuacgagcugaaggacagagugaccuacuucgacagaaacuacggccugagaaccuuccuguucugcacccccuucacccccgacggcagagcccacggcgagcugcccgagcagcacaagagaaagacccugcugagcaccgaccacgccuuccccuacaucaagaccagaaucagagugugccacagagaggagaccgugcugacccccguggagguggccaucgaggacaugcagaagaagaccagagagcuggccuucgccaccgagcaggacccccccgacgccaagaugcugcagauggugcugcagggcagcgugggccccaccgugaaccagggcccccuggagguggcccagguguuccuggccgagauccccgaggaccccaagcuguucagacaccacaacaagcugagacugugcuucaaggacuucugcaagaagugcgaggacgcccugagaaagaacaaggcccugaucggccccgaccagaaggaguaccacagagagcuggagagaaacuacugcagacugagagaggcccugcagccccugcugacccagagacugccccagcugauggcccccaccccccccggccugagaaacagccugaacagagccagcuucagaaaggccgaccuguaa

SEQ ID NO: 16265 - RNA, 6423 nt, Artificial Sequence
  DOCK7__Homo_sapiens__XP_011540628
auggccgagagaagagccuucgcccagaagaucagcagaaccguggccgccgaggugagaaagcagaucagcggccaguacagcggcagcccccagcugcugaagaaccugaacaucgugggcaacaucagccaccacaccaccgugccccugaccgaggccguggaccccguggaccuggaggacuaccugaucacccacccccuggccguggacagcggcccccugagagaccugaucgaguucccccccgacgacaucgaggugguguacagccccagagacugcagaacccuggugagcgccgugcccgaggagagcgagauggacccccacgugagagacugcaucagaagcuacaccgaggacugggccaucgugaucagaaaguaccacaagcugggcaccggcuucaaccccaacacccuggacaagcagaaggagagacagaagggccugcccaagcagguguucgagagcgacgaggcccccgacggcaacagcuaccaggacgaccaggacgaccugaagagaagaagcaugagcaucgacgacacccccagaggcagcugggccugcagcaucuucgaccugaagaacagccugcccgacgcccugcugcccaaccugcuggacagaacccccaacgaggagaucgacagacagaacgacgaccagagaaagagcaacagacacaaggagcuguucgcccugcaccccagccccgacgaggaggagcccaucgagagacugagcgugcccgacauccccaaggagcacuucggccagagacugcuggugaagugccugagccugaaguucgagaucgagaucgagcccaucuucgccagccuggcccuguacgacgugaaggagaagaagaagaucagcgagaacuucuacuucgaccugaacagcgagcagaugaagggccugcugagaccccacgugccccccgccgccaucaccacccuggccagaagcgccaucuucagcaucaccuaccccagccaggacguguuccuggugaucaagcuggagaaggugcugcagcagggcgacaucggcgagugcgccgagcccuacaugaucuucaaggaggccgacgccaccaagaacaaggagaagcuggagaagcugaagagccaggccgaccaguucugccagagacugggcaaguacagaaugcccuucgccuggaccgccauccaccugaugaacaucgugagcagcgccggcagccuggagagagacagcaccgagguggagaucagcaccggcgagagaaagggcagcuggagcgagagaagaaacagcagcaucgugggcagaagaagccuggagagaaccaccagcggcgacgacgccugcaaccugaccagcuucagacccgccacccugaccgugaccaacuucuucaagcaggagggcgacagacugagcgacgaggaccuguacaaguuccuggccgacaugagaagacccagcagcgugcugagaagacugagacccaucaccgcccagcugaagaucgacaucagccccgcccccgagaacccccacuacugccugacccccgagcugcugcaggugaagcuguaccccgacagcagagugagacccaccagagagauccuggaguuccccgccagagacguguacgugcccaacaccaccuacagaaaccugcuguacaucuacccccagagccugaacuucgccaacagacagggcagcgccagaaacaucaccgugaaggugcaguucauguacggcgaggaccccagcaacgccaugcccgugaucuucggcaagagcagcugcagcgaguucagcaaggaggccuacaccgccgugguguaccacaacagaagccccgacuuccacgaggagaucaaggugaagcugcccgccacccugaccgaccaccaccaccugcuguucaccuucuaccacgugagcugccagcagaagcagaacaccccccuggagacccccgugggcuacaccuggauccccaugcugcagaacggcagacugaagaccggccaguucugccugcccgugagccuggagaagcccccccaggccuacagcgugcugagccccgaggugccccugcccggcaugaaguggguggacaaccacaagggcguguucaacguggaggugguggccgugagcagcauccacacccaggaccccuaccuggacaaguucuucgcccuggugaacgcccuggacgagcaccuguuccccgugagaaucggcgacaugagaaucauggagaacaaccuggagaacgagcugaagagcagcaucagcgcccugaacagcagccagcuggagcccguggugagauuccugcaccugcugcuggacaagcugauccugcuggugaucagaccccccgugaucgccggccagaucgugaaccugggccaggccagcuucgaggccauggccagcaucaucaacagacugcacaagaaccuggagggcaaccacgaccagcacggcagaaacagccugcuggccagcuacauccacuacguguucagacugcccaacaccuaccccaacagcagcagccccggccccggcggccugggcggcagcgugcacuacgccaccauggccagaagcgccgugagacccgccagccugaaccugaacagaagcagaagccugagcaacagcaaccccgacaucagcggcacccccaccagccccgacgacgaggugagaagcaucaucggcagcaagggccuggacagaagcaacagcugggugaacaccggcggccccaaggccgcccccuggggcagcaaccccagccccagcgccgagagcacccaggccauggacagaagcugcaacagaaugagcagccacaccgagaccagcagcuuccugcagacccugaccggcagacugcccaccaagaagcuguuccacgaggagcuggcccugcaguggguggugugcagcggcagcgugagagagagcgcccugcagcaggccugguucuucuucgagcugauggugaagagcauggugcaccaccuguacuucaacgacaagcuggaggcccccagaaagagcagauuccccgagagauucauggacgacaucgccgcccuggugagcaccaucgccagcgacaucgugagcagauuccagaaggacaccgagaugguggagagacugaacaccagccuggccuucuuccugaacgaccugcugagcgugauggacagaggcuucguguucagccugaucaagagcugcuacaagcaggugagcagcaagcuguacagccugcccaaccccagcgugcuggugagccugagacuggacuuccugagaaucaucugcagccacgagcacuacgugacccugaaccugcccugcagccugcugaccccccccgccagccccagccccagcgugagcagcgccaccagccagagcagcggcuucagcaccaacgugcaggaccagaagaucgccaacauguucgagcugagcgugcccuucagacagcagcacuaccuggccggccuggugcugaccgagcuggccgugauccuggaccccgacgccgagggccuguucggccugcacaagaaggugaucaacauggugcacaaccugcugagcagccacgacagcgaccccagauacagcgacccccagaucaaggccagaguggccaugcuguaccugccccugaucggcaucaucauggagaccgugccccagcuguacgacuucaccgagacccacaaccagagaggcagacccaucugcaucgccaccgacgacuacgagagcgagagcggcagcaugaucagccagaccguggccauggccaucgccggcaccagcgugccccagcugaccagacccggcagcuuccugcugaccagcaccagcggcagacagcacaccaccuucagcgccgagagcagcagaagccugcugaucugccugcugugggugcugaagaacgccgacgagaccgugcugcagaagugguucaccgaccugagcgugcugcagcugaacagacugcuggaccugcuguaccugugcgugagcugcuucgaguacaagggcaagaagguguucgagagaaugaacagccugaccuucaagaagagcaaggacaugagagccaagcuggaggaggccauccugggcagcaucggcgccagacaggagauggugagaagaagcagaggccagcugggcaccuacaccaucgccagcccccccgagagaagccccagcggcagcgccuucggcagccaggagaaccugagauggagaaaggacaugacccacuggagacagaacaccgagaagcuggacaagagcagagccgagaucgagcacgaggcccugaucgacggcaaccuggccaccgaggccaaccugaucauccuggacacccuggagaucguggugcagaccgugagcgugaccgagagcaaggagagcauccugggcggcgugcugaaggugcugcugcacagcauggccugcaaccagagcgccguguaccugcagcacugcuucgccacccagagagcccuggugagcaaguuccccgagcugcuguucgaggaggagaccgagcagugcgccgaccugugccugagacugcugagacacugcagcagcagcaucggcaccaucagaagccacgccagcgccagccuguaccugcugaugagacagaacuucgagaucggcaacaacuucgccagagugaagaugcaggugaccaugagccugagcagccuggugggcaccagccagaacuucaacgaggaguuccugagaagaagccugaagaccauccugaccuacgccgaggaggaccuggagcugagagagaccaccuuccccgaccaggugcaggaccugguguucaaccugcacaugauccugagcgacaccgugaagaugaaggagcaccaggaggaccccgagaugcugaucgaccugauguacagaaucgccaagggcuaccagaccagccccgaccugagacugaccuggcugcagaacauggccggcaagcacagcgagagaagcaaccacgccgaggccgcccagugccuggugcacagcgccgcccugguggccgaguaccugagcaugcuggaggacagaaaguaccugcccgugggcugcgugaccuuccagaacaucagcagcaacgugcuggaggagagcgccgugagcgacgacguggugagccccgacgaggagggcaucugcagcggcaaguacuucaccgagagcggccuggugggccugcuggagcaggccgccgccagcuucagcauggccggcauguacgaggccgugaacgagguguacaaggugcugauccccauccacgaggccaacagagacgccaagaagcugagcaccauccacggcaagcugcaggaggccuucagcaagaucgugcaccagagcaccggcugggagagaauguucggcaccuacuucagagugggcuucuacggcaccaaguucggcgaccuggacgagcaggaguucguguacaaggagcccgccaucaccaagcuggccgagaucagccacagacuggagggcuucuacggcgagagauucggcgaggacgugguggaggugaucaaggacagcaaccccguggacaagugcaagcuggaccccaacaaggccuacauccagaucaccuacguggagcccuacuucgacaccuacgagaugaaggacagaaucaccuacuucgacaagaacuacaaccugagaagauucauguacugcacccccuucacccuggacggcagagcccacggcgagcugcacgagcaguucaagagaaagaccauccugaccaccagccacgccuuccccuacaucaagaccagagugaacgugacccacaaggaggagaucauccugacccccaucgagguggccaucgaggacaugcagaagaagacccaggagcuggccuucgccacccaccaggaccccgccgaccccaagaugcugcagauggugcugcagggcagcgugggcaccaccgugaaccagggcccccuggagguggcccagguguuccugagcgagauccccagcgaccccaagcuguucagacaccacaacaagcugagacugugcuucaaggacuucaccaagagaugcgaggacgcccugagaaagaacaagagccugaucggccccgaccagaaggaguaccagagagagcuggagagaaacuaccacagacugaaggaggcccugcagccccugaucaacagaaagaucccccagcuguacaaggccgugcugcccgugaccugccacagagacagcuucagcagaaugagccugagaaagauggaccuguaa

SEQ ID NO: 16266 - RNA, 6300 nt, Artificial Sequence
  DOCK8__Homo_sapiens__NP_982272
auggccacccugcccagcgccgagagaagagccuucgcccugaagaucaacagauacagcagcgccgagaucagaaagcaguucacccugccccccaaccugggccaguaccacagacagagcaucagcaccagcggcuuccccagccugcagcugccccaguucuacgaccccguggagcccguggacuucgagggccugcugaugacccaccugaacagccuggacgugcagcuggcccaggagcugggcgacuucaccgacgacgaccuggacgugguguucacccccaaggagugcagaacccugcagcccagccugcccgaggagggcguggagcuggacccccacgugagagacugcgugcagaccuacaucagagaguggcugaucgugaacagaaagaaccagggcagccccgagaucugcggcuucaagaagaccggcagcagaaaggacuuccacaagacccugcccaagcagaccuucgagagcgagacccuggagugcagcgagcccgccgcccaggccggccccagacaccugaacgugcugugcgacgugagcggcaagggccccgugaccgccugcgacuucgaccugagaagccugcagcccgacaagagacuggagaaccugcugcagcaggugagcgccgaggacuucgagaagcagaacgaggaggccagaagaaccaacagacaggccgagcuguucgcccuguaccccagcguggacgaggaggacgccguggagaucagacccgugcccgagugccccaaggagcaccugggcaacagaauccuggugaagcugcugacccugaaguucgagaucgagaucgagccccuguucgccagcaucgcccuguacgacgugaaggagagaaagaagaucagcgagaacuuccacugcgaccugaacagcgaccaguucaagggcuuccugagagcccacacccccagcguggccgccagcagccaggccagaagcgccguguucagcgugaccuaccccagcagcgacaucuaccugguggugaagaucgagaaggugcugcagcagggcgagaucggcgacugcgccgagcccuacaccgugaucaaggagagcgacggcggcaagagcaaggagaagaucgagaagcugaagcugcaggccgagagcuucugccagagacugggcaaguacagaaugcccuucgccugggcccccaucagccugagcagcuucuucaacgugagcacccuggagagagaggugaccgacguggacagcguggugggcagaagcagcgugggcgagagaagaacccuggcccagagcagaagacugagcgagagagcccugagccuggaggagaacggcgugggcagcaacuucaagaccagcacccugagcgugagcagcuucuucaagcaggagggcgacagacugagcgacgaggaccuguucaaguuccuggccgacuacaagagaagcagcagccugcagagaagagugaagagcauccccggccugcugagacuggagaucagcaccgcccccgagaucaucaacugcugccugacccccgagaugcugcccgugaagcccuuccccgagaacagaaccagaccccacaaggagauccuggaguuccccaccagagagguguacgugccccacaccguguacagaaaccugcuguacguguacccccagagacugaacuucgugaacaagcuggccagcgccagaaacaucaccaucaagauccaguucaugugcggcgaggacgccagcaacgccaugcccgugaucuucggcaagagcagcggccccgaguuccugcaggagguguacaccgccgugaccuaccacaacaagagccccgacuucuacgaggaggugaagaucaagcugcccgccaagcugaccgugaaccaccaccugcuguucaccuucuaccacaucagcugccagcagaagcagggcgccagcguggagacccugcugggcuacagcuggcugcccauccugcugaacgagagacugcagaccggcagcuacugccugcccguggcccuggagaagcugccccccaacuacagcaugcacagcgccgagaaggugccccugcagaacccccccaucaagugggccgagggccacaagggcguguucaacaucgaggugcaggccgugagcagcgugcacacccaggacaaccaccuggagaaguucuucacccugugccacagccuggagagccaggugaccuuccccaucagagugcuggaccagaagaucagcgagauggcccuggagcacgagcugaagcugagcaucaucugccugaacagcagcagacuggagccccuggugcuguuccugcaccuggugcuggacaagcuguuccagcugagcgugcagcccauggugaucgccggccagaccgccaacuucagccaguucgccuucgagagcgugguggccaucgccaacagccugcacaacagcaaggaccugagcaaggaccagcacggcagaaacugccugcuggccagcuacgugcacuacguguucagacugcccgaggugcagagagacgugcccaagagcggcgcccccaccgcccugcuggaccccagaagcuaccacaccuacggcagaaccagcgccgccgccgugagcagcaagcugcugcaggccagagugaugagcagcagcaaccccgaccuggccggcacccacagcgccgccgacgaggaggugaagaacaucaugagcagcaagaucgccgacagaaacugcagcagaaugagcuacuacugcagcggcagcagcgacgcccccagcagccccgccgcccccagacccgccagcaagaagcacuuccacgaggagcuggcccugcagaugguggugagcaccggcauggugagagagaccguguucaaguacgccugguucuucuucgagcugcuggugaagagcauggcccagcacgugcacaacauggacaagagagacagcuucagaagaaccagauucagcgacagauucauggacgacaucaccaccaucgugaacguggugaccagcgagaucgccgcccugcuggugaagccccagaaggagaacgagcaggccgagaagaugaacaucagccuggccuucuuccuguacgaccugcugagccugauggacagaggcuucguguucaaccugaucagacacuacugcagccagcugagcgccaagcugagcaaccugcccacccugaucagcaugagacuggaguuccugagaauccugugcagccacgagcacuaccugaaccugaaccuguucuucaugaacgccgacaccgcccccaccagccccugccccagcaucagcagccagaacagcagcagcugcagcagcuuccaggaccagaagaucgccagcauguucgaccugaccagcgaguacagacagcagcacuuccugaccggccugcuguucaccgagcuggccgccgcccuggacgccgagggcgagggcaucagcaaggugcagagaaaggccgugagcgccauccacagccugcugagcagccacgaccuggaccccagaugcgugaagcccgaggugaaggugaagaucgccgcccuguaccugccccuggugggcaucauccuggacgcccugccccagcugugcgacuucaccguggccgacaccagaagauacagaaccagcggcagcgacgaggagcaggagggcgccggcgccaucaaccagaacguggcccuggccaucgccggcaacaacuucaaccugaagaccagcggcaucgugcugagcagccugcccuacaagcaguacaacaugcugaacgccgacaccaccagaaaccugaugaucugcuuccuguggaucaugaagaacgccgaccagagccugaucagaaaguggaucgccgaccugcccagcacccagcugaacagaauccuggaccugcuguucaucugcgugcugugcuucgaguacaagggcaagcagagcagcgacaaggugagcacccaggugcugcagaagagcagagacgugaaggccagacuggaggaggcccugcugagaggcgagggcgccagaggcgagaugaugagaagaagagcccccggcaacgacagauuccccggccugaacgagaaccugagauggaagaaggagcagacccacuggagacaggccaacgagaagcuggacaagaccaaggccgagcuggaccaggaggcccugaucagcggcaaccuggccaccgaggcccaccugaucauccuggacaugcaggagaacaucauccaggccagcagcgcccuggacugcaaggacagccugcugggcggcgugcugagagugcuggugaacagccugaacugcgaccagagcaccaccuaccugacccacugcuucgccacccugagagcccugaucgccaaguucggcgaccugcuguucgaggaggagguggagcagugcuucgaccugugccaccaggugcugcaccacugcagcagcagcauggacgugaccagaagccaggccugcgccacccuguaccugcugaugagauucagcuucggcgccaccagcaacuucgccagagugaagaugcaggugaccaugagccuggccagccuggugggcagagcccccgacuucaacgaggagcaccugagaagaagccugagaaccauccuggccuacagcgaggaggacaccgccaugcagaugacccccuuccccacccagguggaggagcugcugugcaaccugaacagcauccuguacgacaccgugaagaugagagaguuccaggaggaccccgagaugcugauggaccugauguacagaaucgccaagagcuaccaggccagccccgaccugagacugaccuggcugcagaacauggccgagaagcacaccaagaagaagugcuacaccgaggccgccaugugccuggugcacgccgccgcccugguggccgaguaccugagcaugcuggaggaccacagcuaccugcccgugggcagcgugagcuuccagaacaucagcagcaacgugcuggaggagagcguggugagcgaggacacccugagccccgacgaggacggcgugugcgccggccaguacuucaccgagagcggccuggugggccugcuggagcaggccgccgagcuguucagcaccggcggccuguacgagaccgugaacgagguguacaagcuggugauccccauccuggaggcccacagagaguucagaaagcugacccugacccacagcaagcugcagagagccuucgacagcaucgugaacaaggaccacaagagaauguucggcaccuacuucagagugggcuucuucggcagcaaguucggcgaccuggacgagcaggaguucguguacaaggagcccgccaucaccaagcugcccgagaucagccacagacuggaggccuucuacggccagugcuucggcgccgaguucguggaggugaucaaggacagcacccccguggacaagaccaagcuggaccccaacaaggccuacauccagaucaccuucguggagcccuacuucgacgaguacgagaugaaggacagagugaccuacuucgagaagaacuucaaccugagaagauucauguacaccacccccuucacccuggagggcagacccagaggcgagcugcacgagcaguacagaagaaacaccgugcugaccaccaugcacgccuuccccuacaucaagaccagaaucagcgugauccagaaggaggaguucgugcugacccccaucgagguggccaucgaggacaugaagaagaagacccugcagcuggccguggccaucaaccaggagccccccgacgccaagaugcugcagauggugcugcagggcagcgugggcgccaccgugaaccagggcccccuggagguggcccagguguuccuggccgagauccccgccgaccccaagcuguacagacaccacaacaagcugagacugugcuucaaggaguucaucaugagaugcggcgaggccguggagaagaacaagagacugaucaccgccgaccagagagaguaccagcaggagcugaagaagaacuacaacaagcugaaggagaaccugagacccaugaucgagagaaagauccccgagcuguacaagcccaucuucagaguggagagccagaagagagacagcuuccacagaagcagcuucagaaagugcgagacccagcugagccagggcagcuaa

SEQ ID NO: 16267 - RNA, 6207 nt, Artificial Sequence
  DOCK9__Homo_sapiens__NP_001123520
augcaggccgacaagugcagaaccagcagcagaagcgugaagaaggagcuggugaucgagagcccccugcaguacaaggacgccgcccagggcgagguggaggccgagagccccggccccgugcccgccaagcccaagcugaucgagccccuggacuacgagaacgugaucgugcagaagaagacccagauccugaacgacugccugagagagaugcugcuguuccccuacgacgacuuccagaccgccauccugagaagacagggcagauacaucugcagcaccgugcccgccaaggccgaggaggaggcccagagccuguucgugaccgagugcaucaagaccuacaacagcgacuggcaccuggugaacuacaaguacgaggacuacagcggcgaguucagacagcugcccaacaagguggugaagcuggacaagcugcccgugcacguguacgagguggacgaggagguggacaaggacgaggacgccgccagccugggcagccagaagggcggcaucaccaagcacggcuggcuguacaagggcaacaugaacagcgccaucagcgugaccaugagaagcuucaagagaagauucuuccaccugauccagcugggcgacggcagcuacaaccugaacuucuacaaggacgagaagaucagcaaggagcccaagggcagcaucuuccuggacagcugcaugggcguggugcagaacaacaaggugagaagauucgccuucgagcugaagaugcaggacaagagcagcuaccugcuggccgccgacagcgagguggagauggaggaguggaucaccauccugaacaagauccugcagcugaacuucgaggccgccaugcaggagaagagaaacggcgacagccacgaggacgacgagcagagcaagcuggagggcagcggcagcggccuggacagcuaccugcccgagcuggccaagagcgccagagaggccgagaucaagcugaagagcgagagcagagugaagcuguucuaccuggaccccgacgcccagaagcuggacuucagcagcgccgagcccgaggugaagagcuucgaggagaaguucggcaagagaauccuggugaagugcaacgaccugagcuucaaccugcagugcugcguggccgagaacgaggagggccccaccaccaacguggagcccuucuucgugacccugagccuguucgacaucaaguacaacagaaagaucagcgccgacuuccacguggaccugaaccacuucagcgugagacagaugcuggccaccaccagccccgcccugaugaacggcagcggccagagccccagcgugcugaagggcauccugcacgaggccgccaugcaguaccccaagcagggcaucuucagcgugaccugcccccaccccgacaucuuccugguggccagaaucgagaaggugcugcagggcagcaucacccacugcgccgagcccuacaugaagagcagcgacagcagcaagguggcccagaaggugcugaagaacgccaagcaggccugccagagacugggccaguacagaaugcccuucgccugggccgccagaacccuguucaaggacgccagcggcaaccuggacaagaacgccagauucagcgccaucuacagacaggacagcaacaagcugagcaacgacgacaugcugaagcugcuggccgacuucagaaagcccgagaagauggccaagcugcccgugauccugggcaaccuggacaucaccaucgacaacgugagcagcgacuuccccaacuacgugaacagcagcuacauccccaccaagcaguucgagaccugcagcaagacccccaucaccuucgagguggaggaguucgugcccugcauccccaagcacacccagcccuacaccaucuacaccaaccaccuguacguguaccccaaguaccugaaguacgacagccagaagagcuucgccaaggccagaaacaucgccaucugcaucgaguucaaggacagcgacgaggaggacagccagccccugaagugcaucuacggcagacccggcggccccguguucaccagaagcgccuucgccgccgugcugcaccaccaccagaaccccgaguucuacgacgagaucaagaucgagcugcccacccagcugcacgagaagcaccaccugcugcugaccuucuuccacgugagcugcgacaacagcagcaagggcagcaccaagaagagagacgugguggagacccaggugggcuacagcuggcugccccugcugaaggacggcagaguggugaccagcgagcagcacauccccgugagcgccaaccugcccagcggcuaccugggcuaccaggagcugggcaugggcagacacuacggccccgagaucaaguggguggacggcggcaagccccugcugaagaucagcacccaccuggugagcaccguguacacccaggaccagcaccugcacaacuucuuccaguacugccagaagaccgagagcggcgcccaggcccugggcaacgagcuggugaaguaccugaagagccugcacgccauggagggccacgugaugaucgccuuccugcccaccauccugaaccagcuguucagagugcugaccagagccacccaggaggagguggccgugaacgugaccagagugaucauccacgugguggcccagugccacgaggagggccuggagagccaccugagaagcuacgugaaguacgccuacaaggccgagcccuacguggccagcgaguacaagaccgugcacgaggagcugaccaagagcaugaccaccauccugaagcccagcgccgacuuccugaccagcaacaagcugcugaaguacagcugguucuucuucgacgugcugaucaagagcauggcccagcaccugaucgagaacagcaaggugaagcugcugagaaaccagagauuccccgccagcuaccaccacgccguggagaccguggugaacaugcugaugccccacaucacccagaaguucagagacaaccccgaggccagcaagaacgccaaccacagccuggccguguucaucaagagaugcuucaccuucauggacagaggcuucguguucaagcagaucaacaacuacaucagcugcuucgcccccggcgaccccaagacccuguucgaguacaaguucgaguuccugagaguggugugcaaccacgagcacuacaucccccugaaccugcccaugcccuucggcaagggcagaauccagagauaccaggaccugcagcuggacuacagccugaccgacgaguucugcagaaaccacuuccuggugggccugcugcugagagaggugggcaccgcccugcaggaguucagagaggugagacugaucgccaucagcgugcugaagaaccugcugaucaagcacagcuucgacgacagauacgccagcagaagccaccaggccagaaucgccacccuguaccugccccuguucggccugcugaucgagaacgugcagagaaucaacgugagagacgugagccccuuccccgugaacgccggcaugaccgugaaggacgagagccuggcccugcccgccgugaacccccuggugaccccccagaagggcagcacccuggacaacagccugcacaaggaccugcugggcgccaucagcggcaucgccagccccuacaccaccagcacccccaacaucaacagcgugagaaacgccgacagcagaggcagccugaucagcaccgacagcggcaacagccugcccgagagaaacagcgagaagagcaacagccuggacaagcaccagcagagcagcacccugggcaacagcguggugagaugcgacaagcuggaccagagcgagaucaagagccugcugaugugcuuccuguacauccugaagagcaugagcgacgacgcccuguucaccuacuggaacaaggccagcaccagcgagcugauggacuucuucaccaucagcgaggugugccugcaccaguuccaguacaugggcaagagauacaucgccagaaccggcaugaugcacgccagacugcagcagcugggcagccuggacaacagccugaccuucaaccacagcuacggccacagcgacgccgacgugcugcaccagagccugcuggaggccaacaucgccaccgaggugugccugaccgcccuggacacccugagccuguucacccuggccuucaagaaccagcugcuggccgaccacggccacaacccccugaugaagaagguguucgacguguaccugugcuuccugcagaagcaccagagcgagaccgcccugaagaacguguucaccgcccugagaagccugaucuacaaguuccccagcaccuucuacgagggcagagccgacaugugcgccgcccugugcuacgagauccugaagugcugcaacagcaagcugagcagcaucagaaccgaggccagccagcugcuguacuuccugaugagaaacaacuucgacuacaccggcaagaagagcuucgugagaacccaccugcaggugaucaucagcgugagccagcugaucgccgacguggugggcaucggcggcaccagauuccagcagagccugagcaucaucaacaacugcgccaacagcgacagacugaucaagcacaccagcuucagcagcgacgugaaggaccugaccaagagaaucagaaccgugcugauggccaccgcccagaugaaggagcacgagaacgaccccgagaugcugguggaccugcaguacagccuggccaagagcuacgccagcacccccgagcugagaaagaccuggcuggacagcauggccagaauccacgugaagaacggcgaccugagcgaggccgccaugugcuacgugcacgugaccgcccugguggccgaguaccugaccagaaaggaggccgugcagugggagcccccccugcugccccacagccacagcgccugccugagaagaagcagaggcggcguguucagacagggcugcaccgccuucagagugaucacccccaacaucgacgaggaggccagcaugauggaggacgugggcaugcaggacgugcacuucaacgaggacgugcugauggagcugcuggagcagugcgccgacggccuguggaaggccgagagauacgagcugaucgccgacaucuacaagcugaucauccccaucuacgagaagagaagagacuucgagagacuggcccaccuguacgacacccugcacagagccuacagcaaggugaccgaggugaugcacagcggcagaagacugcugggcaccuacuucagaguggccuucuucggccaggccgcccaguaccaguucaccgacagcgagaccgacguggagggcuucuucgaggacgaggacggcaaggaguacaucuacaaggagcccaagcugaccccccugagcgagaucagccagagacugcugaagcuguacagcgacaaguucggcagcgagaacgugaagaugauccaggacagcggcaaggugaaccccaaggaccuggacagcaaguacgccuacauccaggugacccacgugauccccuucuucgacgagaaggagcugcaggagagaaagaccgaguucgagagaagccacaacaucagaagauucauguucgagaugcccuucacccagaccggcaagagacagggcggcguggaggagcagugcaagagaagaaccauccugaccgccauccacugcuuccccuacgugaagaagagaauccccgugauguaccagcaccacaccgaccugaaccccaucgagguggccaucgacgagaugagcaagaagguggccgagcugagacagcugugcagcagcgccgagguggacaugaucaagcugcagcugaagcugcagggcagcgugagcgugcaggugaacgccggcccccuggccuacgccagagccuuccuggacgacaccaacaccaagagauaccccgacaacaaggugaagcugcugaaggagguguucagacaguucguggaggccugcggccaggcccuggccgugaacgagagacugaucaaggaggaccagcuggaguaccaggaggagaugaaggccaacuacagagagauggccaaggagcugagcgagaucaugcacgagcagcugggcuaa

SEQ ID NO: 16268 - RNA, 909 nt, Artificial Sequence
  DOHH__Homo_sapiens__XP_011526642
auggugaccgagcaggagguggacgccaucggccagacccugguggaccccaagcagccccugcaggccagauucagagcccuguucacccugagaggccugggcggccccggcgccaucgccuggaucagccaggccuucgacgacgacagcgcccugcugaagcacgagcuggccuacugccugggccagaugcaggacgccagagccauccccaugcugguggacgugcugcaggacaccagacaggagcccauggugagacacgaggccggcgaggcccugggcgccaucggcgaccccgaggugcuggagauccugaagcaguacagcagcgaccccgugaucgagguggccgagaccugccagcuggccgugagaagacuggaguggcugcagcagcacggcggcgagcccgccgccggccccuaccugagcguggaccccgccccccccgccgaggagagagacgugggcagacugagagaggcccugcuggacgagagcagaccccuguucgagagauacagagccauguucgcccugagaaacgccggcggcgaggaggccgcccuggcccuggccgagggccugcacugcggcagcgcccuguucagacacgaggugggcuacgugcugggccagcugcagcacgaggccgccgugccccagcuggccgccgcccuggccagaugcaccgagaaccccauggugagacacgagugcgccgaggcccugggcgccaucgccagacccgccugccuggccgcccugcaggcccacgccgacgaccccgagagaguggugagagagagcugcgagguggcccuggacauguacgagcacgagaccggcagagccuuccaguacgccgacggccuggagcagcugagaggcgcccccagcuaa

SEQ ID NO: 16269 - RNA, 1029 nt, Artificial Sequence
  DOK1__Homo_sapiens__NP_001184189
augcuggagaacagccuguacagccccaccugggagggcagccaguucugggugaccgugcagagaaccgaggccgccgagagaugcggccugcacggcagcuacgugcugagaguggaggccgagagacugacccugcugaccgugggcgcccagagccagauccuggagccccugcugagcuggcccuacacccugcugagaagauacggcagagacaaggugauguucagcuucgaggccggcagaagaugccccagcggccccggcaccuucaccuuccagaccgcccagggcaacgacaucuuccaggccguggagaccgccauccacagacagaaggcccagggcaaggccggccagggccacgacgugcugagagccgacagccacgagggcgagguggccgagggcaagcugcccagcccccccggcccccaggagcugcuggacagcccccccgcccuguacgccgagccccuggacagccugagaaucgcccccugccccagccaggacagccuguacagcgacccccuggacagcaccagcgcccaggccggcgagggcgugcagagaaagaagccccuguacugggaccuguacgagcacgcccagcagcagcugcugaaggccaagcugaccgaccccaaggaggaccccaucuacgacgagcccgagggccuggcccccgugcccccccagggccuguacgaccugcccagagagcccaaggacgccugguggugccaggccagagugaaggaggagggcuacgagcugcccuacaaccccgccaccgacgacuacgccgugcccccccccagaagcaccaagccccugcuggcccccaagccccagggccccgccuuccccgagcccggcaccgccaccggcagcggcaucaagagccacaacagcgcccuguacagccaggugcagaagagcggcgccagcggcagcugggacugcggccugagcagagugggcaccgacaagaccggcgugaagagcgagggcagcaccuaa

SEQ ID NO: 16270 - RNA, 1239 nt, Artificial Sequence
  DOK2__Homo_sapiens__NP_003965
augggcgacggcgccgugaagcagggcuuccuguaccugcagcagcagcagaccuucggcaagaaguggagaagauucggcgccagccuguacggcggcagcgacugcgcccuggccagacuggagcugcaggagggccccgagaagcccagaagaugcgaggccgccagaaaggugaucagacugagcgacugccugagaguggccgaggccggcggcgaggccagcagccccagagacaccagcgccuucuuccuggagaccaaggagagacuguaccugcuggccgcccccgccgccgagagaggcgacugggugcaggccaucugccugcuggccuuccccggccagagaaaggagcugagcggccccgagggcaagcagagcagacccugcauggaggagaacgagcuguacagcagcgccgugaccgugggcccccacaaggaguucgccgugaccaugagacccaccgaggccagcgagagaugccaccugagaggcagcuacacccugagagccggcgagagcgcccuggagcuguggggcggccccgagcccggcacccagcuguacgacuggcccuacagauuccugagaagauucggcagagacaaggugaccuucagcuucgaggccggcagaagaugcgugagcggcgagggcaacuucgaguucgagaccagacagggcaacgagaucuuccuggcccuggaggaggccaucagcgcccagaagaacgccgcccccgccaccccccagccccagcccgccaccauccccgccagccugcccagacccgacagccccuacagcagaccccacgacagccugcccccccccagccccaccacccccgugcccgcccccagacccagaggccaggagggcgaguacgccgugcccuucgacgccguggccagaagccugggcaagaacuucagaggcauccuggccgugcccccccagcugcuggccgacccccuguacgacagcaucgaggagacccugccccccagacccgaccacaucuacgacgagcccgagggcguggccgcccugagccuguacgacagcccccaggagcccagaggcgaggccuggagaagacaggccaccgccgacagagaccccgccggccugcagcacgugcagcccgccggccaggacuucagcgccagcggcuggcagcccggcaccgaguacgacaacguggugcugaagaagggccccaaguaa

SEQ ID NO: 16271 - RNA, 993 nt, Artificial Sequence
  DOK3__Homo_sapiens__NP_001138347
auggacccccuggagacccccaucaaggacggcauccuguaccagcagcacgugaaguucggcaagaagugcuggagaaaggugugggcccugcuguacgccggcggccccagcggcguggccagacuggagagcugggaggugagagacggcggccugggcgccgccggcgacagaagcgccggccccggcagaagaggcgagagaagagugaucagacuggccgacugcgugagcgugcugcccgccgacggcgagagcugccccagagacaccggcgccuuccugcugaccaccaccgagagaagccaccugcuggccgcccagcacagacaggccuggaugggccccaucugccagcuggccuuccccggcaccggcgaggccagcagcggcagcaccgacgcccagagccccaagagaggccuggugcccauggaggagaacagcaucuacagcagcuggcaggaggugggcgaguuccccgugguggugcagagaaccgaggccgccaccagaugccagcugaagggccccgcccugcuggugcugggccccgacgccauccagcugagagaggccaagggcacccaggcccuguacagcuggcccuaccacuuccugagaaaguucggcagcgacaagauccugcugggcacccccggcgugagccugcugaucugcaagggcgagagaaccgacgacgugagcggcaucauccuggacgagagccugcugagagccuacagcgugcccggcgccggcggccacagcagagugcaggacagccugggccccgugcugagagagcccaccuuccagggcgagagaagcuuccugaagaccagcaugcugagaagccugcugugcagcugcagcuggagacaccccagaagccagcccagaacccaggccagcugccugcagggcagcgacugccccgccccccacagaaacagcaccagcgccgcccacacccugggcaccagcuaa

SEQ ID NO: 16272 - RNA, 981 nt, Artificial Sequence
  DOK4__Homo_sapiens__NP_060580
auggccaccaacuucagcgacaucgugaagcagggcuacgugaagaugaagagcagaaagcugggcaucuacagaagaugcuggcugguguucagaaagagcagcagcaagggcccccagagacuggagaaguaccccgacgagaagagcgugugccugagaggcugccccaaggugaccgagaucagcaacgugaagugcgugaccagacugcccaaggagaccaagagacaggccguggccaucaucuucaccgacgacagcgccagaaccuucaccugcgacagcgagcuggaggccgaggagugguacaagacccugagcguggagugccugggcagcagacugaacgacaucagccugggcgagcccgaccugcuggcccccggcgugcagugcgagcagaccgacagauucaacguguuccugcugcccugccccaaccuggacguguacggcgagugcaagcugcagaucacccacgagaacaucuaccugugggacauccacaaccccagagugaagcuggugagcuggccccugugcagccugagaagauacggcagagacgccaccagauucaccuucgaggccggcagaaugugcgacgccggcgagggccuguacaccuuccagacccaggagggcgagcagaucuaccagagagugcacagcgccacccuggccaucgccgagcagcacaagagagugcugcuggagauggagaagaacgugagacugcugaacaagggcaccgagcacuacagcuaccccugcacccccaccaccaugcugcccagaagcgccuacuggcaccacaucaccggcagccagaacaucgccgaggccagcagcuacgccggcgagggcuacggcgccgcccaggccagcagcgagaccgaccugcugaacagauucauccugcugaagcccaagcccagccagggcgacagcagcgaggccaagacccccagccaguaa

SEQ ID NO: 16273 - RNA, 921 nt, Artificial Sequence
  DOK5__Homo_sapiens__NP_060901
auggccagcaacuucaacgacaucgugaagcagggcuacgugagaaucagaagcagaagacugggcaucuaccagagaugcuggcugguguucaagaaggccagcagcaagggccccaagagacuggagaaguucagcgacgagagagccgccuacuucagaugcuaccacaaggugaccgagcugaacaacgugaagaacguggccagacugcccaagagcaccaagaagcacgccaucggcaucuacuucaacgacgacaccagcaagaccuucgccugcgagagcgaccuggaggccgacgaguggugcaaggugcugcagauggagugcgugggcaccagaaucaacgacaucagccugggcgagcccgaccugcuggccaccggcguggagagagagcagagcgagagauucaacguguaccugaugcccagccccaaccuggacgugcacggcgagugcgcccugcagaucaccuacgaguacaucugccugugggacgugcagaaccccagagugaagcugaucagcuggccccugagcgcccugagaagauacggcagagacaccaccugguucaccuucgaggccggcagaaugugcgagaccggcgagggccuguucaucuuccagaccagagacggcgaggccaucuaccagaaggugcacagcgccgcccuggccaucgccgagcagcacgagagacugcugcagagcgugaagaacagcaugcugcagaugaagaugagcgagagagccgccagccugagcaccauggugccccugcccagaagcgccuacuggcagcacaucaccagacagcacagcaccggccagcuguacagacugcaggacgugagcagcccccugaagcugcacagaaccgagaccuuccccgccuacagaagcgagcacuaa

SEQ ID NO: 16274 - RNA, 996 nt, Artificial Sequence
  DOK6__Homo_sapiens__NP_689934
auggccagcaacuucaacgacaucgugaagcagggcuacgugaagaucagaagcagaaagcugggcaucuucagaagaugcuggcugguguucaagaaggccagcagcaagggccccagaagacuggagaaguuccccgacgagaaggccgccuacuucagaaacuuccacaaggugaccgagcugcacaacaucaagaacaucaccagacugcccagagagaccaagaagcacgccguggccaucaucuuccacgacgagaccagcaagaccuucgccugcgagagcgagcuggaggccgaggaguggugcaagcaccugugcauggagugccugggcaccagacugaacgacaucagccugggcgagcccgaccugcuggccgccggcgugcagagagagcagaacgagagauucaacguguaccugaugcccacccccaaccuggacaucuacggcgagugcaccaugcagaucacccacgagaacaucuaccugugggacauccacaacgccaaggugaagcuggugauguggccccugagcagccugagaagauacggcagagacagcaccugguucaccuucgagagcggcagaaugugcgacaccggcgagggccuguucaccuuccagaccagagagggcgagaugaucuaccagaaggugcacagcgccacccuggccaucgccgagcagcacgagagacugaugcuggagauggagcagaaggccagacugcagaccagccugaccgagcccaugacccugagcaagagcaucagccugcccagaagcgccuacuggcaccacaucaccagacagaacagcgugggcgagaucuacagccugcagggccacggcuucggcagcagcaagaugagcagagcccagaccuuccccagcuacgcccccgagcagagcgaggaggcccagcagccccugagcagaagcagcagcuacggcuucagcuacagcagcagccugauccaguaa

SEQ ID NO: 16275 - RNA, 768 nt, Artificial Sequence
  DOK7__Homo_sapiens__NP_001158145
augaccgaggccgcccugguggagggccaggugaagcugagagacggcaagaaguggaagagcagauggcuggugcugagaaagcccagccccguggccgacugccugcugaugcugguguacaaggacaagagcgagagaaucaagggccugagagagagaagcagccugacccuggaggacaucugcggccuggagcccggccugcccuacgagggccuggugcacacccuggccaucgugugccugagccaggccaucaugcugggcuucgacagccacgaggccaugugcgccugggacgccagaaucagauacgcccugggcgaggugcacagauuccacgugaccguggcccccggcaccaagcuggagagcggccccgccacccugcaccugugcaacgacgugcuggugcuggccagagacaucccccccgccgugaccggccaguggaagcugagcgaccugagaagauacggcgccgugcccagcggcuucaucuucgagggcggcaccagaggcuggagacugcugcccgugcugggcagaggcggcgccgaccagcugcccgugagacugcacagacccagacaccugccccaccagggcccccugugggccgccgccggcagcaccagacccaagagccccggcacccuggacugcggcggcgccugcggccccggcagccccggcaaccccaccgccggcgaggccgccgagcccccccugaccugcggccaggccggccaguggagaggcuaa

SEQ ID NO: 16276 - RNA, 1617 nt, Artificial Sequence
  DOLK__Homo_sapiens__NP_055723
augaccagagagugccccagccccgcccccggccccggcgccccccugagcggcagcgugcuggccgaggccgccgugguguucgccguggugcugagcauccacgccaccgugugggacagauacagcuggugcgccguggcccuggccgugcaggccuucuacgugcaguacaagugggacagacugcugcagcagggcagcgccguguuccaguucagaaugagcgccaacagcggccugcugcccgccagcauggugaugccccugcugggccuggugaugaaggagagaugccagaccgccggcaaccccuucuucgagagauucggcaucgugguggccgccaccggcauggccguggcccuguucagcagcgugcuggcccugggcaucaccagacccgugcccaccaacaccugcgugauccugggccuggccggcggcgugaucaucuacaucaugaagcacagccugagcgugggcgaggugaucgaggugcuggaggugcugcugaucuucguguaccugaacaugauccugcuguaccugcugcccagaugcuucacccccggcgaggcccugcuggugcugggcggcaucagcuucgugcugaaccagcugaucaagagaagccugacccugguggagagccagggcgaccccguggacuucuuccugcugguggugguggugggcauggugcugaugggcaucuucuucagcacccuguucguguucauggacagcggcaccugggccagcagcaucuucuuccaccugaugaccugcgugcugagccugggcguggugcugcccuggcugcacagacugaucagaagaaacccccugcuguggcugcugcaguuccuguuccagaccgacaccagaaucuaccugcuggccuacuggagccugcuggccacccuggccugccugguggugcuguaccagaacgccaagagaagcagcagcgagagcaagaagcaccaggcccccaccaucgccagaaaguacuuccaccugaucgugguggccaccuacauccccggcaucaucuucgacagaccccugcuguacguggccgccaccgugugccuggccguguucaucuuccuggaguacgugagauacuucagaaucaagccccugggccacacccugagaagcuuccugagccuguuccuggacgagagagacagcggcccccugauccugacccacaucuaccugcugcugggcaugagccugcccaucuggcugauccccagacccugcacccagaagggcagccugggcggcgccagagcccuggugcccuacgccggcgugcuggccgugggcgugggcgacaccguggccagcaucuucggcagcaccaugggcgagaucagauggcccggcaccaagaagaccuucgagggcaccaugaccagcaucuucgcccagaucaucagcguggcccugauccugaucuucgacagcggcguggaccugaacuacagcuacgccuggauccugggcagcaucagcaccgugagccugcuggaggccuacaccacccagaucgacaaccugcugcugccccuguaccugcugauccugcugauggccuaa

SEQ ID NO: 16277 - RNA, 1701 nt, Artificial Sequence
  DONSON__Homo_sapiens__NP_060083
auggcccugagcgugcccggcuacagccccggcuucagaaagccccccgagguggugagacugagaagaaagagagccagaagcagaggcgccgccgccagcccccccagagagcugaccgagcccgccgccagaagagccgcccugguggccggccugccccugagacccuuccccgccgccggcggcagaggcggcggcagcggcggcggccccgccgccgccagaagaaaccccuucgccagacuggacaacagacccagaguggccgccgagccccccgacggccccgccagagagcagcccgaggcccccgugcccuuccuggacagcaaccaggagaacgaccugcugugggaggagaaguuccccgagagaaccaccgugaccgagcugccccagaccagccacgugagcuucagcgagcccgacauccccagcagcaagagcaccgagcugcccguggacuggagcaucaagaccagacugcuguucaccagcagccagcccuucaccugggccgaccaccugaaggcccaggaggaggcccagggccuggugcagcacugcagagccaccgaggugacccugcccaagagcauccaggaccccaagcugagcagcgagcugagaugcaccuuccagcagagccugaucuacuggcugcaccccgcccugagcuggcugccccuguuccccagaaucggcgccgacagaaagauggccggcaagaccagccccuggagcaacgacgccacccugcagcacgugcugaugagcgacuggagcgugagcuucaccagccuguacaaccugcugaagaccaagcugugccccuacuucuacgugugcaccuaccaguucaccgugcuguucagagccgccggccuggccggcagcgaccugaucaccgcccugaucagccccaccaccagaggccugagagaggccaugagaaacgagggcaucgaguucagccugccccugaucaaggagagcggccacaagaaggagaccgccagcggcaccagccugggcuacggcgaggagcaggccaucagcgacgaggacgaggaggagagcuucagcuggcuggaggagaugggcgugcaggacaagaucaagaagcccgacauccugagcaucaagcugagaaaggagaagcacgaggugcagauggaccacagacccgagagcguggugcuggugaagggcaucaacaccuucacccugcugaacuuccugaucaacagcaagagccugguggccaccagcggcccccaggccggccugccccccacccugcugagccccguggccuucagaggcgccaccaugcagaugcugaaggccagaagcgugaacgugaagacccaggcccugagcggcuacagagaccaguucagccuggagaucaccggccccaucaugccccacagccugcacagccugaccaugcugcugaagagcagccagagcggcagcuucagcgccgugcuguacccccacgagcccaccgccguguucaacaucugccugcagauggacaaggugcuggacauggagguggugcacaaggagcugaccaacugcggccugcaccccaacacccuggagcagcugagccagaucccccugcugggcaagagcagccugagaaacguggugcugagagacuacaucuacaacuggagaagcuaa

SEQ ID NO: 16278 - RNA, 6897 nt, Artificial Sequence
  DOPEY2__Homo_sapiens__NP_001307643
auggaccccgaggagcaggagcugcugaacgacuacagauacagaagcuacagcagcgugaucgagaaggcccugagaaacuucgagagcagcagcgagugggccgaccugaucagcagccugggcaagcugaacaaggcccugcagagcaaccugagauacagccugcugcccagaagacugcugaucagcaagagacuggcccagugccugcaccccgcccugcccagcggcgugcaccugaaggcccuggagaccuacgagaucaucuucaagaucgugggcaccaaguggcuggccaaggaccuguuccuguacagcugcggccuguucccccugcuggcccacgccgccgugagcgugagacccgugcugcugacccuguacgagaaguacuuccugccccugcagaagcugcugcugcccagccugcaggccuucaucgugggccugcugcccggccuggaggagggcagcgagaucagcgacagaaccgacgcccugcugcugagacugagccugguggugggcaaggagguguucuacaccgcccuguggggcagcgugcuggccagccccagcaucagacugcccgccagcguguucguggugggccacaucaacagagacgcccccggcagagagcagaaguacaugcugggcaccaaccaccagcugaccgugaagagccugagagccagccugcuggacagcaacgugcuggugcagagaaacaaccuggagaucgugcuguucuucuuccccuucuacaccugccuggacagcaacgagagagccaucccccugcugagaagcgacaucgugagaauccugagcgccgccacccagacccugcugagaagagacaugagccugaacagaagacuguacgccuggcugcugggcagcgacaucaagggcaacaccguggugcccgagagcgagaucagcaacagcuacgaggaccagagcagcuacuucuucgagaaguacagcaaggaccugcugguggagggccuggccgagauccugcaccagaaguucaucgacgccgacguggaggagagacaccacgccuaccugaagcccuucagagugcugaucagccugcuggacaagcccgagaucggcccccagguggugggcaaccuguuccuggaggugaucagagccuucuacagcuacugcagagacgcccugggcagcgaccugaagcugagcuacacccagagcggcaacagccugaucagcgccaucaaggagaacagaaacgccagcgagaucgugaagaccgugaaccugcugaucaccagccugagcaccgacuuccugugggacuacaugaccagaugcuucgaggagugcuucagacccgugaagcagagauacagcgugagaaacagcgugagccccccccccaccgugagcgagcugugcgcccugcugguguuccugcuggacgugaucccccuggagcuguacagcgaggugcagacccaguaccugccccaggugcugggcugccuggugcagccccuggccgaggacauggaggcccugagccugcccgagcugacccacgcccugaagaccugcuucaaggugcugagcaaggugcagaugccccccagcuaccuggacaccgagagcaccagcggcaccagcagccccgugaagggcgagaacggcaagaucauccuggagaccaaggccgugauccccggcgacgaggacgccagcuuccccccccugaagagcgaggacagcggcaucggccugagcgccagcagccccgagcugagcgagcaccugagagugcccagagugagccuggagagagacgacguguggaagaagggcggcagcaugcagagaaccuuccugugcauccaggagcugaucgccaacuucgccagcaagaacaucuucggcgugcagcugaccgccagcggcgaggagagcaagagcgaggagcccgccggcaagagagacagagacggcacccagagccuggccgccaacgacagcagcagaaagaacagcugggagcccaagcccaucaccgugccccaguucaagcagaugcugagcgaccuguucaccgccagaggcagccccuucaagaccaagagcagcgagagccccagcagcagccccagcagccccgccagaaagaacggcggcgagugggacguggagaagguggugaucgaccugggcggcagcagagaggagagaagagaggccuucgccgccgccugccaccugcugcuggacugcgccaccuuccccguguaccugagcgaggaggagaccgagcagcugugcgccacccuguuccagcugcccggcgccggcgacagcagcuuccccagcuggcugaagagccugaugaccaucugcugcugcgugaccgacugcuaccugcagaacguggccaucagcacccugcuggaggugaucaaccacagccagagccuggcccuggugaucgaggacaagaugaagagauacaagagcagcggccacaaccccuucuucggcaagcugcagauggugaccgugccccccaucgcccccggcauccugaaggugaucgccgagaagaccgacuucuaccagagaguggccagagugcuguggaaccagcugaacaaggagaccagagagcaccacgugaccugcguggagcuguucuacagacugcacugccuggcccccaccgccaacaucugcgaggacaucaucugccacgcccugcuggaccccgacaagggcaccagacuggaggcccuguucagauucagcgugaucuggcaccugaccagagagauccagggcagcagagugaccagccacaacagaagcuucgacagaagccuguucguggugcuggacagccuggccugcaccgacggcgccaucggcgccgccgcccagggcuggcuggugagagcccugagccugggcgacguggccagaauccuggagcccgugcugcugcugcugcugcagcccaagacccagagaaccagcauccacugccugaagcaggagaacagcgccgacgaccugcacagaugguucaacagaaagaagaccagcuucagagaggccugcgccgugcccgagccccaggagagcggcagcgaggagcaccugccccugagccaguucaccaccguggacagagaggccaucugggccgagguggagaaggagcccgagaaguacccccugagaggcgagcugagcgaggaggagcugcccuacuacguggagcugcccgacagaaccgcccacggcgcccccgacagcagcgagcacaccgagagcgccgacaccagcagcugccacaccgacagcgagaacaccagcagcuucagcagccccagccacgaccugcaggagcugagcaacgaggagaacugcugcgcccccauccccaugggcggcagagccuaccccaagagaagcgcccugcuggccgccuuccagagcgagagcuucaaggccggcgccaagcugagccuggugagaguggacagcgacaagacccaggccagcgagagcuucagcagcgacgaggaggccgaccuggagcugcaggcccugaccaccagcagacugcugaagcagcagagagagagacaggaggccguggaggcccuguucaagcacauccugcuguaccugcagcccuacgacagcagaagagugcuguacgccuucagcgugcuggaggccgugcugaagaccaaccccaaggaguucaucgaggccgugagcagaaccagcauggacaccagcagcaccgcccaccugaaccugaucagcaaccugcuggccagacaccaggaggcccugaucggccagagcuucuacggcaagcugcagacccaggugcccaacgugugcccccacagccugcugcuggagcugcugaccuaccugugccugagcuuccugagaagcuacuaccccugcuaccugaaggugagccacagagacauccugggcaacagagacgugcaggugaagagcguggaggugcugaucagaaucaugaugcagcuggugagcguggccaagagcagcgagggcaagaacguggaguucauccacagccugcugcagagaugcaaggugcaggaguucgugcugcugagccugagcgccagcauguacaccagccagaagagauacggccuggccaccgcccaccacggcagagcccugcccgaggacagccuguucgaggagagccugaucaaccugggccaggaccagaucuggagcgagcacccccugcagaucgagcugcugaagcugcugcaggugcugaucgugcuggagcaccaccugggcagagcccacgaggaggccgagaaccagcccgaccugagcagagaguggcagagagcccugaacuuccagcaggccaucagcgcccugcaguacgugcagccccacccccugaccagccagggccugcuggugagcgccguggugagaggccugcagcccgccuacggcuacggcaugcaccccgccugggugagccuggugacccacagccugcccuacuucggcaagagccugggcuggaccgugacccccuucguggugcagaucugcaagaaccuggacgaccuggugaagcaguacgagagcgagagcgugaagcugagcgugagcaccaccagcaagagagagaacaucagccccgacuacccccugacccugcuggagggccugaccaccaucagccacuucugccugcuggagcaggccaaccagaacaagaagaccauggccgccggcgaccccgccaaccugagaaacgccagaaacgccauccuggaggagcugcccagaaccgugaacaccauggcccugcuguggaacgugcugagaaaggaggagacccagaagagacccguggaccugcugggcgccaccaagggcagcagcagcguguacuucaagaccaccaagaccaucagacagaagauccuggacuuccugaacccccugaccgcccaccugggcgugcagcugaccgccgccguggccgccguguggagcagaaagaaggcccagagacacagcaagaugaagaucauccccaccgccagcgccagccagcugacccugguggaccuggugugcgcccugagcacccugcagaccgacacccugcugcaccuggugaaggagguggugaagagacccccccaggugaagggcggcgacgagaagagcccccugguggacauccccgugcugcaguucugcuacgccuuccugcagagacugcccgugcccgcccugcaggagaacuucagcagccugcugggcgugcugaaggagagcgugcagcugaaccuggccccccccggcuacuuccugcugcugagcaugcugaacgacuucgugaccagaacccccaaccuggagaacaagaaggaccagaaggaccugcaggagaucacccagaagauccuggaggccgugggcaacaucgccggcagcagccuggagcagaccagcuggcugagcagaaaccuggaggugaaggcccagccccaggccagccuggaggagagcgacgccgaggaggaccuguacgacgccgccgccgccagcgccauggugagcagcagcgcccccagcguguacagcgugcaggcccugagccugcuggccgaggugcuggccagccugcuggacaugguguacagaagcgacgagaaggagaaggccgugccccugaucagcagacugcuguacuacguguuccccuaccugagaaaccacagcgccuacaacgcccccagcuucagagccggcgcccagcugcugagcagccugagcggcuacgccuacaccaagagagccuggagaaaggaggugcuggagcuguuccuggaccccgccuucuuccagauggacaccagcugcgugcacuggaagagcaucaucgaccaccugcugacccacgagaagaccauguucaaggaccugaugaacaugcagagcagcagccugaagcuguucagcagcuucgagcagaaggccaugcugcugaagagacaggccuucgccguguucagcggcgagcuggaccaguaccaccuguaccugccccugauccaggagagacugaccgacaaccugagagugggccagaccagcaucguggccgcccagauguuccuguucuucagagugcugcugcugagaaucagcccccagcaccugaccagccuguggcccaucauggugagcgagcugauccagaccuucacccagcuggaggaggaccugaaggacgaggacgagagccugagaagcaccaacaaggugaacagaaccaaggugagcgugcccgacgccaacggccccagcgugggcgagaucccccagagcgagcugauccuguaccugagcgccugcaaguuccuggacaccgcccugagcuucccccccgacaagaugccccuguuccagaucuacagaugggccuucauccccgagguggacaccgagggccccgccuuccugagcgacguggaggagaaccaccaggagugcaagccccacaccgugagaauccuggagcugcugaagcugaaguucggcgagaucagcagcagcgacgagaucaccaugaagagcgaguucccccugcugagacagcacagcgugagcagcaucagacagcugaugcccuucuucaugacccugaacggcgccuucaagacccagagacagcugcccgccgacagccccggcacccccuuccuggacuuccccgugaccgacagccccagaauccugaagcagcuggaggagugcaucgaguacgacuuccuggagcaccccgagugcuaa

SEQ ID NO: 16279 - RNA, 4614 nt, Artificial Sequence
  DOT1L__Homo_sapiens__NP_115871
augggcgagaagcuggagcugagacugaagagccccgugggcgccgagcccgccguguaccccuggccccugcccguguacgacaagcaccacgacgccgcccacgagaucaucgagaccaucagaugggugugcgaggagauccccgaccugaagcuggccauggagaacuacgugcugaucgacuacgacaccaagagcuucgagagcaugcagagacugugcgacaaguacaacagagccaucgacagcauccaccagcuguggaagggcaccacccagcccaugaagcugaacaccagacccagcaccggccugcugagacacauccugcagcagguguacaaccacagcgugaccgaccccgagaagcugaacaacuacgagcccuucagccccgagguguacggcgagaccagcuucgaccugguggcccagaugaucgacgagaucaagaugaccgacgacgaccuguucguggaccugggcagcggcgugggccagguggugcugcagguggccgccgccaccaacugcaagcaccacuacggcguggagaaggccgacauccccgccaaguacgccgagaccauggacagagaguucagaaaguggaugaagugguacggcaagaagcacgccgaguacacccuggagagaggcgacuuccugagcgaggaguggagagagagaaucgccaacaccagcgugaucuucgugaacaacuucgccuucggccccgagguggaccaccagcugaaggagagauucgccaacaugaaggagggcggcagaaucgugagcagcaagcccuucgccccccugaacuucagaaucaacagcagaaaccugagcgacaucggcaccaucaugagagugguggagcugagcccccugaagggcagcgugagcuggaccggcaagcccgugagcuacuaccugcacaccaucgacagaaccauccuggagaacuacuucagcagccugaagaaccccaagcugagagaggagcaggaggccgccagaagaagacagcagagagagagcaagagcaacgccgccacccccaccaagggccccgagggcaagguggccggccccgccgacgcccccauggacagcggcgccgaggaggagaaggccggcgccgccaccgugaagaagcccagccccagcaaggccagaaagaagaagcugaacaagaagggcagaaagauggccggcagaaagagaggcagacccaagaagaugaacaccgccaaccccgagagaaagcccaagaagaaccagaccgcccuggacgcccugcacgcccagaccgugagccagaccgccgccagcagcccccaggacgccuacagaagcccccacagccccuucuaccagcugccccccagcgugcagagacacagccccaacccccugcugguggcccccaccccccccgcccugcagaagcugcuggagagcuucaagauccaguaccugcaguuccuggccuacaccaagaccccccaguacaaggccagccugcaggagcugcugggccaggagaaggagaagaacgcccagcugcugggcgccgcccagcagcugcugagccacugccaggcccagaaggaggagaucagaagacuguuccagcagaagcuggacgagcugggcgugaaggcccugaccuacaacgaccugauccaggcccagaaggagaucagcgcccacaaccagcagcugagagagcagagcgagcagcuggagcaggacaacagagcccugagaggccagagccugcagcugcugaaggccagaugcgaggagcugcagcuggacugggccacccugagccuggagaagcugcugaaggagaagcaggcccugaagagccagaucagcgagaagcagagacacugccuggagcugcagaucagcaucguggagcuggagaagagccagagacagcaggagcugcugcagcugaagagcugcgugccccccgacgacgcccugagccugcaccugagaggcaagggcgcccugggcagagagcuggagcccgacgccagcagacugcaccuggagcuggacugcaccaaguucagccugccccaccugagcagcaugagccccgagcugagcaugaacggccaggccgccggcuacgagcugugcggcgugcugagcagacccagcagcaagcagaacaccccccaguaccuggccagcccccuggaccaggagguggugcccugcacccccagccacgugggcagacccagacuggagaagcugagcggccuggccgcccccgacuacaccagacugagccccgccaagaucgugcugagaagacaccugagccaggaccacaccgugcccggcagacccgccgccagcgagcugcacagcagagccgagcacaccaaggagaacggccugcccuaccagagccccagcgugcccggcagcaugaagcugagcccccaggaccccagaccccugagccccggcgcccugcagcuggccggcgagaagagcagcgagaagggccugagagagagagccuacggcagcagcggcgagcugaucaccagccugcccaucagcaucccccugagcaccgugcagcccaacaagcugcccgugagcaucccccuggccagcguggugcugcccagcagagccgagagagccagaagcacccccagccccgugcugcagcccagagaccccagcagcacccuggagaagcagaucggcgccaacgcccacggcgccggcagcagaagccuggcccuggcccccgccggcuucagcuacgccggcagcguggccaucagcggcgcccuggccggcagccccgccagccugacccccggcgccgagcccgccacccuggacgagagcagcagcagcggcagccuguucgccaccgugggcagcagaagcagcaccccccagcacccccugcugcuggcccagcccagaaacagccugcccgccagccccgcccaccagcugagcagcagccccagacugggcggcgccgcccagggcccccugcccgaggccagcaagggcgaccugcccagcgacagcggcuucagcgaccccgagagcgaggccaagagaagaaucguguucaccaucaccaccggcgccggcagcgccaagcagagccccagcagcaagcacagcccccugaccgccagcgccagaggcgacugcgugcccagccacggccaggacagcagaagaagaggcagaagaaagagagccagcgccggcacccccagccugagcgccggcgugagccccaagagaagagcccugcccagcguggccggccuguucacccagcccagcggcagcccccugaaccugaacagcauggugagcaacaucaaccagccccuggagaucaccgccaucagcagccccgagaccagccugaagagcagccccgugcccuaccaggaccacgaccagccccccgugcugaagaaggagagaccccugagccagaccaacggcgcccacuacagcccccugaccagcgacgaggagcccggcagcgaggacgagcccagcagcgccagaaucgagagaaagaucgccaccaucagccuggagagcaagagcccccccaagacccuggagaacggcggcggccuggccggcagaaagcccgcccccgccggcgagcccgugaacagcagcaaguggaagagcaccuucagccccaucagcgacaucggccuggccaagagcgccgacagcccccugcaggccagcagcgcccugagccagaacagccuguucaccuucagacccgcccuggaggagcccagcgccgacgccaagcuggccgcccaccccagaaagggcuuccccggcagccugagcggcgccgacggccugagccccggcaccaaccccgccaacggcugcaccuucggcggcggccuggccgccgaccugagccugcacagcuucagcgacggcgccagccugccccacaagggccccgaggccgccggccugagcagcccccugagcuuccccagccagagaggcaaggagggcagcgacgccaaccccuuccugagcaagagacagcuggacggccuggccggccugaagggcgagggcagcagaggcaaggaggccggcgagggcggccugccccugugcggccccaccgacaagaccccccugcugagcggcaaggccgccaaggccagagacagagagguggaccugaagaacggccacaaccuguucaucagcgccgccgccgugccccccggcagccugcugagcggccccggccuggcccccgccgccagcagcgccggcggcgccgccagcagcgcccagacccacagaagcuuccugggccccuucccccccggcccccaguucgcccugggccccaugagccugcaggccaaccugggcagcguggccggcagcagcgugcugcagagccuguucagcagcgugcccgccgccgccggccuggugcacgugagcagcgccgccaccagacugaccaacagccacgccaugggcagcuucagcggcguggccggcggcaccgugggcggcaacuaa

SEQ ID NO: 16280 - RNA, 1227 nt, Artificial Sequence
  DPAGT1__Homo_sapiens__NP_001373
augugggccuucagcgagcugcccaugccccugcugaucaaccugaucgugagccugcugggcuucguggccaccgugacccugauccccgccuucagaggccacuucaucgccgccagacugugcggccaggaccugaacaagaccagcagacagcagauccccgagagccagggcgugaucagcggcgccguguuccugaucauccuguucugcuucauccccuuccccuuccugaacugcuucgugaaggagcagugcaaggccuucccccaccacgaguucguggcccugaucggcgcccugcuggccaucugcugcaugaucuuccugggcuucgccgacgacgugcugaaccugagauggagacacaagcugcugcugcccaccgccgccagccugccccugcugaugguguacuucaccaacuucggcaacaccaccaucguggugcccaagcccuucagacccauccugggccugcaccuggaccugggcauccuguacuacguguacaugggccugcuggccguguucugcaccaacgccaucaacauccuggccggcaucaacggccuggaggccggccagagccuggugaucagcgccagcaucaucguguucaaccugguggagcuggagggcgacugcagagacgaccacguguucagccuguacuucaugauccccuucuucuucaccacccugggccugcuguaccacaacugguaccccagcagaguguucgugggcgacaccuucugcuacuucgccggcaugaccuucgccguggugggcauccugggccacuucagcaagaccaugcugcuguucuucaugccccagguguucaacuuccuguacagccugccccagcugcugcacaucauccccugccccagacacagaauccccagacugaacaucaagaccggcaagcuggagaugagcuacagcaaguucaagaccaagagccugagcuuccugggcaccuucauccugaagguggccgagagccugcagcuggugaccgugcaccagagcgagaccgaggacggcgaguucaccgagugcaacaacaugacccugaucaaccugcugcugaaggugcugggccccauccacgagagaaaccugacccugcugcugcugcugcugcagauccugggcagcgccaucaccuucagcaucagauaccagcuggugagacuguucuacgacguguaa

SEQ ID NO: 16281 - RNA, 612 nt, Artificial Sequence
  DPCD__Homo_sapiens__NP_056263
auggccgugaccggcuggcuggagagccugagaaccgcccagaagaccgcccugcugcaggacggcagaagaaaggugcacuaccuguuccccgacggcaaggagauggccgaggaguacgacgagaagaccagcgagcugcuggugagaaaguggagagugaagagcgcccugggcgccaugggccaguggcagcuggaggugggcgaccccgccccccugggcgccggcaaccugggccccgagcugaucaaggagagcaacgccaaccccaucuucaugagaaaggacaccaagaugagcuuccaguggagaaucagaaaccugcccuaccccaaggacguguacagcgugagcguggaccagaaggagagaugcaucaucgugagaaccaccaacaagaaguacuacaagaaguucagcauccccgaccuggacagacaccagcugccccuggacgacgcccugcugagcuucgcccacgccaacugcacccugaucaucagcuaccagaagcccaaggagguggugguggccgagagcgagcugcagaaggagcugaagaaggugaagaccgcccacagcaacgacggcgacugcaagacccaguaa

SEQ ID NO: 16282 - RNA, 4182 nt, Artificial Sequence
  DPCR1__Homo_sapiens__NP_543146
auggcccagcccgugcacagccugugcagcgccuucggccugcagugcugccugcuguuccugcuggccagcuggggcgccggcgccaccaccuuccaggaguaccagaagaccggcgagcugagcaccagcgaccacaucuucccccugacccccggccugguguacagcauccccuucgaccacaucgugcugcacagcggccagagaccccccgagcugcccaagagcaccgagauccacgagcagaagagacacugcaacaccaccagacacagcaagcccaccgacaagcccaccggcaacagcaagaccaucgaccacaagagcagcaccgacaaccacgaggccccccccaccagcgaggagaacagcagcaaccagggcaaggaccccaugaucagaaaccagagaagcguggaccccgccgacagcaccaccacccacaaggagagcgccggcaagaagcacaucacccccgcccccaagagcaagaucaacugcagaaagagcaccaccggcaagagcaccgugaccagaaagagcgacaagaccggcagaccccuggagaagagcaugagcacccuggacaagaccagcaccagcagccacaagaccaccaccagcuuccacaacagcggcaacagccagaccaagcagaagagcaccagcuuccccgagaagaucaccgccgccagcaagaccaccuacaagaccaccggcacccccgaggagagcgagaagaccgaggacagcagaaccaccguggccagcgacaagcugcugaccaagaccaccaagaacauccaggagaccaucagcgccaacgagcugacccagagccuggccgagcccaccgagcacggcggcagaaccgccaacgagaacaacacccccagccccgccgagcccaccgagaacagagagagaaccgccaacgagaacaccacccugagccccgccgagcccaucgagaacagagagagaaccgccaacgagaacaccgcccccuuccccgccggccccaccgagaacagagagaugaccgccaacgagaacaccacccuguuccccgccgagcccaccgagcacggcgagagaaccgccaacgagaacaccacccccagccccgccgagcccaccgagcacggcgagagaaccgccaacgagaacaccacccccagccccgccgagcccaccgagcacggcgagagaacccccuucgccaacgacaagaccaccagcagcagcgccgagagcaccgagcacggcgagagaaccccccuggccaacgagaacaccacccccagccccgccgagcccaccgagaacagagagagaaccgccaacgagaacaccacccccagccccgccggccccaccgagaacagagagaccaccgccaacgagaagaccacccugagccccguggagcccaccgagaacagagagaccaccgccaacgagaagaccacccccagccccgccgagcccaccgagaacggccagagaacccccuucgccaacgagaagaccaccagcagcagcgccgagcccaccgagcacggcgagagaaccccccuggccaacgagaacaccacccccagccccgccgagcccaccgagaacagagagagaaccgccaacgagaagaccacccccagccccgccgagcccaccgagaacggcgacagaaccccccuggccaacgagaagaccacccccagccuggccgagcccaccgagaacggccagagaacccccuucgccaacgagaagaccaccagcagcagcgccgagcccaccgagcacgaggagagaaccccccuggccaacgagaacaccacccccagccccgccgagcccaccgagaacagagagagaaccgccaacgagaacaccacccccagccccgccggccccaccgagaacagagagaugaccgccaacgagaagaccacccuguuccccgccgagcccaccgagaacagagagagaaccgccaacgagaagaccaccagcagccccgccgagcccaccgagaacggccagagaacccccuucgccaacgagaagaccaccagcagcagcgccgagcccaccgagcacggcgagagaaccccccuggccaacgagaacaccacccugagccccgccgagcccaccgagaacagagagagaaccgccaacgagaagaccacccccuuccccgccgagcccaccgagaacagagagagaaccgccaacgagaacaccacccccagccccgcccagcccaccgagaacggcgacagaaccccccuggccaacgagaagaccacccccagccuggccgagcccaccgagaacggcaagagaacccccuucgccaacgagaagaccaccagcagcagcgccgagcccaccgagcacgccgagagaaccccccuggccaacgagaacaccaccagcagccccgccgagcccaccgagaacagagagagaaccgccaacgagaagaccacccaguuccccgccgagcccaccgagaacagagagagcaccgccaacgagaagaccacccccuuccccgccgagcccaccgagaacagagaguggaccgccaacgagaacaccacccugagccccgccgagcccaccgagcacgaggagaugaccccccuggccaacgagaagaccacccugagccccgccgagcccaccgagaacggcgagagaacccccuucaccaacgagaagaccacccccagcagcgccgagcccaccgagcacggcgagagaaccccccuggccaacgagaucaccacccccagcagagccgagcccaccgagcacggcgagagaaucgccaacgagaaggccacccccagccccgccaagcccaccgagcacggcgagaccaccgugaacgaggacaccacccccagcagcgccgagcccaccgagaacggcgagagaaccccccuggccaacgagaacaccaccaccagccccaccgagagcaccgagcacggcgagagaaccgccaacgagaagaccacccccagccccgccgagcccaccgagcacggcgagagaacccccagcgccaacgagaagaccauccccagccccgccaagcccaccgagcacgaggagaugacccccagcgccaacgagaacaccacccccagccccgugaagcccaccgagcacggcgagaagaccacccuggccaacgagaagaucacccugagccccgagggccccaccgagcacggcgccaagaccaccagcgccaacgagaagaucacccccagccuggccaagcccaccgagcacggcgagagaaccaccagccccaacgacaagaucaccagcagcgccgccgagagcaccgagcacagagacagagccaccagcgccaacgugaucacccccgcccccgccgagcccaucaagcacgccaagagaaccacccuggcccacgagaagaugacccaggugaccgagaagagcaccgagcaccccgagaagaccaccagcaccaccgagaagaccaccagaacccccgagaagcccacccuguacagcgagaagaccaucugcaccaagggcaagaacacccccgugcccgagaagcccaccgagaaccugggcaacaccacccugaccaccgagaccaucaaggcccccgugaagagcaccgagaaccccgagaagaccgccgccgugaccaagaccaucaagcccagcgugaaggugaccggcgacaagagccugaccaccaccagcagccaccugaacaagaccgaggugacccaccaggugcccaccggcagcuucacccugaucaccagcagaaccaagcugagcagcaucaccagcgaggccaccggcaacgagagccaccccuaccugaacaaggacggcagccagaagggcauccacgccggccagaugggcgagaacgacagcuuccccgccugggccaucgugaucguggugcugguggccgugauccugcugcugguguuccugggccugaucuuccuggugagcuacaugaugagaaccagaagaacccugacccagaacacccaguacaacgacgccgaggacgagggcggccccaacagcuaccccguguaccugauggagcagcagaaccugggcaugggccagauccccagccccagauaa

SEQ ID NO: 16283 - RNA, 1236 nt, Artificial Sequence
  DPEP1__Homo_sapiens__NP_001121613
auguggagcggcugguggcuguggccccugguggccgugugcaccgccgacuucuucagagacgaggccgagagaaucaugagagacagccccgugaucgacggccacaacgaccugcccuggcagcugcuggacauguucaacaacagacugcaggacgagagagccaaccugaccacccuggccggcacccacaccaacauccccaagcugagagccggcuucgugggcggccaguucuggagcguguacacccccugcgacacccagaacaaggacgccgugagaagaacccuggagcagauggacguggugcacagaaugugcagaauguaccccgagaccuuccuguacgugaccagcagcgccggcaucagacaggccuucagagagggcaagguggccagccugaucggcguggagggcggccacagcaucgacagcagccugggcgugcugagagcccuguaccagcugggcaugagauaccugacccugacccacagcugcaacacccccugggccgacaacuggcugguggacaccggcgacagcgagccccagagccagggccugagccccuucggccagagaguggugaaggagcugaacagacugggcgugcugaucgaccuggcccacgugagcguggccaccaugaaggccacccugcagcugagcagagcccccgugaucuucagccacagcagcgccuacagcgugugcgccagcagaagaaacgugcccgacgacgugcugagacuggugaagcagaccgacagccuggugauggugaacuucuacaacaacuacaucagcugcaccaacaaggccaaccugagccagguggccgaccaccuggaccacaucaaggagguggccggcgccagagccgugggcuucggcggcgacuucgacggcgugcccagagugcccgagggccuggaggacgugagcaaguaccccgaccugaucgccgagcugcugagaagaaacuggaccgaggccgaggugaagggcgcccuggccgacaaccugcugagaguguucgaggccguggagcaggccagcaaccugacccaggcccccgaggaggagcccaucccccuggaccagcugggcggcagcugcagaacccacuacggcuacagcagcggcgccagcagccugcacagacacuggggccugcugcuggccagccuggccccccuggugcugugccugagccugcuguaa

SEQ ID NO: 16284 - RNA, 1461 nt, Artificial Sequence
  DPEP2__Homo_sapiens__NP_071750
augcagcccagcggccuggagggccccggcaccuucggcagauggccccugcugagccugcugcugcugcugcugcugcugcagcccgugaccugcgccuacaccacccccggcccccccagagcccugaccacccugggcgcccccagagcccacaccaugcccggcaccuacgcccccagcaccacccugagcagccccagcacccagggccugcaggagcaggccagagcccugaugagagacuucccccugguggacggccacaacgaccugccccuggugcugagacagguguaccagaagggccugcaggacgugaaccugagaaacuucagcuacggccagaccagccuggacagacugagagacggccuggugggcgcccaguucuggagcgccuacgugcccugccagacccaggacagagacgcccugagacugacccuggagcagaucgaccugaucagaagaaugugcgccagcuacagcgagcuggagcuggugaccagcgccaaggcccugaacgacacccagaagcuggccugccugaucggcguggagggcggccacagccuggacaacagccugagcauccugagaaccuucuacaugcugggcgugagauaccugacccugacccacaccugcaacacccccugggccgagagcagcgccaagggcgugcacagcuucuacaacaacaucagcggccugaccgacuucggcgagaaggugguggccgagaugaacagacugggcaugaugguggaccugagccacgugagcgacgccguggccagaagagcccuggaggugagccaggcccccgugaucuucagccacagcgccgccagaggcgugugcaacagcgccagaaacgugcccgacgacauccugcagcugcugaagaagaacggcggcguggugauggugagccugagcaugggcgugauccagugcaaccccagcgccaacgugagcaccguggccgaccacuucgaccacaucaaggccgugaucggcagcaaguucaucggcaucggcggcgacuacgacggcgccggcaaguucccccagggccuggaggacgugagcaccuaccccgugcugaucgaggagcugcugagcagaggcuggagcgaggaggagcugcagggcgugcugagaggcaaccugcugagaguguucagacagguggagaaggugcaggaggagaacaaguggcagagcccccuggaggacaaguuccccgacgagcagcugagcagcagcugccacagcgaccugagcagacugagacagagacagagccugaccagcggccaggagcugaccgagauccccauccacuggaccgccaagcugcccgccaaguggagcgugagcgagagcagcccccacauggcccccgugcuggccgugguggccaccuuccccgugcugauccuguggcuguaa

SEQ ID NO: 16285 - RNA, 1542 nt, Artificial Sequence
  DPEP3__Homo_sapiens__NP_071752
augaucagaaccccccugagcgccagcgcccacagacugcugcugcccggcagcagaggcagaccccccagaaacaugcagcccaccggcagagagggcagcagagcccugagcagaagauaccugagaagacugcugcugcugcugcugcugcugcugcugagacagcccgugaccagagccgagaccacccccggcgcccccagagcccugagcacccugggcagccccagccuguucaccacccccggcgugcccagcgcccugaccacccccggccugaccacccccggcacccccaagacccuggaccugagaggcagagcccaggcccugaugagaagcuucccccugguggacggccacaacgaccugccccaggugcugagacagagauacaagaacgugcugcaggacgugaaccugagaaacuucagccacggccagaccagccuggacagacugagagacggccuggugggcgcccaguucuggagcgccagcgugagcugccagagccaggaccagaccgccgugagacuggcccuggagcagaucgaccugauccacagaaugugcgccagcuacagcgagcuggagcuggugaccagcgccgagggccugaacagcagccagaagcuggccugccugaucggcguggagggcggccacagccuggacagcagccugagcgugcugagaagcuucuacgugcugggcgugagauaccugacccugaccuucaccugcagcacccccugggccgagagcagcaccaaguucagacaccacauguacaccaacgugagcggccugaccagcuucggcgagaaggugguggaggagcugaacagacugggcaugaugaucgaccugagcuacgccagcgacacccugaucagaagagugcuggaggugagccaggcccccgugaucuucagccacagcgccgccagagccgugugcgacaaccugcugaacgugcccgacgacauccugcagcugcugaagaagaacggcggcaucgugauggugacccugagcaugggcgugcugcagugcaaccugcuggccaacgugagcaccguggccgaccacuucgaccacaucagagccgugaucggcagcgaguucaucggcaucggcggcaacuacgacggcaccggcagauucccccagggccuggaggacgugagcaccuaccccgugcugaucgaggagcugcugagcagaagcuggagcgaggaggagcugcagggcgugcugagaggcaaccugcugagaguguucagacagguggagaaggugagagaggagagcagagcccagagccccguggaggccgaguuccccuacggccagcugagcaccagcugccacagccaccuggugccccagaacggccaccaggccacccaccuggaggugaccaagcagcccaccaacagagugcccuggagaagcagcaacgccagccccuaccuggugcccggccugguggccgccgccaccauccccaccuucacccaguggcugugcuaa

SEQ ID NO: 16286 - RNA, 1245 nt, Artificial Sequence
  DPF1__Homo_sapiens__NP_001128627
augggcggccugagcgccagacccaccgccggcagaaccgaccccgccggcaccugcuggggccaggaccccggcagcaagauggccaccgugauccccggcccccugagccugggcgaggacuucuacagagaggccaucgagcacugcagaagcuacaacgccagacugugcgccgagagaagccugagacugcccuuccuggacagccagaccggcguggcccagaacaacugcuacaucuggauggagaagacccacagaggccccggccuggcccccggccagaucuacaccuaccccgccagaugcuggagaaagaagagaagacugaacauccuggaggaccccagacugagacccugcgaguacaagaucgacugcgaggccccccugaagaaggagggcggccugcccgagggccccgugcuggaggcccugcugugcgccgagaccggcgagaagaagaucgagcugaaggaggaggagaccaucauggacugccagaagcagcagcugcuggaguucccccacgaccuggagguggaggaccuggaggacgacauccccagaagaaagaacagagccaagggcaaggccuacggcaucggcggccugagaaagagacaggacaccgccagccuggaggacagagacaagcccuacgugugcgacaucugcggcaagagauacaagaacagacccggccugagcuaccacuacacccacacccaccuggccgaggaggagggcgaggagaacgccgagagacacgcccugcccuuccacagaaagaacaaccacaagcaguucuacaaggagcuggccugggugcccgaggcccagagaaagcacaccgccaagaaggcccccgacggcaccgugauccccaacggcuacugcgacuucugccugggcggcagcaagaagaccggcugccccgaggaccugaucagcugcgccgacugcggcagaagcggccaccccagcugccugcaguucaccgugaacaugaccgccgccgugagaaccuacagauggcagugcaucgagugcaagagcugcagccugugcggcaccagcgagaacgacgaccagcugcuguucugcgacgacugcgacagaggcuaccacauguacugccugagcccccccauggccgagccccccgagggcagcuggagcugccaccugugccugagacaccugaaggagaaggccagcgccuacaucacccugaccuaa

SEQ ID NO: 16287 - RNA, 1137 nt, Artificial Sequence
  DPF3__Homo_sapiens__NP_001267471
auggccaccgugauccacaacccccugaaggcccugggcgaccaguucuacaaggaggccaucgagcacugcagaagcuacaacagcagacugugcgccgagagaagcgugagacugcccuuccuggacagccagaccggcguggcccagaacaacugcuacaucuggauggagaagagacacagaggccccggccuggcccccggccagcuguacaccuaccccgccagaugcuggagaaagaagagaagacugcacccccccgaggaccccaagcugagacugcuggagaucaagcccgagguggagcugccccugaagaaggacggcuucaccagcgagagcaccacccuggaggcccugcugagaggcgagggcguggagaagaagguggacgccagagaggaggagagcauccaggagauccagagagugcuggagaacgacgagaacguggaggagggcaacgaggaggaggaccuggaggaggacauccccaagagaaagaacagaaccagaggcagagccagaggcagcgccggcggcagaagaagacacgacgccgccagccaggaggaccacgacaagcccuacgugugcgacaucugcggcaagagauacaagaacagacccggccugagcuaccacuacgcccacacccaccuggccagcgaggagggcgacgaggcccaggaccaggagaccagaagcccccccaaccacagaaacgagaaccacagaccccagaagggccccgacggcaccgugauccccaacaacuacugcgacuucugccugggcggcagcaacaugaacaagaagagcggcagacccgaggagcuggugagcugcgccgacugcggcagaagcggccaccccaccugccugcaguucacccugaacaugaccgaggccgugaagaccuacaaguggcagugcaucgagugcaagagcugcauccugugcggcaccagcgagaacgacgaccagcugcuguucugcgacgacugcgacagaggcuaccacauguacugccugaacccccccguggccgagccccccgagggcagcuggagcugccaccugugcugggagcugcugaaggagaaggccagcgccuucggcugccaggccuaa

SEQ ID NO: 16288 - RNA, 1332 nt, Artificial Sequence
  DPH1__Homo_sapiens__NP_001374
augagaagacaggugauggccgcccugguggugagcggcgccgccgagcagggcggcagagacggccccggcagaggcagagcccccagaggcagaguggccaaccagaucccccccgagauccugaagaacccccagcugcaggccgccaucagagugcugcccagcaacuacaacuucgagauccccaagaccaucuggagaauccagcaggcccaggccaagaagguggcccugcagaugcccgagggccugcugcuguucgccugcaccaucguggacauccuggagagauucaccgaggccgaggugauggugaugggcgacgugaccuacggcgccugcugcguggacgacuucaccgccagagcccugggcgccgacuuccuggugcacuacggccacagcugccugauccccauggacaccagcgcccaggacuucagagugcuguacguguucguggacaucagaaucgacaccacccaccugcuggacagccugagacugaccuucccccccgccaccgcccuggcccuggugagcaccauccaguucgugagcacccugcaggccgccgcccaggagcugaaggccgaguacagagugagcgugccccagugcaagccccugagccccggcgagauccugggcugcaccagccccagacugagcaaggagguggaggccgugguguaccugggcgacggcagauuccaccuggagagcgugaugaucgccaaccccaacgugcccgccuacagauacgaccccuacagcaaggugcugagcagagagcacuacgaccaccagagaaugcaggccgccagacaggaggccaucgccaccgccagaagcgccaagagcuggggccugauccugggcacccugggcagacagggcagccccaagauccuggagcaccuggagagcagacugagagcccugggccugagcuucgugagacugcugcugagcgagaucuuccccagcaagcugagccugcugcccgagguggacgugugggugcagguggccugccccagacugagcaucgacuggggcaccgccuuccccaagccccugcugacccccuacgaggccgccguggcccugagagacaucagcuggcagcagcccuaccccauggacuucuacgccggcagcagccugggccccuggaccgugaaccacggccaggacagaagaccccacgcccccggcagacccgccagaggcaaggugcaggagggcagcgccagaccccccagcgccguggccugcgaggacugcagcugcagagacgagaagguggccccccuggcccccuaa

SEQ ID NO: 16289 - RNA, 174 nt, Artificial Sequence
  DPH3__Homo_sapiens__NP_001040899
auggccguguuccacgacgagguggagaucgaggacuuccaguacgacgaggacagcgagaccuacuucuaccccugccccugcggcgacaacuucagcaucaccaaggaccaguucgugugcggcgagaccgugcccgcccccagcgccaacaaggagcuggugaagugcuaa

SEQ ID NO: 16290 - RNA, 498 nt, Artificial Sequence
  DPH6__Homo_sapiens__NP_001135444
augagaguggccgcccugaucagcggcggcaaggacagcugcuacaacaugaugcagugcaucgccgccggccaccagaucguggcccuggccaaccugagacccgccgagaaccaggugggcagcgacgagcuggacagcuacauguaccagaccgugggccaccacgccaucgaccuguacgccgaggccauggcccugccccuguacagaagaaccaucagaggcagaagccuggacaccagacagguguacaccaagugcgagggcgacgagguggaggaccuguacgagcugcugaagcuggugaagggcaucaccagaaugacccugcuggccgaguacgacgcccugaaccugcaggacuuccacaugcaccugaaggugggcagccaggccaucguguacagaacccccaacgagcugugcacccacagcaaguucgacaagcacaccuucccccccuucaucagcgagaucgccaagugcgagguguaa

SEQ ID NO: 16291 - RNA, 1359 nt, Artificial Sequence
  DPH7__Homo_sapiens__NP_620133
augaugggcugcuucgcccugcagaccguggacaccgagcugaccgccgacagcguggaguggugcccccugcagggcugcagacaccugcuggccugcggcaccuaccagcugagaagacccgaggacagacccgccggcccccagaacaagggcggcauggaggugaaggagccccaggugagacugggcagacuguuccuguacagcuucaacgacaacaacagcauccacccccugguggaggugcagagaaaggacaccagcgccauccuggacaugaaguggugccacauccccguggccggccacgcccugcugggccuggccgacgccagcggcagcauccagcugcugagacugguggagagcgagaagagccacgugcuggagccccugagcagccuggcccuggaggagcagugccuggcccugagccuggacuggagcaccggcaagaccggcagagccggcgaccagccccugaagaucaucagcagcgacagcaccggccagcugcaccugcugauggugaacgagaccagacccagacugcagaagguggccagcuggcaggcccaccaguucgaggccuggaucgccgccuucaacuacuggcaccccgagaucguguacagcggcggcgacgacggccugcugagaggcugggacaccagagugcccggcaaguuccuguucaccagcaagagacacaccaugggcgugugcagcauccagagcagcccccacagagagcacauccuggccaccggcagcuacgacgagcacauccugcugugggacaccagaaacaugaagcagccccuggccgacacccccgugcagggcggcguguggagaaucaaguggcaccccuuccaccaccaccugcugcuggccgccugcaugcacagcggcuucaagauccugaacugccagaaggccauggaggagagacaggaggccaccgugcugaccagccacacccugcccgacagccugguguacggcgccgacuggagcuggcugcuguucagaagccugcagagagcccccagcuggagcuuccccagcaaccugggcaccaagaccgccgaccugaagggcgccagcgagcugcccacccccugccacgagugcagagaggacaacgacggcgagggccacgccagaccccagagcggcaugaagccccugaccgagggcaugagaaagaacggcaccuggcugcaggccaccgccgccaccaccagagacugcggcgugaaccccgaggaggccgacagcgccuucagccugcuggccaccugcagcuucuacgaccacgcccugcaccugugggagugggagggcaacuaa

SEQ ID NO: 16292 - RNA, 783 nt, Artificial Sequence
  DPM1__Homo_sapiens__NP_003850
auggccagccuggaggugagcagaagccccagaagaagcagaagagagcuggaggugagaagccccagacagaacaaguacagcgugcugcugcccaccuacaacgagagagagaaccugccccugaucguguggcugcuggugaagagcuucagcgagagcggcaucaacuacgagaucaucaucaucgacgacggcagccccgacggcaccagagacguggccgagcagcuggagaagaucuacggcagcgacagaauccugcugagacccagagagaagaagcugggccugggcaccgccuacauccacggcaugaagcacgccaccggcaacuacaucaucaucauggacgccgaccugagccaccaccccaaguucauccccgaguucaucagaaagcagaaggagggcaacuucgacaucgugagcggcaccagauacaagggcaacggcggcguguacggcugggaccugaagagaaagaucaucagcagaggcgccaacuuccugacccagauccugcugagacccggcgccagcgaccugaccggcagcuucagacuguacagaaaggaggugcuggagaagcugaucgagaagugcgugagcaagggcuacguguuccagauggagaugaucgugagagccagacagcugaacuacaccaucggcgaggugcccaucagcuucguggacagaguguacggcgagagcaagcugggcggcaacgagaucgugagcuuccugaagggccugcugacccuguucgccaccaccuaa

SEQ ID NO: 16293 - RNA, 255 nt, Artificial Sequence
  DPM2__Homo_sapiens__NP_003854
auggccaccggcaccgaccagguggugggccugggccugguggccgugagccugaucaucuucaccuacuacaccgccugggugauccugcugcccuucaucgacagccagcacgugauccacaaguacuuccugcccagagccuacgccguggccaucccccuggccgccggccugcugcugcugcuguucgugggccuguucaucagcuacgugaugcugaagaccaagagagugaccaagaaggcccaguaa

SEQ ID NO: 16294 - RNA, 369 nt, Artificial Sequence
  DPM3__Homo_sapiens__NP_061846
augcugagcgugggcggccugagacugagccuggugagauucagcuuccugcugcugagaggcgcccugcugcccagccuggccgugaccaugaccaagcuggcccaguggcuguggggccuggccauccugggcagcaccuggguggcccugaccaccggcgcccugggccuggagcugccccugagcugccaggaggugcuguggccccugcccgccuaccugcuggugagcgccggcugcuacgcccugggcaccgugggcuacagaguggccaccuuccacgacugcgaggacgccgccagagagcugcagagccagauccaggaggccagagccgaccuggccagaagaggccugagauucuaa

SEQ ID NO: 16295 - RNA, 2403 nt, Artificial Sequence
  DPP10__Homo_sapiens__NP_001171505
augaccgccgccaagcaggagccccagcccacccccggcgccagagccagccaggcccagcccgccgaccaggagcugggcagcaacagccccccccagagaaacuggaagggcaucgccaucgcccugcuggugauccugguggugugcagccugaucaccaugagcgugauccugcugacccccgacgagcugaccaacagcagcgagaccagacugagccuggaggaccuguucagaaaggacuucgugcugcacgaccccgaggccagauggaucaacgacaccgacgugguguacaagagcgagaacggccacgugaucaagcugaacaucgagaccaacgccaccacccugcugcuggagaacaccaccuucgugaccuucaaggccagcagacacagcgugagccccgaccugaaguacgugcugcuggccuacgacgugaagcagaucuuccacuacagcuacaccgccagcuacgugaucuacaacauccacaccagagaggugugggagcugaacccccccgagguggaggacagcgugcugcaguacgccgccuggggcgugcagggccagcagcugaucuacaucuucgagaacaacaucuacuaccagcccgacaucaagagcagcagccugagacugaccagcagcggcaaggaggagaucaucuucaacggcaucgccgacuggcuguacgaggaggagcugcugcacagccacaucgcccacugguggagccccgacggcgagagacuggccuuccugaugaucaacgacagccuggugcccaccauggugauccccagauucaccggcgcccuguaccccaagggcaagcaguaccccuaccccaaggccggccaggugaaccccaccaucaagcuguacguggugaaccuguacggccccacccacacccuggagcugaugccccccgacagcuucaagagcagagaguacuacaucaccauggugaagugggugagcaacaccaagaccguggugagauggcugaacagagcccagaacaucagcauccugaccgugugcgagaccaccaccggcgccugcagcaagaaguacgagaugaccagcgacaccuggcugagccagcagaacgaggagcccguguucagcagagacggcagcaaguucuucaugaccgugcccgugaagcagggcggcagaggcgaguuccaccacaucgccauguuccugauccagagcaagagcgagcagaucaccgugagacaccugaccagcggcaacugggaggugaucaagauccuggccuacgacgagaccacccagaagaucuacuuccugagcaccgagagcagccccagaggcagacagcuguacagcgccagcaccgagggccugcugaacagacagugcaucagcugcaacuucaugaaggagcagugcaccuacuucgacgccagcuucagccccaugaaccagcacuuccugcuguucugcgagggccccagagugcccguggugagccugcacagcaccgacaaccccgccaaguacuucauccuggagagcaacagcaugcugaaggaggccauccugaagaagaagaucggcaagcccgagaucaagauccugcacaucgacgacuacgagcugccccugcagcugagccugcccaaggacuucauggacagaaaccaguacgcccugcugcugaucauggacgaggagcccggcggccagcuggugaccgacaaguuccacaucgacugggacagcgugcugaucgacauggacaacgugaucguggccagauucgacggcagaggcagcggcuuccagggccugaagauccugcaggagauccacagaagacugggcagcguggaggugaaggaccagaucaccgccgugaaguuccugcugaagcugcccuacaucgacagcaagagacugagcaucuucggcaagggcuacggcggcuacaucgccagcaugauccugaagagcgacgagaagcuguucaagugcggcagcgugguggcccccaucaccgaccugaagcuguacgccagcgccuucagcgagagauaccugggcaugcccagcaaggaggagagcaccuaccaggccgccagcgugcugcacaacgugcacggccugaaggaggagaacauccugaucauccacggcaccgccgacaccaaggugcacuuccagcacagcgccgagcugaucaagcaccugaucaaggccggcgugaacuacaccaugcagguguaccccgacgagggccacaacgugagcgagaagagcaaguaccaccuguacagcaccauccugaaguucuucagcgacugccugaaggaggagaucagcgugcugccccaggagcccgaggaggacgaguaa

SEQ ID NO: 16296 - RNA, 2124 nt, Artificial Sequence
  DPP3__Homo_sapiens__NP_001243599
auggccgacacccaguacauccugcccaacgacaucggcgugagcagccuggacugcagagaggccuucagacugcugagccccaccgagagacuguacgccuaccaccugagcagagccgccugguacggcggccuggccgugcugcugcagaccagccccgaggcccccuacaucuacgcccugcugagcagacuguucagagcccaggaccccgaccagcugagacagcacgcccuggccgagggccugaccgaggaggaguaccaggagaagcuggagagagugauccugggcagcgaggccgcccagcagcaccccgaggaggugagaggccuguggcagaccugcggcgagcugauguucagccuggagcccagacugagacaccugggccugggcaaggagggcaucaccaccuacuucagcggcaacugcaccauggaggacgccaagcuggcccaggacuuccuggacagccagaaccugagcgccuacaacaccagacuguucaaggagguggacggcgagggcaagcccuacuacgaggugagacuggccagcgugcugggcagcgagcccagccuggacagcgaggugaccagcaagcugaagagcuacgaguucagaggcagccccuuccaggugaccagaggcgacuacgcccccauccugcagaaggugguggagcagcuggagaaggccaaggccuacgccgccaacagccaccagggccagaugcuggcccaguacaucgagagcuucacccagggcagcaucgaggcccacaagagaggcagcagauucuggauccaggacaagggccccaucguggagagcuacaucggcuucaucgagagcuacagagaccccuucggcagcagaggcgaguucgagggcuucguggccguggugaacaaggccaugagcgccaaguucgagagacugguggccagcgccgagcagcugcugaaggagcugcccuggccccccaccuucgagaaggacaaguuccugacccccgacuucaccagccuggacgugcugaccuucgccggcagcggcauccccgccggcaucaacauccccaacuacgacgaccugagacagaccgagggcuucaagaacgugagccugggcaacgugcuggccguggccuacgccacccagagagagaagcugaccuuccuggaggaggacgacaaggaccuguacauccuguggaagggccccagcuucgacgugcaggugggccugcacgagcugcugggccacggcagcggcaagcuguucgugcaggacgagaagggcgccuucaacuucgaccaggagaccgugaucaaccccgagaccggcgagcagauccagagcugguacagaagcggcgagaccugggacagcaaguucagcaccaucgccagcagcuacgaggagugcagagccgagagcgugggccuguaccugugccugcacccccaggugcuggagaucuucggcuucgagggcgccgacgccgaggacgugaucuacgugaacuggcugaacauggugagagccggccugcuggcccuggaguucuacacccccgaggccuucaacuggagacaggcccacaugcaggccagauucgugauccugagagugcugcuggaggccggcgagggccuggugaccaucacccccaccaccggcagcgacggcagacccgacgccagagugagacuggacagaagcaagaucagaagcgugggcaagcccgcccuggagagauuccugagaagacugcaggugcugaagagcaccggcgacguggccggcggcagagcccuguacgagggcuacgccaccgugaccgacgccccccccgagugcuuccugacccugagagacaccgugcugcugagaaaggagagcagaaagcugaucgugcagcccaacaccagacuggagggcagcgacgugcagcugcuggaguacgaggccagcgccgccggccugaucagaagcuucagcgagagauuccccgaggacggccccgagcuggaggagauccugacccagcuggccaccgccgacgccagauucuggaagggccccagcgaggcccccagcggccaggccuaa

SEQ ID NO: 16297 - RNA, 2301 nt, Artificial Sequence
  DPP4__Homo_sapiens__NP_001926
augaagacccccuggaaggugcugcugggccugcugggcgccgccgcccuggugaccaucaucaccgugcccguggugcugcugaacaagggcaccgacgacgccaccgccgacagcagaaagaccuacacccugaccgacuaccugaagaacaccuacagacugaagcuguacagccugagauggaucagcgaccacgaguaccuguacaagcaggagaacaacauccugguguucaacgccgaguacggcaacagcagcguguuccuggagaacagcaccuucgacgaguucggccacagcaucaacgacuacagcaucagccccgacggccaguucauccugcuggaguacaacuacgugaagcaguggagacacagcuacaccgccagcuacgacaucuacgaccugaacaagagacagcugaucaccgaggagagaauccccaacaacacccagugggugaccuggagccccgugggccacaagcuggccuacguguggaacaacgacaucuacgugaagaucgagcccaaccugcccagcuacagaaucaccuggaccggcaaggaggacaucaucuacaacggcaucaccgacuggguguacgaggaggagguguucagcgccuacagcgcccugugguggagccccaacggcaccuuccuggccuacgcccaguucaacgacaccgaggugccccugaucgaguacagcuucuacagcgacgagagccugcaguaccccaagaccgugagagugcccuaccccaaggccggcgccgugaaccccaccgugaaguucuucguggugaacaccgacagccugagcagcgugaccaacgccaccagcauccagaucaccgcccccgccagcaugcugaucggcgaccacuaccugugcgacgugaccugggccacccaggagagaaucagccugcaguggcugagaagaauccagaacuacagcgugauggacaucugcgacuacgacgagagcagcggcagauggaacugccugguggccagacagcacaucgagaugagcaccaccggcugggugggcagauucagacccagcgagccccacuucacccuggacggcaacagcuucuacaagaucaucagcaacgaggagggcuacagacacaucugcuacuuccagaucgacaagaaggacugcaccuucaucaccaagggcaccugggaggugaucggcaucgaggcccugaccagcgacuaccuguacuacaucagcaacgaguacaagggcaugcccggcggcagaaaccuguacaagauccagcugagcgacuacaccaaggugaccugccugagcugcgagcugaaccccgagagaugccaguacuacagcgugagcuucagcaaggaggccaaguacuaccagcugagaugcagcggccccggccugccccuguacacccugcacagcagcgugaacgacaagggccugagagugcuggaggacaacagcgcccuggacaagaugcugcagaacgugcagaugcccagcaagaagcuggacuucaucauccugaacgagaccaaguucugguaccagaugauccugcccccccacuucgacaagagcaagaaguacccccugcugcuggacguguacgccggccccugcagccagaaggccgacaccguguucagacugaacugggccaccuaccuggccagcaccgagaacaucaucguggccagcuucgacggcagaggcagcggcuaccagggcgacaagaucaugcacgccaucaacagaagacugggcaccuucgagguggaggaccagaucgaggccgccagacaguucagcaagaugggcuucguggacaacaagagaaucgccaucuggggcuggagcuacggcggcuacgugaccagcauggugcugggcagcggcagcggcguguucaagugcggcaucgccguggcccccgugagcagaugggaguacuacgacagcguguacaccgagagauacaugggccugcccacccccgaggacaaccuggaccacuacagaaacagcaccgugaugagcagagccgagaacuucaagcagguggaguaccugcugauccacggcaccgccgacgacaacgugcacuuccagcagagcgcccagaucagcaaggcccugguggacgugggcguggacuuccaggccaugugguacaccgacgaggaccacggcaucgccagcagcaccgcccaccagcacaucuacacccacaugagccacuucaucaagcagugcuucagccugcccuaa

SEQ ID NO: 16298 - RNA, 2406 nt, Artificial Sequence
  DPP6__Homo_sapiens__NP_001034439
augaaggagaaggccaugaucaagaccgccaagaugcagggcaacgugauggagcuggugggcagcaaccccccccagagaaacuggaagggcaucgccaucgcccugcuggugauccuggugaucugcagccugaucgugaccagcgugauccugcugacccccgccgaggacaacagccugagccagaagaagaaggugaccguggaggaccuguucagcgaggacuucaagauccacgaccccgaggccaaguggaucagcgacaccgaguucaucuacagagagcagaagggcaccgugagacuguggaacguggagaccaacaccagcaccgugcugaucgagggcaagaagaucgagagccugagagccaucagauacgagaucagccccgacagagaguacgcccuguucagcuacaacguggagcccaucuaccagcacagcuacaccggcuacuacgugcugagcaagaucccccacggcgacccccagagccuggacccccccgaggugagcaacgccaagcugcaguacgccggcuggggccccaagggccagcagcugaucuucaucuucgagaacaacaucuacuacugcgcccacgugggcaagcaggccaucagaguggugagcaccggcaaggagggcgugaucuacaacggccugagcgacuggcuguacgaggaggagauccugaagacccacaucgcccacugguggagccccgacggcaccagacuggccuacgccgccaucaacgacagcagagugcccaucauggagcugcccaccuacaccggcagcaucuaccccaccgugaagcccuaccacuaccccaaggccggcagcgagaaccccagcaucagccugcacgugaucggccugaacggccccacccacgaccuggagaugaugccccccgacgaccccagaaugagagaguacuacaucaccauggugaagugggccaccagcaccaagguggccgugaccuggcugaacagagcccagaacgugagcauccugacccugugcgacgccaccaccggcgugugcaccaagaagcacgaggacgagagcgaggccuggcugcacagacagaacgaggagcccguguucagcaaggacggcagaaaguucuucuucaucagagccaucccccagggcggcagaggcaaguucuaccacaucaccgugagcagcagccagcccaacagcagcaacgacaacauccagagcaucaccagcggcgacugggacgugaccaagauccuggccuacgacgagaagggcaacaagaucuacuuccugagcaccgaggaccugcccagaagaagacagcuguacagcgccaacaccgugggcaacuucaacagacagugccugagcugcgaccugguggagaacugcaccuacuucagcgccagcuucagccacagcauggacuucuuccugcugaagugcgagggccccggcgugcccauggugaccgugcacaacaccaccgacaagaagaagauguucgaccuggagaccaacgagcacgugaagaaggccaucaacgacagacagaugcccaagguggaguacagagacaucgagaucgacgacuacaaccugcccaugcagauccugaagcccgccaccuucaccgacaccacccacuacccccugcugcuggugguggacggcacccccggcagccagagcguggccgagaaguucgaggugagcugggagaccgugauggugagcagccacggcgccgugguggugaagugcgacggcagaggcagcggcuuccagggcaccaagcugcugcacgaggugagaagaagacugggccugcuggaggagaaggaccagauggaggccgugagaaccaugcugaaggagcaguacaucgacagaaccagaguggccguguucggcaaggacuacggcggcuaccugagcaccuacauccugcccgccaagggcgagaaccagggccagaccuucaccugcggcagcgcccugagccccaucaccgacuucaagcuguacgccagcgccuucagcgagagauaccugggccugcacggccuggacaacagagccuacgagaugaccaagguggcccacagagugagcgcccuggaggagcagcaguuccugaucauccaccccaccgccgacgagaagauccacuuccagcacaccgccgagcugaucacccagcugaucagaggcaaggccaacuacagccugcagaucuaccccgacgagagccacuacuucaccagcagcagccugaagcagcaccuguacagaagcaucaucaacuucuucguggagugcuucagaauccaggacaagcugcugaccgugaccgccaaggaggacgaggaggaggacuaa

SEQ ID NO: 16299 - RNA, 1479 nt, Artificial Sequence
  DPP7__Homo_sapiens__NP_037511
augggcagcgcccccugggcccccgugcugcugcuggcccugggccugagaggccugcaggccggcgccagaagagcccccgaccccggcuuccaggagagauucuuccagcagagacuggaccacuucaacuucgagagauucggcaacaagaccuucccccagagauuccuggugagcgacagauucugggugagaggcgagggccccaucuucuucuacaccggcaacgagggcgacgugugggccuucgccaacaacagcgccuucguggccgagcuggccgccgagagaggcgcccugcugguguucgccgagcacagauacuacggcaagagccugcccuucggcgcccagagcacccagagaggccacaccgagcugcugaccguggagcaggcccuggccgacuucgccgagcugcugagagcccugagaagagaccugggcgcccaggacgcccccgccaucgccuucggcggcagcuacggcggcaugcugagcgccuaccugagaaugaaguacccccaccugguggccggcgcccuggccgccagcgcccccgugcuggccguggccggccugggcgacagcaaccaguucuucagagacgugaccgccgacuucgagggccagagccccaagugcacccagggcgugagagaggccuucagacagaucaaggaccuguuccugcagggcgccuacgacaccgugagaugggaguucggcaccugccagccccugagcgacgagaaggaccugacccagcuguucauguucgccagaaacgccuucaccgugcuggccaugauggacuaccccuaccccaccgacuuccugggcccccugcccgccaaccccgugaaggugggcugcgacagacugcugagcgaggcccagagaaucaccggccugagagcccuggccggccugguguacaacgccagcggcagcgagcacugcuacgacaucuacagacuguaccacagcugcgccgaccccaccggcugcggcaccggccccgacgccagagccugggacuaccaggccugcaccgagaucaaccugaccuucgccagcaacaacgugaccgacauguuccccgaccugcccuucaccgacgagcugagacagagauacugccuggacaccuggggcguguggcccagacccgacuggcugcugaccagcuucuggggcggcgaccugagagccgccagcaacaucaucuucagcaacggcaaccuggaccccugggccggcggcggcaucagaagaaaccugagcgccagcgugaucgccgugaccauccagggcggcgcccaccaccuggaccugagagccagccaccccgaggaccccgccagcgugguggaggccagaaagcuggaggccaccaucaucggcgagugggugaaggccgccagaagagagcagcagcccgcccugagaggcggccccagacugagccuguaa

SEQ ID NO: 16300 - RNA, 2349 nt, Artificial Sequence
  DPP8__Homo_sapiens__NP_060213
auggccgccgccauggagaccgagcagcugggcguggagaucuucgagaccgccgacugcgaggagaacaucgagagccaggacagacccaagcuggagcccuucuacguggagagauacagcuggagccagcugaagaagcugcuggccgacaccagaaaguaccacggcuacaugauggccaaggccccccacgacuucauguucgugaagagaaacgaccccgacggcccccacagcgacagaaucuacuaccuggccaugagcggcgagaacagagagaacacccuguucuacagcgagauccccaagaccaucaacagagccgccgugcugaugcugagcuggaagccccugcuggaccuguuccaggccacccuggacuacggcauguacagcagagaggaggagcugcugagagagagaaagagaaucggcaccgugggcaucgccagcuacgacuaccaccagggcagcggcaccuuccuguuccaggccggcagcggcaucuaccacgugaaggacggcggcccccagggcuucacccagcagccccugagacccaaccugguggagaccagcugccccaacaucagaauggaccccaagcugugccccgccgaccccgacuggaucgccuucauccacagcaacgacaucuggaucagcaacaucgugaccagagaggagagaagacugaccuacgugcacaacgagcuggccaacauggaggaggacgccagaagcgccggcguggccaccuucgugcugcaggaggaguucgacagauacagcggcuacugguggugccccaaggccgagaccacccccagcggcggcaagauccugagaauccuguacgaggagaacgacgagagcgagguggagaucauccacgugaccagccccaugcuggagaccagaagagccgacagcuucagauaccccaagaccggcaccgccaaccccaaggugaccuucaagaugagcgagaucaugaucgacgccgagggcagaaucaucgacgugaucgacaaggagcugauccagcccuucgagauccuguucgagggcguggaguacaucgccagagccggcuggacccccgagggcaaguacgccuggagcauccugcuggacagaagccagaccagacugcagaucgugcugaucagccccgagcuguucauccccguggaggacgacgugauggagagacagagacugaucgagagcgugcccgacagcgugaccccccugaucaucuacgaggagaccaccgacaucuggaucaacauccacgacaucuuccacguguucccccagagccacgaggaggagaucgaguucaucuucgccagcgagugcaagaccggcuucagacaccuguacaagaucaccagcauccugaaggagagcaaguacaagagaagcagcggcggccugcccgcccccagcgacuucaagugccccaucaaggaggagaucgccaucaccagcggcgagugggaggugcugggcagacacggcagcaacauccagguggacgaggugagaagacugguguacuucgagggcaccaaggacagcccccuggagcaccaccuguacguggugagcuacgugaaccccggcgaggugaccagacugaccgacagaggcuacagccacagcugcugcaucagccagcacugcgacuucuucaucagcaaguacagcaaccagaagaacccccacugcgugagccuguacaagcugagcagccccgaggacgaccccaccugcaagaccaaggaguucugggccaccauccuggacagcgccggcccccugcccgacuacaccccccccgagaucuucagcuucgagagcaccaccggcuucacccuguacggcaugcuguacaagccccacgaccugcagcccggcaagaaguaccccaccgugcuguucaucuacggcggcccccagguggccaucgccggcgcccccgugacccuguggaucuucuacgacaccggcuacaccgagagauacaugggccaccccgaccagaacgagcagggcuacuaccugggcagcguggccaugcaggccgagaaguuccccagcgagcccaacagacugcugcugcugcacggcuuccuggacgagaacgugcacuucgcccacaccagcauccugcugagcuuccuggugagagccggcaagcccuacgaccugcagaucuacccccaggagagacacagcaucagagugcccgagagcggcgagcacuacgagcugcaccugcugcacuaccugcaggagaaccugggcagcagaaucgccgcccugaaggugaucuaa

SEQ ID NO: 16301 - RNA, 2679 nt, Artificial Sequence
  DPP9__Homo_sapiens__XP_005259730
augagaaaggugaagaagcugagacuggacaaggagaacaccggcagcuggagaagcuucagccugaacagcgagggcgccgagagaauggccaccaccggcacccccaccgccgacagaggcgacgccgccgccaccgacgaccccgccgccagauuccaggugcagaagcacagcugggacggccugagaagcaucauccacggcagcagaaaguacagcggccugaucgugaacaaggccccccacgacuuccaguucgugcagaagaccgacgagagcggcccccacagccacagacuguacuaccugggcaugcccuacggcagcagagagaacagccugcuguacagcgagauccccaagaaggugagaaaggaggcccugcugcugcugagcuggaagcagaugcuggaccacuuccaggccaccccccaccacggcguguacagcagagaggaggagcugcugagagagagaaagagacugggcguguucggcaucaccagcuacgacuuccacagcgagagcggccuguuccuguuccaggccagcaacagccuguuccacugcagagacggcggcaagaacggcuucauggugagccccaugaagccccuggagaucaagacccagugcagcggccccagaauggaccccaagaucugccccgccgaccccgccuucuucagcuucaucaacaacagcgaccuguggguggccaacaucgagaccggcgaggagagaagacugaccuucugccaccagggccugagcaacgugcuggacgaccccaagagcgccggcguggccaccuucgugauccaggaggaguucgacagauucaccggcuacugguggugccccaccgccagcugggagggcagcgagggccugaagacccugagaauccuguacgaggagguggacgagagcgagguggaggugauccacgugcccagccccgcccuggaggagagaaagaccgacagcuacagauaccccagaaccggcagcaagaaccccaagaucgcccugaagcuggccgaguuccagaccgacagccagggcaagaucgugagcacccaggagaaggagcuggugcagcccuucagcagccuguuccccaagguggaguacaucgccagagccggcuggaccagagacggcaaguacgccugggccauguuccuggacagaccccagcaguggcugcagcuggugcugcugccccccgcccuguucauccccagcaccgagaacgaggagcagagacuggccagcgccagagccgugcccagaaacgugcagcccuacgugguguacgaggaggugaccaacguguggaucaacgugcacgacaucuucuaccccuucccccagagcgagggcgaggacgagcugugcuuccugagagccaacgagugcaagaccggcuucugccaccuguacaaggugaccgccgugcugaagagccagggcuacgacuggagcgagcccuucagccccggcgaggacgaguucaagugccccaucaaggaggagaucgcccugaccagcggcgagugggaggugcuggccagacacggcagcaagaucugggugaacgaggagaccaagcugguguacuuccagggcaccaaggacaccccccuggagcaccaccuguacguggugagcuacgaggccgccggcgagaucgugagacugaccacccccggcuucagccacagcugcagcaugagccagaacuucgacauguucgugagccacuacagcagcgugagcaccccccccugcgugcacguguacaagcugagcggccccgacgacgacccccugcacaagcagcccagauucugggccagcaugauggaggccgccagcugcccccccgacuacgugccccccgagaucuuccacuuccacaccagaagcgacgugagacuguacggcaugaucuacaagccccacgcccugcagcccggcaagaagcaccccaccgugcuguucguguacggcggcccccaggugcagcuggugaacaacagcuucaagggcaucaaguaccugagacugaacacccuggccagccugggcuacgccgugguggugaucgacggcagaggcagcugccagagaggccugagauucgagggcgcccugaagaaccagaugggccagguggagaucgaggaccagguggagggccugcaguucguggccgagaaguacggcuucaucgaccugagcagaguggccauccacggcuggagcuacggcggcuuccugagccugaugggccugauccacaagccccagguguucaagguggccaucgccggcgcccccgugaccguguggauggccuacgacaccggcuacaccgagagauacauggacgugcccgagaacaaccagcacggcuacgaggccggcagcguggcccugcacguggagaagcugcccaacgagcccaacagacugcugauccugcacggcuuccuggacgagaacgugcacuucuuccacaccaacuuccuggugagccagcugaucagagccggcaagcccuaccagcugcagaucuaccccaacgagagacacagcaucagaugccccgagagcggcgagcacuacgaggugacccugcugcacuuccugcaggaguaccuguaa

SEQ ID NO: 16302 - RNA, 897 nt, Artificial Sequence
  DPPA2__Homo_sapiens__NP_620170
augagcgacgccaaccuggacagcagcaagaagaacuuccuggagggcgagguggacgacgaggagagcgugauccugacccuggugcccgugaaggacgacgccaacauggagcagauggagcccagcgugagcagcaccagcgacgugaagcuggagaagcccaagaaguacaaccccggccaccugcugcagaccaacgagcaguucaccgccccccagaaggccagaugcaagauccccgcccugccccugcccaccauccugccccccaucaacaaggugugcagagacacccugagagacuggugccagcagcugggccugagcaccaacggcaagaagaucgagguguaccugagacugcacagacacgccuaccccgagcagagacaggacaugcccgagaugagccaggagaccagacugcagagaugcagcagaaagagaaaggccgugaccaagagagccagacugcagagaagcuacgagaugaacgagagagccgaggagaccaacaccguggaggugaucaccagcgcccccggcgccaugcuggccagcugggccagaaucgccgccagagccgugcagcccaaggcccugaacagcugcagcauccccgugagcguggaggccuuccugaugcaggccagcggcgugagauggugcguggugcacggcagacugcugagcgccgacaccaagggcugggugagacugcaguuccacgccggccaggccugggugcccaccacccacagaagaaugaucagccuguuccugcugcccgccugcaucuuccccagccccggcaucgaggacaacaugcugugccccgacugcgccaagagaaacaagaagaugaugaagagacugaugaccguggagaaguaa

SEQ ID NO: 16303 - RNA, 480 nt, Artificial Sequence
  DPPA3__Homo_sapiens__NP_954980
auggaccccagccaguucaaccccaccuacauccccggcagcccccagaugcugaccgaggagaacagcagagacgacagcggcgccagccagaucagcagcgagacccugaucaagaaccugagcaaccugaccaucaacgccagcagcgagagcgugagcccccugagcgaggcccugcugagaagagagagcgugggcgccgccgugcugagagagaucgaggacgaguggcuguacagcagaagaggcgugagaacccugcugagcgugcagagagagaagauggccagacugagauacaugcugcugggcggcgugagaacccacgagagaagacccaccaacaaggagcccaagggcgugaagaaggagagcagacccuucaagugccccugcagcuucugcgugagcaacggcugggaccccagcgagaacgccagaaucggcaaccaggacaccaagccccugcagcccuaa

SEQ ID NO: 16304 - RNA, 915 nt, Artificial Sequence
  DPPA4__Homo_sapiens__NP_060659
augcugagaggcagcgccagcagcaccagcauggagaaggccaagggcaaggaguggaccagcaccgagaagagcagagaggaggaccagcaggccagcaaccagcccaacagcaucgcccugcccggcaccagcgccaagagaaccaaggagaagaugagcaucaagggcagcaaggugcugugccccaagaagaaggccgagcacaccgacaaccccagaccccagaagaagauccccauccccccccugcccagcaagcugccccccgugaaccugauccacagagacauccugagagccuggugccagcagcugaagcugagcagcaagggccagaagcuggacgccuacaagagacugugcgccuucgccuaccccaaccagaaggacuuccccagcaccgccaaggaggccaagaucagaaagagccugcagaagaagcugaagguggagaagggcgagaccagccugcagagcagcgagacccacccccccgagguggcccugccccccgugggcgagccccccgcccuggagaacagcaccgcccugcuggagggcgugaacaccgugguggugaccaccagcgcccccgaggcccugcuggccagcugggccagaaucagcgccagagccagaacccccgaggccguggagagcccccaggaggccagcggcgugagauggugcguggugcacggcaagagccugcccgccgacaccgacggcugggugcaccugcaguuccacgccggccaggccugggugcccgagaagcaggagggcagagugagcgcccuguuccugcugcccgccagcaacuucccccccccccaccuggaggacaacaugcugugccccaagugcgugcacagaaacaaggugcugaucaagagccugcagugggaguaa

SEQ ID NO: 16305 - RNA, 606 nt, Artificial Sequence
  DPT__Homo_sapiens__NP_001928
auggaccugagccugcugugggugcugcugccccuggugaccauggccuggggccaguacggcgacuacggcuaccccuaccagcaguaccacgacuacagcgacgacggcugggugaaccugaacagacagggcuucagcuaccagugcccccagggccaggugaucguggccgugagaagcaucuucagcaagaaggagggcagcgacagacaguggaacuacgccugcaugcccaccccccagagccugggcgagcccaccgagugcuggugggaggagaucaacagagccggcauggagugguaccagaccugcagcaacaacggccugguggccggcuuccagagcagauacuucgagagcgugcuggacagagaguggcaguucuacugcugcagauacagcaagagaugccccuacagcugcuggcugaccaccgaguaccccggccacuacggcgaggagauggacaugaucagcuacaacuacgacuacuacaucagaggcgccaccaccaccuucagcgccguggagagagacagacaguggaaguucaucaugugcagaaugaccgaguacgacugcgaguucgccaacguguaa

SEQ ID NO: 16306 - RNA, 2277 nt, Artificial Sequence
  DPY19L2__Homo_sapiens__NP_776173
augagaaagcagggcgugagcagcaagagacugcagagcagcggcagaagccagagcaagggcagaagaggcgccagccuggccagagagcccgagguggaggaggagauggagaagagcgcccugggcggcggcaagcugcccagaggcagcuggagaagcagccccggcagaauccagagccugaaggagagaaagggccuggagcuggaggugguggccaagaccuuccugcugggccccuuccaguucgugagaaacagccuggcccagcugagagagaaggugcaggagcugcaggccagaagauucagcagcagaaccacccugggcaucgccguguucguggccauccugcacuggcugcaccuggugacccuguucgagaacgacagacacuucagccaccugagcagccuggagagagagaugaccuucagaaccgagaugggccuguacuacagcuacuucaagaccaucaucgaggcccccagcuuccuggagggccuguggaugaucaugaacgacagacugaccgaguacccccugaucaucaacgccaucaagagauuccaccuguaccccgaggugaucaucgccagcugguacugcaccuucaugggcaucaugaaccuguucggccuggagaccaagaccugcuggaacgugaccagaaucgagccccugaacgaggugcagagcugcgagggccugggcgaccccgccugcuucuacgugggcgugaucuucauccugaacggccugaugaugggccuguucuucauguacggcgccuaccugagcggcacccagcugggcggccugaucaccgugcugugcuucuucuucaaccacggcgaggccaccagagugauguggacccccccccugagagagagcuucagcuaccccuuccuggugcugcagaugugcauccugacccugauccugagaaccagcagcaacgacagaagacccuucaucgcccugugccugagcaacguggccuucaugcugcccuggcaguucgcccaguucauccuguucacccagaucgccagccuguuccccauguacguggugggcuacaucgagcccagcaaguuccagaagaucaucuacaugaacaugaucagcgugacccugagcuucauccugauguucggcaacagcauguaccugagcagcuacuacagcagcagccugcugaugaccugggccaucauccugaagagaaacgagauccagaagcugggcgugagcaagcugaacuucuggcugauccagggcagcgccugguggugcggcaccaucauccugaaguuccugaccagcaagauccugggcgugagcgaccacaucagacugagcgaccugaucgccgccagaauccugagauacaccgacuucgacacccugaucuacaccugcgcccccgaguucgacuucauggagaaggccaccccccugagauacaccaagacccugcugcugcccguggugauggugaucaccugcuucaucuucaagaagaccgugagagacaucagcuacgugcuggccaccaacaucuaccugagaaagcagcugcuggagcacagcgagcuggccuuccacacccugcagcugcugguguucaccgcccuggccauccugaucaugagacugaagauguuccugaccccccacaugugcgugauggccagccugaucugcagcagacagcuguucggcuggcuguucagaagagugagauucgagaaggugaucuucggcauccugaccgugaugagcauccagggcuacgccaaccugagaaaccaguggagcaucaucggcgaguucaacaaccugccccaggaggagcugcugcaguggaucaaguacagcaccaccagcgacgccguguucgccggcgccaugcccaccauggccagcaucaagcugagcacccugcaccccaucgugaaccacccccacuacgaggacgccgaccugagagccagaaccaagaucguguacagcaccuacagcagaaagagcgccaaggaggugagagacaagcugcuggagcugcacgugaacuacuacgugcuggaggaggccuggugcguggugagaaccaagcccggcugcagcaugcuggagaucugggacguggaggaccccagcaacgccgccaaccccccccugugcagcgugcugcuggaggacgccagacccuacuucaccaccguguuccagaacagcguguacagagugcugaaggugaacuaa

SEQ ID NO: 16307 - RNA, 2151 nt, Artificial Sequence
  DPY19L3__Homo_sapiens__XP_011524828
augaugagcaucagacagagaagagagaucagagccaccgaggugagcgaggacuuccccgcccaggaggagaacgugaagcuggagaacaagcugcccagcggcugcaccagcagaagacuguggaagauccugagccugaccaucggcggcaccaucgcccugugcaucggccugcugaccagcguguaccuggccacccugcacgagaacgaccugugguucagcaacaucaaggagguggagagagagaucagcuucagaaccgagugcggccuguacuacagcuacuacaagcagaugcugcaggcccccacccuggugcagggcuuccacggccugaucuacgacaacaagaccgagagcaugaagaccaucaaccugcugcagagaaugaacaucuaccaggagguguuccugagcauccuguacagagugcugcccauccagaaguaccuggagcccguguacuucuacaucuacacccuguucggccugcaggccaucuacgugaccgcccuguacaucaccagcuggcugcugagcggcaccuggcugagcggccugcuggccgccuucugguacgugaccaacagaaucgacaccaccagaguggaguucaccaucccccugagagagaacugggcccugcccuucuucgccauccagaucgccgccaucaccuacuuccugagacccaaccugcagccccugagcgagagacugacccugcuggccaucuucaucagcaccuuccuguucagccugaccuggcaguucaaccaguucaugaugcugaugcaggcccuggugcuguucacccuggacagccuggacaugcugcccgccgugaaggccaccuggcuguacggcauccagaucaccagccugcugcuggugugcauccugcaguucuucaacagcaugauccugggcagccugcugaucagcuucaaccugagcguguucaucgccagaaagcugcagaagaaccugaagaccggcagcuuccugaacagacugggcaagcugcugcugcaccuguucauggugcugugccugacccuguuccugaacaacaucaucaagaagauccugaaccugaagagcgacgagcacaucuucaaguuccugaaggccaaguucggccugggcgccaccagagacuucgacgccaaccuguaccugugcgaggaggccuucggccugcugcccuucaacaccuucggcagacugagcgacacccugcuguucuacgccuacaucuucgugcugagcaucaccgugaucguggccuucgugguggccuuccacaaccugagcgacagcaccaaccagcagagcgugggcaagauggagaagggcaccguggaccugaagcccgagaccgccuacaaccugauccacaccauccuguucggcuuccuggcccugagcaccaugagaaugaaguaccuguggaccagccacaugugcguguucgccagcuucggccugugcagccccgagaucugggagcugcugcugaagagcgugcaccuguacaaccccaagagaaucugcaucaugagauacagcgugcccauccugauccugcuguaccugugcuacaaguucuggcccggcaugauggacgagcugagcgagcugagagaguucuacgaccccgacaccguggagcugaugaacuggaucaacagcaacacccccagaaaggccguguucgccggcagcaugcagcugcuggccggcgugaagcugugcaccggcagaacccugaccaaccacccccacuacgaggacagcagccugagagagagaaccagagccguguaccagaucuacgccaagagagcccccgaggaggugcacgcccugcugagaagcuucggcaccgacuacgugauccuggaggacagcaucugcuacgagagaagacacagaagaggcugcagacugagagaccugcuggacaucgccaacggccacaugauggacggccccggcgagaacgaccccgaccugaagcccgccgaccaccccagauucugcgaggagaucaagagaaaccugccccccuacguggccuacuucaccagaguguuccagaacaagaccuuccacguguacaagcugagcagaaacaaguaa

SEQ ID NO: 16308 - RNA, 300 nt, Artificial Sequence
  DPY30__Homo_sapiens__NP_115963
auggagcccgagcagaugcuggagggccagacccagguggccgagaacccccacagcgaguacggccugaccgacaacguggagagaaucguggagaacgagaagaucaacgccgagaagagcagcaagcagaagguggaccugcagagccugcccaccagagccuaccuggaccagaccguggugcccauccugcugcagggccuggccgugcuggccaaggagagaccccccaaccccaucgaguuccuggccagcuaccugcugaagaacaaggcccaguucgaggacagaaacuaa

SEQ ID NO: 16309 - RNA, 1560 nt, Artificial Sequence
  DPYS__Homo_sapiens__NP_001376
auggccgcccccagcagacugcugaucagaggcggcagaguggugaacgacgacuucagcgagguggccgacgugcugguggaggacggcguggugagagcccugggccacgaccugcugccccccggcggcgcccccgccggccugagagugcuggacgccgccggcaagcuggugcugcccggcggcaucgacacccacacccacaugcaguuccccuucaugggcagcagaagcaucgacgacuuccaccagggcaccaaggccgcccugagcggcggcaccaccaugaucaucgacuucgccaucccccagaagggcggcagccugaucgaggccuucgagaccuggagaagcugggccgaccccaaggugugcugcgacuacagccugcacguggccgugaccugguggagcgaccaggugaaggaggagaugaagauccuggugcaggacaagggcgugaacagcuucaagauguucauggccuacaaggaccuguacauggugaccgaccuggagcuguacgaggccuucagcagaugcaaggagaucggcgccaucgcccaggugcacgccgagaacggcgaccugaucgccgagggcgccaagaagaugcuggcccugggcaucaccggccccgagggccacgagcugugcagacccgaggccguggaggccgaggccacccugagagccaucaccaucgccagcgccgugaacugcccccuguacaucgugcacgugaugagcaagagcgccgccaaggugaucgccgacgccagaagagacggcaaggugguguacggcgagcccaucgccgccagccugggcaccgacggcacccacuacuggaacaaggaguggcaccacgccgcccaccacgugaugggccccccccugagacccgaccccagcacccccgacuuccugaugaaccugcuggccaacgacgaccugaccaccaccggcaccgacaacugcaccuucaacaccugccagaaggcccugggcaaggacgacuucaccaagauccccaacggcgugaacggcguggaggacagaaugagcgugaucugggagaagggcgugcacagcggcaagauggacgagaacagauucguggccgugaccagcaccaacgccgccaagaucuucaaccuguaccccagaaagggcagaaucgccgugggcagcgacgccgacaucgugaucugggaccccaagggcaccagaaccaucagcgccaagacccaccaccaggccgugaacuucaacaucuucgagggcauggugugccacggcgugccccuggugaccaucagcagaggcaaggugguguacgaggccggcguguucagcgugaccgccggcgacggcaaguucauccccagaaagcccuucgccgaguacaucuacaagagaaucaagcagagagacagaaccugcacccccacccccguggagagagcccccuacaagggcgagguggccacccugaagagcagagugaccaaggaggacgccaccgccggcaccagaaagcaggcccaccccuaa

SEQ ID NO: 16310 - RNA, 2034 nt, Artificial Sequence
  DPYSL2__Homo_sapiens__NP_001184222
auggccgagagaaagcagagcggcaaggccgccgaggacgaggaggugcccgccuucuucaagaaccugggcagcggcagccccaagcccagacagaaguucugcggcauguucugccccguggagggcagcagcgagaacaagaccaucgacuucgacagccugagcgugggcagaggcagcggccaggugguggcccagcagagagacguggcccaccugggccccgacccccagccccccuacagcagacagggcagaagagccggcggcgagcccagcguggagagcggcagaaagguggagaucagaagagccagcggcaaggaggcccugcagaacaucaacgaccagagcgacagacugcugaucaagggcggcaagaucgugaacgacgaccagagcuucuacgccgacaucuacauggaggacggccugaucaagcagaucggcgagaaccugaucgugcccggcggcgugaagaccaucgaggcccacagcagaauggugauccccggcggcaucgacgugcacaccagauuccagaugcccgaccagggcaugaccagcgccgacgacuucuuccagggcaccaaggccgcccuggccggcggcaccaccaugaucaucgaccacguggugcccgagcccggcaccagccugcuggccgccuucgaccaguggagagagugggccgacagcaagagcugcugcgacuacagccugcacguggacaucagcgaguggcacaagggcauccaggaggagauggaggcccuggugaaggaccacggcgugaacagcuuccugguguacauggccuucaaggacagauuccagcugaccgacugccagaucuacgaggugcugagcgugaucagagacaucggcgccaucgcccaggugcacgccgagaacggcgacaucaucgccgaggagcagcagagaauccuggaccugggcaucaccggccccgagggccacgugcugagcagacccgaggagguggaggccgaggccgugaacagagccaucaccaucgccaaccagaccaacugcccccuguacaucaccaaggugaugagcaagagcagcgccgaggugaucgcccaggccagaaagaagggcaccgugguguacggcgagcccaucaccgccagccugggcaccgacggcagccacuacuggagcaagaacugggccaaggccgccgccuucgugaccagccccccccugagccccgaccccaccacccccgacuuccugaacagccugcugagcugcggcgaccugcaggugaccggcagcgcccacugcaccuucaacaccgcccagaaggccgugggcaaggacaacuucacccugauccccgagggcaccaacggcaccgaggagagaaugagcgugaucugggacaaggccguggugaccggcaagauggacgagaaccaguucguggccgugaccagcaccaacgccgccaagguguucaaccuguaccccagaaagggcagaaucgccgugggcagcgacgccgaccuggugaucugggaccccgacagcgugaagaccaucagcgccaagacccacaacagcagccuggaguacaacaucuucgagggcauggagugcagaggcagcccccugguggugaucagccagggcaagaucgugcuggaggacggcacccugcacgugaccgagggcagcggcagauacauccccagaaagcccuuccccgacuucguguacaagagaaucaaggccagaagcagacuggccgagcugagaggcgugcccagaggccuguacgacggccccgugugcgaggugagcgugacccccaagaccgugacccccgccagcagcgccaagaccagccccgccaagcagcaggccccccccgugagaaaccugcaccagagcggcuucagccugagcggcgcccagaucgacgacaacauccccagaagaaccacccagagaaucguggccccccccggcggcagagccaacaucaccagccugggcuaa

SEQ ID NO: 16311 - RNA, 2055 nt, Artificial Sequence
  DPYSL3__Homo_sapiens__NP_001184223
auggccagcggcagaagaggcugggacagcagccacgaggacgaccugcccguguaccuggccagacccggcaccaccgaccaggugcccagacagaaguacggcggcauguucugcaacguggagggcgccuucgagagcaagacccuggacuucgacgcccugagcgugggccagagaggcgccaagacccccagaagcggccagggcagcgacagaggcagcggcagcagacccggcaucgagggcgacacccccagaagaggccagggcagagaggagagcagagagcccgcccccgccagccccgcccccgccggcguggagaucagaagcgccaccggcaaggaggugcugcagaaccugggccccaaggacaagagcgacagacugcugaucaagggcggcagaaucgugaacgacgaccagagcuucuacgccgacaucuacauggaggacggccugaucaagcagaucggcgacaaccugaucgugcccggcggcgugaagaccaucgaggccaacggcaagauggugauccccggcggcaucgacgugcacacccacuuccagaugcccuacaagggcaugaccaccguggacgacuucuuccagggcaccaaggccgcccuggccggcggcaccaccaugaucaucgaccacguggugcccgagcccgagagcagccugaccgaggccuacgagaaguggagagagugggccgacggcaagagcugcugcgacuacgcccugcacguggacaucacccacuggaacgacagcgugaagcaggaggugcagaaccugaucaaggacaagggcgugaacagcuucaugguguacauggccuacaaggaccuguaccaggugagcaacaccgagcuguacgagaucuucaccugccugggcgagcugggcgccaucgcccaggugcacgccgagaacggcgacaucaucgcccaggagcagaccagaaugcuggagaugggcaucaccggccccgagggccacgugcugagcagacccgaggagcuggaggccgaggccguguucagagccaucaccaucgccagccagaccaacugcccccuguacgugaccaaggugaugagcaagagcgccgccgaccugaucagccaggccagaaagaagggcaacgugguguucggcgagcccaucaccgccagccugggcaucgacggcacccacuacuggagcaagaacugggccaaggccgccgccuucgugaccagccccccccugagccccgaccccaccacccccgacuacaucaacagccugcuggccagcggcgaccugcagcugagcggcagcgcccacugcaccuucagcaccgcccagaaggccaucggcaaggacaacuucaccgccauccccgagggcaccaacggcguggaggagagaaugagcgugaucugggacaaggccguggccaccggcaagauggacgagaaccaguucguggccgugaccagcaccaacgccgccaagaucuucaaccuguaccccagaaagggcagaaucagcgugggcagcgacagcgaccuggugaucugggaccccgacgccgugaagaucgugagcgccaagaaccaccagagcgccgccgaguacaacaucuucgagggcauggagcugagaggcgccccccugguggugaucugccagggcaagaucaugcuggaggacggcaaccugcacgugacccagggcgccggcagauucauccccugcagccccuucagcgacuacguguacaagagaaucaaggccagaagaaagauggccgaccugcacgccgugcccagaggcauguacgacggccccguguucgaccugaccaccacccccaagggcggcacccccgccggcagcgccagaggcagccccaccagacccaacccccccgugagaaaccugcaccagagcggcuucagccugagcggcacccagguggacgagggcgugagaagcgccagcaagagaaucguggccccccccggcggcagaagcaacaucaccagccugagcuaa

SEQ ID NO: 16312 - RNA, 1719 nt, Artificial Sequence
  DPYSL4__Homo_sapiens__NP_006417
augagcuuccagggcaagaagagcauccccagaaucaccagcgacagacugcugaucagaggcggcagaaucgugaacgacgaccagagcuucuacgccgacgugcacguggaggacggccugaucaagcagaucggcgagaaccugaucgugcccggcggcaucaagaccaucgacgcccacggccugauggugcugcccggcggcguggacgugcacaccagacugcagaugcccgugcugggcaugacccccgccgacgacuucugccagggcaccaaggccgcccuggccggcggcaccaccaugauccuggaccacguguuccccgacaccggcgugagccugcuggccgccuacgagcaguggagagagagagccgacagcgccgccugcugcgacuacagccugcacguggacaucaccagauggcacgagagcaucaaggaggagcuggaggcccuggugaaggagaagggcgugaacagcuuccugguguucauggccuacaaggacagaugccagugcagcgacagccagauguacgagaucuucagcaucaucagagaccugggcgcccuggcccaggugcacgccgagaacggcgacaucguggaggaggagcagaagagacugcuggagcugggcaucaccggccccgagggccacgugcugagccaccccgaggagguggaggccgaggccguguacagagccgugaccaucgccaagcaggccaacugcccccuguacgugaccaaggugaugagcaagggcgccgccgacgccaucgcccaggccaagagaagaggcguggugguguucggcgagcccaucaccgccagccugggcaccgacggcagccacuacuggagcaagaacugggccaaggccgccgccuucgugaccagcccccccgugaaccccgaccccaccaccgccgaccaccugaccugccugcugagcagcggcgaccugcaggugaccggcagcgcccacugcaccuucaccaccgcccagaaggccgugggcaaggacaacuucgcccugauccccgagggcaccaacggcaucgaggagagaaugagcauggugugggagaagugcguggccagcggcaagauggacgagaacgaguucguggccgugaccagcaccaacgccgccaagaucuucaacuucuaccccagaaagggcagaguggccgugggcagcgacgccgaccuggugaucuggaaccccaaggccaccaagaucaucagcgccaagacccacaaccugaacguggaguacaacaucuucgagggcguggagugcagaggcgcccccgccguggugaucagccagggcagaguggcccuggaggacggcaagauguucgugacccccggcgccggcagauucgugcccagaaagaccuuccccgacuucguguacaagagaaucaaggccagaaacagacuggccgagauccacggcgugcccagaggccuguacgacggccccgugcacgaggugauggugcccgccaagcccggcagcggcgcccccgccagagccagcugccccggcaagaucagcgugccccccgugagaaaccugcaccagagcggcuucagccugagcggcagccaggccgacgaccacaucgccagaagaaccgcccagaagaucauggccccccccggcggcagaagcaacaucaccagccugagcuaa

SEQ ID NO: 16313 - RNA, 1695 nt, Artificial Sequence
  DPYSL5__Homo_sapiens__NP_001240652
augcuggccaacagcgccagcgugagaauccugaucaagggcggcaagguggugaacgacgacugcacccacgaggccgacguguacaucgagaacggcaucauccagcaggugggcagagagcugaugauccccggcggcgccaaggugaucgacgccaccggcaagcuggugauccccggcggcaucgacaccagcacccacuuccaccagaccuucaugaacgccaccugcguggacgacuucuaccacggcaccaaggccgcccuggugggcggcaccaccaugaucaucggccacgugcugcccgacaaggagaccagccugguggacgccuacgagaagugcagaggccuggccgaccccaaggugugcugcgacuacgcccugcacgugggcaucaccuggugggcccccaaggugaaggccgagauggagacccuggugagagagaagggcgugaacagcuuccagauguucaugaccuacaaggaccuguacaugcugagagacagcgagcuguaccaggugcugcacgccugcaaggacaucggcgccaucgccagagugcacgccgagaacggcgagcugguggccgagggcgccaaggaggcccuggaccugggcaucaccggccccgagggcaucgagaucagcagacccgaggagcuggaggccgaggccacccacagagugaucaccaucgccaacagaacccacugccccaucuaccuggugaacgugagcagcaucagcgccggcgacgugaucgccgccgccaagaugcagggcaagguggugcuggccgagaccaccaccgcccacgccacccugaccggccugcacuacuaccaccaggacuggagccacgccgccgccuacgugaccgugcccccccugagacuggacaccaacaccagcaccuaccugaugagccugcuggccaacgacacccugaacaucguggccagcgaccacagacccuucaccaccaagcagaaggccaugggcaaggaggacuucaccaagaucccccacggcgugagcggcgugcaggacagaaugagcgugaucugggagagaggcguggugggcggcaagauggacgagaacagauucguggccgugaccagcagcaacgccgccaagcugcugaaccuguaccccagaaagggcagaaucauccccggcgccgacgccgacgugguggugugggaccccgaggccaccaagaccaucagcgccagcacccaggugcagggcggcgacuucaaccuguacgagaacaugagaugccacggcgugccccuggugaccaucagcagaggcagagugguguacgagaacggcguguucaugugcgccgagggcaccggcaaguucugcccccugagaagcuuccccgacaccguguacaagaagcuggugcagagagagaagacccugaaggugagaggcguggacagaacccccuaccugggcgacguggccgugguggugcaccccggcaagaaggagaugggcaccccccuggccgacacccccaccagacccgugaccagacacggcggcaugagagaccugcacgagagcagcuucagccugagcggcagccagaucgacgaccacgugcccaagagagccagcgccagaauccuggccccccccggcggcagaagcagcggcaucugguaa

SEQ ID NO: 16314 - RNA, 717 nt, Artificial Sequence
  DRAM1__Homo_sapiens__NP_060840
augcugugcuuccugagaggcauggccuucgugcccuuccugcuggugaccuggagcagcgccgccuucaucaucagcuacgugguggccgugcugagcggccacgugaaccccuuccugcccuacaucagcgacaccggcaccaccccccccgagagcggcaucuucggcuucaugaucaacuucagcgccuuccugggcgccgccaccauguacaccagauacaagaucgugcagaagcagaaccagaccugcuacuucagcacccccguguucaaccuggugagccuggugcugggccuggugggcugcuucggcaugggcaucguggccaacuuccaggagcuggccgugcccguggugcacgacggcggcgcccugcuggccuucgugugcggcgugguguacacccugcugcagagcaucaucagcuacaagagcugcccccaguggaacagccugagcaccugccacaucagaauggugaucagcgccgugagcugcgccgccgugauccccaugaucgugugcgccagccugaucagcaucaccaagcuggaguggaaccccagagagaaggacuacguguaccacguggugagcgccaucugcgaguggaccguggccuucggcuucaucuucuacuuccugaccuucauccaggacuuccagagcgugacccugagaaucagcaccgagaucaacggcgacaucuaa

SEQ ID NO: 16315 - RNA, 618 nt, Artificial Sequence
  DRAP1__Homo_sapiens__NP_006433
augcccagcaagaagaagaaguacaacgccagauucccccccgccagaaucaagaagaucaugcagaccgacgaggagaucggcaagguggccgccgccgugcccgugaucaucagcagagcccuggagcuguuccuggagagccugcugaagaaggccugccaggugacccagagcagaaacgccaagaccaugaccaccagccaccugaagcagugcaucgagcuggagcagcaguucgacuuccugaaggaccugguggccagcgugcccgacaugcagggcgacggcgaggacaaccacauggacggcgacaagggcgccagaagaggcagaaagcccggcagcggcggcagaaagaacggcggcaugggcaccaagagcaaggacaagaagcugagcggcaccgacagcgagcaggaggacgagagcgaggacaccgacaccgacggcgaggaggagaccagccagccccccccccaggccagccaccccagcgcccacuuccagagcccccccacccccuuccugcccuucgccagcacccugccccugccccccgccccccccggccccagcgcccccgacgaggaggacgaggaggacuacgacagcuaa

SEQ ID NO: 16316 - RNA, 2223 nt, Artificial Sequence
  DRC1__Homo_sapiens__NP_659475
augaacccccccggcagccuggaggcccuggaccccaacguggacgagcaccugagcacccagauccuggcccccagcgugcacagcgacaacagccaggagagaauccaggccagaagacugagaaucgccgccagacuggaggccagaagaagagaggcccugggcgaguaccuggacggcaagaaggagagcgaggaggaccagagcaagagcuacaagcagaaggaggagagcagacugaagcuggccaagcugcugcugugcggcaccgagcuggugaccaacauccagguggccaucgacaucagagagauccacagaagaguggaggaggaggagaucaagagacagagaaucgagaagcuggagaacgaggugaagaccagccaggacaaguucgacgagaucaccagcaagugggaggagggcaagcagaagagaaucccccaggagcugugggagaugcugaacacccagcagcugcacugcgccggccugcuggaggacaagaacaagcugaucagcgagcugcagcaggagcugaagaccaaggacgaccaguacgugaaggaccugaagaagcagagcgacgacaucugccugcugcuggagagaauggaggagcaggugaagaacgugaugaagaccuucagagaggagcuguacaacaucgagaaggccuucgagguggagagacaggagcugcuggccagcaacaagaagaagugggagcaggcccugcaggcccacaacgccaaggagcuggaguaccugaacaacagaaugaagaagguggaggacuacgagaagcagcugaacagacagagaaucugggacugcgaggaguacaacaugaucaagaucaagcuggagcaggacgugcagauccuggagcagcagcugcagcagagaaaggccaucuaccagcugaaccaggagaagcuggaguacaaccugcaggugcugaagaagagagacgaggagagcaccgugaucaagagccagcagaagagaaagaucaacagacugcacgacauccugaacaaccugagaagcaaguacgccaagcagaucaagcaguuccaggaggagaaccagagccugaccagcgacuacaagagacuggugaugcaguucaaggagcugcagaaggccaugagacacuucgcccugaucgacgacgagaaguucugggagaucuggcugaugaacgaggaggaggccaaggaccugaucgccagagccuucgacguggacagaaucauccacacccaccaccugggccugcccugggccgcccccgacuucugguuccugaacaacgugggccccaucagccagcagccccagaagagcgccacccagaucguggaggagaugcugaugagaagcgaggaggaggaggccgaggaggccgccgccgagcccgagagcuaccuggaccugcccaagcagaucagcgagaagaccaccaagagaauccugaugcugcugugcgacgagagcggcuuccugaucgagagcaagcugcugagccugcugcugccccuggagcagaacgagugcuaccugcugagacuggacgccaucuucagcgcccugggcaucgagagcgaggacgaccuguacaagcuggugaacuucuuccugaaguacagagcccacagacugagcagcagccugcagaucaagcccugcagccaggccagcauggagaaggccagcauggaggagaccagcaccagaagcgagcuggagcuggccgagcagaccgagauggagggcgagaaggaggagagccugguggagggcgagaaggaggaggaggaggagaccccccccagccccugggugauccaccccaacgacgugcugaagauccuggaggccuucgugaugggccugaagaagcccagagacagcagagccccccugagagugcagaagaacgugagagacaacagcaaggacagcgaguacuggcaggcccugaccaccgugauccccagcagcaagcagaaccugugggacgcccuguacaccgcccuggagaaguaccaccuggugcugacccagagagccaagcugcugcuggagaacagcagccuggagcagcagaacaccgagcugcaggcccugcugcagcaguaccugaacagcaagaucaacagcgagcugcaggugccccccacccaggugcugagagugcccaccaaguaa

SEQ ID NO: 16317 - RNA, 1341 nt, Artificial Sequence
  DRD1__Homo_sapiens__NP_000785
augagaacccugaacaccagcgccauggacggcaccggccuggugguggagagagacuucagcgugagaauccugaccgccugcuuccugagccugcugauccugagcacccugcugggcaacacccuggugugcgccgccgugaucagauucagacaccugagaagcaaggugaccaacuucuucgugaucagccuggccgugagcgaccugcugguggccgugcuggugaugcccuggaaggccguggccgagaucgccggcuucuggcccuucggcagcuucugcaacaucuggguggccuucgacaucaugugcagcaccgccagcauccugaaccugugcgugaucagcguggacagauacugggccaucagcagccccuucagauacgagagaaagaugacccccaaggccgccuucauccugaucagcguggccuggacccugagcgugcugaucagcuucauccccgugcagcugagcuggcacaaggccaagcccaccagccccagcgacggcaacgccaccagccuggccgagaccaucgacaacugcgacagcagccugagcagaaccuacgccaucagcagcagcgugaucagcuucuacauccccguggccaucaugaucgugaccuacaccagaaucuacagaaucgcccagaagcagaucagaagaaucgccgcccuggagagagccgccgugcacgccaagaacugccagaccaccaccggcaacggcaagcccguggagugcagccagcccgagagcagcuucaagaugagcuucaagagagagaccaaggugcugaagacccugagcgugaucaugggcguguucgugugcugcuggcugcccuucuucauccugaacugcauccugcccuucugcggcagcggcgagacccagcccuucugcaucgacagcaacaccuucgacguguucgugugguucggcugggccaacagcagccugaaccccaucaucuacgccuucaacgccgacuucagaaaggccuucagcacccugcugggcugcuacagacugugccccgccaccaacaacgccaucgagaccgugagcaucaacaacaacggcgccgccauguucagcagccaccacgagcccagaggcagcaucagcaaggagugcaaccugguguaccugaucccccacgccgugggcagcagcgaggaccugaagaaggaggaggccgccggcaucgccagaccccuggagaagcugagccccgcccugagcgugauccuggacuacgacaccgacgugagccuggagaagauccagcccaucacccagaacggccagcaccccaccuaa

SEQ ID NO: 16318 - RNA, 1332 nt, Artificial Sequence
  DRD2__Homo_sapiens__NP_000786
auggacccccugaaccugagcugguacgacgacgaccuggagagacagaacuggagcagacccuucaacggcagcgacggcaaggccgacagaccccacuacaacuacuacgccacccugcugacccugcugaucgccgugaucguguucggcaacgugcuggugugcauggccgugagcagagagaaggcccugcagaccaccaccaacuaccugaucgugagccuggccguggccgaccugcugguggccacccuggugaugcccugggugguguaccuggagguggugggcgaguggaaguucagcagaauccacugcgacaucuucgugacccuggacgugaugaugugcaccgccagcauccugaaccugugcgccaucagcaucgacagauacaccgccguggccaugcccaugcuguacaacaccagauacagcagcaagagaagagugaccgugaugaucagcaucgugugggugcugagcuucaccaucagcugcccccugcuguucggccugaacaacgccgaccagaacgagugcaucaucgccaaccccgccuucgugguguacagcagcaucgugagcuucuacgugcccuucaucgugacccugcugguguacaucaagaucuacaucgugcugagaagaagaagaaagagagugaacaccaagagaagcagcagagccuucagagcccaccugagagccccccugaagggcaacugcacccaccccgaggacaugaagcugugcaccgugaucaugaagagcaacggcagcuuccccgugaacagaagaagaguggaggccgccagaagagcccaggagcuggagauggagaugcugagcagcaccagcccccccgagagaaccagauacagccccaucccccccagccaccaccagcugacccugcccgaccccagccaccacggccugcacagcacccccgacagccccgccaagcccgagaagaacggccacgccaaggaccaccccaagaucgccaagaucuucgagauccagaccaugcccaacggcaagaccagaaccagccugaagaccaugagcagaagaaagcugagccagcagaaggagaagaaggccacccagaugcuggccaucgugcugggcguguucaucaucugcuggcugcccuucuucaucacccacauccugaacauccacugcgacugcaacaucccccccgugcuguacagcgccuucaccuggcugggcuacgugaacagcgccgugaaccccaucaucuacaccaccuucaacaucgaguucagaaaggccuuccugaagauccugcacugcuaa

SEQ ID NO: 16319 - RNA, 1203 nt, Artificial Sequence
  DRD3__Homo_sapiens__NP_001269492
auggccagccugagccagcugagcggccaccugaacuacaccugcggcgccgagaacagcaccggcgccagccaggccagaccccacgccuacuacgcccugagcuacugcgcccugauccuggccaucguguucggcaacggccuggugugcauggccgugcugaaggagagagcccugcagaccaccaccaacuaccugguggugagccuggccguggccgaccugcugguggccacccuggugaugcccugggugguguaccuggaggugaccggcggcguguggaacuucagcagaaucugcugcgacguguucgugacccuggacgugaugaugugcaccgccagcauccugaaccugugcgccaucagcaucgacagauacaccgccguggugaugcccgugcacuaccagcacggcaccggccagagcagcugcagaagaguggcccugaugaucaccgccgugugggugcuggccuucgccgugagcugcccccugcuguucggcuucaacaccaccggcgaccccaccgugugcagcaucagcaaccccgacuucgugaucuacagcagcguggugagcuucuaccugcccuucggcgugaccgugcugguguacgccagaaucuacguggugcugaagcagagaagaagaaagagaauccugaccagacagaacagccagugcaacagcgugagacccggcuucccccagcagacccugagccccgaccccgcccaccuggagcugaagagauacuacagcaucugccaggacaccgcccugggcggccccggcuuccaggagagaggcggcgagcugaagagagaggagaagaccagaaacagccugagccccaccaucgcccccaagcugagccuggaggugagaaagcugagcaacggcagacugagcaccagccugaagcugggcccccugcagcccagaggcgugccccugagagagaagaaggccacccagaugguggccaucgugcugggcgccuucaucgugugcuggcugcccuucuuccugacccacgugcugaacacccacugccagaccugccacgugagccccgagcuguacagcgccaccaccuggcugggcuacgugaacagcgcccugaaccccgugaucuacaccaccuucaacaucgaguucagaaaggccuuccugaagauccugagcugcuaa

SEQ ID NO: 16320 - RNA, 1260 nt, Artificial Sequence
  DRD4__Homo_sapiens__NP_000788
augggcaacagaagcaccgccgacgccgacggccugcuggccggcagaggccccgccgccggcgccagcgccggcgccagcgccggccuggccggccagggcgccgccgcccuggugggcggcgugcugcugaucggcgccgugcuggccggcaacagccuggugugcgugagcguggccaccgagagagcccugcagacccccaccaacagcuucaucgugagccuggccgccgccgaccugcugcuggcccugcuggugcugccccuguucguguacagcgaggugcagggcggcgccuggcugcugagccccagacugugcgacgcccugauggccauggacgugaugcugugcaccgccagcaucuucaaccugugcgccaucagcguggacagauucguggccguggccgugccccugagauacaacagacagggcggcagcagaagacagcugcugcugaucggcgccaccuggcugcugagcgccgccguggccgcccccgugcugugcggccugaacgacgugagaggcagagaccccgccgugugcagacuggaggacagagacuacgugguguacagcagcgugugcagcuucuuccugcccugcccccugaugcugcugcuguacugggccaccuucagaggccugcagagaugggagguggccagaagagccaagcugcacggcagagcccccagaagacccagcggccccggcccccccagccccaccccccccgcccccagacugccccaggaccccugcggccccgacugcgccccccccgcccccggccugcccagaggccccugcggccccgacugcgcccccgccgcccccagccugccccaggaccccugcggccccgacugcgccccccccgcccccggccugccccccgaccccugcggcagcaacugcgccccccccgacgccgugagagccgccgcccugcccccccagacccccccccagaccagaagaagaagaagagccaagaucaccggcagagagagaaaggccaugagagugcugcccgugguggugggcgccuuccugcugugcuggacccccuucuucguggugcacaucacccaggcccugugccccgccugcagcgugccccccagacuggugagcgccgugaccuggcugggcuacgugaacagcgcccugaaccccgugaucuacaccguguucaacgccgaguucagaaacguguucagaaaggcccugagagccugcugcuaa

SEQ ID NO: 16321 - RNA, 1434 nt, Artificial Sequence
  DRD5__Homo_sapiens__NP_000789
augcugccccccggcagcaacggcaccgccuaccccggccaguucgcccuguaccagcagcuggcccagggcaacgccgugggcggcagcgccggcgcccccccccugggccccagccagguggugaccgccugccugcugacccugcugaucaucuggacccugcugggcaacgugcuggugugcgccgccaucgugagaagcagacaccugagagccaacaugaccaacguguucaucgugagccuggccgugagcgaccuguucguggcccugcuggugaugcccuggaaggccguggccgagguggccggcuacuggcccuucggcgccuucugcgacguguggguggccuucgacaucaugugcagcaccgccagcauccugaaccugugcgugaucagcguggacagauacugggccaucagcagacccuucagauacaagagaaagaugacccagagaauggcccuggugauggugggccuggccuggacccugagcauccugaucagcuucauccccgugcagcugaacuggcacagagaccaggccgccagcuggggcggccuggaccugcccaacaaccuggccaacuggacccccugggaggaggacuucugggagcccgacgugaacgccgagaacugcgacagcagccugaacagaaccuacgccaucagcagcagccugaucagcuucuacauccccguggccaucaugaucgugaccuacaccagaaucuacagaaucgcccaggugcagaucagaagaaucagcagccuggagagagccgccgagcacgcccagagcugcagaagcagcgccgccugcgcccccgacaccagccugagagccagcaucaagaaggagaccaaggugcugaagacccugagcgugaucaugggcguguucgugugcugcuggcugcccuucuucauccugaacugcauggugcccuucugcagcggccaccccgagggcccccccgccggcuuccccugcgugagcgagaccaccuucgacguguucgugugguucggcugggccaacagcagccugaaccccgugaucuacgccuucaacgccgacuuccagaagguguucgcccagcugcugggcugcagccacuucugcagcagaacccccguggagaccgugaacaucagcaacgagcugaucagcuacaaccaggacaucguguuccacaaggagaucgccgccgccuacauccacaugaugcccaacgccgugacccccggcaacagagagguggacaacgacgaggaggagggccccuucgacagaauguuccagaucuaccagaccagccccgacggcgaccccguggccgagagcgugugggagcuggacugcgagggcgagaucagccuggacaagaucacccccuucacccccaacggcuuccacuaa

SEQ ID NO: 16322 - RNA, 1104 nt, Artificial Sequence
  DRG1__Homo_sapiens__NP_004138
augagcagcacccuggccaagaucgccgagaucgaggccgagauggccagaacccagaagaacaaggccaccgcccaccaccugggccugcugaaggccagacuggccaagcugagaagagagcugaucacccccaagggcggcggcggcggcggccccggcgagggcuucgacguggccaagaccggcgacgccagaaucggcuucgugggcuuccccagcgugggcaagagcacccugcugagcaaccuggccggcguguacagcgagguggccgccuacgaguucaccacccugaccaccgugcccggcgugaucagauacaagggcgccaagauccagcugcuggaccugcccggcaucaucgagggcgccaaggacggcaagggcagaggcagacaggugaucgccguggccagaaccugcaaccugauccugaucgugcuggacgugcugaagccccugggccacaagaagaucaucgagaacgagcuggagggcuucggcaucagacugaacagcaagccccccaacaucggcuucaagaagaaggacaagggcggcaucaaccugaccgccaccugcccccagagcgagcuggacgccgagaccgugaagagcauccuggccgaguacaagauccacaacgccgacgugacccugagaagcgacgccaccgccgacgaccugaucgacgugguggagggcaacagaguguacauccccugcaucuacgugcugaacaagaucgaccagaucagcaucgaggagcuggacaucaucuacaaggugccccacugcgugcccaucagcgcccaccacagauggaacuucgacgaccugcuggagaagaucugggacuaccugaagcuggugagaaucuacaccaagcccaagggccagcugcccgacuacaccagccccguggugcugcccuacagcagaaccaccguggaggacuucugcaugaagauccacaagaaccugaucaaggaguucaaguacgcccugguguggggccugagcgugaagcacaacccccagaaggugggcaaggaccacacccuggaggacgaggacgugauccagaucgugaagaaguaa

SEQ ID NO: 16323 - RNA, 792 nt, Artificial Sequence
  DRGX__Homo_sapiens__NP_001263380
auguucuacuuccacugccccccccagcuggagggcaccgccaccuucggcaaccacagcagcggcgacuucgacgacggcuuccugagaagaaagcagagaagaaacagaaccaccuucacccugcagcagcuggaggcccuggaggccguguucgcccagacccacuaccccgacguguucaccagagaggagcuggccaugaagaucaaccugaccgaggccagagugcaggugugguuccagaacagaagagccaaguggagaaagaccgagagaggcgccagcgaccaggagcccggcgccaaggagcccauggccgaggugacccccccccccgugagaaacaucaacagccccccccccggcgaccaggccagaagcaagaaggaggcccuggaggcccagcagagccugggcagaaccgugggccccgccggccccuucuuccccagcugccugcccggcacccugcugaacaccgccaccuacgcccaggcccugagccacguggccagccugaagggcggcccccugugcagcugcugcgugcccgaccccaugggccugagcuuccugcccaccuacggcugccagagcaacagaaccgccagcguggccacccugagaaugaaggccagagagcacagcgaggccgugcugcagagcgccaaccugcugcccagcaccagcagcagccccggccccguggccaagcccgccccccccgacggcagccaggagaagaccagccccaccaaggagcagagcgaggccgagaagagcguguaa

SEQ ID NO: 16324 - RNA, 4014 nt, Artificial Sequence
  DROSHA__Homo_sapiens__NP_001093882
augaugcagggcaacaccugccacagaaugagcuuccaccccggcagaggcugccccagaggcagaggcggccacggcgccagacccagcgcccccagcuucagaccccagaaccugagacugcugcacccccagcagccccccgugcaguaccaguacgagccccccagcgcccccagcaccaccuucagcaacagccccgcccccaacuuccugccccccagacccgacuucgugcccuuccccccccccaugccccccagcgcccagggcccccugccccccugccccaucagaccccccuuccccaaccaccagaugagacaccccuuccccgugccccccugcuucccccccaugcccccccccaugcccugccccaacaacccccccgugcccggcgccccccccggccagggcaccuuccccuucaugaugcccccccccagcaugccccaccccccccccccccccgugaugccccagcaggugaacuaccaguacccccccggcuacagccaccacaacuuccccccccccagcuucaacagcuuccagaacaaccccagcagcuuccugcccagcgccaacaacagcagcagcccccacuucagacaccugccccccuacccccugcccaaggcccccagcgagagaagaagccccgagagacugaagcacuacgacgaccacagacacagagaccacagccacggcagaggcgagagacacagaagccuggacagaagagagagaggcagaagccccgacagaagaagacaggacagcagauacagaagcgacuacgacagaggcagaacccccagcagacacagaagcuacgagagaagcagagagagagagagagagagacacagacacagagacaacagaagaagccccagccuggagagaagcuacaagaaggaguacaagagaagcggcagcagaagccccagcagagagaagaagagagccagaugggaggaggagaaggacagauggagcgacaaccagagcagcggcaaggacaagaacuacaccagcaucaaggagaaggagcccgaggagaccaugcccgacaagaacgaggaggaggaggaggagcugcugaagcccguguggaucagaugcacccacagcgagaacuacuacagcagcgaccccauggaccaggugggcgacagcaccguggugggcaccagcagacugagagaccuguacgacaaguucgaggaggagcugggcagcagacaggagaaggccaaggccgccagaccccccugggagccccccaagaccaagcuggacgaggaccuggagagcagcagcgagagcgagugcgagagcgacgaggacagcaccugcagcagcagcagcgacagcgagguguucgacgugaucgccgagaucaagagaaagaaggcccaccccgacagacugcacgacgagcugugguacaacgaccccggccagaugaacgacggcccccugugcaagugcagcgccaaggccagaagaaccggcaucagacacagcaucuaccccggcgaggaggccaucaagcccugcagacccaugaccaacaacgccggcagacuguuccacuacagaaucaccgugagcccccccaccaacuuccugaccgacagacccaccgugaucgaguacgacgaccacgaguacaucuucgagggcuucagcauguucgcccacgccccccugaccaacaucccccugugcaaggugaucagauucaacaucgacuacaccauccacuucaucgaggagaugaugcccgagaacuucugcgugaagggccuggagcuguucagccuguuccuguucagagacauccuggagcuguacgacuggaaccugaagggcccccuguucgaggacagcccccccugcugccccagauuccacuucaugcccagauucgugagauuccugcccgacggcggcaaggaggugcugagcaugcaccagauccugcuguaccugcugagaugcagcaaggcccuggugcccgaggaggagaucgccaacaugcugcagugggaggagcuggaguggcagaaguacgccgaggagugcaagggcaugaucgugaccaaccccggcaccaagcccagcagcgugagaaucgaccagcuggacagagagcaguucaaccccgacgugaucaccuuccccaucaucgugcacuucggcaucagacccgcccagcugagcuacgccggcgacccccaguaccagaagcuguggaagagcuacgugaagcugagacaccugcuggccaacagccccaaggugaagcagaccgacaagcagaagcuggcccagagagaggaggcccugcagaagaucagacagaagaacaccaugagaagagaggugaccguggagcugagcagccagggcuucuggaagaccggcaucagaagcgacgugugccagcacgccaugaugcugcccgugcugacccaccacaucagauaccaccagugccugaugcaccuggacaagcugaucggcuacaccuuccaggacagaugccugcugcagcuggccaugacccaccccagccaccaccugaacuucggcaugaaccccgaccacgccagaaacagccugagcaacugcggcaucagacagcccaaguacggcgacagaaaggugcaccacaugcacaugagaaagaagggcaucaacacccugaucaacaucaugagcagacugggccaggacgaccccacccccagcagaaucaaccacaacgagagacuggaguuccugggcgacgccgugguggaguuccugaccagcgugcaccuguacuaccuguuccccagccuggaggagggcggccuggccaccuacagaaccgccaucgugcagaaccagcaccuggccaugcuggccaagaagcuggagcuggacagauucaugcuguacgcccacggccccgaccugugcagagagagcgaccugagacacgccauggccaacugcuucgaggcccugaucggcgccguguaccuggagggcagccuggaggaggccaagcagcuguucggcagacugcuguucaacgaccccgaccugagagagguguggcugaacuacccccugcacccccugcagcugcaggagcccaacaccgacagacagcugaucgagaccagccccgugcugcagaagcugaccgaguucgaggaggccaucggcgugaucuucacccacgugagacugcuggccagagccuucacccugagaaccgugggcuucaaccaccugacccugggccacaaccagagaauggaguuccugggcgacagcaucaugcagcugguggccaccgaguaccuguucauccacuuccccgaccaccacgagggccaccugacccugcugagaagcagccuggugaacaacagaacccaggccaagguggccgaggagcugggcaugcaggaguacgccaucaccaacgacaagaccaagagacccguggcccugagaaccaagacccuggccgaccugcuggagagcuucaucgccgcccuguacaucgacaaggaccuggaguacgugcacaccuucaugaacgugugcuucuuccccagacugaaggaguucauccugaaccaggacuggaacgaccccaagagccagcugcagcagugcugccugacccugagaaccgagggcaaggagcccgacaucccccuguacaagacccugcagaccgugggccccagccacgccagaaccuacaccguggccguguacuucaagggcgagagaaucggcugcggcaagggccccagcauccagcaggccgagaugggcgccgccauggacgcccuggagaaguacaacuucccccagauggcccaccagaagagauucaucgagagaaaguacagacaggagcugaaggagaugagaugggagagagagcaccaggagagagagcccgacgagaccgaggacaucaagaaguaa

SEQ ID NO: 16325 - RNA, 2640 nt, Artificial Sequence
  DRP2__Homo_sapiens__NP_001164655
augaaccugugcuggaacgagaucaagaagaagagccacaaccugagagccagacuggaggccuucagcgaccacagcggcaagcugcagcugccccugcaggagaucaucgacuggcugagccagaaggacgaggagcugagcgcccagcugccccugcagggcgacguggcccuggugcagcaggagaaggagacccacgccgccuucauggaggaggugaagagcagaggccccuacaucuacagcgugcuggagagcgcccaggccuuccugagccagcaccccuucgaggagcuggaggagccccacagcgagagcaaggacaccagccccaagcagagaauccagaaccugagcagauucguguggaagcaggccaccguggccagcgagcugugggagaagcugaccgccagaugcguggaccagcacagacacaucgagagaacccuggagcagcugcuggagauccagggcgccauggaggagcugagcaccacccugagccaggccgagggcgugagagccaccugggagcccaucggcgaccuguucaucgacagccugcccgagcacauccaggccaucaagcuguucaaggaggaguucagccccaugaaggacggcgugaagcuggugaacgaccuggcccaccagcuggccaucagcgacgugcaccugagcauggagaacagccaggcccuggagcagaucaacgugagauggaagcagcugcaggccagcgugagcgagagacugaagcagcugcaggacgcccacagagacuucggccccggcagccagcacuuccugagcagcagcgugcaggugcccugggagagagccaucagccccaacaaggugcccuacuacaucaaccaccaggcccagaccaccugcugggaccaccccaagaugaccgagcuguaccagacccuggccgaccugaacaacaucaaguucagcgccuacagaaccgccaugaagcugagaagagugcagaaggcccugagacuggaccuggugacccugaccaccgcccuggagaucuucaacgagcacgaccugcaggccagcgagcacgugauggacgugguggaggugauccacugccugaccgcccuguacgagagacuggaggaggagagaggcauccuggugaacgugccccugugcguggacaugagccugaacuggcugcugaacguguucgacagcggcagaagcggcaagaugagagcccugagcuucaagaccggcaucgccugccugugcggcaccgaggugaaggagaagcugcaguaccuguucagccagguggccaacagcggcagccagugcgaccagagacaccugggcgugcugcugcacgaggccauccaggugcccagacagcugggcgagguggccgccuucggcggcagcaacguggagcccagcgugagaagcugcuucagauucagcaccggcaagcccgugaucgaggccagccaguuccuggagugggugaaccuggagccccagagcaugguguggcuggccgugcugcacagagugaccaucgccgagcaggugaagcaccagaccaagugcagcaucugcagacagugccccaucaagggcuucagauacagaagccugaagcaguucaacguggacaucugccagaccugcuuccugaccggcagagccagcaagggcaacaagcugcacuaccccaucauggaguacuacacccccaccaccagcagcgagaacaugagagacuucgccaccacccugaagaacaaguucagaagcaagcacuacuucagcaagcacccccagagaggcuaccugcccgugcagagcgugcuggaggccgacuacagcgagacccccgccagcagccccauguggccccacgccgacacccacagcagaaucgagcacuucgccagcagacuggccgagauggagagccagaacugcagcuucuucaacgacagccugagccccgacgacagcaucgacgaggaccaguaccugcugagacacagcagccccaucaccgacagagagcccgccuucggccagcaggcccccugcagcguggccaccgagagcaagggcgagcugcagaagauccuggcccaccuggaggacgagaacagaauccugcagggcgagcugagaagacugaaguggcagcacgaggaggccgccgaggcccccagccuggccgacggcagcaccgaggccgccaccgaccacagaaacgaggagcugcuggccgaggccagaauccugagacagcacaagagcagacuggagaccagaaugcagauccuggaggaccacaacaagcagcuggagagccagcugcagagacugagagagcugcugcugcagccccccaccgagagcgacggcagcggcagcgccggcagcagccuggccagcagcccccagcagagcgagggcagccaccccagagagaagggccagaccacccccgacaccgaggccgccgacgacgugggcagcaagagccaggacgugagccugugccuggaggacaucauggagaagcugagacacgccuuccccagcgugagaagcagcgacgugaccgccaacacccugcuggccagcuaa

SEQ ID NO: 16326 - RNA, 2523 nt, Artificial Sequence
  DSC1__Homo_sapiens__NP_004939
auggcccuggccagcgccgcccccggcagcaucuucugcaagcagcugcuguucagccugcuggugcugacccugcugugcgacgccugccagaagguguaccugagagugcccagccaccugcaggccgagacccuggugggcaaggugaaccuggaggagugccugaagagcgccagccugaucagaagcagcgaccccgccuucagaauccuggaggacggcagcaucuacaccacccacgaccugauccugagcagcgagagaaagagcuucagcaucuuccugagcgacggccagagaagagagcagcaggagaucaagguggugcugagcgccagagagaacaagagccccaagaagagacacaccaaggacaccgcccugaagagaagcaagagaagaugggcccccauccccgccagccugauggagaacagccugggccccuucccccagcacgugcagcagauccagagcgacgccgcccagaacuacaccaucuucuacagcaucagcggccccggcguggacaaggagcccuucaaccuguucuacaucgagaaggacaccggcgacaucuucugcaccagaagcaucgacagagagaaguacgagcaguucgcccuguacggcuacgccaccaccgccgacggcuacgcccccgaguacccccugccccugaucaucaagaucgaggacgacaacgacaacgcccccuacuucgagcacagagugaccaucuucaccgugcccgagaacugcagaagcggcaccagcgugggcaaggugaccgccaccgaccuggacgagcccgacacccugcacaccagacugaaguacaagauccugcagcagauccccgaccaccccaagcacuucagcauccaccccgacaccggcgugaucaccaccaccacccccuuccuggacagagagaagugcgacaccuaccagcugaucauggaggugagagacaugggcggccagcccuucggccuguucaacaccggcaccaucaccaucagccuggaggacgagaacgacaacccccccagcuucaccgagaccagcuacgugaccgagguggaggagaacagaaucgacguggagauccugagaaugaaggugcaggaccaggaccugcccaacaccccccacagcaaggccguguacaagauccugcagggcaacgagaacggcaacuucaucaucagcaccgaccccaacaccaacgagggcgugcugugcguggugaagccccugaacuacgaggugaacagacaggugauccugcaggugggcgugaucaacgaggcccaguucagcaaggccgccagcagccagacccccaccaugugcaccaccaccgugaccgugaagaucaucgacagcgacgagggccccgagugccacccccccgugaaggugauccagagccaggacggcuuccccgccggccaggagcugcugggcuacaaggcccuggaccccgagaucagcagcggcgagggccugagauaccagaagcugggcgacgaggacaacugguucgagaucaaccagcacaccggcgaccugagaacccugaaggugcuggacagagagagcaaguucgugaagaacaaccaguacaacaucagcgugguggccguggacgccgugggcagaagcugcaccggcacccugguggugcaccuggacgacuacaacgaccacgccccccagaucgacaaggaggugaccaucugccagaacaacgaggacuucgccgugcugaagcccguggaccccgacggccccgagaacggcccccccuuccaguucuuccuggacaacagcgccagcaagaacuggaacaucgaggagaaggacggcaagaccgccauccugagacagagacagaaccuggacuacaacuacuacagcgugcccauccagaucaaggacagacacggccugguggccacccacaugcugaccgugagagugugcgacugcagcacccccagcgagugcagaaugaaggacaagagcaccagagacgugagacccaacgugauccugggcagaugggccauccuggccauggugcugggcagcgugcugcugcugugcauccuguucaccugcuucugcgugaccgccaagagaaccgugaagaagugcuuccccgaggacaucgcccagcagaaccugaucgugagcaacaccgagggccccggcgaggaggugaccgaggccaacaucagacugcccaugcagaccagcaacaucugcgacaccagcaugagcgugggcaccgugggcggccagggcaucaagacccagcagagcuucgagauggugaagggcggcuacacccuggacagcaacaagggcggcggccaccagacccuggagagcgugaagggcgugggccagggcgacaccggcagauacgccuacaccgacuggcagagcuucacccagcccagacugggcgaggagagcaucagaggccacacccugaucaagaacuaa

SEQ ID NO: 16327 - RNA, 2544 nt, Artificial Sequence
  DSC2__Homo_sapiens__NP_004940
auggaggccgccagacccagcggcagcuggaacggcgcccugugcagacugcugcugcugacccuggccauccugaucuucgccagcgacgccugcaagaacgugacccugcacgugcccagcaagcuggacgccgagaagcuggugggcagagugaaccugaaggagugcuucaccgccgccaaccugauccacagcagcgaccccgacuuccagauccuggaggacggcagcguguacaccaccaacaccauccugcugagcagcgagaagagaagcuucaccauccugcugagcaacaccgagaaccaggagaagaagaagaucuucguguuccuggagcaccagaccaaggugcugaagaagagacacaccaaggagaaggugcugagaagagccaagagaagaugggcccccauccccugcagcaugcuggagaacagccugggccccuucccccuguuccugcagcaggugcagagcgacaccgcccagaacuacaccaucuacuacagcaucagaggccccggcguggaccaggagcccagaaaccuguucuacguggagagagacaccggcaaccuguacugcaccagacccguggacagagagcaguacgagagcuucgagaucaucgccuucgccaccacccccgacggcuacacccccgagcugccccugccccugaucaucaagaucgaggacgagaacgacaacuaccccaucuucaccgaggagaccuacaccuucaccaucuucgagaacugcagagugggcaccaccgugggccaggugugcgccaccgacaaggacgagcccgacaccaugcacaccagacugaaguacagcaucaucggccaggugccccccagccccacccuguucagcaugcaccccaccaccggcgugaucaccaccaccagcagccagcuggacagagagcugaucgacaaguaccagcugaagaucaaggugcaggacauggacggccaguacuucggccugcagaccaccagcaccugcaucaucaacaucgacgacgugaacgaccaccugcccaccuucaccagaaccagcuacgugaccagcguggaggagaacaccguggacguggagauccugagagugaccguggaggacaaggaccuggugaacaccgccaacuggagagccaacuacaccauccugaagggcaacgagaacggcaacuucaagaucgugaccgacgccaagaccaacgagggcgugcugugcguggugaagccccugaacuacgaggagaagcagcagaugauccugcagaucggcguggugaacgaggcccccuucagcagagaggccagccccagaagcgccaugagcaccgccaccgugaccgugaacguggaggaccaggacgagggccccgagugcaacccccccauccagaccgugagaaugaaggagaacgccgaggugggcaccaccagcaacggcuacaaggccuacgaccccgagaccagaagcagcagcggcaucagauacaagaagcugaccgaccccaccggcugggugaccaucgacgagaacaccggcagcaucaagguguucagaagccuggacagagaggccgagaccaucaagaacggcaucuacaacaucaccgugcuggccagcgaccagggcggcagaaccugcaccggcacccugggcaucauccugcaggacgugaacgacaacagccccuucauccccaagaagaccgugaucaucugcaagcccaccaugagcagcgccgagaucguggccguggaccccgacgagcccauccacggcccccccuucgacuucagccuggagagcagcaccagcgaggugcagagaauguggagacugaaggccaucaacgacaccgccgccagacugagcuaccagaacgacccccccuucggcagcuacguggugcccaucaccgugagagacagacugggcaugagcagcgugaccagccuggacgugacccugugcgacugcaucaccgagaacgacugcacccacagaguggaccccagaaucggcggcggcggcgugcagcugggcaagugggccauccuggccauccugcugggcaucgcccugcuguucugcauccuguucacccuggugugcggcgccagcggcaccagcaagcagcccaaggugauccccgacgaccuggcccagcagaaccugaucgugagcaacaccgaggcccccggcgacgacaagguguacagcgccaacggcuucaccacccagaccgugggcgccagcgcccagggcgugugcggcaccgugggcagcggcaucaagaacggcggccaggagaccaucgagauggugaagggcggccaccagaccagcgagagcugcagaggcgccggccaccaccacacccuggacagcugcagaggcggccacaccgagguggacaacugcagauacaccuacagcgaguggcacagcuucacccagcccagacugggcgaggagagcaucagaggccacacccugaucaagaacuaa

SEQ ID NO: 16328 - RNA, 2691 nt, Artificial Sequence
  DSC3__Homo_sapiens__NP_001932
auggccgccgccggccccagaagaagcgugagaggcgccgugugccugcaccugcugcugacccuggugaucuucagcagagccggcgaggccugcaagaaggugauccugaacgugcccagcaagcuggaggccgacaagaucaucggcagagugaaccuggaggagugcuucagaagcgccgaccugaucagaagcagcgaccccgacuucagagugcugaacgacggcagcguguacaccgccagagccguggcccugagcgacaagaagagaagcuucaccaucuggcugagcgacaagagaaagcagacccagaaggaggugaccgugcugcuggagcaccagaagaaggugagcaagaccagacacaccagagagaccgugcugagaagagccaagagaagaugggcccccauccccugcagcaugcaggagaacagccugggccccuucccccuguuccugcagcagguggagagcgacgccgcccagaacuacaccguguucuacagcaucagcggcagaggcguggacaaggagccccugaaccuguucuacaucgagagagacaccggcaaccuguucugcaccagacccguggacagagaggaguacgacguguucgaccugaucgccuacgccagcaccgccgacggcuacagcgccgaccugccccugccccugcccaucagaguggaggacgagaacgacaaccaccccguguucaccgaggccaucuacaacuucgaggugcuggagagcagcagacccggcaccaccgugggcguggugugcgccaccgacagagacgagcccgacaccaugcacaccagacugaaguacagcauccugcagcagacccccagaagccccggccuguucagcgugcaccccagcaccggcgugaucaccaccgugagccacuaccuggacagagaggugguggacaaguacagccugaucaugaaggugcaggacauggacggccaguucuucggccugaucggcaccagcaccugcaucaucaccgugaccgacagcaacgacaacgcccccaccuucagacagaacgccuacgaggccuucguggaggagaacgccuucaacguggagauccugagaauccccaucgaggacaaggaccugaucaacaccgccaacuggagagugaacuucaccauccugaagggcaacgagaacggccacuucaagaucagcaccgacaaggagaccaacgagggcgugcugagcguggugaagccccugaacuacgaggagaacagacaggugaaccuggagaucggcgugaacaacgaggcccccuucgccagagacauccccagagugaccgcccugaacagagcccuggugaccgugcacgugagagaccuggacgagggccccgagugcacccccgccgcccaguacgugagaaucaaggagaaccuggccgugggcagcaagaucaacggcuacaaggccuacgaccccgagaacagaaacggcaacggccugagauacaagaagcugcacgaccccaagggcuggaucaccaucgacgagaucagcggcagcaucaucaccagcaagauccuggacagagagguggagacccccaagaacgagcuguacaacaucaccgugcuggccaucgacaaggacgacagaagcugcaccggcacccuggccgugaacaucgaggacgugaacgacaacccccccgagauccugcaggaguacguggugaucugcaagcccaagaugggcuacaccgacauccuggccguggaccccgacgagcccgugcacggcgcccccuucuacuucagccugcccaacaccagccccgagaucagcagacuguggagccugaccaaggugaacgacaccgccgccagacugagcuaccagaagaacgccggcuuccaggaguacaccauccccaucaccgugaaggacagagccggccaggccgccaccaagcugcugagagugaaccugugcgagugcacccaccccacccagugcagagccaccagcagaagcaccggcgugauccugggcaagugggccauccuggccauccugcugggcaucgcccugcuguucagcgugcugcugacccuggugugcggcguguucggcgccaccaagggcaagagauuccccgaggaccuggcccagcagaaccugaucaucagcaacaccgaggcccccggcgacgacagagugugcagcgccaacggcuucaugacccagaccaccaacaacagcagccagggcuucugcggcaccaugggcagcggcaugaagaacggcggccaggagaccaucgagaugaugaagggcggcaaccagacccuggagagcugcagaggcgccggccaccaccacacccuggacagcugcagaggcggccacaccgagguggacaacugcagauacaccuacagcgaguggcacagcuucacccagcccagacugggcgagaagcugcacagaugcaaccagaacgaggacagaaugcccagccaggacuacgugcugaccuacaacuacgagggcagaggcagccccgccggcagcgugggcugcugcagcgagaagcaggaggaggacggccuggacuuccugaacaaccuggagcccaaguucaucacccuggccgaggccugcaccaagagauaa

SEQ ID NO: 16329 - RNA, 6039 nt, Artificial Sequence
  DSCAM__Homo_sapiens__NP_001380
auguggauccuggcccugagccuguuccagagcuucgccaacguguucagcgaggaccugcacagcagccuguacuucgugaacgccagccugcaggaggugguguucgccagcaccaccggcacccuggugcccugccccgccgccggcaucccccccgugacccugagaugguaccuggccaccggcgaggagaucuacgacgugcccggcaucagacacgugcaccccaacggcacccugcagaucuuccccuucccccccagcagcuucagcacccugauccacgacaacaccuacuacugcaccgccgagaaccccagcggcaagaucagaagccaggacgugcacaucaaggccgugcugagagagcccuacaccgugagaguggaggaccagaagaccaugagaggcaacguggccguguucaagugcaucauccccagcagcguggaggccuacaucaccguggugagcugggagaaggacaccgugagccuggugagcggcagcagauuccugaucaccagcaccggcgcccuguacaucaaggacgugcagaacgaggacggccuguacaacuacagaugcaucaccagacacagauacaccggcgagaccagacagagcaacagcgccagacuguucgugagcgaccccgccaacagcgcccccagcauccuggacggcuucgaccacagaaaggccauggccggccagagaguggagcugcccugcaaggcccugggccaccccgagcccgacuacagauggcugaaggacaacaugccccuggagcugagcggcagauuccagaagaccgugaccggccugcugaucgagaacaucagacccagcgacagcggcagcuacgugugcgaggugagcaacagauacggcaccgccaaggugaucggcagacuguacgugaagcagccccugaaggccaccaucagccccagaaaggugaagagcagcgugggcagccaggugagccugagcugcagcgugaccggcaccgaggaccaggagcugagcugguacagaaacggcgagauccugaaccccggcaagaacgugagaaucaccggcaucaaccacgagaaccugaucauggaccacauggugaagagcgacggcggcgccuaccagugcuucgugagaaaggacaagcugagcgcccaggacuacgugcagguggugcuggaggacggcacccccaagaucaucagcgccuucagcgagaagguggugagccccgccgagcccgugagccugaugugcaacgugaagggcaccccccugcccaccaucaccuggacccuggacgacgaccccauccugaagggcggcagccacagaaucagccagaugaucaccagcgagggcaacguggugagcuaccugaacaucagcagcagccaggugagagacggcggcguguacagaugcaccgccaacaacagcgccggcguggugcuguaccaggccagaaucaacgugagaggccccgccagcaucagacccaugaagaacaucaccgccaucgccggcagagacaccuacauccacugcagagugaucggcuaccccuacuacagcaucaagugguacaagaacagcaaccugcugcccuucaaccacagacagguggccuucgagaacaacggcacccugaagcugagcgacgugcagaaggagguggacgagggcgaguacaccugcaacgugcuggugcagccccagcugagcaccagccagagcgugcacgugaccgugaaggugccccccuucauccagcccuucgaguuccccagauucagcaucggccagagaguguucauccccugcgugguggugagcggcgaccugcccaucaccaucaccuggcagaaggacggcagacccauccccggcagccugggcgugaccaucgacaacaucgacuucaccagcagccugagaaucagcaaccugagccugaugcacaacggcaacuacaccugcaucgccagaaacgaggccgccgccguggagcaccagagccagcugaucgugagagugccccccaaguucguggugcagcccagagaccaggacggcaucuacggcaaggccgugauccugaacugcagcgccgagggcuaccccgugcccaccaucguguggaaguucagcaagggcgccggcgugccccaguuccagcccaucgcccugaacggcagaauccaggugcugagcaacggcagccugcugaucaagcacgugguggaggaggacagcggcuacuaccugugcaaggugagcaacgacgugggcgccgacgugagcaagagcauguaccugaccgugaagauccccgccaugaucaccagcuaccccaacaccacccuggccacccagggccagaagaaggagaugagcugcaccgcccacggcgagaagcccaucaucgugagaugggagaaggaggacagaaucaucaaccccgagauggccagauaccuggugagcaccaaggaggugggcgaggaggugaucagcacccugcagauccugcccaccgugagagaggacagcggcuucuucagcugccacgccaucaacagcuacggcgaggacagaggcaucauccagcugaccgugcaggagccccccgacccccccgagaucgagaucaaggacgugaaggccagaaccaucacccugagauggaccaugggcuucgacggcaacagccccaucaccggcuacgacaucgagugcaagaacaagagcgacagcugggacagcgcccagagaaccaaggacgugagcccccagcugaacagcgccaccaucaucgacauccaccccagcagcaccuacagcaucagaauguacgccaagaacagaaucggcaagagcgagcccagcaacgagcugaccaucaccgccgacgaggccgcccccgacggccccccccaggaggugcaccuggagcccaucagcagccagagcaucagagugaccuggaaggcccccaagaagcaccugcagaacggcaucaucagaggcuaccagaucggcuacagagaguacagcaccggcggcaacuuccaguucaacaucaucagcguggacaccagcggcgacagcgagguguacacccuggacaaccugaacaaguucacccaguacggccugguggugcaggccugcaacagagccggcaccggccccagcagccaggagaucaucaccaccacccuggaggacgugcccagcuacccccccgagaacgugcaggccaucgccaccagccccgagagcaucagcaucagcuggagcacccugagcaaggaggcccugaacggcauccugcagggcuucagagugaucuacugggccaaccugauggacggcgagcugggcgagaucaagaacaucaccaccacccagcccagccuggagcuggacggccuggagaaguacaccaacuacagcauccaggugcuggccuucaccagagccggcgacggcgugagaagcgagcagaucuucaccagaaccaaggaggacgugcccggcccccccgccggcgugaaggccgccgccgccagcgccagcaugguguucgugagcuggcugcccccccugaagcugaacggcaucaucagaaaguacaccguguucugcagccaccccuaccccaccgugaucagcgaguucgaggccagccccgacagcuucagcuacagaauccccaaccugagcagaaacagacaguacagcgugugggugguggccgugaccagcgccggcagaggcaacagcagcgagaucaucaccguggagccccuggccaaggcccccgccagaauccugaccuucagcggcaccgugaccacccccuggaugaaggacaucgugcugcccugcaaggccgugggcgaccccagccccgccgugaaguggaugaaggacagcaacggcacccccagccuggugaccaucgacggcagaagaagcaucuucagcaacggcagcuucaucaucagaaccgugaaggccgaggacagcggcuacuacagcugcaucgccaacaacaacuggggcagcgacgagaucauccugaaccugcaggugcaggugccccccgaccagcccagacugaccgugagcaagaccaccagcagcagcaucacccugagcuggcugcccggcgacaacggcggcagcagcaucagaggcuacauccugcaguacagcgaggacaacagcgagcaguggggcagcuuccccaucagccccagcgagagaagcuacagacuggagaaccugaagugcggcaccugguacaaguucacccugaccgcccagaacggcgugggccccggcagaaucagcgagaucaucgaggccaagacccugggcaaggagccccaguucagcaaggagcaggagcuguucgccagcaucaacaccaccagagugagacugaaccugaucggcuggaacgacggcggcugccccaucaccagcuucacccuggaguacagacccuucggcaccaccguguggaccaccgcccagagaaccagccugagcaagagcuacauccuguacgaccugcaggaggccaccugguacgagcugcagaugagagugugcaacagcgccggcugcgccgagaagcaggccaacuucgccacccugaacuacgacggcagcaccauccccccccugaucaagagcguggugcagaacgaggagggccugaccaccaacgagggccugaagaugcuggugaccaucagcugcauccuggugggcgugcugcugcuguucgugcugcugcugguggugagaagaagaagaagagagcagagacugaagagacugagagacgccaagagccuggccgagaugcugaugagcaagaacaccagaaccagcgacacccugagcaagcagcagcagacccugagaaugcacaucgacauccccagagcccagcugcugaucgaggagagagacaccauggagaccaucgacgacagaagcaccgugcugcugaccgacgccgacuucggcgaggccgccaagcagaagagccugaccgugacccacaccgugcacuaccagagcgugagccaggccaccggcccccugguggacgugagcgacgccagacccggcaccaaccccaccaccagaagaaacgccaaggccggccccaccgccagaaacagauacgccagccaguggacccugaacagaccccaccccaccaucagcgcccacacccugaccaccgacuggagacugcccacccccagagccgccggcagcguggacaaggagagcgacagcuacagcgugagccccagccaggacaccgacagagccagaagcagcauggugagcaccgagagcgccagcagcaccuacgaggagcuggccagagccuacgagcacgccaagauggaggagcagcugagacacgccaaguucaccaucaccgagugcuucaucagcgacaccagcagcgagcagcugaccgccggcaccaacgaguacaccgacagccugaccagcagcacccccagcgagagcggcaucugcagauucaccgccagcccccccaagccccaggacggcggcagagugaugaacauggccgugcccaaggcccacagacccggcgaccugauccaccugccccccuaccugagaauggacuuccugcugaacagaggcggccccggcaccagcagagaccugagccugggccaggccugccuggagccccagaagagcagaacccugaagagacccaccgugcuggagcccauccccauggaggccgccagcagcgccagcagcaccagagagggccagagcuggcagcccggcgccguggccacccugccccagagagagggcgccgagcugggccaggccgccaagaugagcagcagccaggagagccugcuggacagcagaggccaccugaagggcaacaaccccuacgccaagagcuacacccugguguaa
